US011293064B2

(12) United States Patent
Rigoutsos et al.

(10) Patent No.: US 11,293,064 B2
(45) Date of Patent: Apr. 5, 2022

(54) HUMAN MIRNAS FOR USE IN DIAGNOSIS, PROGNOSIS, AND THERAPY OF HUMAN CONDITIONS AND DISEASES

(71) Applicant: Thomas Jefferson University, Philadelphia, PA (US)

(72) Inventors: Isidore Rigoutsos, Astoria, NY (US); Phillipe Loher, Philadelphia, PA (US); Eric Londin, Philadelphia, PA (US)

(73) Assignee: Thomas Jefferson University, Philadelphia, PA (US)

( * ) Notice: Subject to any disclaimer, the term of this patent is extended or adjusted under 35 U.S.C. 154(b) by 150 days.

(21) Appl. No.: 14/888,637

(22) PCT Filed: May 2, 2014

(86) PCT No.: PCT/US2014/036690
§ 371 (c)(1),
(2) Date: Nov. 2, 2015

(87) PCT Pub. No.: WO2014/179765
PCT Pub. Date: Nov. 6, 2014

(65) Prior Publication Data
US 2017/0009295 A1 Jan. 12, 2017

Related U.S. Application Data

(60) Provisional application No. 61/818,777, filed on May 2, 2013, provisional application No. 61/870,898, filed on Aug. 28, 2013, provisional application No. 61/901,989, filed on Nov. 8, 2013.

(51) Int. Cl.
*C12Q 1/6883* (2018.01)
*C12Q 1/6886* (2018.01)

(52) U.S. Cl.
CPC ......... *C12Q 1/6883* (2013.01); *C12Q 1/6886* (2013.01); *C12Q 2600/118* (2013.01); *C12Q 2600/158* (2013.01); *C12Q 2600/178* (2013.01)

(58) Field of Classification Search
None
See application file for complete search history.

(56) References Cited

U.S. PATENT DOCUMENTS

| | | |
|---|---|---|
| 3,270,960 A | 9/1966 | Phillips |
| 3,773,919 A | 11/1973 | Boswell et al. |
| 7,625,699 B2 | 12/2009 | Devlin et al. |
| 8,574,838 B2 | 11/2013 | Zhang et al. |
| 2003/0194711 A1 | 10/2003 | Zapala et al. |
| 2007/0092882 A1* | 4/2007 | Wang ............ C12Q 1/6837 435/6.11 |
| 2011/0312520 A1 | 12/2011 | Kennedy et al. |
| 2013/0317083 A1* | 11/2013 | Rigoutsos ............ C12Q 1/6886 514/44 A |
| 2014/0213476 A1* | 7/2014 | Keller .................. C12Q 1/6886 506/9 |

FOREIGN PATENT DOCUMENTS

WO WO 2012/106586 8/2012

OTHER PUBLICATIONS

Landgraf, et al. (2007,Cell, v.129, No. 7: 1401-1414). (Year: 2007).*
MiRBase Accession No. MIMAT0000703 [online], [retrieved on Feb. 7, 2018]. Retrieved from the Internet: <http://www.mirbase.org/cgi-bin/mature.pl?mature_acc=MIMAT0000703>. (Year: 2007).*
MiRBase Accession No. MIMAT0001340 [online], [retrieved on Feb. 7, 2018]. Retrieved from the Internet: <http://www.mirbase.org/cgi-bin/mirna_entry.pl?acc=MIMAT0001340>. (Year: 2007).*
GEO accession No. GPL4867 [online], [retrieved on Feb. 7, 2018]. Retrieved from the Internet <https://www.ncbi.nlm.nih.gov/geo/query/acc.cgi?view=data&acc=GPL4867&id=39081&db=GeoDb_blob10>. (Year: 2007).*
MiRBase Accession No. MIMAT0000067 [online], [retrieved on Jan. 2, 2019], Retrieved from the Internet <http://www.mirbase.org/cgi-bin/mirna_entry.pl?acc=MIMAT0000067>. (Year: 2007).*
Motameny, et al. "Next Generation Sequencing of miRNAs—Strategies, Resources and Methods." Genes (2010) 1, 70-84. (Year: 2010).*
Hamfjord, et al. "Differential Expression of miRNAs in Colorectal Cancer: Comparison of Paired Tumor Tissue and Adjacent Normal Mucosa Using High-Throughput Sequencing." PLoS ONE (2012) 7(4): e34150. (Year: 2012).*
Guo, et al. "Global Expression Analysis of miRNA Gene Cluster and Family Based on isomiRs from Deep Sequencing Data." Computational Biology and Chemistry (2010) 34(3): 165-171. (Year: 2010).*
Bioconductor [online], [retrieved on Feb. 13, 2020], Retrieved from the Internet: <http://www.bioconductor.org/packages/release/bioc/html/DESeq2.html>. (Year: 2020).*
Abelson, J.F., et al., "Sequence variants in SLITRK1 are associated with Tourette's syndrome." Science, 2005. 310(5746): p. 317-320.
Allawi H. T. et al. "Quantitation of microRNAs using a modified Invader assay" RNA (2004) 10: 1153-1161.
Ambros, V., "A hierarchy of regulatory genes controls a larva-to-adult developmental switch in C. elegans." Cell, 1989. 57(1): p. 49-57.

(Continued)

*Primary Examiner* — Tracy Vivlemore
(74) *Attorney, Agent, or Firm* — Saul Ewing Arnstein & Lehr LLP; Kathryn Doyle; Justin Crotty

(57) ABSTRACT

Disclosed herein are novel compositions, methods, and systems for determining whether a subject has, or is at risk of developing, or is at a given stage of a condition afflicting a tissue of interest, or determining the tissue or cell provenance of a biological sample, based on expression level of one or more of the novel miRNA and isomiR sequences disclosed herein. The compositions, methods, and systems described herein can be used to diagnose a disease or disorder, or prognose a given stage and/or progression of the disease or disorder, or determine the identity of the tissue or cell in a sample. In some embodiments, the compositions, methods, and systems described herein can be used to develop a treatment for the disease or disorder. For example, in some embodiments, the novel miRNAs can be used as therapeutics for treatment of a disease or disorder.

3 Claims, 7 Drawing Sheets

Specification includes a Sequence Listing.

(56) References Cited

OTHER PUBLICATIONS

Ameres SL, Zamore PD. "Diversifying microRNA sequence and function." Nat Rev Mol Cell Biol (2013)14:475-488.
Arruda, M. et al. "Invader technology for DNA and RNA analysis: Principles and applications" Expert Rev. Mol. Diagn (2002) 2: 487-496.
Baek, D., et al., "The impact of microRNAs on protein output." Nature, 2008. 455(7209): p. 64-71.
Bartel, D.P., "MicroRNAs: genomics, biogenesis, mechanism, and function." Cell, 2004. 116(2): p. 281-297.
Bartel, D.P. "MicroRNAs: target recognition and regulatory functions." Cell, 2009. 136(2): p. 215-33.
Brennecke, J. and S.M. Cohen, "Towards a complete description of the microRNA complement of animal genomes." Genome Biol, 2003. 4(9): p. 228.
Brenner, S. et al. "Gene expression analysis by massively parallel signature sequencing (MPSS) on microbead arrays" Nature Biotechnology (2000) 18: 630-634.
Brodersen, P. and O. Voinnet, "Revisiting the principles of microRNA target recognition and mode of action." Nat Rev Mol Cell Biol, 2009. 10(2): p. 141-8.
Calin, G.A. and C.M. Croce, "Chronic lymphocytic leukemia: interplay between non-coding RNAs and protein-coding genes." Blood, 2009. 114(23): p. 4761-4770.
Calin, G.A. and C.M. Croce, "MicroRNA-cancer connection: the beginning of a new tale." Cancer Research, 2006. 66(15): p. 7390-7394.
Calin, G.A., et al., "Frequent deletions and down-regulation of micro-RNA genes miR15 and miR16 at 13q14 in chronic lymphocytic leukemia." Proc Natl Acad Sci U S A, 2002. 99(24): p. 15524-9.
Chang, S., et al., "MicroRNAs act sequentially and asymmetrically to control chemosensory laterality in the nematode." Nature, 2004. 430(7001): p. 785-9.
Chi, S.W., et al., "Argonaute HITS-CLIP decodes microRNA-mRNA interaction maps." Nature, 2009. 460(7254): p. 479-86.
Chi, S.W., G.J. Hannon, and R.B. Darnell, "An alternative mode of microRNA target recognition." Nat Struct Mol Biol, 2012. 19(3): p. 321-7.
Didiano, D. and O. Hobert, "Molecular architecture of a miRNA-regulated 3' UTR." RNA, 2008. 14(7): p. 1297-1317.
Didiano, D. and O. Hobert, "Perfect seed pairing is not a generally reliable predictor for miRNA-target interactions." Nat Struct Mol Biol, 2006. 13(9): p. 849-51.
Easow, G., A.A. Teleman, and S.M. Cohen, "Isolation of microRNA targets by miRNP immunopurification." RNA, 2007. 13(8): p. 1198-204.
Ebert and Shape. "MicroRNA sponges: Progress and possibilities" RNA (2010) 16:2043-2050.
Ebert et al. "MicroRNA sponges: Competitive inhibitors of small RNAs in mammalian cells" Nat. Methods (2007) 4: 721-726.
Eis, P.S. et al. "An invasive cleavage assay for direct quantitation of specific RNAs" Nat. Biotechnol. (2001)19: 673-676.
Esquela-Kerscher, A. and F.J. Slack, "Oncomirs—microRNAs with a role in cancer." Nature Reviews Cancer, 2006. 6(4): p. 259-269.
Fabian, M.R., N. Sonenberg, and W. Filipowicz, "Regulation of mRNA translation and stability by microRNAs." Annu Rev Biochem, 2010. 79: p. 351-79.
Farh, K.K., et al., "The widespread impact of mammalian MicroRNAs on mRNA repression and evolution". Science, 2005. 310(5755): p. 1817-21.
Friedländer, M.R., et al., "Discovering microRNAs from deep sequencing data using miRDeep." Nature Biotechnology, 2008, 26, 407-415.
Godshalk, S.E., et al., "A Variant in a MicroRNA complementary site in the 3' UTR of the KIT oncogene increases risk of acral melanoma." Oncogene, 2011, 30: 1542-50.
Griffiths-Jones, S., "miRBase: microRNA sequences, targets and gene nomenclature." Nucleic Acids Research, 2006. 34(90001): p. D140-D144.
Ha, I., B. Wightman, and G. Ruvkun, "A bulged lin-4/lin-14 RNA duplex is sufficient for Caenorhabditis elegans lin-14 temporal gradient formation." Genes Dev, 1996. 10(23): p. 3041-50.
Hafner, M., et al., "Transcriptome-wide identification of RNA-binding protein and microRNA target sites by PAR-CLIP." Cell, 2010. 141(1): p. 129-41.
Hammond, S.M. "MicroRNAs as tumor suppressors" Nature Genetics. 2007(39): p. 582-583.
Hebert, S.S. and B. De Strooper, "Alterations of the microRNA network cause neurodegenerative disease." Trends Neurosci, 2009. 32(4): p. 199-206.
Ibanez-Ventoso, C. and M. Driscoll, "MicroRNAs in C. elegans Aging: Molecular Insurance for Robustness?" Curr Genomics, 2009. 10(3): p. 144-53.
Johnston, R.J. and O. Hobert, "A microRNA controlling left/right neuronal asymmetry in Caenorhabditis elegans." Nature, 2003. 426(6968): p. 845-9.
Kodzius R. et al. "CAGE: cap analysis of gene expression" Nature Methods (2006) 3: 211-222.
Lagos Quintana et al, "Identification of Novel Genes Coding for Small Expressed RNAs" Science 294, 853-857 (2001).
Lagos-Quintana et al, "Identification of Tissue-Specific MicroRNAs from Mouse." Current Biology, 12, 735-739 (2002).
Lagos-Quintana et al, "New microRNAs from mouse and human" RNA, 9, 175-179 (2003).
Lal, A., et al., miR-24 Inhibits cell proliferation by targeting E2F2, MYC, and other cell-cycle genes via binding to "seedless" 3'UTR microRNA recognition elements. Mol Cell, 2009. 35(5): p. 610-25.
Lau et al., "An Abundant Class of Tiny RNAs with Probable Regulatory Roles in Caenorhabditis elegans" Science 294, 858-861 (2001).
Lee and Ambros "An Extensive Class of Small RNAs in Caenorhabditis elegans." Science, 294, 862 (2001).
Lee, R.C., R.L. Feinbaum, and V. Ambros, "The C. elegans heterochronic gene lin-4 encodes small RNAs with antisense complementarity to lin-14." Cell, 1993. 75(5): p. 843-854.
Lim, et al., The microRNAs of Caenorhabditis elegans Genes & Development, 17, p. 991-1008 (2003).
Lim, L.P., et al., "Vertebrate microRNA genes." Science 2003. 299(5612): p. 1540-1540.
Liu, X., K. Fortin, and Z. Mourelatos, "MicroRNAs: biogenesis and molecular functions." Brain Pathol, 2008. 18(1): p. 113-21.
Llorens et al., "A highly expressed miR-101 isomiR is a functional silencing small RNA" (2013) BMC Genomics 14: 104.
Lu, M., et al., "An analysis of human microRNA and disease associations." PLoS ONE, 2008. 3(10): p. e3420.
Ma, L.et al., "Tumour invasion and metastasis initiated by microRNA-10b in breast cancer." Nature, 2007. 449(7163): p. 682-688.
Mendell, J.T., "miRiad roles for the miR-17-92 cluster in development and disease." Cell, 2008. 133(2): p. 217-222.
Metzker M. L. "Sequencing technologies—the next generation" Nature Reviews (2010) 11: 31-46.
Miranda, K.C., et al., A pattern-based method for the identification of MicroRNA binding sites and their corresponding heteroduplexes. Cell, 2006. 126(6): p. 1203-1217.
Nelson, P.T., W.X. Wang, and B.W. Rajeev, MicroRNAs (miRNAs) in neurodegenerative diseases. Brain Pathol, 2008. 18(1): p. 130-8.
Pareek C. S. et al. "Sequencing technologies and genome sequencing" J. Appl Genetics (2011) 52: 413-435.
Perkel, J. "Making contact with Sequencing's Fourth Generation" BioTechniques (2011): 50:93-95.
Perkins, D.O., et al., "microRNA expression in the prefrontal cortex of individuals with schizophrenia and schizoaffective disorder." Genome Biology, 2007. 8(2): R27.
Poliseno, L., et al., "A coding-independent function of gene and pseudogene mRNAs regulates tumour biology"—Supplement. Nature, 2010. 465(7301): p. 1-19.
Reinhart, B.J., et al., "The 21-nucleotide let-7 RNA regulates developmental timing in Caenorhabditis elegans." Nature, 2000. 403(6772): p. 901-6.
Rigoutsos, I. and A. Tsirigos, in MicroRNAs in Development and Cancer Molecular Medicine and Medicinal Chemistry Ch.10, ed. F.J. Slack. vol. vol. 1. 2010: Imperial College Press.

(56) References Cited

OTHER PUBLICATIONS

Rigoutsos, I., et al., "Short blocks from the noncoding parts of the human genome have instances within nearly all known genes and relate to biological processes." Proceedings of the National Academy of Sciences of the United States of America, 2006. 103(17): p. 6605-6610.

Rigoutsos, I., "New tricks for animal microRNAS: targeting of amino acid coding regions at conserved and nonconserved sites." Cancer Research, 2009. 69(8): p. 3245-3248.

Ruvkun, G. and J. Giusto, "The Caenorhabditis elegans heterochronic gene lin-14 encodes a nuclear protein that forms a temporal developmental switch." Nature, 1989. 338(6213): p. 313-19.

Ryan, B.M., A.I. Robles, and C.C. Harris, "Genetic variation in microRNA networks: the implications for cancer research." Nature Reviews Cancer, 2010. 10(6): p. 389-402.

Saey, T., "Cancer's little helpers: Tiny pieces of RNA may turn cells to the dark side." Science News, 2010.

Saha S. et al. "Characterization of the yeast transcriptome" Cell (1997) 88: 243-251.

Selbach, M., et al., "Widespread changes in protein synthesis induced by microRNAs." Nature, 2008. 455(7209): p. 58-63.

Singh Y. et al. "Recent developments in oligonucleotide conjugation" Chem. Soc. Rev., 2010, 39, 2054-2070.

Skalsky, R.L., et al., "The viral and cellular microRNA targetome in lymphoblastoid cell lines." PLoS Pathog, 2012. 8(1): p. e1002484.

Small, E.M. and E.N. Olson, "Pervasive roles of microRNAs in cardiovascular biology." Nature, 2011. 469(7330): p. 336-342.

Small, E.M. et al., "MicroRNAs add a new dimension to cardiovascular disease." Circulation, 2010. 121(8): p. 1022-1032.

Somel, M., et al., "MicroRNA, mRNA, and protein expression link development and aging in human and macaque brain." Genome Res, 2010. 20(9): p. 1207-18.

Spizzo, R., et al., "SnapShot: MicroRNAs in Cancer." Cell, 2009. 137(3): p. 586.e1.

Stark, A., et al., "Animal MicroRNAs confer robustness to gene expression and have a significant impact on 3'UTR evolution." Cell, 2005. 123(6): p. 1133-46.

Swami M. "Small RNAs: Pseudogenes act as microRNA decoys." Nature Reviews Genetics (2010) 11: 530-531).

Taganov, K.D. et al. "MicroRNAs and immunity: tiny players in a big field." Immunity, 2007. 26(2): p. 133-137.

Tay, Y., et al., "MicroRNAs to Nanog, Oct4 and Sox2 coding regions modulate embryonic stem cell differentiation." Nature, 2008. 455(7216): p. 1124-1128.

Thomas, M., J. et al. "Desperately seeking microRNA targets." Nat Struct Mol Biol, 2010. 17(10): p. 1169-74.

Urquhart, et al., "Rate-Controlled Delivery Systems in Drug and Hormone Research" Ann. Rev. Pharmacol. Toxicol. 24: 199-236 (1984).

Vasilescu, C., et al., MicroRNA fingerprints identify miR-150 as a plasma prognostic marker in patients with sepsis. PLoS ONE, 2009. 4(10): p. e7405.

Velculescu, V. E. et al. "Serial Analysis of Gene Expression." Science (1995) 270: 484-487.

Vella, M.C., et al., "The C. elegans microRNA let-7 binds to imperfect let-7 complementary sites from the lin-41 3'UTR." Genes Dev, 2004. 18(2): p. 132-7.

Ventura, A. and T. Jacks, "MicroRNAs and Cancer: short RNAs go a long way." Cell, 2009. 136(4): p. 586-591.

Voelkerding K. V. et al. "Next-Generation Sequencing: From Basic Research to Diagnostics" Clinical Chemistry (2009) 55: 641-658.

Voorhoeve, P.M. and R. Agami, "Classifying microRNAs in cancer: The good, the bad and the ugly." Biochimica et Biophysica Acta (BBA)—Reviews on Cancer, 2007. 1775(2): p. 274-282.

Wang, W.-X., et al., "miR-107 regulates granulin/progranulin with implications for traumatic brain injury and neurodegenerative disease." The American Journal of Pathology, 2010. 177(1): p. 334-345.

Wang, W.-X., et al., "The expression of microRNA miR-107 decreases early in Alzheimer's disease and may accelerate disease progression through regulation of beta-site amyloid precursor protein-cleaving enzyme 1." Journal of Neuroscience, 2008. 28(5): p. 1213-1223.

Wang, Y., et al., MicroRNA: past and present. Front Biosci, 2007. 12: p. 2316-29.

Wightman, B., I. Ha, and G. Ruvkun, "Posttranscriptional regulation of the heterochronic gene lin-14 by lin-4 mediates temporal pattern formation in C. elegans." Cell, 1993. 75(5): p. 855-862.

Williams, A.H., et al., "MicroRNA-206 delays ALS progression and promotes regeneration of neuromuscular synapses in mice." Science 2009. 326(5959): p. 1549-1554.

Xia, Z., et al., "Molecular dynamics simulations of Ago silencing complexes reveal a large repertoire of admissible 'seed-less' targets." Sci Rep, 2012. 2: p. 569.

Zhang J. et al. "The impact of next-generation sequencing on genomics" J. Genet Genomics (2011) 38: 95-109.

Zisoulis, D.G., et al., "Comprehensive discovery of endogenous Argonaute binding sites in Caenorhabditis elegans." Nat Struct Mol Biol, 2010. 17(2): p. 173-9.

International Search Report for PCT/US14/36690 dated Feb. 4, 2015.

* cited by examiner

HUMAN MIRNAS FOR USE IN DIAGNOSIS, PROGNOSIS, AND THERAPY OF HUMAN CONDITIONS AND DISEASES

CROSS-REFERENCE TO RELATED APPLICATIONS

The present application is a 35 U.S.C. § 371 national phase application from, and claims priority to, International Application No. PCT/US2014/036690, filed May 2, 2014, and published under PCT Article 21(2) in English, which claims priority under 35 U.S.C. § 119(e) to U.S. Provisional Application No. 61/818,777, filed May 2, 2013, U.S. Provisional Application No. 61/870,898, filed Aug. 28, 2013, and U.S. Provisional Application No. 61/901,989, filed Nov. 8, 2013, all of which applications are incorporated herein by reference in their entireties.

GOVERNMENT SUPPORT

This invention was made with government support under grant No. 2U 19-AI056363-06/2030984, awarded by the National Institutes of Health. The U.S. government has certain rights in the invention.

SEQUENCE LISTING

The instant application contains a Sequence Listing which has been submitted in ASCII format via EFS-Web and is hereby incorporated by reference in its entirety. Said ASCII copy, created on May 2, 2014, is named 77983PCT.txt and is 8,071,491 bytes in size.

TECHNICAL FIELD

Provided herein relates to methods and compositions for determining a cellular state or a tissue state of a biological sample, or the tissue or cell provenance of a biological sample. Specifically, some embodiments of the methods described herein can be used to diagnose or prognose for a given stage of a disease, e.g., cancer, or disorder, in a subject. Other embodiments can be used to determine the tissue or cell type from which a biological sample was obtained.

BACKGROUND

MicroRNAs (miRNAs) are an abundant class of short non-coding RNAs (ncRNAs), ~22 nucleotides (nts) in length, which play a significant role in the regulation of gene expression. Bartel, D. P., Cell, 2004, 116(2): 281-97; Bartel, D. P., Cell, 2009, 136(2): 215-33. The first animal miRNA, lin-4, was discovered accidentally during a genetic screen in Caenorhabditis elegans (C. elegans) where it was previously reported to repress the expression of a protein-coding gene lin-14. Ambros, V., Cell, 1989, 57(1): 49-57; Ruvkun, G. and J. Giusto, Nature, 1989, 338(6213): 313-19. Downregulation of lin-14 led to a change in pattern formation in C. elegans larvae. In 2000, a second miRNA, let-7, was reported to be an important miRNA in C. elegans development. Reinhart, B. J., et al., Nature, 2000, 403(6772): 901-6. Other miRNAs have been previously reported in various species, including worms, flies, and mammals. See, e.g., Chang, S., et al., Nature, 2004, 430(7001): 785-89; Johnston, R. J. and O. Hobert, Nature, 2003, 426(6968): p. 845-49; Brennecke, J. and S. M. Cohen, Genome Biol, 2003, 4(9): 228. See also the miRNA database accessible online at www.mirbase.org. Currently, more than two thousand miRNAs are known for the human genome and contained in miRBase Release 19. Griffiths-Jones, S., Nucleic Acids Research, 2006, 34(90001): D140-D144.

MiRNAs interact with their target RNAs in a sequence-dependent manner. Miranda, K. C., et al., Cell, 2006, 126(6): 1203-1217; Bartel, D. P., Cell, 2004, 116(2): 281-297; Bartel, D. P., Cell, 2009, 136(2): 215-233; Rigoutsos, I., Cancer Research, 2009, 69(8): 3245-3248. MiRNAs can function as post-transcriptional regulators of gene expression. In mammals, over 90% of all protein-coding genes are generally believed to be regulated by miRNAs. Miranda, K. C., et al., Cell, 2006, 126(6): 1203-1217. Even though the entire miRNA sequence can bind to the mRNA target, the sequence spanning positions 2-7 inclusive from the 5' end of a miRNA, known as the "seed," is previously reported to be important for target determination and coupling. Bartel, D. P., Cell, 2004, 116(2): 281-97; Reinhart, B. J., et al., Nature, 2000, 403(6772): 901-06; Lee, R. C. et al., Cell, 1993, 75(5): 843-854; Wightman, B., et al., Cell, 1993, 75(5): 855-862; Tay, Y., et al., Nature, 2008, 455(7216): 1124-1128; Brodersen, P., Nat Rev Mol Cell Biol, 2009. 10(2): 141-48; Lal, A., et al., Mol Cell, 2009, 35(5): 610-25; Rigoutsos, I. and Tsirigos, A., in MicroRNAs in Development and Cancer Molecular Medicine and Medicinal Chemistry Ch. 10, ed. F. J. Slack. Vol. 1, 2010: Imperial College Press; Xia, Z., et al., Sci Rep, 2012, 2: 569. Originally it was assumed that the presence of the reverse complement of the seed in mRNAs was both a sufficient and necessary condition for targeting. Bartel, D. P., Cell, 2009, 136(2): 215-233. However, genetic studies and numerous subsequent efforts showed miRNA functionality in the presence of inexact matches and/or bulges in the seed region. Wightman, B., et al. Cell, 1993, 75(5): 855-862; Tay, Y., et al., Nature, 2008, 455(7216): 1124-1128; Lal, A., et al., Mol Cell, 2009, 35(5): 610-25; Ha, I. et al., Genes Dev, 1996. 10(23): p. 3041-50; Vella, M. C., et al., Genes Dev, 2004. 18(2): 132-37; Farh, K. K., et al., Science, 2005, 310(5755): 1817-21; Stark, A., et al., Cell, 2005, 123(6): 1133-46; Didiano, D. and Hobert O., Nat Struct Mol Biol, 2006. 13(9): 849-51; Easow, G. et al., RNA, 2007, 13(8): 1198-204; Baek, D., et al., Nature, 2008, 455(7209): 64-71; Selbach, M., et al., Nature, 2008. 455 (7209): 58-63; Chi, S. W., et al., Nature, 2009, 460(7254): 479-86; Fabian, M. R. et al., Annu Rev Biochem, 2010, 79: 351-79; Hafner, M., et al., Cell, 2010, 141(1): 129-41; Thomas, M., Nat Struct Mol Biol, 2010, 17(10): 1169-74; Zisoulis, D. G., et al., Nat Struct Mol Biol, 2010. 17(2): 173-79; Chi, S. W. et al., Nat Struct Mol Biol, 2012. 19(3): 321-27; Skalsky, R. L., et al., PLoS Pathog, 2012. 8(1): e1002484. The importance of such inexact matches has been previously reported to have direct relevance to answering the question of how many targets a miRNA can have.

The role of microRNAs was shown in previous reports where miR-15a and miR-16 are down-regulated or deleted in most patients with chronic lymphocytic leukemia (CLL). Calin, G. A., et al., Proc Natl Acad Sci USA, 2002, 99(24): 15524-9; Calin, G. A. and Croce, C. M., Blood, 2009, 114(23): 4761-4770. MiRNAs have also been reported to be involved in many fundamental biological processes. Lee, R. C. et al., Cell, 1993, 75(5): 843-854; Wightman, B. et al., Cell, 1993, 75(5): 855-862; Tay, Y., et al., Nature, 2008, 455(7216): 1124-1128; Ha, I. et al., Genes & Development, 1996, 10(23): 3041-3050; Ruvkun, G., et al., Nature, 2000. 403(6772): 901-906; Didiano, D. and Hobert, O., RNA, 2008. 14(7): 1297-1317. Previous reports have also showed miRNA connections to cardiovascular disease (Small, E. M. et al., Circulation, 2010. 121(8): 1022-1032; Small, E. M.

and Olson, E. N. Nature, 2011. 469(7330): 336-342), immunity (Taganov, K. D. et al., Immunity, 2007. 26(2): 133-137), schizophrenia (Perkins. D. O., et al., microRNA expression in the prefrontal cortex of individuals with schizophrenia and schizoaffective disorder. Genome Biology, 2007. 8(2): R27), brain processes (Liu, X., et al., Brain Pathol, 2008. 18(1): 113-21; Wang, Y., et al., Front Biosci, 2007. 12: 2316-29), neurodegeneration (Wang, W.-X., et al., Journal of Neuroscience, 2008. 28(5): 1213-1223; Wang, W.-X., et al., The American journal of pathology, 2010. 177(1): 334-345; Abelson, J. F., et al., Science, 2005. 310(5746): 317-320), Alzheimer's and brain aging (Nelson, P. T. et al., Brain Pathol, 2008, 18(1): p. 130-8; Hebert, S. S. and De Strooper, B., Trends Neurosci, 2009. 32(4): 199-206; Ibanez-Ventoso, C. and Driscoll, M. Curr Genomics, 2009. 10(3): 144-53; Somel, M., et al., Genome Res, 2010. 20(9): 1207-18), and other conditions (Small, E. M. and Olson, E. N., Nature, 2011, 469(7330): 336-342; Mendell, J. T., Cell, 2008. 133 (2): 217-222; Vasilescu, C., et al., PLoS ONE, 2009. 4(10): e7405; Williams, A. H., et al., Science, 2009. 326(5959): 1549-1554. Further, many miRNAs are also linked to cancers (Calin, G. A., et al., Proc Natl Acad Sci USA, 2002, 99(24): 15524-9; Calin, G. A. and Croce, C. M. Blood, 2009. 114(23): 4761-4770; Esquela-Kerscher, A. and Slack, F. J., Nature Reviews Cancer, 2006. 6(4): 259-269; Hammond, S. M., Nature Genetics. 2007, 39: 582-583; Poliseno, L., et al., Supplement. Nature, 2010. 465(7301): p. 1-19), invasion and metastasis (Ma, L., et al., Nature, 2007. 449(7163): 682-688), and exhibit tissue- and cell-state-dependent profiles (Calin, G. A. and Croce, C. M., Cancer Research, 2006. 66(15): 7390-7394; Lu, M., et al., PLoS ONE, 2008. 3(10): e3420; Godshalk, S. E., et al., Oncogene, 2011, 30: 1542-50; Ryan, B. M. et al., Nature Reviews Cancer, 2010, 10(6): 389-402; Saey, T., Science News, 2010, "Cancer's little helpers: Tiny pieces of RNA may turn cells to the dark side"; Spizzo, R., et al., Cell, 2009, 137(3): 586-586.e1; Ventura, A. and Jacks, T., Cell, 2009. 136(4): 586-591; Voorhoeve, P. M. and Agami, R., Cancer, 2007, 1775(2): 274-282). The prevalence of miRNA-driven regulatory interactions across a very wide spectrum of human conditions and diseases makes the question of how many miRNAs existing a very important one. Recent advances in next generation sequencing have further complicated the picture by revealing that multiple distinct mature miRNA species can arise from the same miRNA precursor arm: these mature miRNAs are termed "isomiRs." These isomiRs typically differ from the mature miRNA sequences currently in public databases such as miRBase (Griffiths-Jones S. 2006. Nucleic Acids Res 34(90001): D140-D144) on either their 5' or 3' ends thereby increasing the diversity and complexity of the miRNA-ome. While the biological relevance of isomiRs is not fully understood, they have been shown to associate with the Argonaute complex (Ameres S L, Zamore P D. 2013. Nat Rev Mol Cell Biol: 1-14) which in turn suggests a functional role. Recent studies of isomiR expression have either focused on isomiRs of a single miRNA or on the isomiR expression patterns within a specific tissue. For example, a 5'-isomiR of miR-101 was observed to be ubiquitously expressed in several human tissues and cell lines (Llorens et al., 2013. BMC Genomics 14: 104). There is a continuous demand for more accurate diagnostic and prognostic tools and improved therapies. As such, there is still a need to identify novel miRNA and isomiR sequences that can be used for diagnosis, prognosis, and therapy of human conditions or diseases or to identify the provenance (tissue or cell) of a biological sample.

SUMMARY

There is a need to identify novel miRNA sequences that provide more accurate or reliable diagnostic and/or prognostic tools and/or improved therapies or can be used to determine the origin of a biological sample. To this end, inventors analyzed about 1,367 next generation sequencing datasets (RNA-sequencing and Argonaute cross-linking and immunoprecipitation (CLIP)-sequencing) corresponding to human normal and disease states from 13 distinct tissue types (from a total of approximately 200 human tissue types) and discovered at least tens of thousands of novel miRNAs as disclosed herein: each of the novel miRNAs has an associated false discovery rate (FDR) of 0.05 or lower.

By analyzing a large collection of next generation sequencing datasets, the inventors have discovered numerous novel human miRNAs and variants thereof. For a large fraction of these novel miRNAs, the inventors have additional corroborating evidence, through the analysis of CLIP-sequencing datasets, that they are loaded on Argonaute, which provides further credence to their bona fide miRNA nature.

In addition, by analyzing short RNA sequence profiles of deep sequenced biological samples of various human tissues and/or cell types, the inventors have discovered that the actual instance of the mature miRNA product that arises from a given miRNA locus and is detected in a given cell or tissue context can be different from the instance of the mature miRNA product that arises from the same miRNA locus in a different cell or tissue context, and this finding has been observed for many of the miRNAs currently in miRBase, which is a public repository of miRNA sequences for vertebrates, invertebrates, viruses, and plants. Accordingly, these tissue and/or cell-type dependence correlation of the novel miRNAs described herein can be used to determine tissue of origin in samples of interest. Additionally or alternatively, the tissue/cell-type dependence of the novel miRNAs described herein can also be used to determine cell state, disease type, disease stage, etc.

Accordingly, these novel miRNAs described herein can be used in various applications, e.g., to generate novel molecular signatures for cell types, cell states, disease, disease stage, disease progression, etc. They can also be used to identify novel and unexpected molecular players in cellular contexts of interest and also to reveal unexpected molecular interplays that underlie the onset and progression of diseases. Further, the novel miRNAs described herein can provide novel and improved means for therapeutic interventions. Accordingly, provided herein relates to methods, compositions, assays and systems for determining a given state of a cell and/or a tissue, which can be used for diagnosing a disease or disorder, and/or prognosing a given stage and/or progression of a disease or disorder, and/or treating a disease or disorder.

In one aspect, provided herein relates to methods or assays of determining a given state of a cell and/or a tissue. The method or assay comprises detecting in a biological sample the presence or absence of one or more miRNAs described herein. In some embodiments, the biological sample can be derived from a subject suspected of being at risk of or having a given stage of a disease or disorder. Accordingly, methods or assays described herein can also be used to determine whether a subject has, or is at risk of developing, or is at a given stage of a disease or disorder, e.g., a condition afflicting a tissue of interest. In one embodiment, the condition afflicting a tissue of interest includes cancer.

In some embodiments, the method or assay described herein can comprise detecting in the biological sample the presence or absence of a plurality of the miRNAs described herein.

In some embodiments of the methods or assays described herein, detection of the presence or absence of at least one of the novel miRNAs described herein can include measuring an expression level of the miRNA of interest in the biological sample. The expression level of the miRNA of interest can be detected by any methods known in the art, including, but not limited to, sequencing, next-generation sequencing (e.g., deep sequencing), polymerase chain reaction (PCR), and real-time quantitative PCR, northern blot, microarray, in situ hybridization, serial analysis of gene expression (SAGE), cap analysis gene expression (CAGE), massively parallel signature sequencing (MPSS), direct multiplexed measurements of the type employed in the Nanostring platform, and any combinations thereof. In such embodiments, the methods or assays can further comprise comparing with a reference sample the determined expression level of the miRNA of interest in the biological sample. When there is a discrepancy in the expression level or amount of at least one miRNA molecule between the biological sample and the reference sample, the discrepancy can be indicative of the cell or the tissue in a state different from the reference sample. For example, in some embodiments, the discrepancy can be indicative of a subject either having, or being at risk of developing, or being at a given stage of a disease or disorder, e.g., a condition afflicting the tissue. In alternative embodiments, the discrepancy can be indicative of a subject lacking of a disease or disorder to be evaluated.

The reference sample used in the methods, assays and systems described herein can be a sample derived from the same type of cell or tissue with a known condition. For example, the reference sample can represent a normal condition of a cell or tissue to be detected. The normal reference sample can be obtained from the test subject or a different subject. Alternatively, the reference sample can represent a recognizable stage of a possibly abnormal condition of a cell or a tissue to be detected.

A biological sample for evaluation in the methods, assays, and systems described herein can include one or more cells derived from any tissue or fluid in a subject. In one embodiment, the biological sample can be a tissue suspected of being at risk of, or being afflicted with a given stage of a disease or a disorder. Non-limiting examples of sample origins can include, but are not limited to, breast, pancreas, blood, prostate, colon, lung, skin, brain, ovary, kidney, oral cavity, throat, cerebrospinal fluid, and liver.

Different embodiments of the methods, assays and systems described herein can be used for diagnosis and/or prognosis of a disease or disorder (including a given stage of a disease or disorder) in a subject, e.g., a disease or disorder afflicting a certain tissue in a subject. For example, the disease or disorder to be diagnosed and/or prognosed in a subject can be associated with breast, pancreas, blood, prostate, colon, lung, skin, brain, ovary, kidney, oral cavity, throat, cerebrospinal fluid, liver, and any combination thereof. In some embodiments, the disease or disorder to be diagnosed and/or prognosed with the methods, assays or systems described herein can be a blood disorder, e.g., associated with diseased or abnormal platelets. In other embodiments, the disease or disorder to be diagnosed and/or prognosed with the methods, assays or systems described herein can be any cancer, e.g., but not limited to breast cancer and pancreatic cancer.

For a subject who is determined to have, or is at risk of developing, or is at a given stage of the disease or disorder, the subject can be administered or prescribed with a specific treatment. For example, in some embodiments where the subject is diagnosed with cancer (e.g., breast carcinoma or pancreatic carcinoma) or progression thereof, the method can further comprise administering or prescribing the subject a treatment, e.g., chemotherapy, radiation therapy, surgery, engineered transcripts that can "sponge" various combinations of the novel miRNAs described herein, or any combinations thereof.

Another aspect provided herein relates to systems for analyzing a biological sample, e.g., to determine a given state of a cell or a tissue, and/or to diagnose and/or prognose a disease or disorder, or a given state of a disease or disorder in a subject. In one embodiment, the system comprises: (a) a determination module configured to receive a biological sample and to determine sequence information and, optionally quantity estimate information, wherein the sequence information comprises a sequence of one or more miRNAs described herein; and wherein the quantity estimate information comprises at least an estimate of the abundance of said sequence, with said abundance optionally scaled with regard to the abundance of a reference molecule; (b) a storage device configured to store sequence information and optionally the quantity estimate information from the determination module; (c) a comparison module adapted to compare the sequence information and optionally the quantity estimate information stored on the storage device with reference data, and to provide a comparison result, wherein the comparison result identifies the presence or absence of the miRNA molecule, and optionally how its quantity estimate is related to the reference data, wherein a discrepancy in a quantity estimate level is indicative of the biological sample having an increased likelihood of having, or being at a cellular or tissue state different from a state represented by the reference data; and (d) a display module for displaying a content based in part on the comparison result for the user, wherein the content is a signal indicative of a subject having, or being at risk of developing, or being at a given stage of a disease or disorder, or a signal indicative of lacking a disease or disorder.

A computer-readable physical medium for determination of a given state of a cell or a tissue, including diagnosis and/or prognosis of a disease or disorder, or a state of a disease or disorder in a subject, is also provided herein. The computer-readable physical medium having computer readable instructions recorded thereon to define software modules includes a comparison module and a display module for implementing a method on a computer, wherein the method comprises: (a) comparing with the comparison module the data stored on a storage device with reference data to provide a comparison result, wherein the comparison result captures the presence or absence of the miRNA molecule and/or the difference between its quantity estimate and the reference data, wherein a discrepancy in a quantity estimate level is indicative of a biological sample having an increased likelihood of having, or being at a cellular or tissue state different from a state represented by the reference data; and (b) a display module for displaying a content based in part on the comparison result for the user, wherein the content is a signal indicative of a subject having, or being at risk of developing, or being at a given stage of a disease or disorder, or a signal indicative of lack of a disease or disorder.

In some embodiments, kits and/or assays for expressing, silencing, and/or quantitating one or more of the novel miRNAs described herein from the model organism of choice (e.g., but not limited to, human, mouse, and rat) are also encompassed within the scope of various aspects described herein.

BRIEF DESCRIPTION OF THE FIGURES

FIG. 5A is based on male samples only. FIG. 5B is based on female samples only.

DETAILED DESCRIPTION OF THE INVENTION

Figure 1A:
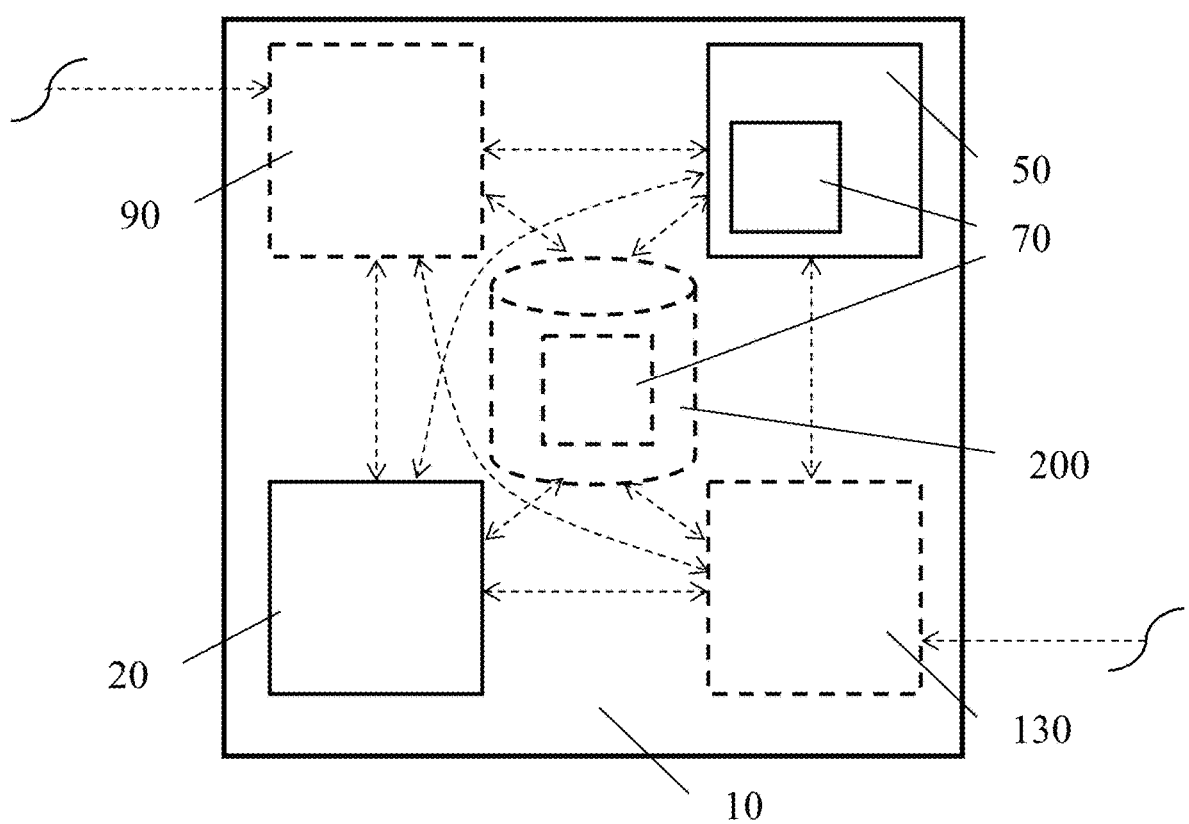
FIGS. 1A-1B are block diagrams showing an example of a system for determining a state of a cell or a tissue and/or for diagnosing or prognosing a disease or disorder, or a stage of a disease or disorder in a subject, based on expression level of one or more novel miRNAs described herein.

There is a need to identify novel miRNA sequences that provide more accurate or reliable diagnostic and/or prognostic tools and/or improved therapies or provide improved tissue of origin identification. To this end, inventors analyzed 1,367 next generation sequencing datasets (RNA-sequencing and Argonaute cross-linking and immunoprecipitation (CLIP)-sequencing) corresponding to human normal and disease states from 13 distinct tissue types (from a total of approximately 200 human tissue types)) and discovered at least tens of thousands of novel miRNAs as disclosed herein: each of the novel miRNAs has an associated FDR of 0.05 or lower.

By analyzing a large collection of next generation sequencing datasets, the inventors have discovered numerous novel human miRNAs and variants thereof. For a large fraction of these novel miRNAs, the inventors have additional corroborating evidence, through the analysis of CLIP-sequencing datasets, that they are loaded on Argonaute, which provides further credence to their bona fide miRNA nature.

In addition, by analyzing short RNA sequence profiles of deep sequenced biological samples of various human tissues and/or cell types, the inventors have discovered that the actual instance of the mature miRNA product that arises from a given miRNA locus and is detected in a given cell or tissue context can be different from the instance of the mature miRNA product that arises from the same miRNA locus in a different cell or tissue context, and this finding has been observed for many of the miRNAs currently in miR-Base, which is a public repository of miRNA sequences for vertebrates, invertebrates, viruses, and plants. Accordingly, these tissue and/or cell-type dependence correlation of the novel miRNAs described herein can be used to determine tissue of origin in samples of interest. Additionally or alternatively, the tissue/cell-type dependence of the novel miRNAs described herein can also be used to determine cell state, disease type, disease stage, etc.

Accordingly, these novel miRNAs described herein can be used in various applications, e.g., to generate novel molecular signatures for cell types, cell states, disease, disease stage, disease progression, etc. They can also be used to identify novel and unexpected molecular players in cellular contexts of interest and also to reveal unexpected molecular interplays that underlie the onset and progression of diseases. Further, the novel miRNAs described herein can provide novel and improved means for therapeutic interventions. Accordingly, provided herein relates to methods, compositions, assays and systems for determining a given state of a cell and/or a tissue, which can be used for diagnosing a disease or disorder, and/or prognosing a given stage and/or progression of a disease or disorder, and/or treating a disease or disorder.

Methods and Assays for Determining a Given State of a Cell or a Tissue, or for Determining Tissue of origin One aspect described herein provides methods and assays for determining a specific state or condition of a cell or a tissue. As the cell or tissue can be derived from a biological sample of a subject suspected of being at risk of or having a given stage of a disease or disorder, e.g., a condition afflicting a tissue, methods and assays for determining whether a subject has or is at risk of developing, or is at a given stage of a disease or disorder, e.g., a condition afflicting a tissue, are also provided herein. The methods or assays of any aspects described herein comprise measuring in a biological sample from a tissue of interest expression level of one or more miRNAs selected from SEQ ID NO: 1 to SEQ ID NO: 47,972 disclosed in Tables 1-3. In some embodiments, the methods or assays of any aspects described herein comprise measuring in a biological sample from a tissue of interest expression level of one or more miRNAs selected from SEQ ID NO: 1 to SEQ ID NO: 47,972 disclosed in Tables 1-3. An alteration of the level of one or more miRNAs as compared to the level of the same miRNA sequence(s) in a reference sample is indicative of the subject either having, or being at risk of developing, or being at a given stage of the condition.

As shown in the Examples, some of the novel miRNAs/isomiRs are preferentially present in some tissues but not in other tissues. This indicates that signatures of one or more miRNAs can be used to answer the question of tissue of origin. Thus, in some embodiments, the methods and/or assays described herein can also be used to determine tissue of origin by comparing the level(s) of one or more miRNAs in the biological sample to that of reference samples of different tissues.

As used herein, the term "alteration of the level of one or more miRNAs" refers to a change in the level of one or more miRNAs in a sample relative to the corresponding level(s) in a reference sample. In some embodiments, the alteration or change in the level of one or more miRNAs can refer to an increase in the level of one or more miRNAs in a sample relative to the corresponding level(s) in a reference sample. For example, in some embodiments where there is an alteration in the level of one or more miRNAs, the level of one or more miRNAs in a sample can be increased by at least about 10% or more, including, e.g., at least about 20%, at least about 30%, at least about 40%, at least about 50%, at least about 60%, at least about 70%, at least about 80%, at least about 90%, at least about 95%, at least about 97%, at least about 99% or more, relative to the corresponding level(s) in a reference sample. In some embodiments where there is an alteration in the level of one or more miRNAs, the level of one or more miRNAs in a sample can be increased by at least about 1.1-fold or more, including, e.g., at least about 1.5-fold, at least about 2-fold, at least about 3-fold, at least about 4-fold, at least about 5-fold, at least about 6-fold, at least about 7-fold, at least about 8-fold, at least about 9-fold, at least about 10-fold or more, relative to the corresponding level(s) in a reference sample.

In some embodiments, the level(s) of one or more miRNAs are considered to be altered (or differentially expressed) relative to reference sample(s) if it has a mean expression of at least 25 or more sequenced reads, and a log 2-change in expression relative to the reference sample(s) of at least 0.5 or higher, or no more than −0.5 or lower.

In other embodiments, the alteration or change in the level of one or more miRNAs can refer to a decrease in the level of one or more miRNAs in a sample relative to the corresponding level(s) in a reference sample. For example, in some embodiments where there is an alteration in the level of one or more miRNAs, the level of one or more miRNAs in a sample can be decreased by at least about 10% or more, including, e.g., at least about 20%, at least about 30%, at least about 40%, at least about 50%, at least about 60%, at least about 70%, at least about 80%, at least about 90%, at least about 95%, at least about 97%, at least about 99% or more (including 100%), relative to the corresponding level(s) in a reference sample.

In some embodiments, the "alteration of the level of one or more miRNAs" can refer to the presence (e.g., a detectable level) of one or more miRNAs in a sample, as compared to the absence (e.g., no detectable level) of those miRNA(s) in a reference sample.

In alternative embodiments, the "alteration of the level of one or more miRNAs" can refer to the absence (e.g., no detectable level) of one or more miRNAs in a sample, as compared to the presence (e.g., a detectable level) of those miRNA(s) in a reference sample.

In some embodiments of any aspects described herein, the method or assay can comprise detecting in the biological sample the level of a plurality (e.g., at least 2, at least 3, at least 4, at least 5, at least 6, at least 7, at least 8, at least 9, at least 10, at least 15, at least 20, at least 25, at least 30, at least 40, at least 50, or more) of the miRNAs selected from SEQ ID NO: 1 to SEQ ID NO: 47,972 disclosed in Tables 1-3.

An amount of a miRNA sequence in the biological sample can be measured or quantified by any known RNA detection methods. By way of example only, the miRNA(s) in a biological sample can be detected or read by a sequencing method (including Sanger sequencing, next-generation sequencing or deep sequencing, direct multiplexing, and any art-recognized sequencing method) and a read count of each miRNA sequence can be generated to determine its amount present in the biological sample. Alternatively, where the miRNA sequence(s) in a biological sample are determined by PCR-based methods (e.g., real-time PCR), the amount of the miRNA sequence(s) present in the biological sample can be represented by a $C_t$ number, which can be compared to that of a reference sample. As a person having ordinary skill in the art would appreciate, a larger $C_t$ number generally indicates a lower amount of a nucleic acid sequence present in a sample. In some embodiments, the quantitative amount of the miRNA sequence(s) detected by PCR-based methods (e.g., real-time PCR) can also be determined from a calibration curve generated with known amounts of a nucleic acid sequence.

Any other art-recognized methods detecting or measuring the level of a miRNA sequence, e.g., but not limited to the methods and kits for miRNA isolation and quantitation as described in U.S. Pat. No. 8,574,838, can also be used herein. Additional information about measuring or quantifying one or more miRNA sequences is described in the section "Exemplary methods for detecting or measuring the level of a miRNA sequence" below.

As the amount of the miRNA sequence(s) is determined in the biological sample, in some embodiments, the methods or assays described herein can further comprise comparing with a reference sample the level of one or more miRNA sequences described herein in the biological sample. When there is a difference (e.g., at least about 10% difference or higher) or a statistically significant difference in an amount of at least one or more (e.g., at least 2 or more) or in the profile of miRNA sequences between the biological sample and the reference sample, the difference or significant difference can be indicative of the cell or the tissue in a state different from the reference sample. If the cell or the tissue is derived from a biological sample of a subject, the results of the comparison can be used for diagnosing or prognosing a disease or disorder, or a state of a disease or disorder. Depending on the choice of a reference sample, in some embodiments, the difference or significant difference can be indicative of a subject either having, or being at risk of developing, or being at a given stage of a disease or disorder, e.g., a condition afflicting the tissue; while in other embodiments, the difference or significant difference can be indicative of a subject free of a disease or disorder, e.g., a condition afflicting the tissue. For example, if a subject's miRNA sequence level or profile has no significant difference from that of a normal sample, it indicates that the subject is free of a condition or disease. Additionally or alternatively, if a subject's miRNA sequence level or profile is significantly different from that of a sample of a known disease or disorder to be diagnosed, it indicates that the subject does not likely have that disease or disorder.

If the miRNA sequence level or profile of a biological sample contain miRNA(s) that are preferentially present in a certain tissue but not in other tissues, the tissue origin of the biological sample can be determined based on the presence of those tissue-specific miRNA(s).

The threshold level selected to distinguish a given state of a cell or tissue from another, and/or to determine if a subject has, or is at risk of developing, or is at a given stage of a condition afflicting a tissue of interest can be determined experimentally. For example, by comparing the levels and/or profiles of one or more miRNA molecules detected in a number of references samples of known conditions in a specific tissue (e.g., a normal breast sample vs. a cancerous breast sample), e.g., by deep sequencing and/or quantitative RT-PCR, one of skill in the art can determine a threshold level for levels of one or more miRNA sequences required to distinguish one condition from another (e.g., to distinguish a normal breast sample from a cancerous breast sample).

In some embodiments, the threshold level needs not be pre-determined. For example, cluster analysis can be computationally performed to classify miRNA expression profiles of a biological sample and a set of reference samples into groups such that samples in the same group (called a cluster) have more similar miRNA expression profiling to each other than to those in other groups (clusters). Accordingly, when a biological sample is categorized into the same group with a subset of reference samples of similar miRNA expression profiles, the biological sample is considered to have similar properties (e.g., genotype or phenotype) as the subset of reference samples. For example, when a breast tissue sample from a subject is categorized into the same group representing cancerous breast tissue reference samples, or more specifically, into a sub-group representing invasive breast cancer, the subject is determined to likely to have breast cancer, or more specifically an invasive breast cancer. Various clustering algorithms for classification and clustering are known in the art and can be used for the purposes described herein. Examples of clustering algorithms and/or models include, but are not limited to connectivity-based clustering (e.g., hierarchical clustering), centroid-based clustering (e.g., k-means clustering), distribution-based clustering (e.g., multivariate normal distributions used by the expectation-maximization algorithm), density-based clustering (e.g., DBSCAN and OPTICS), subspace models (e.g., biclustering), and any combinations thereof.

The reference sample used in the methods and assays described herein can be a sample derived from the same type of cell or tissue as a biological sample, and with a known condition. For example, the reference sample can represent a normal condition of a cell or tissue in a biological sample to be analyzed. The normal reference sample can be collected from a subject whose biological sample is being analyzed or from a different subject. Alternatively, the reference sample can represent a recognizable stage of an abnormal condition of a cell or a tissue in a biological sample to be analyzed. By way of example only, if a disease or disorder to be diagnosed or prognosed in a subject is breast cancer, a reference sample can include a normal breast tissue, a ductal carcinoma in situ breast tissue sample, an invasive ductal carcinoma tissue sample or subtype, an invasive lobular carcinoma tissue sample, a lobular carcinoma in situ tissue sample, and any combinations thereof.

In some embodiments, the reference sample can present a known condition of a known tissue origin. Depending on applications, the reference sample can have the same or different tissue origin from the biological sample. For example, in order to determine the tissue origin of a biological sample, the level(s) and/or profile of one or more miRNAs described herein can be compared to reference samples of different tissues.

By way of example only, in some embodiments, the methods described herein can be used to determine a primary origin of an unknown tumor or cancer. Thus, in some embodiments, the methods described herein can be used to determine whether the tumor is a primary tumor or a secondary tumor (i.e., a metastasis). For example, a biopsy of an unknown tumor can be subjected to the methods or assays described herein to determine the tissue origin of the tumor, wherein if the tissue origin of the tumor is determined to be the same tissue type as from where the biopsy is collected, the tumor is diagnosed as a primary tumor, or if the tissue origin of the tumor is determined to be different from the type of the tissue from where the biopsy is collected, the tumor is diagnosed as a secondary tumor (i.e., a metastasis). Thus, the methods described herein can be used to fingerprint a biological sample, e.g., whether it is a normal sample or a diseased sample (e.g., a cancerous sample).

In some embodiments, more than one reference samples can be used, wherein the reference samples can represent a variety of different conditions (e.g., normal condition, different stages of a disease or disorder, different tissue origins). By way of example only, if a biological sample of a subject generates a similar or comparable miRNA expression profile (e.g., in terms of levels and/or locations of miRNA sequences) to that of a normal sample or a group of normal samples (reference samples), the subject can be considered normal with respect to the normal sample or the group normal samples. Similarly, if a biological sample of a subject generates a similar or comparable miRNA expression profile (e.g., in terms of levels and/or locations of miRNA sequences) to that of a sample or a group of samples derived from a given tissue (reference samples), the subject's biological sample can be considered to have the same tissue type as the reference samples.

The miRNA expression profile can be generated based on one or more genes. In some embodiments, the miRNA expression profile can be generated based on a specific gene, e.g., a gene that is associated with a condition or disorder. In some embodiments, miRNA sequences can be detected from at least two genes in a biological sample and compared to the corresponding reference sample to determine if similar conclusions are obtained.

For a subject who is determined to have, or is at risk of developing, or is at a given stage of the disease or disorder, the subject can be administered or prescribed with an appropriate treatment. For example, in some embodiments where the subject is diagnosed with cancer (e.g., breast carcinoma or pancreatic carcinoma) or progression thereof, the method can further comprise administering or prescribing the subject an anti-cancer treatment, e.g., chemotherapy, radiation therapy, surgery, immunotherapy, RNA therapeutics (e.g., siRNAs, miRNAs), or any combinations thereof.

In some embodiments, a subject in need thereof can be administered with an antagonist or a mimic of one or more (e.g., at least one, at least two, at least three, at least four, at least five, or more) of the miRNA sequences selected from SEQ ID NO: 1 to SEQ ID NO: 47,972 in Tables 1-3, depending on whether the subject is diagnosed to have an overexpression or a deficiency of one or more miRNA sequences determined to be associated with a condition or disorder. For example, in some embodiments where the level(s) of one or more miRNAs described herein are determined to represent a "causal event" for the disease or disorder, the level(s) of the miRNAs can be controlled in order to return their levels to what would be considered "normal" levels and thus alleviate the impact that can result from the changes in their amount. Examples of the techniques that can be used to control the level(s) of one or more miRNAs described herein include, but are not limited to, antisensing or sponging (e.g., microRNA sponges as described in Ebert and Shape. "MicroRNA sponges: Progress and possibilities" RNA (2010) 16:2043-2050; and Ebert et al. "MicroRNA sponges: Competitive inhibitors of small RNAs in mammalian cells" Nat. Methods (2007) 4: 721-726), decoying (e.g., as described in Swami M. "Small RNAs: Pseudogenes act as microRNA decoys." Nature Reviews Genetics (2010) 11: 530-531), overexpression, and/or any art-recognized techniques.

Additional information about antagonists or mimics of miRNAs described herein is described in the section "Pharmaceutical compositions" below.

Novel miRNA Sequences or Molecules Described Herein

The inventors have discovered a collection of novel microRNAs (miRNAs) of SEQ ID NO: 1 to SEQ ID NO: 47,972 in Tables 1-3 in a human genome, based on deep sequencing data using different tools and/or design methodology. The cardinality of the class of non-coding RNAs (ncRNAs) known as microRNAs or miRNAs has been a controversial issue for more than a decade. It was previously estimated that the number of human miRNAs would not exceed 300 (Lim et al. Science. 2003 Mar. 7; 299(5612): 1540). However, different methods that were used later provided higher, yet concordant, figures for the number of human miRNAs and their cardinality was estimated to be in the several tens of thousands. The miRBase repository has served as a widely-accepted public clearinghouse of miRNA sequences for vertebrates, invertebrates, viruses and plants. The database's latest release (Rel. 20) from 2013 contains ~2,600 human miRNA entries produced from ~1,800 miRNA precursors.

Tables 1-3 listing sequences of novel miRNAs of SEQ ID NO: 1 to SEQ ID NO: 47,972 are submitted and incorporated herein by reference in their entireties. Oligonucleotides comprising sequences complementary to the novel miRNAs listed in Tables 1-3 are also encompassed within the scope of the inventions described herein. By "complementary" is meant that an oligonucleotide can form hydrogen bond(s) with another oligonucleotide by either traditional Watson-Crick or other non-traditional types. The complementary oligonucleotides can be completely or partially complementary to the novel miRNA sequences listed in Tables 1-3. In some embodiments, partial complementarity is indicated by the percentage of contiguous residues in an oligonucleotide that can form hydrogen bonds (e.g., Watson-Crick base pairing) with a second oligonucleotide sequence (e.g., 5, 6, 7, 8, 9, 10 out of 10 being 50%, 60%, 70%, 80%, 90%, and 100% complementary). "Completely complementary" or 100% complementarity means that all the contiguous residues of an oligonucleotide sequence will form hydrogen bond with the same number of contiguous residues in a second oligonucleotide sequence. Less than perfect complementarity refers to the situation in which some, but not all, nucleotide units of two strands can hydrogen bond with each other.

Table 1 shows a listing of novel miRNAs of SEQ ID NO: 1 to SEQ ID NO: 19,754 that the inventors identified using their own designed methodology as described in Example 1. In Table 1, SEQ ID NO: 1 to SEQ ID NO: 9,877 contain miRNA sequences of mature form, while SEQ ID NO: 9,878 to SEQ ID NO: 19,754 contain sequences each having a hairpin sequence and a mature miRNA sequence.

Table 2 shows a listing of novel miRNAs of SEQ ID NO: 19,755 to SEQ ID NO: 27,168 that the inventors identified using a public tool called miRDeep2. MiRDeep2 (see Friedländer, M. R., et al., Nature Biotechnology, 2008, 26, 407-415, for methods of discovering microRNAs from deep sequencing data using miRDeep) follows a slightly different approach to finding miRNAs that is based on a multi-faceted scoring system. In an effort to be comprehensive, miRDeep2 was also used to discover miRNAs to complement the inventor's methodology (as described in Example 1). In Table 2, SEQ ID NO: 19,755 to SEQ ID NO: 23,461 contain miRNA sequences of mature form, while SEQ ID NO: 23,462 to SEQ ID NO: 27,168 contain sequences each having a hairpin sequence and a mature miRNA sequence.

Table 3 shows a listing of novel miRNAs of SEQ ID NO: 27,169 to SEQ ID NO: 47,972. These are variants or isomers of miRNAs, called isomiRs. The term "isomiR" generally refers to a miRNA who sequence is slightly different than the sequence of a known miRNA, e.g., a miRNA that is known in the public databases." However, this apparent difference could simply be because the "miRNA" is found in tissue X whereas the "isomiR" is found in tissue Y and it so happened that the tissue X was first studied. If tissue Y was first studied then what is called "isomiR" might have been called "miRNA" and vice versa.

In some instances, both the "miRNA" and the "isomiR" can be found in the same tissue but the isomiR has a lower expression than the miRNA. In some instances, tissues where what is commonly called as "miRNA" has lower expression than an "isomiR" from the same locus: in such examples, the labels of miRNA and isomiR can be used interchangeably. Accordingly, as used herein, the terms "miRNA" and "isomiR" are used herein interchangeably and will be making a distinction only if necessary to remove any ambiguities.

While the novel miRNA sequences listed in Tables 1-3 are from human genomes, many of these sequences are conserved in other species, e.g., but not limited to other primates such as Chimpanzee, Gorilla, Orangutan, and Macaque. Some human miRNA sequences as described herein are also conserved in mice, fruit-fly, and worms. See Example 2.

MicroRNAs (miRNAs) are small, non-coding RNA molecules that generally function as regulators of a genome. The terms "microRNA" or "miRNA" are used interchangeably herein, are generally endogenous RNAs, some of which are known to regulate the expression of protein-coding genes at the posttranscriptional level. As used herein, the term "microRNA" refers to any type of micro-interfering RNA, including but not limited to, endogenous microRNA and artificial or synthetic microRNA. Typically, endogenous microRNA are small RNAs encoded in the genome which are capable of modulating the productive utilization of mRNA. A mature miRNA is a single-stranded RNA molecule of about 21-23 nucleotides in length that is complementary to a target sequence and hybridizes to the target RNA sequence to inhibit expression of a (protein-coding or non-coding) gene which encodes a miRNA target sequence. miRNAs themselves are encoded by genes that are transcribed from DNA but not translated into protein (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression. MicroRNA sequences have been described in publications such as, Lim, et al., Genes & Development, 17, p. 991-1008 (2003), Lim et al Science 299, 1540 (2003), Lee and Ambros Science, 294, 862 (2001), Lau et al., Science 294, 858-861 (2001), Lagos-Quintana et al, Current Biology, 12, 735-739 (2002), Lagos Quintana et al, Science 294, 853-857 (2001), and Lagos-Quintana et al, RNA, 9, 175-179 (2003), which are incorporated by reference. Multiple microRNAs can also be incorporated into the precursor molecule.

A mature miRNA is produced as a result of a series of miRNA maturation steps; first a gene encoding the miRNA is transcribed. The gene encoding the miRNA is typically much longer than the processed mature miRNA molecule; miRNAs are first transcribed as primary transcripts or "pri-miRNA" with a cap and poly-A tail, which is subsequently processed to short, about 70-nucleotide "stem-loop structures" known as "pre-miRNA" in the cell nucleus. This processing is performed in animals by a protein complex known as the Microprocessor complex, consisting of the nuclease Drosha and the double-stranded RNA binding protein Pasha. These pre-miRNAs are then processed to mature miRNAs in the cytoplasm by interaction with the endonuclease Dicer, which also initiates the formation of the RNA-induced silencing complex (RISC). This complex is responsible for the gene silencing observed due to miRNA expression and RNA interference. The pathway is different for miRNAs derived from intronic stem-loops; these are processed by Drosha but not by Dicer. In some instances, a given region of DNA and its complementary strand can both function as templates to give rise to at least two miRNAs. Mature miRNAs can direct the cleavage of mRNA or they can interfere with translation of the mRNA, either of which results in reduced protein accumulation, rendering miRNAs capable of modulating gene expression and related cellular activities.

As discussed above, recent advances in next generation sequencing have complicated this picture by revealing that multiple distinct mature miRNA species, the isomiRs, can arise from the same miRNA precursor arm ("pre-miR"). The isomiRs typically differ from the mature miRNA sequences currently in public databases such as miRBase on either their 5' or 3' ends, thereby increasing the diversity and complexity of the miRNA-ome. IsomiRs, just like miRNAs, associate with the Argonaute complex. Accordingly, the terms "miRNA" and "isomiR" are used herein interchangeably and will be making a distinction only if necessary to remove any ambiguities.

The term "pri-miRNA" refers to a precursor to a mature miRNA molecule which comprises: (i) a microRNA sequence and (ii) stem-loop component which are both flanked (i.e. surrounded on each side) by "microRNA flanking sequences", where each flanking sequence typically ends in either a cap or poly-A tail. A pri-microRNA, (also referred to as large RNA precursors), are composed of any type of nucleic acid based molecule capable of accommodating the microRNA flanking sequences and the microRNA sequence. Examples of pri-miRNAs and the individual components of such precursors (flanking sequences and microRNA sequence) are provided herein. The nucleotide sequence of the pri-miRNA precursor and its stem-loop components can vary widely. In one embodiment, a pre-miRNA molecule can be an isolated nucleic acid; including microRNA flanking sequences and comprising a stem-loop structure and a microRNA sequence incorporated therein. A pri-miRNA molecule can be processed in vivo or in vitro to an intermediate species caller "pre-miRNA", which is further processed to produce a mature miRNA.

The term "pre-miRNA" refers to the intermediate miRNA species in the processing of a pri-miRNA to mature miRNA, where pri-miRNA is processed to pre-miRNA in the nucleus, whereupon pre-miRNA translocates to the cytoplasm where it undergoes additional processing in the cytoplasm to form mature miRNA. Pre-miRNAs are generally about 70 nucleotides long, but can be less than 70 nucleotides or more than 70 nucleotides.

The term "microRNA flanking sequence" as used herein refers to nucleotide sequences including microRNA processing elements. MicroRNA processing elements are the minimal nucleic acid sequences which contribute to the production of mature miRNA from precursor microRNA. Often these elements are located within a 40 nucleotide sequence that flanks a microRNA stem-loop structure. In some instances the microRNA processing elements are found within a stretch of nucleotide sequences of between 5 and 4,000 nucleotides in length that flank a microRNA stem-loop structure. Thus, in some embodiments the flanking sequences are 5-4,000 nucleotides in length. As a result, the length of the precursor molecule can be, in some instances at least about 150 nucleotides or 270 nucleotides in length. The total length of the precursor molecule, however, can be greater or less than these values. In other embodiments the minimal length of the microRNA flanking sequence is 10, 20, 30, 40, 50, 60, 70, 80, 90, 100, 150, 200 and any integer there between. In other embodiments the maximal length of the microRNA flanking sequence is 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900 4,000 and any integer there between.

MicroRNA flanking sequences can be native microRNA flanking sequences or artificial microRNA flanking sequences. A native microRNA flanking sequence is a nucleotide sequence that is ordinarily associated in naturally existing systems with microRNA sequences, i.e., these sequences are found within the genomic sequences surrounding the minimal microRNA hairpin in vivo. Artificial microRNA flanking sequences are nucleotides sequences that are not found to be flanking to microRNA sequences in naturally existing systems. microRNA flanking sequences within the pri-miRNA molecule can flank one or both sides of the stem-loop structure encompassing the microRNA sequence. Thus, one end (i.e., 5') of the stem-loop structure can be adjacent to a single flanking sequence and the other end (i.e., 3) of the stem-loop structure cannot be adjacent to a flanking sequence. Preferred structures have flanking sequences on both ends of the stein-loop structure. The flanking sequences can be directly adjacent to one or both ends of the stem-loop structure or can be connected to the stem-loop structure through a linker, additional nucleotides or other molecules.

A "stem-loop structure" refers to a nucleic acid having a secondary structure that includes a region of nucleotides which are known or predicted to form a double strand (stein portion) that is linked on one side by a region of predominantly single-stranded nucleotides (loop portion). The terms "hairpin" and "fold-back" structures are also used herein to refer to stem-loop structures. Such structures are well known in the art and the term is used consistently with its known meaning in the art. The actual primary sequence of nucleotides within the stem-loop structure is not critical to the practice of the invention as long as the secondary structure is present. As is known in the art, the secondary structure does not require exact base-pairing. Thus, the stem can include one or more base mismatches. Alternatively, the base-pairing can be exact, i.e. not include any mismatches. In some instances the precursor microRNA molecule can include more than one stein-loop structure. The multiple stem-loop structures can be linked to one another through a linker, such as, for example, a nucleic acid linker or by a microRNA flanking sequence or other molecule or some combination thereof.

The hairpin sequences in Tables 1 and 2 can provide information about novel miRNAs and the pre-miRNA that are believed to be responsible for the miRNAs production. The hairpin sequences of Tables 1 and 2 can be used in the same manner that one would use a pre-miRNA (e.g., similar preparation methods, similar delivery methods, similar application settings, similar detection methods).

Furthermore, miRNA-like stem-loops can be expressed in cells as a vehicle to deliver artificial or synthetic miRNAs for the purpose of modulating the expression of endogenous genes through the miRNA and/or RNAi pathways.

In some embodiments, the miRNAs described herein are miRNA mimetic. As used herein, the term "miRNA mimetic" refers to an artificial miRNA which is flanked by the appropriate sequences that will allow it to form the stem-loop like structures that are typical of a pri-miRNA.

The term "artificial microRNA" includes any type of RNA sequence, other than endogenous microRNA, which is capable of modulating the productive utilization of mRNA. For instance, the term artificial microRNA also encompasses a nucleic acid sequence which would be previously identified as siRNA, where the siRNA is incorporated into a vector and surrounded by miRNA flanking sequences as described herein.

In some embodiments, the term "miRNA" as used herein can encompass an oligonucleotide having a hairpin sequence and a mature miRNA sequence. In some embodiments, the term "miRNA" can encompass isomiR.

In some embodiments, the novel miRNA sequences described herein can encompass at least one or more nucleotide modifications, e.g., addition, deletion and/or substitutions of nucleotides, and/or modifications to the side groups and/or backbone of the nucleotides. Unmodified miRNA sequences can be less than optimal in some applications, e.g., unmodified miRNA sequences can be prone to degradation by e.g., cellular nucleases. However, chemical modifications to one or more of the subunits of the miRNA sequences can confer improved properties, e.g., can render miRNA sequences more stable to nucleases. Typical miRNA sequence modifications can include one or more of: (i) alteration, e.g., replacement, of one or both of the non-linking phosphate oxygens and/or of one or more of the linking phosphate oxygens in the phosphodiester intersugar linkage; (ii) alteration, e.g., replacement, of a constituent of the ribose sugar, e.g., of the 2' hydroxyl on the ribose sugar; (iii) wholesale replacement of the phosphate moiety with "dephospho" linkers; (iv) modification or replacement of a naturally occurring base with a non-natural base; (v) replacement or modification of the ribose-phosphate backbone, e.g. peptide nucleic acid (PNA); (vi) modification of the 3' end or 5' end of the oligonucleotide, e.g., removal, modification or replacement of a terminal phosphate group or conjugation of a moiety, e.g., conjugation of a ligand, to either the 3' or 5' end of oligonucleotide; and (vii) modification of the sugar, e.g., six membered rings.

The terms replacement, modification, alteration, and the like, as used in this context, do not imply any process limitation, e.g., modification does not mean that one must start with a reference or naturally occurring ribonucleic acid and modify it to produce a modified ribonucleic acid bur rather modified simply indicates a difference from a naturally occurring molecule. As described below, modifications, e.g., those described herein, can be provided as asymmetrical modifications.

Diseases or Disorders that can be Diagnosed, Prognosed, and/or Treated Using One or More Novel miRNAs Described Herein or Complementary Sequences Thereof In some aspects, different embodiments of the methods, assays, compositions, and systems described herein can be used for diagnosis and/or prognosis of a disease or disorder, and/or the state of the disease or disorder in a subject, e.g., a condition afflicting a certain tissue in a subject. In other aspects, different compositions described herein can be used for treatment of a disease or disorder in a subject. For example, the disease or disorder in a subject can be associated with breast, pancreas, blood, prostate, colon, lung, skin, brain, ovary, kidney, oral cavity, throat, cerebrospinal fluid, liver, or other tissues, and any combination thereof. Examples 7-8 shows differential expression of some of the novel miRNA sequences listed in Tables 1-3 in tissues of different states (e.g., disease states or cell states).

In some embodiments, diseases or disorders that can be diagnosed, prognosed, and/or treated using one or more novel miRNAs described herein or complementary sequences thereof can include conditions that are not terminal but can cause an interruption, disturbance, or cessation of a bodily function, system, or organ. Such examples of diseases or disorders can include, e.g., but are not limited to, developmental disorders (e.g., autism), brain disorders (e.g., epilepsy), mental disorders (e.g., depression), endocrine disorders (e.g., diabetes), heart diseases (e.g., cardiomyopathy), or skin disorders (e.g., skin inflammation).

In some embodiments, diseases or disorders that can be diagnosed, prognosed, and/or treated using one or more novel miRNAs described herein or complementary sequences thereof can include breast diseases or disorders. Exemplary breast disease or disorder includes breast cancer.

In some embodiments, diseases or disorders that can be diagnosed, prognosed, and/or treated using one or more novel miRNAs described herein or complementary sequences thereof can include pancreatic diseases or disorders. Nonlimiting examples of pancreatic diseases or disorders include acute pancreatitis, chronic pancreatitis, hereditary pancreatitis, pancreatic cancer (e.g., endocrine or exocrine tumors), etc., and any combinations thereof.

In some embodiments, diseases or disorders that can be diagnosed, prognosed, and/or treated using one or more novel miRNAs described herein or complementary sequences thereof can include blood diseases or disorders. Examples of blood diseases or disorders include, but are not limited to, platelet disorders, von Willebrand diseases, deep vein thrombosis, pulmonary embolism, sickle cell anemia, thalassemia, anemia, aplastic anemia, fanconi anemia, hemochromatosis, hemolytic anemia, hemophilia, idiopathic thrombocytopenic purpura, iron deficiency anemia, pernicious anemia, polycythemia vera, thrombocythemia and thrombocytosis, thrombocytopenia, and any combinations thereof.

In some embodiments, diseases or disorders that can be diagnosed, prognosed, and/or treated using one or more novel miRNAs described herein or complementary sequences thereof can include prostate diseases or disorders. Non-limiting examples of prostate diseases or disorders can include prostatis, prostatic hyperplasia, prostate cancer, and any combinations thereof.

In some embodiments, diseases or disorders that can be diagnosed, prognosed, and/or treated using one or more novel miRNAs described herein or complementary sequences thereof can include colon diseases or disorders. Exemplary colon diseases or disorders can include, but are not limited to, colorectal cancer, colonic polyps, ulcerative colitis, diverticulitis, and any combinations thereof.

In some embodiments, diseases or disorders that can be diagnosed, prognosed, and/or treated using one or more novel miRNAs described herein or complementary sequences thereof can include lung diseases or disorders. Examples of lung diseases or disorders can include, but are not limited to, asthma, chronic obstructive pulmonary disease, infections, e.g., influenza, pneumonia and tuberculosis, and lung cancer.

In some embodiments, diseases or disorders that can be diagnosed, prognosed, and/or treated using one or more novel miRNAs described herein or complementary sequences thereof can include skin diseases or disorders, or skin conditions. An exemplary skin disease or disorder can include skin cancer, e.g., melanoma; and psoriasis.

In some embodiments, diseases or disorders that can be diagnosed, prognosed, and/or treated using one or more novel miRNAs described herein or complementary sequences thereof can include brain diseases or disorders. Examples of brain diseases or disorders can include, but are not limited to, brain infections (e.g., meningitis, encephalitis, brain abscess), brain tumor, glioblastoma, stroke, ischemic stroke, multiple sclerosis (MS), vasculitis, and neurodegenerative disorders (e.g., Parkinson's disease, Huntington's disease, Pick's disease, amyotrophic lateral sclerosis (ALS), dementia, and Alzheimer's disease), and any combinations thereof.

In some embodiments, diseases or disorders that can be diagnosed, prognosed, and/or treated using one or more novel miRNAs described herein or complementary sequences thereof can include liver diseases or disorders. Examples of liver diseases or disorders can include, but are not limited to, hepatitis, cirrhosis, liver cancer, billary cirrhosis, primary sclerosing cholangitis, Budd-Chiari syndrome, hemochromatosis, transthyretin-related hereditary amyloidosis, Gilbert's syndrome, and any combinations thereof.

In other embodiments, diseases or disorders that can be diagnosed, prognosed, and/or treated using one or more novel miRNAs described herein or complementary sequences thereof can include cancer. Examples of cancers can include, but are not limited to, bladder cancer; breast cancer; brain cancer including glioblastomas and medulloblastomas; cervical cancer; choriocarcinoma; colon cancer including colorectal carcinomas; endometrial cancer; esophageal cancer; gastric cancer; head and neck cancer; hematological neoplasms including acute lymphocytic and myelogenous leukemia, multiple myeloma, AIDS associated leukemias and adult T-cell leukemia lymphoma; intraepithelial neoplasms including Bowen's disease and Paget's disease, liver cancer; lung cancer including small cell lung cancer and non-small cell lung cancer; lymphomas including Hodgkin's disease and lymphocytic lymphomas; neuroblastomas; oral cancer including squamous cell carcinoma; osteosarcomas; ovarian cancer including those arising from epithelial cells, stromal cells, germ cells and mesenchymal cells; pancreatic cancer; prostate cancer; rectal cancer; sarcomas including leiomyosarcoma, rhabdomyosarcoma, liposarcoma, fibrosarcoma, synovial sarcoma and osteosarcoma; skin cancer including melanomas, Kaposi's sarcoma, basocellular cancer, and squamous cell cancer; testicular cancer including germinal tumors such as seminoma, non-seminoma (teratomas, choriocarcinomas), stromal tumors, and germ cell tumors; thyroid cancer including thyroid adenocarcinoma and medullar carcinoma; transitional cancer and renal cancer including adenocarcinoma and Wilm's tumor.

In some embodiments, the methods, assays, kits, and systems described herein can be used for determining a given stage of cancer in a subject. The stage of a cancer generally describes the extent the cancer has progressed and/or spread. The stage usually takes into account the size of a tumor, how deeply the tumor has penetrated, whether the tumor has invaded adjacent organs, how many lymph nodes the tumor has metastasized to (if any), and whether the tumor has spread to distant organs. Staging of cancer is generally used to assess prognosis of cancer as a predictor of survival, and cancer treatment is primarily determined by staging. Thus, methods, systems, kits, and assays for determining a given stage of cancer in a subject are also provided herein. For example, such methods and assays can comprise detecting in a biological sample (e.g., a biopsy) the presence, absence or level of one or more miRNA sequences described herein.

In some embodiments, the cancer to be diagnosed or prognosed can be breast carcinoma. In such embodiments, the methods or assays described herein can be used to distinguish a cancerous breast tissue from a normal breast tissue, or identify a given stage of a cancerous breast tissue, e.g., ductal carcinoma in situ, lobular carcinoma in situ, invasive ductal carcinoma or a subtype, invasive lobular carcinoma, etc.

In some embodiments, the cancer to be diagnosed or prognosed can be pancreatic cancer. In such embodiments, the methods or assays described herein can be used to distinguish a cancerous pancreas tissue from a normal pancreas tissue, or identify a given state of a cancerous pancreas tissue, e.g., early-stage pancreatic cancer or late-stage pancreatic cancer.

In some embodiments, the methods, assays, kits, and systems described herein can be used for determining tissue origin of a biological sample from a subject. For example, the tissue origin of a biological sample from a subject can be determined based on comparison of the level(s) and/or profile of one or more miRNAs described herein in the biological sample with reference samples of different tissues. Example 3 shows tissue specificity of the novel miRNAs described herein that can be used to identify tissue origin of a biological sample.

By way of example only, in some embodiments, the methods, assays, kits, and systems described herein can be used to determine a primary origin of an unknown tumor or cancer. Thus, in some embodiments, the methods described herein can be used to determine whether the tumor is a primary tumor or a secondary tumor (i.e., a metastasis). For example, a biopsy of an unknown tumor can be subjected to the methods or assays described herein to determine the tissue origin of the tumor, wherein if the tissue origin of the tumor is determined to be the same tissue type as from where the biopsy is collected, the tumor is diagnosed as a primary tumor, or if the tissue origin of the tumor is determined to be different from the type of the tissue from where the biopsy is collected, the tumor is diagnosed as a secondary tumor (i.e., a metastasis). Thus, the methods described herein can be used to fingerprint a biological sample, e.g., whether it is a normal sample or a diseased sample (e.g., a cancerous sample).

For a subject who is determined to have, or is at risk of developing, or is at a given stage of cancer (e.g., breast carcinoma or pancreatic carcinoma), the subject can be administered or prescribed with an anti-cancer treatment, e.g., chemotherapy, radiation therapy, surgery, immunotherapy, RNA therapeutics (e.g., siRNAs, miRNAs), or any combinations thereof.

In some embodiments, a subject in need thereof can be administered with an antagonist or a mimic of one or more of the miRNA sequences selected from SEQ ID NO: 1 to SEQ ID NO: 47,972 in Tables 1-3, depending on whether the subject is diagnosed to have an overexpression or a deficiency of one or more miRNA sequences determined to be associated with a condition or disorder. Additional information about antagonists or mimics of miRNAs described herein is described in the section "Pharmaceutical compositions" below.

Exemplary Methods for Detecting One or More miRNA Sequences Described Herein

One or more miRNA sequence(s) can be detected by any methods known in the art, including, but not limited to, Sanger sequencing, nucleic acid amplification (e.g., polymerase chain reaction (PCR), and real-time quantitative PCR), northern blot, nucleic acid hybridization (e.g., microarray), in situ hybridization, serial analysis of gene expression (SAGE), cap analysis gene expression (CAGE) and massively parallel signature sequencing (MPSS), next generation sequencing (including deep sequencing, e.g., sequencing with deep coverage), direct multiplexing, etc., and any combinations thereof.

Methods for performing SAGE to detect RNAs have been previously described in Velculescu, V. E. et al. "Serial Analysis of Gene Expression." Science (1995) 270: 484-487; and Saha S. et al. "Characterization of the yeast transcriptome" Cell (1997) 88: 243-251, and exemplary SAGE protocols can be accessed at sagenet.org/protocol/index.htm. Methods for performing CAGE to detect RNAs has been previously described, e.g., in Kodzius R. et al. "CAGE: cap analysis of gene expression" Nature Methods (2006) 3: 211-222. Methods for performing MPSS to detect RNAs can be found, e.g., in Brenner, S. et al. "Gene expression analysis by massively parallel signature sequencing (MPSS) on microbead arrays" Nature Biotechnology (2000) 18: 630-634.

In some embodiments, the INVADER® assay (Third Wave Technologies Inc., Madison, Wis.) can be modified and used to detect miRNA sequences in a biological sample. The INVADER® assay is generally a homogeneous, isothermal, signal amplification system for the quantitative detection of nucleic acids. The assay can directly detect either DNA or RNA without target amplification or reverse transcription. It is based on the ability of Cleavase® enzymes to recognize as a substrate and cleave a specific nucleic acid structure generated through the hybridization of two oligonucleotides to the target sequence. Modification of the INVADER® assay for miRNA sequence detection has been previously described, e.g., in de Arruda, M. et al. "Invader technology for DNA and RNA analysis: Principles and applications" Expert Rev. Mol. Diagn (2002) 2: 487-496; Eis, P. S. et al. "An invasive cleavage assay for direct quantitation of specific RNAs" Nat. Biotechnol. (2001) 19: 673-676; and Allawi H. T. et al. "Quantitation of microRNAs using a modified Invader assay" RNA (2004) 10: 1153-1161.

Next-generation sequencing (NGS) is a novel approach for the detection and sequencing of DNA or RNA molecules as reviewed, e.g., in Voelkerding K. V. et al. "Next-Generation Sequencing: From Basic Research to Diagnostics" Clinical Chemistry (2009) 55: 641-658; Metzker M. L. "Sequencing technologies—the next generation" Nature Reviews (2010) 11: 31-46; Zhang J. et al. "The impact of next-generation sequencing on genomics" J. Genet Genomics (2011) 38: 95-109; and Pareek C. S. et al. "Sequencing technologies and genome sequencing" J. Appl Genetics (2011) 52: 413-435. Various commercial NGS instruments and reagent kits for high-throughput next-generation sequencing have been developed and used for RNA-sequencing. For example, exemplary NGS instruments that can be used for RNA-sequencing or deep sequencing of RNA can include, but are not limited to, the GS FLX sequencer (based on pyrosequencing) from 454 Life Sciences now part of ROCHE Diagnostics [http://www.454.com/], the Genome Analyzer (based on polymerase-based sequence-by-synthesis) from Illumina [http://www.illumina.com], the SOLiD™ System (based on ligation-based sequencing) from Applied Biosystems [http://www.appliedbiosystems.com/absite/us/en/home/applications-technologies/solid-next-generation-sequencing/next-generation-systems.html], and the HeliScope™ Single Molecule Sequencer from Helicos BioScience [http://www.helicosbio.com/].

Other NGS or higher-generation sequencing methods based on single-molecule sequencing (without PCR amplification) can also be used to detect miRNA sequences or molecules in some embodiments of the methods, assays, and systems described herein. Examples of single-molecule sequencing methods can include, but are not limited to, Ion Torrent (pH sensing), nanopore sequencing, and transmission electron microscope (TEM) for sequencing. See, e.g., Perkel, J. "Making contact with Sequencing's Fourth Generation" BioTechniques (2011): 50:93-95.

Systems and Computer Readable Media for Determination of a Given State of a Cell or Tissue Another aspect provided herein relates to systems (and non-transitory computer readable media for causing computer systems), e.g., to perform a method for determining a given state and/or condition of a cell or a tissue sample, and/or to perform the methods of various aspects described herein, based on determining presence and/or absence and/or level(s) of one or more miRNA sequence described herein. In some embodiments, the systems and computer readable media described herein can be used to diagnose and/or prognose a condition or a stage of the condition in a subject.

FIG. 1A depicts a device or a computer system 10 comprising one or more processors 20 and a memory 50 storing one or more programs 70 for execution by the one or more processors 20.

In some embodiments, the device or computer system 10 can further comprise a non-transitory computer-readable storage medium 200 storing the one or more programs 70 for execution by the one or more processors 20 of the device or computer system 10.

In some embodiments, the device or computer system 10 can further comprise one or more input devices 90, which can be configured to send or receive information to or from any one from the group consisting of: an external device (not shown), the one or more processors 20, the memory 50, the non-transitory computer-readable storage medium 200, and one or more output devices 130.

In some embodiments, the device or computer system 10 can further comprise one or more output devices 130, which can be configured to send or receive information to or from any one from the group consisting of: an external device (not shown), the one or more processors 20, the memory 50, and the non-transitory computer-readable storage medium 200.

In some embodiments, the device or computer system 10 for determining a given state and/or condition of a cell or tissue sample (biological sample) comprises:

one or more processors; and memory to store one or more programs, the one or more programs comprising instructions for:

(i) measuring in a biological sample the level(s) of one or more miRNA sequences selected from SEQ ID NO: 1 to SEQ ID NO: 47,972 listed in Tables 1-3; and (ii) comparing the measured level(s) of one or more miRNA sequences to that of at least one or more reference samples to determine any significant alteration or difference in the level(s) of the miRNAs between the biological sample and the reference sample(s); and (iii) displaying a content based in part on the data output from (ii), wherein the content comprises a signal indicative of a subject having, or being at risk of developing, or being at a given stage of a disease or disorder, or a signal indicative of no sign of the disease or disorder.

Figure 1B:
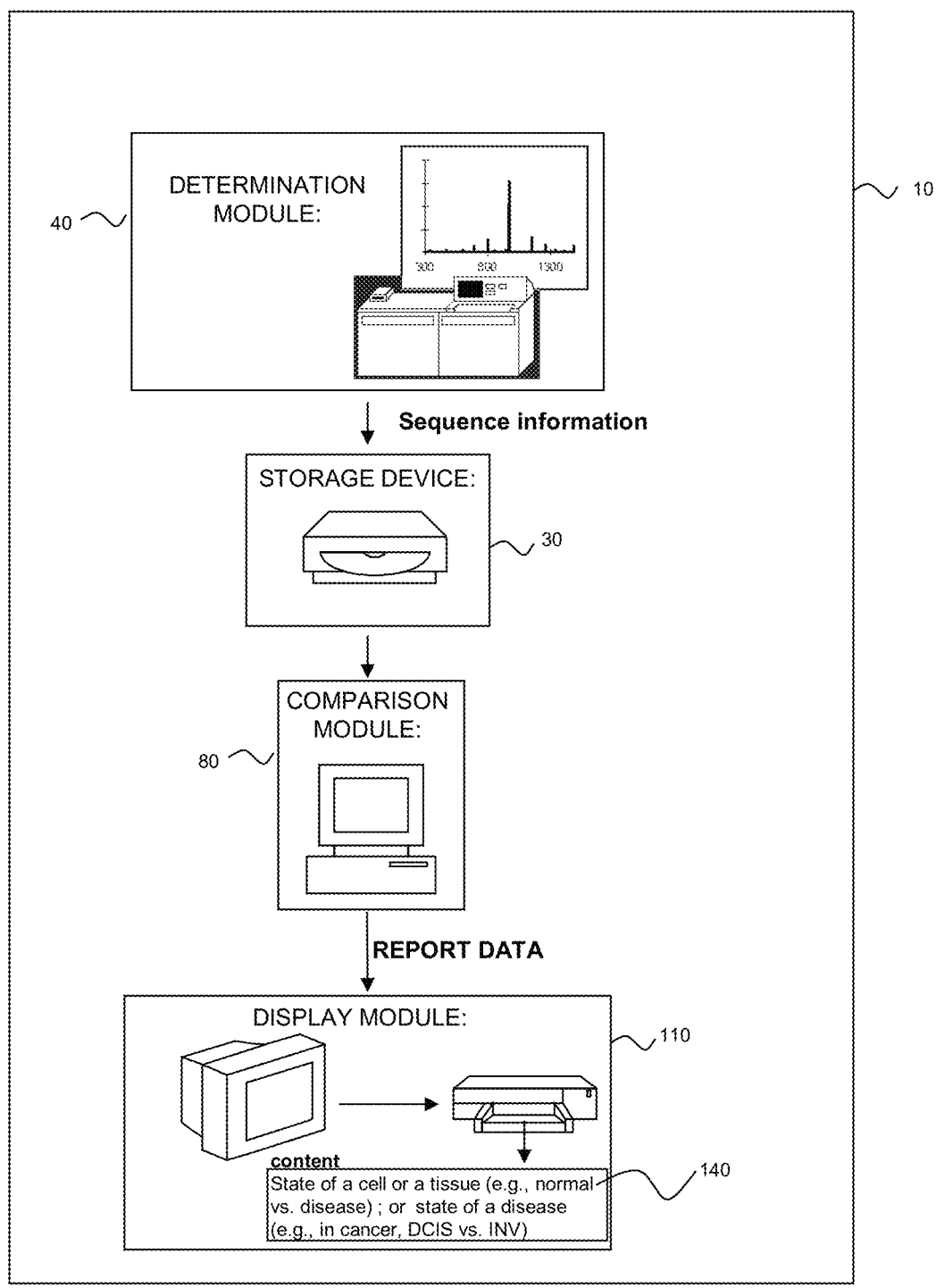
Figure 2:
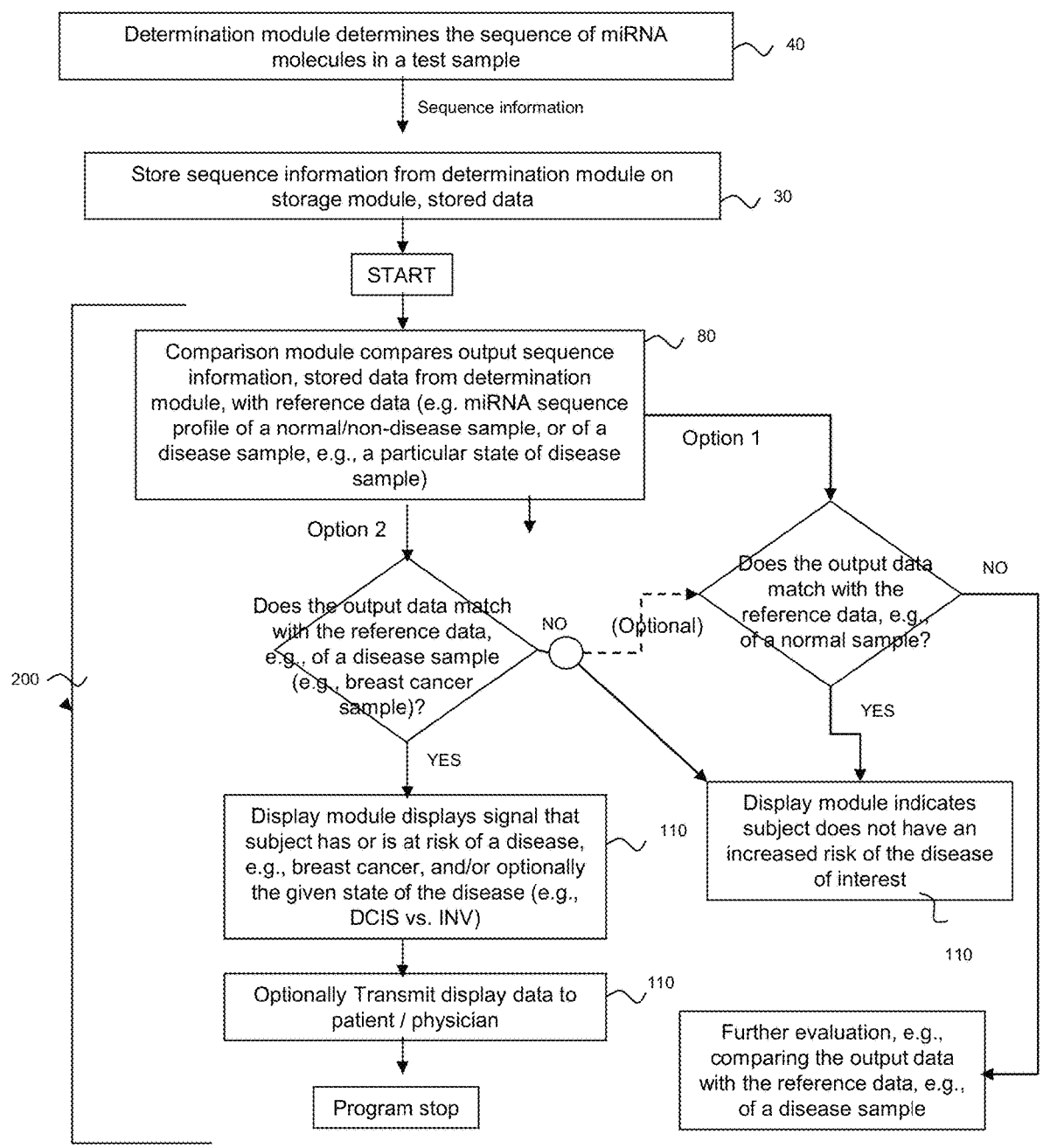
FIG. 2 is a block diagram showing exemplary instructions on a computer readable medium for determining a state of a cell or a tissue and/or for diagnosing or prognosing a disease or disorder, or a stage of a disease or disorder in a subject, based on expression level of one or more novel miRNAs described herein.

FIG. 1B depicts a device or a system (e.g., a computer system) for obtaining data from at least one biological sample obtained from one or more subjects. Accordingly, a system for analyzing a biological sample is provided herein. The system can be used to diagnose or prognose a condition or state of a condition in a subject. The system 10 comprises:

(a) a determination module 40 configured to receive a biological sample and to determine sequence information, wherein the sequence information comprises a sequence of at least one or more miRNA molecules from the biological sample; (b) a storage device 30 configured to store sequence information from the determination module 40; (c) a comparison module 80 adapted to compare the sequence information stored on the storage device with reference data, and to provide a comparison result, wherein the comparison result identifies the presence or absence or level(s) of the miRNA molecule(s), wherein a discrepancy in an expression level of the miRNA molecule(s) from the reference data is indicative of the biological sample having an increased likelihood of having or being at a cellular or tissue state different from a state represented by the reference data; and (d) a display module 110 for displaying a content based in part on the comparison result for the user, wherein the content is a signal indicative of a subject having, or being at risk of developing, or being at a given stage of a disease or disorder, or a signal indicative of lacking a disease or disorder.

A tangible and non-transitory (e.g., no transitory forms of signal transmission) computer readable medium 200 having computer readable instructions recorded thereon to define software modules for implementing a method on a computer is also provided herein. In some embodiments, the software modules can include a comparison module and a display module for implementing a method on a computer. In some embodiments, the computer-readable medium 200 stores one or more programs for determining a given state of a condition of a cell or tissue (a biological sample). In some embodiments, the computer-readable medium 200 stores one or more programs for determining a condition or state of a condition of a subject. The one or more programs for execution by one or more processors of a computer system comprises (a) instructions for comparing the measured miRNA data (from a biological sample) stored on a storage device with reference data to provide a comparison result, wherein the comparison result the comparison result identifies the presence or absence (or difference in levels) of the miRNA molecule(s), wherein a discrepancy in level(s) of the miRNA molecule(s) from the reference data is indicative of the biological sample having an increased likelihood of having or being at a cellular or tissue state different from a state represented by the reference data; and (b) instructions for displaying a content based in part on the comparison result for the user, wherein the content is a signal indicative of a subject having, or being at risk of developing, or being at a given stage of a disease or disorder, or a signal indicative of lacking a disease or disorder.

Embodiments provided herein have been described through functional modules, which are defined by computer executable instructions recorded on computer readable media and which cause a computer to perform method steps when executed. The modules have been segregated by function for the sake of clarity. However, it should be understood that the modules need not correspond to discrete blocks of code and the described functions can be carried out by the execution of various code portions stored on various media and executed at various times. Furthermore, it should be appreciated that the modules may perform other functions, thus the modules are not limited to having any particular functions or set of functions.

Computing devices typically include a variety of media, which can include computer-readable storage media and/or communications media, in which these two terms are used herein differently from one another as follows. Computer-readable storage media or computer readable media (e.g., 200) can be any available tangible media (e.g., tangible storage media) that can be accessed by the computer, is typically of a non-transitory nature, and can include both volatile and nonvolatile media, removable and non-removable media. By way of example, and not limitation, computer-readable storage media can be implemented in connection with any method or technology for storage of information such as computer-readable instructions, program modules, structured data, or unstructured data. Computer-readable storage media can include, but are not limited to, RAM (random access memory), ROM (read only memory), EEPROM (erasable programmable read only memory), flash memory or other memory technology, CD-ROM (compact disc read only memory), DVD (digital versatile disk) or other optical disk storage, magnetic cassettes, magnetic tape, magnetic disk storage or other magnetic storage devices, or other tangible and/or non-transitory media which can be used to store desired information. Computer-readable storage media can be accessed by one or more local or remote computing devices, e.g., via access requests, queries or other data retrieval protocols, for a variety of operations with respect to the information stored by the medium.

On the other hand, communications media typically embody computer-readable instructions, data structures, program modules or other structured or unstructured data in a data signal that can be transitory such as a modulated data signal, e.g., a carrier wave or other transport mechanism, and includes any information delivery or transport media. The term "modulated data signal" or signals refers to a signal that has one or more of its characteristics set or changed in such a manner as to encode information in one or more signals. By way of example, and not limitation, communication media include wired media, such as a wired network or direct-wired connection, and wireless media such as acoustic, RF, infrared and other wireless media.

In some embodiments, the computer readable storage media 200 can include the "cloud" system, in which a user can store data on a remote server, and later access the data or perform further analysis of the data from the remote server.

Computer-readable data embodied on one or more computer-readable media, or computer readable medium 200, can define instructions, for example, as part of one or more programs, that, as a result of being executed by a computer, instruct the computer to perform one or more of the functions described herein (e.g., in relation to system 10, or computer readable medium 200), and/or various embodiments, variations and combinations thereof. Such instructions may be written in any of a plurality of programming languages, for example, Java, J#, Visual Basic, C, C#, C++, Fortran, Pascal, Eiffel, Basic, COBOL assembly language, and the like, or any of a variety of combinations thereof. The computer-readable media on which such instructions are embodied may reside on one or more of the components of either of system 10, or computer readable medium 200 described herein, can be distributed across one or more of such components, and may be in transition there between.

The computer-readable media can be transportable such that the instructions stored thereon can be loaded onto any computer resource to implement the aspects provided herein. In addition, it should be appreciated that the instructions stored on the computer readable media, or computer-readable medium 200, described above, are not limited to instructions embodied as part of an application program running on a host computer. Rather, the instructions can be embodied as any type of computer code (e.g., software or microcode) that can be employed to program a computer to implement various aspects described herein. The computer executable instructions can be written in a suitable computer language or combination of several languages. Basic computational biology methods are known to those of ordinary skill in the art and are described in, for example, Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Baxevanis Bioinformatics: A Practical Guide for Analysis of Gene and Proteins (Wiley & Sons, Inc., 2nd ed., 2001).

The functional modules of certain embodiments provided herein include a determination module, a storage device, a comparison module and a display module. The functional modules can be executed on one, or multiple, computers, or by using one, or multiple, computer networks. The determination module 40 has computer executable instructions to provide sequence information in computer readable form. As used herein, "sequence information" refers to any nucleotide sequence, including but not limited to full-length sequence, partial sequence, or mutated sequences. Moreover, information "related to" the sequence information includes detection of the presence or absence of a miRNA sequence, determination of the expression level of a miRNA sequence in a biological sample, and the like. In some embodiments, the sequence information can include sequences of any miRNA molecules present in a biological sample. In some embodiments, the sequence information can include sequences of miRNA molecules. In other embodiments, the sequence information can include sequences of miRNA molecules described herein, miRNA molecules, piRNA molecules, mRNA molecules, or any combinations thereof. In some embodiments, the sequence information can include sequences of miRNA molecules present in a biological sample, and a genomic sequence of one or more protein-coding genes.

As an example, determination modules 40 for determining sequence information can include known systems for automated sequence analysis, including but not limited to, Hitachi FMBIO® and Hitachi FMBIO® II Fluorescent Scanners (available from Hitachi Genetic Systems, Alameda, Calif.); Spectrumedix® SCE 9610 Fully Automated 96-Capillary Electrophoresis Genetic Analysis Systems (available from SpectruMedix LLC, State College, Pa.); ABI PRISM® 377 DNA Sequencer, ABI® 373 DNA Sequencer, ABI PRISM® 310 Genetic Analyzer, ABI PRISM® 3100 Genetic Analyzer, and ABI PRISM® 3700 DNA Analyzer (available from Applied Biosystems, Foster City, Calif.); Molecular Dynamics FluorImager™ 575, SI Fluorescent Scanners, and Molecular Dynamics FluorImager™ 595 Fluorescent Scanners (available from Amersham Biosciences UK Limited, Little Chalfont, Buckinghamshire, England); GenomyxSC™ DNA Sequencing System (available from Genomyx Corporation (Foster City, Calif.); and Pharmacia ALF™ DNA Sequencer and Pharmacia ALFexpress™ (available from Amersham Biosciences UK Limited, Little Chalfont, Buckinghamshire, England); any next- or higher-generation sequencing instruments such as, but not limited to, GF GLX Titanium, G S Junior (available from 454 Life Sciences, part of Roche Diagnostic Corporation, Branford, Conn.); HiSeq 2000, Genome Analyzer IIX, Genome Analyzer IIE, iScan SQ (available from Illumina, San Diego, Calif.); ABI SOLiD™ system (e.g., SOLiD4 platform available from Life Technologies, Applied Biosystems, Carlsbad, Calif.); HeliScope™ Single Molecule Sequencer (available from Helicos Biosciences Corporation, Cambridge, Mass.); and PACBIO RS (available from Pacific Biosciences, Menlo Park, Calif.).

Alternative methods for determining sequence information, i.e., determination modules 40, include systems for nucleic acid analysis. For example, mass spectrometry systems including Matrix Assisted Laser Desorption Ionization-Time of Flight (MALDI-TOF) systems and SELDI-TOF-MS ProteinChip array profiling systems; systems for analyzing gene expression data (see, for example, published U.S. Patent Application, Pub. No. U.S. 2003/0194711); systems for array based expression analysis: e.g., HT array systems and cartridge array systems such as GeneChip® AutoLoader, Complete GeneChip® Instrument System, GeneChip® Fluidics Station 450, GeneChip® Hybridization Oven 645, GeneChip® QC Toolbox Software Kit, GeneChip® Scanner 3000 7G plus Targeted Genotyping System, GeneChip® Scanner 3000 7G Whole-Genome Association System, GeneTitan™ Instrument, and GeneChip® Array Station (each available from Affymetrix, Santa Clara, Calif.); Densitometers (e.g. X-Rite-508-Spectro Densitometer® (available from RP Imaging™, Tucson, Ariz.), The HYRYS™ 2 HIT densitometer (available from Sebia Electrophoresis, Norcross, Ga.); automated Fluorescence in situ hybridization systems (see for example, U.S. Pat. No. 6,136,540); 2D gel imaging systems coupled with 2-D imaging software; microplate readers; Fluorescence activated cell sorters (FACS) (e.g. Flow Cytometer FACS-Vantage SE, (available from Becton Dickinson, Franklin Lakes, N.J.); and radio isotope analyzers (e.g. scintillation counters).

The sequence information determined in the determination module can be read by the storage device 30. As used herein the "storage device" 30 is intended to include any suitable computing or processing apparatus or other device configured or adapted for storing data or information. Examples of electronic apparatus suitable for use with various embodiments described herein can include stand-alone computing apparatus, data telecommunications networks, including local area networks (LAN), wide area networks (WAN), Internet, Intranet, and Extranet, and local and distributed computer processing systems. Storage devices 30 also include, but are not limited to: magnetic storage media, such as floppy discs, hard disc storage media, magnetic tape, optical storage media such as CD-ROM, DVD, electronic storage media such as RAM, ROM, EPROM, EEPROM and the like, general hard disks and hybrids of these categories such as magnetic/optical storage media. The storage device 30 is adapted or configured for having recorded thereon sequence information or expression level information. Such information may be provided in digital form that can be transmitted and read electronically, e.g., via the Internet, on diskette, via USB (universal serial bus) or via any other suitable mode of communication.

As used herein, "expression level information" refers to any nucleotide expression level information, including but not limited to full-length nucleotide sequences, partial nucleotide sequences, or mutated sequences. Moreover, information "related to" the expression level information includes detection of the presence or absence of a sequence (e.g., presence or absence of a nucleotide sequence), determination of the concentration of a sequence in the sample (e.g., nucleotide (RNA or DNA) expression levels), and the like.

As used herein, "stored" refers to a process for encoding information on the storage device 30. Those skilled in the art can readily adopt any of the presently known methods for recording information on known media to generate manufactures comprising the sequence information or expression level information.

A variety of software programs and formats can be used to store the sequence information or expression level information on the storage device. Any number of data processor structuring formats (e.g., text file or database) can be employed to obtain or create a medium having recorded thereon the sequence information or expression level information.

By providing sequence information or expression level information in computer-readable form, one can use the sequence information or expression level information in readable form in the comparison module 80 to compare a specific sequence or expression profile with the reference data within the storage device 30. In some embodiments, the comparison module 80 can also include bioinformatics analysis tools for next-generation sequencing data (e.g., short-read sequence data). Examples of bioinformatics analysis tools for next-generation sequencing (NGS) data can include any commercial NGS analysis packages that are compatible with the sequenced reads obtained from the NGS instrument. The NGS analysis package can include a sequence mapping tool for mapping sequences (e.g., short-read sequences) to a reference genome, sequence assembly tool for de novo assembly of overlapping reads to form contiguous nucleic acid sequence, a genome browser, and any combinations thereof. Examples of short-read alignment tools for mapping miRNA sequences to a reference genome can include, without limitations, Bfast, BioScope, Bowtie, Burrows-Wheeler Aligner (BWA), CLC bio, CloudBurst, Eland/Eland2, Exonerate, GenomeMapper, GnuMap, Karma, MAQ, MOM, Mosaik, MrFAST/MrsFAST, NovoAlign, PASS, PerM, RazerS, RMAP, SSAHA2, Segemehl, SeqMap, SHRiMP, Slider/Sliderll, SOAP/SOAP2, Srprism, Stampy, vmatch, ZOOM and any art-recognized alignment tools that can be used to align short-read sequences to a reference genome. In one embodiment, Burrows-Wheeler Aligner (BWA) can be used to map miRNA sequences to a reference genome (e.g., a human genome). Examples of sequence assembly tools include, but are not limited to, ABySS, ALLPATHS, Edena, Euler-SR, SHARCGS, SHARP, SSAKE, Velvet and any other art-recognized assembly tools. Different genome browsers can be used to visualize genomic maps, e.g., generated after sequence alignment to a reference genome.

In one embodiment, the comparison module 80 uses sequence information alignment programs such as BLAST (Basic Local Alignment Search Tool) or FAST (using the Smith-Waterman algorithm) that may be employed individually or in combination. These algorithms determine the alignment between similar regions of sequences and a percent identity between sequences.

In some embodiments, the comparison module can include a pattern recognition pattern that can be pre-trained with different reference data sets such as data sets comprising profiles of miRNA sequences obtained from different state of a tissue (e.g., normal data set vs. diseased or abnormal data set; or data sets corresponding to different stages of a disease or disorder and a normal data set).

Accordingly, in some embodiments, the comparison module can compare a profile of miRNA sequences of a biological sample determined by the determination module 40 to reference data stored on the storage device 30, and classify the biological sample into a specific state (e.g., normal, diseased or abnormal, and/or a given stage of a disease or disorder). For example, comparison programs can be used to compare an expression level of a miRNA sequence in a biological sample to a reference data expression level (e.g., sequence data from a control/reference sample described herein) and/or profiles of miRNA sequences in a biological sample to reference data expression profiles (e.g., sequence data from a control/reference sample described herein). The comparison made in computer-readable form provides a computer readable comparison result, which can be processed by a variety of means. Content 140 based on the comparison result can be retrieved from the comparison module 80 to indicate a given state of a cell or a tissue, and/or whether a subject has, or is at risk of developing of a disease or disorder, or a given state of the disease or disorder.

In one embodiment, the reference data stored in the storage device 30 to be read by the comparison module 80 is sequence information data obtained from a reference sample described herein or a control biological sample of the same type as the biological sample to be tested. Alternatively, the reference data are a database, e.g., a collection of sequence information data obtained from a plurality of reference samples described herein and control biological samples of the same type as the biological sample to be tested. For example, reference data can include profiles of miRNA sequences that are indicative of a given state of a cell or tissue and/or a disease or disorder of interest or a given state of the disease or disorder. In one embodiment, the reference data can include sequence information of miRNA sequences and/or profiles of miRNA sequences that are indicative of a disease or disorder of interest, e.g., a disease or disorder afflicting a tissue, and or different stages of a disease or disorder of interest, e.g., different stages of cancer. By way of example only, reference data stored in a system for diagnosing and/or prognosing breast cancer can include, but not limited to, (a) profile(s) of miRNA sequences obtained from one or a group of normal subjects, (b) profile(s) of miRNA sequences obtained from one or a group of subjects having a given stage of breast cancer (e.g., DCIS, lobular carcinoma in situ, INV, etc.); (c) profile(s) of miRNA obtained from a normal tissue of the test subject, profile(s) of miRNA sequences obtained from a diseased or abnormal tissue of the test subject that was previously diagnosed, and any combinations thereof.

In one embodiment, the reference data are electronically or digitally recorded and annotated from databases including, but not limited to GenBank (NCBI) protein and DNA databases such as genome, ESTs, SNPS, Traces, Celara, Ventor Reads, Watson reads, HGTS, and the like; Swiss Institute of Bioinformatics databases, such as ENZYME, PROSITE, SWISS-2DPAGE, Swiss-Prot and TrEMBL databases; the Melanie software package or the ExPASy WWW server, and the like; the SWISS-MODEL, Swiss-Shop and other network-based computational tools; the Comprehensive Microbial Resource database (available from The Institute of Genomic Research). The resulting information can be stored in a relational database that may be employed to determine homologies between the reference data or genes or proteins within and among genomes.

The "comparison module" 80 can use a variety of available software programs and formats for the comparison operative to compare sequence information determined in the determination module 40 to reference data. In one embodiment, the comparison module 80 is configured to use pattern recognition techniques to compare sequence information from one or more entries to one or more reference data patterns. The comparison module 80 can be configured using existing commercially-available or freely-available software for comparing patterns, and may be optimized for particular data comparisons that are conducted. The comparison module 80 provides computer readable information related to the sequence information that can include, for example, detection of the presence or absence of a miRNA sequence; determination of the concentration of a miRNA sequence in the sample, or determination of an expression profile.

The comparison module 80, or any other module described herein, may include an operating system (e.g., UNIX) on which runs a relational database management system, a World Wide Web application, and a World Wide Web server. World Wide Web application includes the executable code necessary for generation of database language statements (e.g., Structured Query Language (SQL) statements). Generally, the executables will include embedded SQL statements. In addition, the World Wide Web application may include a configuration file, which contains pointers and addresses to the various software entities that comprise the server as well as the various external and internal databases which must be accessed to service user requests. The Configuration file also directs requests for server resources to the appropriate hardware—as may be necessary should the server be distributed over two or more separate computers. In one embodiment, the World Wide Web server supports a TCP/IP protocol. Local networks such as this are sometimes referred to as "Intranets." An advantage of such Intranets is that they allow easy communication with public domain databases residing on the World Wide Web (e.g., the GenBank or Swiss Pro World Wide Web site). Thus, in a particular preferred embodiment provided herein, users can directly access data (via Hypertext links for example) residing on Internet databases using a HTML interface provided by Web browsers and Web servers. In one embodiment, users can access data residing on Cloud storage.

Various algorithms or software packages are available which are useful for comparing and analyzing sequence information and/or expression data determined in the determination module 40. For example, various software packages for next-generation sequencing (NGS) analysis are available in the commercial and/or public domains. Exemplary software packages for NGS analysis can include, without limitations, sequence alignment tools as discussed above; de novo alignment and/or assembly tools as discussed above; integrated solutions, such as CLCbio Genomics Workbench, Galaxy, Genomatix, JMP Genomics, NExt-GENE, SeqMan Genome Analyzer, SHORE, SlimSearch; genome browser (including alignment viewer and/or assembly database) such as EagleView, LookSeq, MapView, Sequence Assembly Manager, STADEN, XMatchView; software packages for transciptomics such as ERANGE, S-Mo.R-Se, MapNext, QPalma, RSAT, TopHat; or any combinations thereof.

In some embodiments, when the sequence information is determined by microarray-based methods, various software packages for microarray analysis can be used, e.g., but not limited to, GeneChip® Sequence Analysis Software (GSEQ), GeneChip® Targeted Genotyping Analysis Software (GTGS) and Expression Console™ Software. Accordingly, depending on methods used to produce sequence information in the determination module 40, various sequence analysis software can be used.

In one embodiment described herein, pattern comparison software is used to compare an expression profile of miRNA sequences to a reference data for determining a given state of a cell or tissue, or whether the expression profiled obtained from a test subject is indicative of a disease or disorder, or a given state of a disease or disorder.

The comparison module 80 provides computer readable comparison result that can be processed in computer readable form by predefined criteria, or criteria defined by a user, to provide a content based in part on the comparison result that may be stored and output as requested by a user using a display module 110. The display module 110 enables display of a content 140 based in part on the comparison result for the user, wherein the content 140 is a signal indicative of a subject having, or being at risk of developing or being at a given stage of a disease or disorder, or a signal indicative of the subject having no risk of the disease or disorder. Such signal, can be for example, a display of content 140 indicative of the presence or absence of increased risk for a disease or disorder, or a given state of a disease or disorder on a computer monitor, a printed page of content 140 indicating the presence or absence of increased risk for a given state of a disease or disorder from a printer, or a light or sound indicative of the presence or absence of increased risk for a given state of a disease or disorder.

The content 140 based on the comparison result can include an expression profile of one or more miRNA sequences determined from the test subject. In one embodiment, the content 140 based on the comparison result can include a comparison of the miRNA expression profile between the test subject and one or more reference samples described herein. In one embodiment, the content 140 based on the comparison result is merely a signal indicative of the presence or absence of an increased risk of a given state of a disease or disorder.

In one embodiment provided herein, the content 140 based on the comparison result is displayed a on a computer monitor. In one embodiment, the content 140 based on the comparison result is displayed through printable media. The display module 110 can be any suitable device configured to receive from a computer and display computer readable information to a user. Non-limiting examples include, for example, general-purpose computers such as those based on INTEL® processor, QUALCOMM® processors, Sun Microsystems processors, Hewlett-Packard processors, any of a variety of processors available from Advanced Micro Devices (AMD) of Sunnyvale, Calif., or any other type of processors (including mobile processors), visual display devices such as tablet computers, flat panel displays, cathode ray tubes and the like, as well as computer printers of various types.

In one embodiment, a World Wide Web browser is used for providing a user interface for display of the content 140 based on the comparison result. It should be understood that other modules described herein can be adapted to have a web browser interface. Through the Web browser, a user may construct requests for retrieving data from the comparison module. Thus, the user will typically point and click to user interface elements such as buttons, pull down menus, scroll bars and the like conventionally employed in graphical user interfaces. The requests formulated with the user's Web browser are transmitted to a Web application which formats them to produce a query that can be employed to extract the pertinent information related to the sequence information, e.g., but not limited to, display of nucleotide (RNA or DNA) expression levels; or display of information based thereon.

In one embodiment, the sequence information of the reference sample data is also displayed.

In one embodiment, the display module 110 displays the comparison result based on sequence information and whether the comparison result is indicative of a disease or disorder, or a given stage of a disease or disorder. For example, in the case of diagnosis of breast cancer, the display module 110 can display the comparison result based on determined sequence information and whether the comparison results is indicative of breast cancer, or a particular stage of breast cancer (e.g., duct carcinoma in situ, lobular carcinoma in situ, invasive, etc.).

In one embodiment, the content 140 based on the comparison result that is displayed is a signal (e.g. positive or negative signal) indicative of the presence or absence of an increased risk for a disease or disorder, or a given stage of the disease or disorder, thus only a positive or negative indication may be displayed.

In any embodiments, the comparison module can be executed by a computer implemented software as discussed earlier. In such embodiments, a result from the comparison module can be displayed on an electronic display. The result can be displayed by graphs, numbers, characters or words. In additional embodiments, the results from the comparison module can be transmitted from one location to at least one other location. For example, the comparison results can be transmitted via any electronic media, e.g., internet, fax, phone, a "cloud" system, and any combinations thereof. Using the "cloud" system, users can store and access personal files and data or perform further analysis on a remote server rather than physically carrying around a storage medium such as a DVD or thumb drive.

Each of the above identified modules or programs corresponds to a set of instructions for performing a function described above. These modules and programs (i.e., sets of instructions) need not be implemented as separate software programs, procedures or modules, and thus various subsets of these modules may be combined or otherwise re-arranged in various embodiments. In some embodiments, memory may store a subset of the modules and data structures identified above. Furthermore, memory may store additional modules and data structures not described above.

The illustrated aspects of the disclosure may also be practiced in distributed computing environments where certain tasks are performed by remote processing devices that are linked through a communications network. In a distributed computing environment, program modules can be located in both local and remote memory storage devices.

Moreover, it is to be appreciated that various components described herein can include electrical circuit(s) that can include components and circuitry elements of suitable value in order to implement the embodiments of the subject innovation(s). Furthermore, it can be appreciated that many of the various components can be implemented on one or more integrated circuit (IC) chips. For example, in one embodiment, a set of components can be implemented in a single IC chip. In other embodiments, one or more of respective components are fabricated or implemented on separate IC chips.

What has been described above includes examples of the embodiments of the present invention. It is, of course, not possible to describe every conceivable combination of components or methodologies for purposes of describing the claimed subject matter, but it is to be appreciated that many further combinations and permutations of the subject innovation are possible. Accordingly, the claimed subject matter is intended to embrace all such alterations, modifications, and variations that fall within the spirit and scope of the appended claims. Moreover, the above description of illustrated embodiments of the subject disclosure, including what is described in the Abstract, is not intended to be exhaustive or to limit the disclosed embodiments to the precise forms disclosed. While specific embodiments and examples are described herein for illustrative purposes, various modifications are possible that are considered within the scope of such embodiments and examples, as those skilled in the relevant art can recognize.

In particular and in regard to the various functions performed by the above described components, devices, circuits, systems and the like, the terms used to describe such components are intended to correspond, unless otherwise indicated, to any component which performs the specified function of the described component (e.g., a functional equivalent), even though not structurally equivalent to the disclosed structure, which performs the function in the herein illustrated exemplary aspects of the claimed subject matter. In this regard, it will also be recognized that the innovation includes a system as well as a computer-readable storage medium having computer-executable instructions for performing the acts and/or events of the various methods of the claimed subject matter.

The aforementioned systems/circuits/modules have been described with respect to interaction between several components/blocks. It can be appreciated that such systems/circuits and components/blocks can include those components or specified sub-components, some of the specified components or sub-components, and/or additional components, and according to various permutations and combinations of the foregoing. Sub-components can also be implemented as components communicatively coupled to other components rather than included within parent components (hierarchical). Additionally, it should be noted that one or more components may be combined into a single component providing aggregate functionality or divided into several separate sub-components, and any one or more middle layers, such as a management layer, may be provided to communicatively couple to such sub-components in order to provide integrated functionality. Any components described herein may also interact with one or more other components not specifically described herein but known by those of skill in the art.

In addition, while a particular feature of the subject innovation may have been disclosed with respect to only one of several implementations, such feature may be combined with one or more other features of the other implementations as may be desired and advantageous for any given or particular application. Furthermore, to the extent that the terms "includes," "including," "has," "contains," variants thereof, and other similar words are used in either the detailed description or the claims, these terms are intended to be inclusive in a manner similar to the term "comprising" as an open transition word without precluding any additional or other elements.

As used in this application, the terms "component," "module," "system," or the like are generally intended to refer to a computer-related entity, either hardware (e.g., a circuit), a combination of hardware and software, software, or an entity related to an operational machine with one or more specific functionalities. For example, a component may be, but is not limited to being, a process running on a processor (e.g., digital signal processor), a processor, an object, an executable, a thread of execution, a program, and/or a computer. By way of illustration, both an application running on a controller and the controller can be a component. One or more components may reside within a process and/or thread of execution and a component may be localized on one computer and/or distributed between two or more computers. Further, a "device" can come in the form of specially designed hardware; generalized hardware made specialized by the execution of software thereon that enables the hardware to perform specific function; software stored on a computer-readable medium; or a combination thereof.

In view of the exemplary systems described above, methodologies that may be implemented in accordance with the described subject matter will be better appreciated with reference to the flowcharts of the various figures. For simplicity of explanation, the methodologies are depicted and described as a series of acts. However, acts in accordance with this disclosure can occur in various orders and/or concurrently, and with other acts not presented and described herein. Furthermore, not all illustrated acts may be required to implement the methodologies in accordance with the disclosed subject matter. In addition, those skilled in the art will understand and appreciate that the methodologies could alternatively be represented as a series of interrelated states via a state diagram or events. Additionally, it should be appreciated that the methodologies disclosed in this specification are capable of being stored on an article of manufacture to facilitate transporting and transferring such methodologies to computing devices. The term article of manufacture, as used herein, is intended to encompass a computer program accessible from any computer-readable device or storage media.

Provided herein therefore relates to systems 10 (and computer readable medium 200 for causing computer systems) to perform methods for determining a given stage of a cell or a tissue, and/or whether a subject has, or is at risk of developing, or is at a given stage of a disease, e.g., cancer, or disorder, based on expression profiles of miRNA sequences.

System 10, and computer readable medium 200, are merely an illustrative embodiments provided herein for performing methods of determining whether an individual has a specific disease or disorder or a pre-disposition, for a specific disease or disorder based on expression profiles or sequence information, and are not intended to limit the scope described herein. Variations of system 10, and computer readable medium 200, are possible and are intended to fall within the scope described herein.

The modules of the machine, or used in the computer readable medium, may assume numerous configurations. For example, function may be provided on a single machine or distributed over multiple machines.

Reference Sample(s) or Reference Data

As used herein, a reference sample can include a normal or negative control, alternatively a disease (or disorder) or positive control, against which biological samples can be compared. Therefore, it can be determined whether the biological sample to be evaluated for a specific disease or disorder, or a stage of a disease or disorder, has measurable difference or substantially no difference, as compared to a reference sample. A normal or healthy sample or tissue refers to a sample or tissue that does not have a disease or disorder to be evaluated.

The reference sample can be obtained from the patient to be diagnosed or prognosed, or from a different subject, who is preferably of same age and/or race.

In one embodiment, the reference sample can be obtained from the same patient at the same time that the biological sample is taken. In one embodiment, the reference sample can be taken from a normal and/or healthy tissue of the same patient. In one embodiment, the reference sample can be taken from a normal and/or healthy tissue, for example tissue taken adjacent to the cancer, such as within 1 or 2 cm diameter from the leading front of the tumor. Alternatively, the reference sample can be taken from an equivalent position in the subject's body, for example in the case of breast cancer, a reference sample can be taken from any area of the breast which is not cancerous. In another embodiment, the reference sample can be a disease or abnormal sample taken previously from the same patient, against which a new biological sample can be compared to provide an evaluation of the therapeutic treatment efficacy.

In one embodiment, the reference sample can be a sample taken previously, e.g., a sample of the same or a different cancer/tumor, the comparison of which can, for example, provide characterization of the source of the new tumor, and/or progression or development of an existing cancer, such as before, during or after therapeutic treatment. For example, the reference sample can be obtained from a different patient, e.g., it can be a control sample, or a collection of control samples, representing different stages or different types of diseases or disorders. In one embodiment, the reference sample can be a control sample or a collection of control samples, representing different stages of a specific cancer (e.g., cancer staging samples) or different types of cancer, for example those listed herein (i.e., cancer reference samples). Comparison of the biological sample data with data obtained from such cancer staging or cancer reference samples can, for example, allow for the characterization of the assessed cancer to a specific stage and/or type of cancer.

Depending on various applications, the reference sample can comprise a sample derived from a tissue type that is same as or different from the tissue type of a biological sample. In some embodiments wherein the tissue origin of a biological sample is unknown, the level(s) and/or profile of the miRNA present in the biological sample can be compared to a set of reference samples of different tissue origins in order to identify the tissue origin of the biological sample. In some embodiments where the tissue origin of a biological sample is known or believed to be known (e.g., while a tissue biopsy is known to be collected from a lung tissue, the sample can comprise cells originated from breast due to metastasis), the reference sample(s) can comprise a sample of the same tissue type as the biological sample, and/or a sample of a different tissue type from the biological sample. By comparison between the biological sample and reference sample(s), tissue origin of the biological sample can be validated and/or identified.

As used herein, the term "reference data" refers to data obtained from a reference sample as described herein, or a collection of reference samples as described herein.

Biological Sample of a Subject and Preparation Thereof

A "biological sample" subjected to analysis using the methods, assays and systems described herein generally refers to a sample taken or isolated from a subject or a biological organism. In some embodiments, the biological sample contains one or more cells, e.g., tissue culture mammalian cells, cell lysate, a tissue sample from a subject, a homogenate of a tissue sample from a subject or a fluid sample from a subject. Exemplary biological samples include, but are not limited to, blood (including whole blood, serum, cord blood, and plasma), sputum, urine, spinal fluid, pleural fluid, nipple aspirates, lymph fluid, the external sections of the skin, respiratory, intestinal, and genitourinary tracts, tears, saliva, milk, feces, sperm, cells or cell cultures, serum, leukocyte fractions, smears, tissue samples of all kinds, embryos, etc. The term also includes both a mixture of the above-mentioned samples such as whole human blood containing a cell. The term "biological sample" also includes untreated or pretreated (or pre-processed) biological samples.

A "biological sample" can contain at least one cell or a plurality of cells from a subject. In some embodiments, the biological sample can contain one or more somatic cells from a subject. In other embodiments, the biological sample can contain one or more germ cells from a subject. In other embodiments, the biological sample can contain one or more stem cells from a subject.

In one embodiment, the biological sample can contain one or more cells from a subject's biological fluid sample. Examples of biological fluids include, but are not limited to, saliva, bone marrow, blood, serum, plasma, urine, sputum, cerebrospinal fluid, an aspirate, tears, and any combinations thereof.

For example, the biological sample can contain one or more circulating tumor cells from a subject's blood (including whole blood, serum, cord blood, and plasma). In some embodiments, the biological sample can contain at least one type of blood cells (e.g., red blood cells, white blood cells, platelets).

In one embodiment, the biological sample can contain one or more cells derived from any tissue of a subject, e.g., a tissue suspected of being at risk of, or being afflicted with a given stage of a disease or a disorder. Non-limiting examples of a tissue can include, but are not limited to, breast, pancreas, blood, prostate, colon, lung, skin, brain, ovary, kidney, oral cavity, throat, liver, and any combinations thereof. In some embodiments, the tissue can be obtained from a resection, biopsy, or core needle biopsy. In addition, fine needle aspirate samples can be used. Samples can be either paraffin-embedded or frozen tissue.

The biological sample can be obtained by removing a sample of cells from a subject, but can also be accomplished by using previously isolated cells (e.g. isolated by another person). In addition, the biological sample can be freshly collected or a previously collected sample.

In some embodiments, the biological sample is a frozen biological sample, e.g., a frozen tissue or fluid sample such as urine, blood, serum or plasma. The frozen sample can be thawed before employing methods, assays and systems described herein. After thawing, a frozen sample can be centrifuged before being subjected to methods, assays and systems described herein.

In some embodiments, a biological sample can be a nucleic acid product derived from a tissue (e.g., fresh/frozen and paraffin-embedded) or a fluid sample (e.g., blood) of a subject or cultured cells. The nucleic acid product can include DNA, RNA, mRNA, miRNA, piRNA, siRNA, snRNA, miRNA molecules described herein, and any combinations thereof. In some embodiments, the nucleic acid product can comprise one or more miRNA molecules described herein.

In some embodiments, a biological sample can include RNA isolated from a tissue (e.g., fresh or frozen or paraffin-embedded) or a fluid sample (e.g., blood) of a subject or cultured cells. Nucleic acid and ribonucleic acid (RNA) molecules can be isolated from a particular biological sample using any of a number of procedures, which are well-known in the art, the particular isolation procedure chosen being appropriate for the particular biological sample. For example, freeze-thaw and alkaline lysis procedures can be useful for obtaining nucleic acid molecules from solid materials; heat and alkaline lysis procedures can be useful for obtaining nucleic acid molecules from urine; and proteinase K extraction can be used to obtain nucleic acid from blood (Roiff, A et al. PCR: Clinical Diagnostics and Research, Springer (1994)).

In one embodiment, a biological sample can include RNA isolated from a tissue (e.g., fresh or frozen or paraffin-embedded) by any known methods in the art. When the RNA sample is deemed to be of good quality (according to one of skill in the art), the sample can be subjected to further treatment, following recommended instructions as provided by various commercial RNA preparation kits available for RNA sequencing (e.g., the kits from Life Technologies). Depending on the length of RNA molecules of interest, in some embodiments, the RNA sample can be subjected to miRNA sequencing. In other embodiments, the RNA sample can be subjected to long RNA sequencing.

In some embodiments, a biological sample can be an enriched RNA fraction derived from a tissue (e.g., fresh/frozen and paraffin-embedded) or a fluid sample (e.g., blood) of a subject or cultured cells, e.g., an RNA fraction enriched for non-coding RNAs. This can be achieved, for example, by removing mRNAs by use of affinity purification, e.g., using an oligodT column or any other art-recognized methods such as using commercial small RNA isolation kits.

In some embodiments, a biological sample can be a nucleic acid product or an RNA fraction amplified after polymerase chain reaction (PCR) or after reverse transcription-PCR. The nucleic acid product can include DNA (e.g., cDNA), RNA and mRNA and can be isolated from a particular biological sample using any of a number of procedures, which are well known in the art, the particular isolation procedure chosen being appropriate for the particular biological sample. Methods of isolating and analyzing nucleic acid variants as described above are well known to one skilled in the art and can be found, for example in the Molecular Cloning: A Laboratory Manual, 3rd Ed., Sambrook and Russel, Cold Spring Harbor Laboratory Press, 2001.

In some embodiments, the biological sample can be treated with a chemical and/or biological reagent. Chemical and/or biological reagents can be employed to protect and/or maintain the stability of the sample, including biomolecules (e.g., nucleic acids) therein, during processing. One exemplary reagent is an RNase inhibitor or RNA stabilizer, which is generally used to protect or maintain the stability of RNA during processing. In addition, or alternatively, chemical and/or biological reagents can be employed to release nucleic acid (e.g., miRNA molecules) from the biological sample.

The skilled artisan is well aware of methods and processes appropriate for pre-processing of biological samples required for determination of nucleic acid including miRNA molecules as described herein.

In some embodiments, a biological sample used for determining the level of one or more miRNAs can be a sample containing circulating miRNAs, e.g., extracellular miRNAs. Extracellular miRNAs freely circulate in a wide range of biological material, including bodily fluids, such as fluids from the circulatory system, e.g., a blood sample or a lymph sample, or from another bodily fluid such as cerebrospinal fluid (CSF), urine or saliva. Accordingly, in some embodiments, the biological sample used for determining the level of one or more miRNAs can be a bodily fluid, for example, blood, fractions thereof, serum, plasma, urine, saliva, tears, sweat, semen, vaginal secretions, lymph, bronchial secretions, CSF, etc. In some embodiments, the sample is a sample that is obtained non-invasively.

Circulating miRNAs include miRNAs in cells (cellular miRNA), extracellular miRNAs in microvesicles (microvesicle-associated miRNA), and extracellular miRNAs that are not associated with cells or microvesicles (extracellular, non-vesicular miRNA).

The biological sample is generally obtained from a subject who has or is suspected of having a disease or disorder, e.g., a condition afflicting a tissue, or who is suspected of having a risk of developing a disease or disorder, e.g., a condition afflicting a tissue. In some embodiments, the biological sample can be obtained from a subject who has or is suspected of having cancer, or who is suspected of having a risk of developing cancer. By way of example only, in one embodiment, the biological sample can be obtained from a subject who has or is suspected of having breast cancer, or who is suspected of having a risk of breast cancer. In another embodiment, the biological sample can be obtained from a subject who has or is suspected of having pancreatic cancer, or who is suspected of having a risk of pancreatic cancer.

In some embodiments, the biological sample can be obtained from a subject who is being treated for the disease or disorder, e.g., but not limited to, cancer such as breast cancer or pancreatic cancer. In other embodiments, the biological sample can be obtained from a subject whose previously-treated disease or disorder, e.g., but not limited to, cancer such as breast cancer or pancreatic cancer, is in remission. In other embodiments, the biological sample can be obtained from a subject who has a recurrence of a previously-treated disease or disorder, e.g., but not limited to, cancer such as breast cancer or pancreatic cancer.

As used herein, a "subject" can mean a human or an animal. Examples of subjects include primates (e.g., humans, and monkeys). Usually the animal is a vertebrate such as a primate, rodent, domestic animal or game animal. Primates include chimpanzees, cynomologous monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, and avian species, e.g., chicken, emu, ostrich. A patient or a subject includes any subset of the foregoing, e.g., all of the above, or includes one or more groups or species such as humans, primates or rodents. In certain embodiments of the aspects described herein, the subject is a mammal, e.g., a primate, e.g., a human. The terms, "patient" and "subject" are used interchangeably herein. A subject can be male or female. The term "patient" and "subject" does not denote a particular age. Thus, any mammalian subjects from adult to newborn subjects, as well as fetuses, are intended to be covered.

In one embodiment, the subject or patient is a mammal. The mammal can be a human, non-human primate, mouse, rat, dog, cat, horse, or cow, but are not limited to these examples. In one embodiment, the subject is a human being. In another embodiment, the subject can be a domesticated animal and/or pet. In some embodiments, the subject is a human.

Pharmaceutical Compositions and Administration Methods

In some embodiments, a subject in need thereof, e.g., whose level(s) of one or more miRNAs (as selected from SEQ ID NO: 1 to SEQ ID NO: 47,972 in Tables 1-3) in a biological sample are determined to be over-expressed or under-expressed, can be administered with a miRNA-related therapeutic. In some embodiments, the miRNA-related therapeutic is an antagonist against a target miRNA that inhibit the function of the target miRNA. As used herein, the term "antagonist" is used in the broadest sense, and includes any molecule that partially or fully blocks, inhibits, or neutralizes a biological activity of a microRNA disclosed herein. Suitable antagonist molecules specifically include, but are not limited to antisense oligonucleotides, small organic molecules, aptamers, etc. Methods for identifying antagonists of a microRNA can comprise contacting a target microRNA with a candidate antagonist molecule and measuring a detectable change in one or more biological activities normally associated with the microRNA. Accordingly, one aspect provides a pharmaceutical composition comprising an antagonist against one or more miRNAs selected from SEQ ID NO: 1 to SEQ ID NO: 47,972 in Tables 1-3.

In some embodiments, the miRNA-related therapeutic is a mimic of a target miRNA that induces or restores the function of the target miRNA. As used herein, the term "mimic" refers to a molecule (e.g., an oligonucleotide) that is capable of mimicking the activity of a miRNA molecule. In some embodiments, a miRNA mimic is a molecule (e.g., an oligonucleotide) that is capable of mimicking at least about 30% or above (including, e.g., at least about 40%, at least about 50%, at least about 60%, at least about 70%, at least about 80%, at least about 90%, at least about 95%, at least about 97%, at least about 99%, or up to 100%) of the activity of a miRNA molecule. Accordingly, a pharmaceutical composition comprising a mimic of one or more miRNAs selected from SEQ ID NO: 1 to SEQ ID NO: 47,972 in Tables 1-3 is also provided herein. In some embodiments, the pharmaceutical composition can comprise engineered transcripts that can "sponge" various combinations of the miRNAs described herein, or any combinations thereof.

In some embodiments, the miRNA mimics can be a double-stranded and/or blunt-ended oligonucleotide, which means the oligonucleotide is double-stranded throughout the molecule and/or blunt-ended on both ends. In some embodiments, the miRNA mimics can be a single-strand oligonucleotide. In some embodiments, the single-stranded oligonucleotide can comprise a hairpin structure. Methods of making miRNA mimics are known in the art, e.g., as described in the International Patent Publication No. WO 2012/106586, which is incorporated herein by reference.

In some embodiments where the miRNA antagonists or miRNA mimics comprise an oligonucleotide, the oligonucleotide can be modified. For example, in some embodiments, the backbone of the oligonucleotides described herein can be modified, e.g., to stabilize the oligonucleotides for in vivo delivery. For example, the modified backbone of the oligonucleotides can comprise morpholino subunits, phosphorothioate subunits, locked nucleic acid (LNA), peptide nucleic acid (PNC), hexitol nucleic acid (HNA), or any combinations thereof. See, e.g., Singh Y. et al. Chem. Soc. Rev., 2010, 39, 2054-2070 for additional information about various examples of oligonucleotide backbones.

Additionally or alternatively, the oligonucleotides can be modified for a desired property, e.g., improved cell delivery, cell-targeting delivery, and/or enhanced stability. By way of example only, the oligonucleotides can be modified by conjugating it to a delivery-targeting moiety. As used herein, the term "delivery-targeting moiety" refers to a moiety that can facilitate binding of an oligonucleotide to the outer surface of a cell and/or uptake or endocytosis of the oligonucleotide into the cell. Any art-recognized delivery-targeting moiety, e.g., but not limited to, antibodies, peptides, proteins, aptamers, dendrimers, and molecules, can be used. In some embodiments, the delivery-targeting moiety is a cell surface receptor ligand. As used herein, a "cell surface receptor ligand" refers to a molecule that can bind to the outer surface of a cell. Exemplary, cell surface receptor ligand includes, for example, a cell surface receptor binding peptide, a cell surface receptor binding glycopeptide, a cell surface receptor binding protein, a cell surface receptor binding glycoprotein, a cell surface receptor binding organic compound, and a cell surface receptor binding drug.

Cell surface receptor ligands include, but are not limited to, cytokines, growth factors, hormones, antibodies, and angiogenic factors.

In some embodiments, the delivery-targeting moiety can also refer to a molecule that binds to or interacts with a target molecule. Typically the nature of the interaction or binding is noncovalent, e.g., by hydrogen, electrostatic, or van der Waals interactions, however, binding may also be covalent.

In some embodiments, the delivery-targeting moiety can include an endosomolytic ligand. As used herein, the term "endosomolytic ligand" refers to molecules having endosomolytic properties. Endosomolytic ligands promote the lysis of and/or transport of the composition of the invention, or its components, from the cellular compartments such as the endosome, lysosome, endoplasmic reticulum (ER), Golgi apparatus, microtubule, peroxisome, or other vesicular bodies within the cell, to the cytoplasm of the cell. Some exemplary endosomolytic ligands include, but are not limited to, imidazoles, poly or oligoimidazoles, linear or branched polyethyleneimines (PEIs), linear and branched polyamines, e.g. spermine, cationic linear and branched polyamines, polycarboxylates, polycations, masked oligo or poly cations or anions, acetals, polyacetals, ketals/polyketals, orthoesters, linear or branched polymers with masked or unmasked cationic or anionic charges, dendrimers with masked or unmasked cationic or anionic charges, polyanionic peptides, polyanionic peptidomimetics, pH-sensitive peptides, natural and synthetic fusogenic lipids, natural and synthetic cationic lipids.

In some embodiments, the delivery-targeting moiety can include a PK modulating ligand and/or PK modulator. As used herein, the terms "PK modulating ligand" and "PK modulator" refers to molecules which can modulate the pharmacokinetics (PK) of the composition described herein. Some exemplary PK modulator include, but are not limited to, lipophilic molecules, bile acids, sterols, phospholipid analogues, peptides, protein binding agents, vitamins, fatty acids, phenoxazine, aspirin, naproxen, ibuprofen, suprofen, ketoprofen, (S)-(+)-pranoprofen, carprofen, PEGs, biotin, and transthyretia-binding ligands (e.g., tetraiidothyroacetic acid, 2, 4, 6-triiodophenol and flufenamic acid).

In some embodiments, the oligonucleotides described herein can be conjugated to a molecule in any methods known in the art. By way of example only, the oligonucleotides can be conjugated in the following methods: (i) peptide-oligonucleotide conjugates (POCs); (ii) carbohydrate-oligonucleotide conjugates (COCs); (iii) lipophilic oligonucleotide conjugates (LOCs); (iv) metal complex-oligonucleotide conjugates (MCOCs); (v) nanoparticle-oligonucleotide conjugates (NOCs); (vi) these can include bifunctional oligonucleotides, which have one domain that hybridizes to target RNA and a second domain that attracts activator proteins; (vii) peptide-conjugated oligonucleotides, which can be fused to a peptide domain consisting of cationic and hydrophobic residues that facilitates cell entry; (viii) cell penetrating peptide-oligonucleotide; and (ix) any combinations thereof. See, e.g., Singh Y. et al. Chem. Soc. Rev., 2010, 39, 2054-2070 for additional information about some conjugation methods of oligonucleotides to a molecule.

In some embodiments, the oligonucleotides can be conjugated to a carrier molecule. In some embodiments, a carrier molecule can be a natural or synthetic polymer. For example, a carrier molecule can be cholesterol or an RNA aptamer and the like. A carrier molecule can be conjugated to the oligonucleotides at the 5' and/or 3' end, or at the 5' and/or 3' end of one of the strands, or at an internal nucleotide position.

In some embodiments, one or two strands of the oligonucleotides can be encoded by or delivered with a viral vector. A variety of viral vectors know in the art can be modified to express or carry an oligonucleotide into a target cell, for example herpes simplex virus-1 or lentiviral vectors have been used to enhance the delivery of siRNA.

In some embodiments, an oligonucleotide can be associated with a non-viral vector. Non-viral vectors can be coupled to targeting and delivery enhancing moieties, such as antibodies, various polymers (e.g., PEG), fusogenic peptides, linkers, cell penetrating peptides and the like. Non-viral vectors include, but are not limited to liposomes and lipoplexes, polymers and peptides, synthetic particles and the like. In some embodiments, a liposome or lipoplex has a neutral, negative or positive charge and can comprise cardolipin, anisamide-conjugated polyethylene glycol, diolcoyl phosphatidylcholine, or a variety of other neutral, anionic, or cationic lipids or lipid conjugates. siRNAs can be complexed to cationic polymers (e.g., polyethylenimine (PEI)), biodegradable cationic polysaccharide (e.g., chitosan), or cationic polypeptides (e.g., atelocollagen, poly lysine, and protamine).

In some embodiments, oligonucleotide delivery can be enhanced by targeting the oligonucleotide to a cell. Targeting moieties can be conjugated to a variety of delivery compositions and provide selective or specific binding to a target cell(s). Targeting moieties can include, but are not limited to moieties that bind to cell surface receptors, cell specific extracellular polypeptide, saccharides or lipids, and the like. For example, small molecules such as folate, peptides such as RGD containing peptides, and antibodies such as antibodies to epidermal growth factor receptor can be used to target specific cell types.

In some embodiments, oligonucleotide delivery can be enhanced by moieties that interact with cellular mechanisms and machinery, such as uptake and intracellular trafficking. In certain aspects cell penetrating peptides (CPPs) (e.g., TAT and MPG from HIV-1, penetratin, polyarginine can be coupled with an siRNA or a delivery vector to enhance delivery into a cell. Fusogenic peptides (e.g., endodomain derivatives of HIV-1 envelope (HGP) or influenza fusogenic peptide (diINF-7)) can also be used to enhance cellular delivery.

A variety of delivery systems such as cholesterol-siRNA, RNA aptamers-siRNA, adenoviral vector, lentiviral vector, stable nucleic acid lipid particle (SNALP), cardiolipin analog-based liposome, DSPE-polyethylene glycol-DOTAP-cholesterol liposome, hyaluronan-DPPE liposome, neutral DOPC liposome, atelocollagen, chitosan, polyethylenimine, poly-lysine, protamine, RGD-polyethylene glycol-polyethylenimine, HER-2 liposome with histidine-lysine peptide, HIV antibody-protamine, arginine, oligoarginine(9R) conjugated water soluble lipopolymer (WSLP), oligoarginine (15R), TAT-PAMAM, cholesterol-MPG-8, DOPE-cationic liposome, GALA peptide-PEG-MMP-2 cleavable peptide-DOPE and the like have been used to enhance the delivery of siRNA.

As described in detail below, the pharmaceutical compositions described herein can be specially formulated for administration in solid or liquid form, including those adapted for the following: (1) oral administration, for example, drenches (aqueous or non-aqueous solutions or suspensions), gavages, lozenges, dragees, capsules, pills, tablets (e.g., those targeted for buccal, sublingual, and systemic absorption), boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) transmucosally; (9) nasally; or (10) intrathecally. Additionally, one or more REST E2- and/or E3-skipping modulating agents can be implanted into a patient or injected using a drug delivery system. See, for example, Urquhart, et al., Ann. Rev. Pharmacol. Toxicol. 24: 199-236 (1984); Lewis, ed. "Controlled Release of Pesticides and Pharmaceuticals" (Plenum Press, New York, 1981); U.S. Pat. No. 3,773,919; and U.S. Pat. No. 35 3,270,960, content of all of which is herein incorporated by reference.

As used here, the term "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alchols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

The amount of oligonucleotide which can be combined with a carrier material to produce a single dosage form will generally be that amount of the compound which produces a therapeutic effect. Generally out of one hundred percent, this amount will range from about 0.1% to 99% of oligonucleotide, preferably from about 5% to about 70%, most preferably from 10% to about 30%.

Toxicity and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compositions that exhibit large therapeutic indices are preferred. As used herein, the term ED denotes effective dose and is used in connection with animal models. The term EC denotes effective concentration and is used in connection with in vitro models.

The data obtained from the cell culture assays and animal studies can be used in formulating a range of dosage for use in humans. The dosage of such compounds lies preferably within a range of circulating concentrations that include the ED50 with little or no toxicity. The dosage can vary within this range depending upon the dosage form employed and the route of administration utilized.

The therapeutically effective dose can be estimated initially from cell culture assays. A dose can be formulated in animal models to achieve a circulating plasma concentration range that includes the IC50 (i.e., the concentration of the therapeutic which achieves a half-maximal inhibition of symptoms) as determined in cell culture. Levels in plasma can be measured, for example, by high performance liquid chromatography. The effects of any particular dosage can be monitored by a suitable bioassay.

The dosage can be determined by a physician and adjusted, as necessary, to suit observed effects of the treatment. For example, a therapeutic dose range for the miRNA mimics can be 0.01-5.0 mg of miRNA per kg of patient body weight (mg/kg).

With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment or make other alteration to treatment regimen. The dosing schedule can vary from once a week to daily depending on a number of clinical factors, such as the subject's sensitivity to the polypeptides. The desired dose can be administered everyday or every third, fourth, fifth, or sixth day. The desired dose can be administered at one time or divided into subdoses, e.g., 2-4 subdoses and administered over a period of time, e.g., at appropriate intervals through the day or other appropriate schedule. Such sub-doses can be administered as unit dosage forms. In some embodiments of the aspects described herein, administration is chronic, e.g., one or more doses daily over a period of weeks or months. Examples of dosing schedules are administration daily, twice daily, three times daily or four or more times daily over a period of 1 week, 2 weeks, 3 weeks, 4 weeks, 1 month, 2 months, 3 months, 4 months, 5 months, or 6 months or more.

In some embodiments, the pharmaceutical composition further includes at least a second therapeutic agent (e.g., an agent other than a miRNA antagonist or mimic described herein). Exemplary therapeutic agents that can formulated with a miRNA antagonist or mimic described herein include, but are not limited to, those found in Harrison's Principles of Internal Medicine, 17th Edition, 2008, McGraw-Hill N.Y., NY; Physicians Desk Reference, 63rd Edition, 2008, Thomson Reuters, N.Y., N.Y.; Goodman & Gilman's The Pharmacological Basis of Therapeutics, 11th Edition, 2005, McGraw-Hill N.Y., NY; United States Pharmacopeia, The National Formulary, USP-32 NF-27, 2008, U.S. Pharmacopeia, Rockville, Md., the complete contents of all of which are incorporated herein by reference.

Kits

Based on the identification of novel miRNA sequences associated with a condition or disease, one aspect described herein also provides for the design and preparation of detection reagents needed to identify or detect one or more novel miRNAs disclosed herein in a biological sample of a subject. Examples of detection reagents that can be used to identify the disclosed miRNA sequences in a biological sample can include a primer and a probe, wherein the probe can selectively hybridize the miRNA of interest.

Accordingly, provided herein include kits for determining whether a subject has, or is at risk of developing, or is at a given stage of condition afflicting a tissue of interest. In some embodiments, the kits can be used for monitoring the response of a subject to a therapeutic treatment. The kits can include at least one reagent specific for detecting for the presence or absence of at least one novel miRNAs described herein, and instructions for use.

In one embodiment, a kit can comprise an oligonucleotide array affixed with a plurality of oligonucleotide probes that interrogate no more than 100 novel miRNAs described herein (including no more than 75 miRNAs, no more than 50 miRNAs, no more than 25 miRNAs, no more than 20 miRNAs, no more than 15 miRNAs, no more than 10 miRNAs, no more than 5 miRNAs or less), wherein the miRNAs comprise at least two or any combinations of the novel miRNAs disclosed in Tables 1-3 submitted herewith and incorporated herein by reference in their entireties, and an optional container containing a detectable label (e.g., comprising a fluorescent molecule) to be conjugated to a nucleotide molecule derived from a test sample of a human subject; and at least one reagent. Examples of a reagent that can be included in the kit can include, without limitations, a restriction enzyme, a universal adaptor to be conjugated to a nucleotide molecule, a primer complementary to the universal adaptor, a wash agent, and any combinations thereof.

In some embodiments, the plurality of oligonucleotide probes affixed to an oligonucleotide array can interrogate about 2-100 miRNAs, e.g., about 3-50 miRNAs, about 3-25 miRNAs, about 3-10 miRNAs, or about 3-5 miRNAs, wherein the miRNAs comprise at least two or any combinations of the novel miRNAs disclosed in Tables 1-3 submitted herewith and incorporated herein by reference in their entireties.

Additional reagents included in the kit can vary with the selection of a sequencing method described herein.

Embodiments of Various Aspects Described Herein can be Defined in any of the Following Numbered Paragraphs:
1. A method of determining whether a subject has, or is at risk of developing, or is at a given stage of a condition afflicting a tissue of interest, or a method of determining tissue origin comprising measuring in a biological sample from the tissue of interest expression level of one or more of the miRNAs, wherein the miRNAs comprise a sequence selected from SEQ ID NO: 1 to SEQ ID NO: 47,972, wherein the alteration of the level of said one or more miRNAs as compared to the level of the same one or more miRNA in a reference sample is indicative of the subject either having, or being at risk of developing, or is at a given stage of the condition.
2. The method of paragraph 1, wherein the reference sample represents a normal condition of the tissue.
3. The method of paragraph 1, wherein the reference sample represents a recognizable stage of an abnormal condition of the tissue.
4. The method of any of paragraphs 1-3, wherein the tissue of interest is breast.
5. The method of any of paragraphs 1-3, wherein the tissue of interest is pancreas.
6. The method of any of paragraphs 1-3, wherein the tissue of interest is blood.
7. The method of any of paragraphs 1-3, wherein the tissue of interest is prostate.
8. The method of any of paragraphs 1-3, wherein the tissue of interest is colon.
9. The method of any of paragraphs 1-3, wherein the tissue of interest is lung.
10. The method of any of paragraphs 1-3, wherein the tissue of interest is skin.
11. The method of any of paragraphs 1-3, wherein the tissue of interest is brain.
12. The method of any of paragraphs 1-3, wherein the tissue of interest is liver.
13. The method of any of paragraphs 1-3, wherein the tissue of interest is heart.
14. The method of any of paragraphs 1-3, wherein the tissue of interest is muscle.
15. The method of any of paragraphs 1-3, wherein the tissue of interest is ovary.
16. The method of any of paragraphs 1-3, wherein the tissue of interest is testicle.
17. The method of any of paragraphs 1-3, wherein the tissue of interest is bone marrow.
18. The method of paragraph 4, wherein the condition of interest is cancer of the breast.
19. The method of paragraph 5, wherein the condition of interest is cancer of the pancreas.
20. The method of paragraph 6, wherein the condition of interest is leukemia.
21. The method of paragraph 7, wherein the condition of interest is cancer of the prostate.
22. The method of paragraph 8, wherein the condition of interest is cancer of the colon.
23. The method of paragraph 9, wherein the condition of interest is cancer of the lung.
24. The method of paragraph 10, wherein the condition of interest is melanoma.
25. The method of paragraph 10, wherein the condition of interest is psoriasis.
26. The method of paragraph 10, wherein the condition of interest is scleroderma.
27. The method of paragraph 11, wherein the condition of interest is Alzheimer's disease.
28. The method of paragraph 11, wherein the condition of interest is Parkinson's disease.
29. The method of paragraph 11, wherein the condition of interest is Multiple Sclerosis.
30. The method of paragraph 11, wherein the condition of interest is cancer of the brain.
31. The method of paragraph 12, wherein the condition of interest is cancer of the liver.

32. The method of paragraph 13, wherein the condition of interest is cardiomyopathy.
33. The method of paragraph 14, wherein the condition of interest is a muscle disorder.
34. The method of paragraph 15, wherein the condition of interest is ovarian cancer.
35. The method of paragraph 16, wherein the condition of interest is testicular cancer.
36. The method of paragraph 17, wherein the condition of interest is myelodysplastic syndrome (MDS) or myeloproliferative disorders (MPD).
37. The method of any of paragraphs 1-36, wherein said one or more miRNAs are measured by a method comprising Sanger sequencing, polymerase chain reaction (PCR), and real-time quantitative PCR, northern blot, microarray, in situ hybridization, serial analysis of gene expression (SAGE), cap analysis gene expression (CAGE) and massively parallel signature sequencing (MPSS), next generation sequencing, deep sequencing, direct multiplexing, and any combinations thereof.
38. A computer implemented method for determining whether a subject has, or is at risk of developing, or is at a given stage of a condition afflicting a tissue of interest, comprising:
    on a device having one or more processors and a memory storing one or more programs for execution by one or more processors, the one or more programs including instructions for:
        measuring in a biological sample from the tissue of interest expression level of one or more of the miRNAs, wherein the miRNAs comprise a sequence selected from SEQ ID NO: 1 to SEQ ID NO: 47,972;
        comparing the measured level of one or more miRNAs to that of at least one or more reference samples to determine alteration in the level of the miRNAs between the biological sample and the reference samples, wherein the alteration in the level of said one or more miRNAs in the biological sample as compared to the level of the same one or more miRNAs in the reference samples is indicative of the subject either having, or being at risk of developing, or is at a given stage of the condition; and
        displaying a content based in part on the data output from (ii), wherein the content comprises a signal indicative of a subject having, or being at risk of developing, or being at a given stage of a disease or disorder, or a signal indicative of no sign of the disease or disorder.
39. The computer implemented method of paragraph 38, wherein said one or more miRNAs are measured by a method comprising Sanger sequencing, polymerase chain reaction (PCR), and real-time quantitative PCR, northern blot, microarray, in situ hybridization, serial analysis of gene expression (SAGE), cap analysis gene expression (CAGE) and massively parallel signature sequencing (MPSS), next generation sequencing, deep sequencing, direct multiplexing, and any combinations thereof.
40. The computer implemented method of paragraph 38 or 39, wherein the reference samples comprise a sample representing a normal condition of the tissue.
41. The computer implemented method of any of paragraphs 38-40, wherein the reference samples comprise a sample representing a recognizable stage of an abnormal condition of the tissue.
42. The computer implemented method of any of paragraphs 38-41, wherein the tissue of interest is breast.
43. The computer implemented method of any of paragraphs 38-41, wherein the tissue of interest is pancreas.
44. The computer implemented method of any of paragraphs 38-41, wherein the tissue of interest is blood.
45. The computer implemented method of any of paragraphs 38-41, wherein the tissue of interest is prostate.
46. The computer implemented method of any of paragraphs 38-41, wherein the tissue of interest is colon.
47. The computer implemented method of any of paragraphs 38-41, wherein the tissue of interest is lung.
48. The computer implemented method of any of paragraphs 38-41, wherein the tissue of interest is skin.
49. The computer implemented method of any of paragraphs 38-41, wherein the tissue of interest is brain.
50. The computer implemented method of any of paragraphs 38-41, wherein the tissue of interest is liver.
51. The computer implemented method of any of paragraphs 38-41, wherein the tissue of interest is heart.
52. The computer implemented method of any of paragraphs 38-41, wherein the tissue of interest is muscle.
53. The computer implemented method of any of paragraphs 38-41, wherein the tissue of interest is ovary.
54. The computer implemented method of any of paragraphs 38-41, wherein the tissue of interest is testicle.
55. The computer implemented method of any of paragraphs 38-41, wherein the tissue of interest is bone marrow.
56. The computer implemented method of paragraph 42, wherein the condition of interest is cancer of the breast.
57. The computer implemented method of paragraph 43, wherein the condition of interest is cancer of the pancreas.
58. The computer implemented method of paragraph 44, wherein the condition of interest is leukemia.
59. The computer implemented method of paragraph 45, wherein the condition of interest is cancer of the prostate.
60. The computer implemented method of paragraph 46, wherein the condition of interest is cancer of the colon.
61. The computer implemented method of paragraph 47, wherein the condition of interest is cancer of the lung.
62. The computer implemented method of paragraph 48, wherein the condition of interest is melanoma.
63. The computer implemented method of paragraph 48, wherein the condition of interest is psoriasis.
64. The computer implemented method of paragraph 48, wherein the condition of interest is scleroderma.
65. The computer implemented method of paragraph 49, wherein the condition of interest is Alzheimer's disease.
66. The computer implemented method of paragraph 49, wherein the condition of interest is Parkinson's disease.
67. The computer implemented method of paragraph 49, wherein the condition of interest is Multiple Sclerosis.
68. The computer implemented method of paragraph 49, wherein the condition of interest is cancer of the brain.
69. The computer implemented method of paragraph 50, wherein the condition of interest is cancer of the liver.
70. The computer implemented method of paragraph 51, wherein the condition of interest is cardiomyopathy.
71. The computer implemented method of paragraph 52, wherein the condition of interest is a muscle disorder.
72. The computer implemented method of paragraph 53, wherein the condition of interest is ovarian cancer.
73. The computer implemented method of paragraph 54, wherein the condition of interest is testicular cancer.
74. The computer implemented method of paragraph 55, wherein the condition of interest is myelodysplastic syndrome (MDS) or myeloproliferative disorders (MPD).
75. The computer implemented method of any of paragraphs 38-74, wherein the content is displayed on a computer display, a screen, a monitor, an email, a text message, a website, a physical printout (e.g., paper) or provided as stored information in a storage device.

76. A computer system for determining whether a subject has, or is at risk of developing, or is at a given stage of a condition afflicting a tissue of interest, comprising:
one or more processors and a memory to store one or more programs, the one or more programs comprising instructions for:
measuring in a biological sample from the tissue of interest expression level of one or more of the miRNAs, wherein the miRNAs comprise a sequence selected from SEQ ID NO: 1 to SEQ ID NO: 47,972;
comparing the measured level of one or more miRNAs to that of at least one or more reference samples to determine alteration in the level of the miRNAs between the biological sample and the reference samples, wherein the alteration in the level of said one or more miRNAs in the biological sample as compared to the level of the same one or more miRNAs in the reference samples is indicative of the subject either having, or being at risk of developing, or is at a given stage of the condition; and
displaying a content based in part on the data output from (ii), wherein the content comprises a signal indicative of a subject having, or being at risk of developing, or being at a given stage of a disease or disorder, or a signal indicative of no sign of the disease or disorder.

77. The computer system of paragraph 76, wherein said one or more miRNAs are measured by a method comprising Sanger sequencing, polymerase chain reaction (PCR), and real-time quantitative PCR, northern blot, microarray, in situ hybridization, serial analysis of gene expression (SAGE), cap analysis gene expression (CAGE) and massively parallel signature sequencing (MPSS), next generation sequencing, deep sequencing, direct multiplexing, and any combinations thereof.

78. The computer system of paragraph 76 or 77, wherein the reference samples comprise a sample representing a normal condition of the tissue.

79. The computer system of any of paragraphs 76-78, wherein the reference samples comprise a sample representing a recognizable stage of an abnormal condition of the tissue.

80. The computer system of any of paragraphs 76-79, wherein the tissue of interest is breast.

81. The computer system of any of paragraphs 76-79, wherein the tissue of interest is pancreas.

82. The computer system of any of paragraphs 76-79, wherein the tissue of interest is blood.

83. The computer system of any of paragraphs 76-79, wherein the tissue of interest is prostate.

84. The computer system of any of paragraphs 76-79, wherein the tissue of interest is colon.

85. The computer system of any of paragraphs 76-79, wherein the tissue of interest is lung.

86. The computer system of any of paragraphs 76-79, wherein the tissue of interest is skin.

87. The computer system of any of paragraphs 76-79, wherein the tissue of interest is brain.

88. The computer system of any of paragraphs 76-79, wherein the tissue of interest is liver.

89. The computer system of any of paragraphs 76-79, wherein the tissue of interest is heart.

90. The computer system of any of paragraphs 76-79, wherein the tissue of interest is muscle.

91. The computer system of any of paragraphs 76-79, wherein the tissue of interest is ovary.

92. The computer system of any of paragraphs 76-79, wherein the tissue of interest is testicle.

93. The computer system of any of paragraphs 76-79, wherein the tissue of interest is bone marrow.

94. The computer system of paragraph 80, wherein the condition of interest is cancer of the breast.

95. The computer system of paragraph 81, wherein the condition of interest is cancer of the pancreas.

96. The computer system of paragraph 82, wherein the condition of interest is leukemia.

97. The computer system of paragraph 83, wherein the condition of interest is cancer of the prostate.

98. The computer system of paragraph 84, wherein the condition of interest is cancer of the colon.

99. The computer system of paragraph 85, wherein the condition of interest is cancer of the lung.

100. The computer system of paragraph 86, wherein the condition of interest is melanoma.

101. The computer system of paragraph 86, wherein the condition of interest is psoriasis.

102. The computer system of paragraph 86, wherein the condition of interest is scleroderma.

103. The computer system of paragraph 87, wherein the condition of interest is Alzheimer's disease.

104. The computer system of paragraph 87, wherein the condition of interest is Parkinson's disease.

105. The computer system of paragraph 87, wherein the condition of interest is Multiple Sclerosis.

106. The computer system of paragraph 87, wherein the condition of interest is cancer of the brain.

107. The computer system of paragraph 88, wherein the condition of interest is cancer of the liver.

108. The computer system of paragraph 89, wherein the condition of interest is cardiomyopathy.

109. The computer system of paragraph 90, wherein the condition of interest is a muscle disorder.

110. The computer system of paragraph 91, wherein the condition of interest is ovarian cancer.

111. The computer system of paragraph 92, wherein the condition of interest is testicular cancer.

112. The computer system of paragraph 93, wherein the condition of interest is myelodysplastic syndrome (MDS) or myeloproliferative disorders (MPD).

113. The computer system of any of paragraphs 76-112, wherein the content is displayed on a computer display, a screen, a monitor, an email, a text message, a website, a physical printout (e.g., paper) or provided as stored information in a storage device.

114. A non-transitory computer-readable storage medium storing one or more programs for determining whether a subject has, or is at risk of developing, or is at a given stage of a condition afflicting a tissue of interest, the one or more programs for execution by one or more processors of a non-transitory computer-readable storage medium, the one or more programs comprising instructions for:
measuring in a biological sample from the tissue of interest expression level of one or more of the miRNAs, wherein the miRNAs comprise a sequence selected from SEQ ID NO: 1 to SEQ ID NO: 47,972;
comparing the measured level of one or more miRNAs to that of at least one or more reference samples to determine alteration in the level of the miRNAs between the biological sample and the reference samples, wherein the alteration in the level of said one or more miRNAs in the biological sample as compared to the level of the same one or more miRNAs in the reference samples is indicative of the subject either having, or being at risk of developing, or is at a given stage of the condition; and displaying a content based in part on the data output from (ii), wherein the content comprises a signal indicative of a subject having, or being at risk of developing, or being at a given stage of a disease or disorder, or a signal indicative of no sign of the disease or disorder.

115. The non-transitory computer-readable storage medium of paragraph 114, wherein said one or more miRNAs are measured by a method comprising Sanger sequencing, polymerase chain reaction (PCR), and real-time quantitative PCR, northern blot, microarray, in situ hybridization, serial analysis of gene expression (SAGE), cap analysis gene expression (CAGE) and massively parallel signature sequencing (MPSS), next generation sequencing, deep sequencing, direct multiplexing, and any combinations thereof.

116. The non-transitory computer-readable storage medium of paragraph 114 or 115, wherein the reference samples comprise a sample representing a normal condition of the tissue.

117. The non-transitory computer-readable storage medium of any of paragraphs 114-116, wherein the reference samples comprise a sample representing a recognizable stage of an abnormal condition of the tissue.

118. The non-transitory computer-readable storage medium of any of paragraphs 114-117, wherein the tissue of interest is breast.

119. The non-transitory computer-readable storage medium of any of paragraphs 114-117, wherein the tissue of interest is pancreas.

120. The non-transitory computer-readable storage medium of any of paragraphs 114-117, wherein the tissue of interest is blood.

121. The non-transitory computer-readable storage medium of any of paragraphs 114-117, wherein the tissue of interest is prostate.

122. The non-transitory computer-readable storage medium of any of paragraphs 114-117, wherein the tissue of interest is colon.

123. The non-transitory computer-readable storage medium of any of paragraphs 114-117, wherein the tissue of interest is lung.

124. The non-transitory computer-readable storage medium of any of paragraphs 114-117, wherein the tissue of interest is skin.

125. The non-transitory computer-readable storage medium of any of paragraphs 114-117, wherein the tissue of interest is brain.

126. The non-transitory computer-readable storage medium of any of paragraphs 114-117, wherein the tissue of interest is liver.

127. The non-transitory computer-readable storage medium of any of paragraphs 114-117, wherein the tissue of interest is heart.

128. The non-transitory computer-readable storage medium of any of paragraphs 114-117, wherein the tissue of interest is muscle.

129. The non-transitory computer-readable storage medium of any of paragraphs 114-117, wherein the tissue of interest is ovary.

130. The non-transitory computer-readable storage medium of any of paragraphs 114-117, wherein the tissue of interest is testicle.

131. The non-transitory computer-readable storage medium of any of paragraphs 114-117, wherein the tissue of interest is bone marrow.

132. The non-transitory computer-readable storage medium of paragraph 118, wherein the condition of interest is cancer of the breast.

133. The non-transitory computer-readable storage medium of paragraph 119, wherein the condition of interest is cancer of the pancreas.

134. The non-transitory computer-readable storage medium of paragraph 120, wherein the condition of interest is leukemia.

135. The non-transitory computer-readable storage medium of paragraph 121, wherein the condition of interest is cancer of the prostate.

136. The non-transitory computer-readable storage medium of paragraph 122, wherein the condition of interest is cancer of the colon.

137. The non-transitory computer-readable storage medium of paragraph 123, wherein the condition of interest is cancer of the lung.

138. The non-transitory computer-readable storage medium of paragraph 124, wherein the condition of interest is melanoma.

139. The non-transitory computer-readable storage medium of paragraph 124, wherein the condition of interest is psoriasis.

140. The non-transitory computer-readable storage medium of paragraph 124, wherein the condition of interest is scleroderma.

141. The non-transitory computer-readable storage medium of paragraph 125, wherein the condition of interest is Alzheimer's disease.

142. The non-transitory computer-readable storage medium of paragraph 125, wherein the condition of interest is Parkinson's disease.

143. The non-transitory computer-readable storage medium of paragraph 125, wherein the condition of interest is Multiple Sclerosis.

144. The non-transitory computer-readable storage medium of paragraph 125, wherein the condition of interest is cancer of the brain.

145. The non-transitory computer-readable storage medium of paragraph 126, wherein the condition of interest is cancer of the liver.

146. The non-transitory computer-readable storage medium of paragraph 127, wherein the condition of interest is cardiomyopathy.

147. The non-transitory computer-readable storage medium of paragraph 128, wherein the condition of interest is a muscle disorder.

148. The non-transitory computer-readable storage medium of paragraph 129, wherein the condition of interest is ovarian cancer.

149. The non-transitory computer-readable storage medium of paragraph 130, wherein the condition of interest is testicular cancer.

150. The non-transitory computer-readable storage medium of paragraph 131, wherein the condition of interest is myelodysplastic syndrome (MDS) or myeloproliferative disorders (MPD).

151. The non-transitory computer-readable storage medium of any of paragraphs 114-150, wherein the content is displayed on a computer display, a screen, a monitor, an email, a text message, a website, a physical printout (e.g., paper) or provided as stored information in a storage device.

152. The method, computer implemented method, computer system, or non-transitory computer-readable storage medium of any of the preceding claims, wherein isoforms of the miRNAs are used.
153. The method, computer implemented method, computer system, or non-transitory computer-readable storage medium of claim 152, wherein the isoforms can correspond to novel miRNAs.
154. The method, computer implemented method, computer system, or non-transitory computer-readable storage medium of claim 152, wherein the isoforms can correspond to known miRNAs.

Some Selected Definitions

For convenience, certain terms employed in the entire application (including the specification, examples, and appended claims) are collected here. Unless defined otherwise, all technical and scientific terms used herein have the same meaning as commonly understood by one of ordinary skill in the art to which this invention belongs.

It should be understood that this invention is not limited to the particular methodology, protocols, and reagents, etc., described herein and as such may vary. The terminology used herein is for the purpose of describing particular embodiments only, and is not intended to limit the scope of the present invention, which is defined solely by the claims.

Other than in the operating examples, or where otherwise indicated, all numbers expressing quantities of ingredients or reaction conditions used herein should be understood as modified in all instances by the term "about." The term "about" when used to describe the present invention, in connection with percentages means±1%.

In one respect, the present invention relates to the herein described compositions, methods, and respective component(s) thereof, as essential to the invention, yet open to the inclusion of unspecified elements, essential or not ("comprising"). In some embodiments, other elements to be included in the description of the composition, method or respective component thereof are limited to those that do not materially affect the basic and novel characteristic(s) of the invention ("consisting essentially of"). This applies equally to steps within a described method as well as compositions and components therein. In other embodiments, the inventions, compositions, methods, and respective components thereof, described herein are intended to be exclusive of any element not deemed an essential element to the component, composition or method ("consisting of").

All patents, patent applications, and publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventor is not entitled to antedate such disclosure by virtue of prior invention or for any other reason. All statements as to the date or representation as to the contents of these documents is based on the information available to the applicants and does not constitute any admission as to the correctness of the dates or contents of these documents.

The term "statistically significant" or "significantly" or "significant" refers to statistical significance and generally means a one standard deviation (1SD) above or below a reference level. Alternatively, statistical significance can be measured by means of a "false discovery rate" threshold, e.g. 0.05. The term refers to statistical evidence that there is a difference. It is defined as the probability of making a decision to reject the null hypothesis when the null hypothesis is actually true. The decision is often made using the p-value. Alternatively, the decision is made using the estimated false discovery rate.

The term "deep sequencing" as used herein generally refers to next- or higher-generation sequencing known to a skilled artisan.

The term "nucleic acid" is well known in the art. A "nucleic acid" as used herein will generally refer to a molecule (i.e., strand) of DNA, RNA or a derivative or analog thereof, comprising a nucleobase. A nucleobase includes, for example, a naturally occurring purine or pyrimidine base found in DNA (e.g. an adenine "A," a guanine "G," a thymine "T" or a cytosine "C") or RNA (e.g. an A, a G, a uracil "U" or a C). The term "nucleic acid" encompasses the terms "oligonucleotide" and "polynucleotide," each as a subgenus of the term "nucleic acid." The term "oligonucleotide" refers to a molecule of between about 2 and about 100 nucleobases in length. The term "polynucleotide" refers to at least one molecule of greater than about 100 nucleobases in length.

The term "non-coding" refers to sequences of nucleic acid molecules that cannot be translated in a sequence-specific manner to produce into a particular polypeptide or peptide. In some embodiments, the term "non-coding" in reference to RNA can refer to a RNA sequence that is not translated in a sequence-specific manner to produce a particular polypeptide or peptide. In some embodiments, a non-coding RNA can comprise a sequence corresponding to a fragment of a protein-coding region, but which is not translated into a functional peptide or protein when it forms part of a non-coding RNA. Non-coding sequences include but are not limited to introns or parts thereof, promoter regions or parts thereof, 3' untranslated regions (3' UTR) or parts thereof, 5' untranslated regions (5' UTR) or parts thereof, as well as intergenic regions. In general, a 3' or 5' untranslated region is part of or spans one or more exons.

The term "coding region" or "protein-coding region" as used herein, refers to a portion of the nucleic acid sequence, which is transcribed and translated in a sequence-specific manner to produce a particular polypeptide or protein when placed under the control of appropriate regulatory sequences and appropriate molecular machinery. The coding region of a protein-coding gene is said to encode one, or more, such polypeptide or protein.

The term "oligonucleotide," as used herein is defined as a nucleic acid molecule, or its sequence representation, comprised of at least two or more ribo- or deoxyribonucleotides. The exact size of the oligonucleotide will depend on various factors and on the particular application and use of the oligonucleotide.

The term "probe" as used herein refers to an oligonucleotide, polynucleotide or nucleic acid, either RNA or DNA, whether occurring naturally as in a purified restriction enzyme digest or produced synthetically, which is capable of annealing with or specifically hybridizing to a nucleic acid with sequences complementary to the probe. A probe may be either single-stranded or double-stranded. The exact length of the probe will depend upon many factors, including temperature, source of probe and the method used. For example, for diagnostic applications, depending on the complexity of the target sequence, an oligonucleotide probe typically contains 15-25 or more nucleotides, although it may contain fewer nucleotides. The probes as disclosed herein are selected to be "substantially complementary" to different strands of a particular target nucleic acid sequence. This means that the probes must be sufficiently complementary so as to be able to "specifically hybridize" or anneal with their respective target strands. Therefore, the probe sequence need not reflect the exact complementary sequence of the target. For example, a non-complementary nucleotide fragment may be attached to the 5' or 3' end of the probe, with the remainder of the probe sequence being complementary to the target strand. Alternatively, non-complementary bases or longer sequences can be interspersed into the probe, provided that the probe sequence has sufficient complementarily with the sequence of the target nucleic acid to anneal therewith specifically.

In the context of this disclosure, the term "probe" refers to a molecule that can detectably distinguish among target molecules differing in sequence composition and also in structure (e.g. nucleic acid or protein sequence). Detection can be accomplished in a variety of different ways depending on the type of probe used and the type of target molecule. Thus, for example, detection may be based on discrimination on detection of specific binding. Examples of such specific binding include antibody binding and nucleic acid, antibody binding to protein, nucleic acid binding to nucleic acid, or aptamer binding to protein or nucleic acid. Thus, for example, probes can include enzyme substrates, antibodies and antibody fragments, and preferably nucleic acid hybridization probes.

The term "specifically hybridize" refers to the association between two single-stranded nucleic acid molecules of sufficient complementary sequence to permit such hybridization under pre-determined conditions generally used in the art (sometimes the sequences are referred to as "substantially complementary"). In particular, the term specifically hybridize also refers to hybridization of an oligonucleotide with a substantially complementary sequence as compared to non-complementary sequence.

The term "specifically" as used herein with reference to a probe which is used to specifically detect a given sequence of contiguous nucleotides, refers to a probe that identifies the particular sequence based on preferential hybridization to the sequence under consideration stringent hybridization conditions and/or on exclusive amplification or replication of molecules of interest.

The term "specifically" as used herein with reference to a probe which is used to specifically detect a sequence difference, refers to a probe that identifies a particular sequence difference based on exclusive hybridization to the sequence difference under stringent hybridization conditions and/or on exclusive amplification or replication of the sequence difference.

In its broadest sense, the term "substantially" as used herein in respect to "substantially complementary", or when used herein with respect to a nucleotide sequence in relation to a reference or a target nucleotide sequence, means a nucleotide sequence having a percentage of identity between the substantially complementary nucleotide sequence and the exact complementary sequence of said reference or target nucleotide sequence of at least 60%, at least 70%, at least 80% or 85%, at least 90%, at least 93%, at least 95% or 96%, at least 97% or 98%, at least 99% or 100% (the later being equivalent to the term "identical" in this context). For example, identity is assessed over a length of at least 10 nucleotides, or at least 11, 12, 13, 14, 15, 16, 17, 18, 19, 20, 21, 22 or up to 50 nucleotides of the entire length of the nucleic acid sequence to said reference sequence (if not specified otherwise below). Sequence comparisons can be carried out using default GAP analysis with the University of Wisconsin GCG, SEQWEB application of GAP, based on the algorithm of Needleman and Wunsch (Needleman and Wunsch (1970) J Mol. Biol. 48: 443-453; as defined above), or any of the tools that have been used for this purpose by the skilled artisan. A nucleotide sequence "substantially complementary" to a reference nucleotide sequence hybridizes to the reference nucleotide sequence under low stringency conditions, preferably medium stringency conditions, most preferably high stringency conditions.

In its broadest sense, the term "substantially identical," when used herein with respect to a nucleotide sequence, means a nucleotide sequence corresponding to a reference or target nucleotide sequence, wherein the percentage of identity between the substantially identical nucleotide sequence and the reference or target nucleotide sequence is at least 60%, at least 70%, at least 80% or 85%, at least 90%, at least 93%, at least 95% or 96%, at least 97% or 98%, at least 99% or 100% (the later being equivalent to the term "identical" in this context). For example, identity is assessed over a length of 10-40 nucleotides, such as at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or up to 50 nucleotides of a nucleic acid sequence to said reference sequence (if not specified otherwise below). Sequence comparisons are carried out using default GAP analysis with the University of Wisconsin GCG, SEQWEB application of GAP, based on the algorithm of Needleman and Wunsch (Needleman and Wunsch (1970) J Mol. Biol. 48: 443-453; as defined above), or similar tools, as mentioned above. A nucleotide sequence "substantially identical" to a reference nucleotide sequence hybridizes to the exact complementary sequence of the reference nucleotide sequence (i.e. its corresponding strand in a double-stranded molecule) under low stringency conditions, preferably medium stringency conditions, most preferably high stringency conditions (as defined above). Homologues of a specific nucleotide sequence include nucleotide sequences that is at least 24% identical, at least 35% identical, at least 50% identical, at least 65% identical to the reference sequence, as measured using the parameters described above, wherein the molecule represented by the homologous sequence is considered to have the same biological activity as the molecule encoded by the specific nucleotide sequence. The term "substantially non-identical" refers to a nucleotide sequence that does not hybridize to the nucleic acid sequence under stringent conditions.

The term "primer" as used herein refers to an oligonucleotide, either RNA or DNA, either single-stranded or double-stranded, either derived from a biological system, generated by restriction enzyme digestion, or produced synthetically which, when placed in the proper environment, is able to functionally act as an initiator of template-dependent nucleic acid synthesis. When presented with an appropriate nucleic acid template, suitable nucleoside triphosphate precursors of nucleic acids, a polymerase enzyme, suitable cofactors and conditions such as a suitable temperature and pH, the primer may be extended at its 3' terminus by the addition of nucleotides by the action of a polymerase or similar activity to yield a primer extension product. The primer may vary in length depending on the particular conditions and requirement of the application. For example, in diagnostic applications, the oligonucleotide primer is typically 15-25 or more nucleotides in length, but can be longer as needed. The primer must be of sufficient complementarity to the desired template to prime the synthesis of the desired extension product, that is, to be able to anneal with the desired template strand in a manner sufficient to provide the 3' hydroxyl moiety of the primer in appropriate juxtaposition for use in the initiation of synthesis by a polymerase or similar enzyme. It is not required that the primer sequence represent an exact complement of the desired template. For example, a non-complementary nucleotide sequence may be attached to the 5' end of an otherwise complementary primer. Alternatively, non-complementary bases may be interspersed within the oligonucleotide primer sequence, provided that the primer sequence has sufficient complementarity with the sequence of the desired template strand to functionally provide a template-primer complex for the synthesis of the extension product.

In some embodiments, the term "complementary" as used herein refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is anti-parallel to the first region if the residue is thymine (for DNA) or uracil (for RNA). Similarly, it is known that a cytosine residue of a first nucleic acid strand is capable of base pairing with a residue of a second nucleic acid strand which is anti-parallel to the first strand if the residue is guanine. A cytosine residue of a first nucleic acid strand is also capable of base pairing with a residue of a second nucleic acid strand which is anti-parallel to the first strand if the residue is uracil—such interactions are referred to as "non-Watson-Crick" or "G:U wobbles." A first region of a nucleic acid is complementary to a second region of the same or a different nucleic acid if at least one nucleotide residue of the first region is capable of base pairing with a residue of the second region, when the two regions are arranged in an anti-parallel fashion. Preferably, the first region comprises a first portion and the second region comprises a second portion, whereby, when the first and second portions are arranged in an anti-parallel fashion, such that at least about 50%, and preferably at least about 75%, at least about 90%, or at least about 95% or at least 100% of the nucleotide residues of the first portion are capable of base pairing with nucleotide residues in the second portion. More preferably, all nucleotide residues of the first portion are capable of base pairing with nucleotide residues in the second portion. A first region of a nucleic acid is "near-complementary" to a second region of the same or a different nucleic acid if, at least one nucleotide residue of the first region is capable of base pairing with a residue of the second region, when the two regions are arranged in an anti-parallel fashion, and not all of the nucleotides of the two regions are base-paired. Such interactions are exemplified by heteroduplexes of miRNAs with mRNAs where the typical interaction between the two molecules is effected by only a subset of the residues spanning each region. Additionally, the two interacting regions need not have the same length.

The term "antisense" generally refers to a nucleotide or a ribonucleotide sequence being complementary to the gene's messenger RNA (mRNA), which is called the "sense" sequence. For example, a sense segment of mRNA "5'-AAGGUC-3'" would be blocked by the anti-sense mRNA segment "3'-UUCCAG-5'").

The term "antisense oligonucleotide" refers to a nucleotide sequence including a "region of complementarity" that is substantially complementary to a sequence, for example a target sequence. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5' and/or 3' terminus.

As used herein, the term "antisense oligonucleotides comprising a nucleotide sequence" refers to an antisense oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, or a surrogate replacement moiety. The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured herein by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods described herein.

EXAMPLES

The following examples illustrate some embodiments and aspects of the invention. It will be apparent to those skilled in the relevant art that various modifications, additions, substitutions, and the like can be performed without altering the spirit or scope of the invention, and such modifications and variations are encompassed within the scope of the invention as defined in the claims which follow. The following examples do not in any way limit the invention.

Example 1. An Exemplary Methodology to Identify Novel miRNAs

Identification of Candidate Hairpin Precursors within a Dataset

To identify novel miRNAs the following three steps are carried out; candidates that satisfy the conditions of all these stages are labeled 'novel miRNAs':

(i) For each sample, only those short RNA sequence reads that mapped unambiguously on the human genome are considered. The sequence reads were expanded into putative "sequence islands", and only those islands ranging in length from 20-30 nts were retained. From these islands, only those overlapping sequence reads whose length ranged between 20 and 24 nts inclusive were considered for further analysis.

(ii) Each 20-24 nt sequence reads was expanded out into a putative precursor segment of 70-75 nts in length. To ensure that we tested all possible arrangements, the following 4 options were considered:

a. Addition of 45 nts to the 5'-end and of 5 nts to the 3'-end of the sequence island b. Addition of 35 nts to the 5'-end and 15 nts to the 3'-end of the sequence island c. Addition of 5 nts to the 5'-end and 45 nts to the 3'-end of the sequence island d. Addition of 15 nts to the 5'-end and 35 nts to the 3'-end of the sequence island For each of the four conditions, RNAfold from the 'Vienna package' (Hofacker et al. "Fast Folding and comparison of RNA secondary structures." Monatshefte fuer Chemie, Vol 125, 167-188, 1996) was used to predict the folding structure of the resulting sequence segment and to examine whether it folded into a hairpin with the miRNA product on either the hairpin's 5' (a. and b.) or 3' (c. and d.) arm. The two different sets of hairpin lengths that were tested (conditions a and b; and c and d above) allowed control for the offset of the mature miRNA from the loop within the hairpin structure, a distance that can be variable.

(iii) Only those candidate segments, and their associated miRNA candidates, which folded into a hairpin structure, had at least 15 base pairs between the two arms, and an energy value of −12 Kcal/mol or less were kept.

Identification of Mature miRNA and Precursor Sequence Boundaries

The boundaries of the mature miRNA candidates at each locus were determined by identifying the segment with the highest percentage of sequenced reads among the isomiRs. The most abundant segment with length between 20 and 24 nts was considered to be the representative mature miRNA from the locus at hand. The genomic locations of the hairpin were determined from the folded hairpin structures surrounding a potential miRNA. The hairpin with the highest folding energy was determined as the most likely candidate.

Determination of False Discovery Rate

Each one of the 962 datasets was considered in turn. Counts for unambiguously mapped reads were generated for each known and novel miRNA in the sample under consideration. Significant miRNAs (whether known or novel) were determined using a method adapted from CHIP-seq peak calling (Xu, J. & Zhang, Y. "A generalized linear model for peak calling in ChIP-Seq data." Journal of computational biology: a journal of computational molecular cell biology 19, 826-838, 2012.), maximum likelihood estimates of the parameters of the negative binomial distribution are calculated from the probability density function and subsequent p-values determined from the cumulative distribution function of the fitted data. P-values were corrected for multiple testing using the Benjamini-Hochberg procedure and an FDR calculated for each miRNA. Only those miRNAs (known or novel) with a FDR <=0.001 were kept. Sequences that were already contained in Rel. 20 of miRBase or the public mirtron repository were removed from further consideration. Additionally, any sequences that overlapped with tRNAs, rRNAs and snRNAs were removed from further consideration.

Example 2. Conservation Properties of the Novel miRNAs Described Herein in Other Species For about 9,877 novel miRNAs listed in Table 1 that were discovered by the inventors using the method that they developed as described in Example 1, it was sought to determine the extent to which the mature miRNA and the corresponding precursor miRNA are conserved across model organisms. In particular, the inventors performed a stringent search where they sought instances not only of the mature miRNA but also of the full-length precursor in several model organisms (referred to as "novel hairpin: mature miRNA combination" or "mature miRNA:novel hairpin combination"). For this purpose, the inventors used GLSEARCH (Pearson W R. 2000. "Flexible sequence similarity searching with the FASTA3 program package." *Methods in molecular biology* (Clifton, N.J.) 132: 185-219) to look for each of the identified novel miRNA precursors and their corresponding mature miRNA(s) in the chimpanzee, gorilla, orangutan, macaque, mouse, *drosophila* and worm genome assemblies. During these searches it was required that (a) at least 70% of the miRNA precursor positions be identically present in the searched genome; and, (b) at least 85% of the human mature miRNA positions be identically present in the identified orthologous precursor including an identically present seed. It was found that the vast majority of these miRNAs are conserved in primates with only a small fraction of them being present in rodents or invertebrates. Table 4 below summarizes the conservation properties of this collection of miRNAs:

TABLE 4

Number of novel hairpin:mature miRNA combinations conserved in genomes of various species for the novel miRNAs discovered using the inventors' method as described in Example 1

| Present in Which Genome | Number of Novel hairpins:Mature miRNA Combinations (n = 9,877) |
|---|---|
| Human (Hu) | 9,877 |
| Chimpanzee (Ch) | 8,536 |
| Gorilla (Go) | 8,303 |
| Orangutan (Or) | 7,013 |
| Macaque (Ma) | 5,434 |
| Mouse (Mo) | 160 |
| Drosophila (Dr) | 1 |
| Worm (Wo) | 1 |

Of the 9,877 cases, 499 miRNA:hairpin combinations (5.1%) are present exclusively in the human genome. This finding shows that these 499 instances could be involved in molecular mechanisms that may not be present in mouse models.

The following Table 5 shows in more detail the conservation properties of each of the 9,877 novel miRNA:hairpin combinations (discovered using the inventor's own method as described in Example 1) across the examined model organisms. The actual miRNA and hairpin sequences and corresponding SEQ ID NOs. can be identified in Table 1 according to the "Novel miRNA ID" and "Hairpin ID" listed in Table 5. In Table 5, "Hu" stands for Human; "Ch" stands for Chimpanzee; "Go" stands for Gorilla; "Or" stands for Orangutan or Pongo; "Ma" stands for "Macaque"; "Mo" stands for "Mouse"; "Dr" stands for Drosophia or fruit-fly; "Wo" stands for "worm."

Lengthy table referenced here

US11293064-20220405-T00001

Please refer to the end of the specification for access instructions.

The inventors also examined the 3,707 novel miRNAs that they discovered using the miRDeep2 method (as listed in Table 2) for conservation of the corresponding miRNA: hairpin combination across model organisms (using the above mentioned approach). As with the collection of the 9,877 novel miRNAs that the inventors discovered using their own method, they find that the vast majority of the miRNAs discovered using the miRDeep2 method are conserved in primates with only a small fraction of them being present in rodents or invertebrates. Table 6 below summarizes the conservation properties of this collection of miRNAs.

TABLE 6

Number of novel hairpin:mature miRNA combinations conserved in genomes of various species for the novel miRNAs discovered using the miRDeep2 method.

| Present in Which Genome | Number of Novel hairpins:Mature miRNA Combinations (n = 3,707) |
|---|---|
| Human (Hu) | 3,707 |
| Chimpanzee (Ch) | 1,242 |
| Gorilla (Go) | 1,273 |
| Orangutan (Or) | 999 |
| Macaque (Ma) | 661 |
| Mouse (Mo) | 109 |

TABLE 6-continued

Number of novel hairpin:mature miRNA combinations conserved in genomes of various species for the novel miRNAs discovered using the miRDeep2 method.

| Present in Which Genome | Number of Novel hairpins:Mature miRNA Combinations (n = 3,707) |
|---|---|
| Drosophila (Dr) | 1 |
| Worm (Wo) | 0 |

Of these 3,707 cases, 2,140 novel miRNA:hairpin combinations (57.7%) are present exclusively in the human genome. The following Table 7 shows in more detail the conservation properties of each of the 3,707 novel miRNA: hairpin combinations across the examined model organisms. The actual miRNA and hairpin sequences and corresponding SEQ ID NOs. can be identified in Table 2 according to the "Novel miRNA ID" and "Hairpin ID" listed in Table 7. In Table 7, "Hu" stands for Human; "Ch" stands for Chimpanzee; "Go" stands for Gorilla; "Or" stands for Orangutan or Pongo; "Ma" stands for "Macaque"; "Mo" stands for "Mouse"; "Dr" stands for Drosophia or fruit-fly; "Wo" stands for "worm."

TABLE 7

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00001.5p-miR | TJU_CMC_MD2.ID00001.hairpin | YES | NO | NO | NO | NO | NO | NO | NO |
| TJU_CMC_MD2.ID00002.5p-miR | TJU_CMC_MD2.ID00002.hairpin | YES | NO | NO | NO | YES | NO | NO | NO |
| TJU_CMC_MD2.ID00003.5p-miR | TJU_CMC_MD2.ID00003.hairpin | YES | YES | YES | YES | NO | NO | NO | NO |
| TJU_CMC_MD2.ID00004.3p-miR | TJU_CMC_MD2.ID00004.hairpin | YES | NO | NO | NO | NO | NO | NO | NO |
| TJU_CMC_MD2.ID00004.5p-miR | TJU_CMC_MD2.ID00004.hairpin | YES | YES | YES | YES | YES | YES | NO | NO |
| TJU_CMC_MD2.ID00005.5p-miR | TJU_CMC_MD2.ID00005.hairpin | YES | NO | YES | YES | YES | NO | NO | NO |
| TJU_CMC_MD2.ID00006.3p-miR | TJU_CMC_MD2.ID00006.hairpin | YES | NO | NO | NO | NO | NO | NO | NO |
| TJU_CMC_MD2.ID00007.3p-miR | TJU_CMC_MD2.ID00007.hairpin | YES | NO | NO | NO | NO | NO | NO | NO |
| TJU_CMC_MD2.ID00008.3p-miR | TJU_CMC_MD2.ID00008.hairpin | YES | NO | NO | NO | NO | NO | NO | NO |
| TJU_CMC_MD2.ID00009.3p-miR | TJU_CMC_MD2.ID00009.hairpin | YES | NO | NO | NO | NO | NO | NO | NO |
| TJU_CMC_MD2.ID00010.3p-miR | TJU_CMC_MD2.ID00010.hairpin | YES | NO | NO | NO | NO | NO | NO | NO |
| TJU_CMC_MD2.ID00011.3p-miR | TJU_CMC_MD2.ID00011.hairpin | YES | NO | YES | YES | NO | NO | NO | NO |
| TJU_CMC_MD2.ID00011.5p-miR | TJU_CMC_MD2.ID00011.hairpin | YES | NO | YES | YES | NO | NO | NO | NO |
| TJU_CMC_MD2.ID00012.3p-miR | TJU_CMC_MD2.ID00012.hairpin | YES | NO | NO | NO | NO | NO | NO | NO |
| TJU_CMC_MD2.ID00013.3p-miR | TJU_CMC_MD2.ID00013.hairpin | YES | NO | NO | NO | NO | NO | NO | NO |
| TJU_CMC_MD2.ID00014.3p-miR | TJU_CMC_MD2.ID00014.hairpin | YES | NO | NO | NO | NO | NO | NO | NO |
| TJU_CMC_MD2.ID00015.5p-miR | TJU_CMC_MD2.ID00015.hairpin | YES | YES | YES | YES | NO | NO | NO | NO |
| TJU_CMC_MD2.ID00016.5p-miR | TJU_CMC_MD2.ID00016.hairpin | YES | NO | YES | YES | NO | NO | NO | NO |
| TJU_CMC_MD2.ID00017.3p-miR | TJU_CMC_MD2.ID00017.hairpin | YES | NO | NO | NO | NO | NO | NO | NO |
| TJU_CMC_MD2.ID00018.5p-miR | TJU_CMC_MD2.ID00018.hairpin | YES | NO | YES | YES | NO | NO | NO | NO |
| TJU_CMC_MD2.ID00019.3p-miR | TJU_CMC_MD2.ID00019.hairpin | YES | NO | NO | NO | NO | NO | NO | NO |
| TJU_CMC_MD2.ID00020.5p-miR | TJU_CMC_MD2.ID00020.hairpin | YES | NO | NO | NO | NO | NO | NO | NO |
| TJU_CMC_MD2.ID00021.5p-miR | TJU_CMC_MD2.ID00021.hairpin | YES | NO | NO | NO | NO | NO | NO | NO |
| TJU_CMC_MD2.ID00022.3p-miR | TJU_CMC_MD2.ID00022.hairpin | YES | NO | NO | NO | NO | NO | NO | NO |
| TJU_CMC_MD2.ID00023.3p-miR | TJU_CMC_MD2.ID00023.hairpin | YES | NO | NO | NO | NO | NO | NO | NO |
| TJU_CMC_MD2.ID00024.5p-miR | TJU_CMC_MD2.ID00024.hairpin | YES | YES | YES | YES | NO | NO | NO | NO |
| TJU_CMC_MD2.ID00025.5p-miR | TJU_CMC_MD2.ID00025.hairpin | YES | YES | YES | YES | YES | NO | NO | NO |
| TJU_CMC_MD2.ID00026.3p-miR | TJU_CMC_MD2.ID00026.hairpin | YES | NO | NO | NO | NO | NO | NO | NO |
| TJU_CMC_MD2.ID00027.5p-miR | TJU_CMC_MD2.ID00027.hairpin | YES | YES | YES | YES | YES | NO | NO | NO |
| TJU_CMC_MD2.ID00028.3p-miR | TJU_CMC_MD2.ID00028.hairpin | YES | NO | NO | NO | NO | NO | NO | NO |
| TJU_CMC_MD2.ID00029.5p-miR | TJU_CMC_MD2.ID00029.hairpin | YES | YES | YES | YES | YES | NO | NO | NO |
| TJU_CMC_MD2.ID00030.3p-miR | TJU_CMC_MD2.ID00030.hairpin | YES | NO | NO | NO | NO | NO | NO | NO |
| TJU_CMC_MD2.ID00031.3p-miR | TJU_CMC_MD2.ID00031.hairpin | YES | NO | NO | NO | NO | NO | NO | NO |
| TJU_CMC_MD2.ID00032.5p-miR | TJU_CMC_MD2.ID00032.hairpin | YES | NO | YES | YES | NO | NO | NO | NO |
| TJU_CMC_MD2.ID00033.5p-miR | TJU_CMC_MD2.ID00033.hairpin | YES | NO | YES | NO | NO | NO | NO | NO |
| TJU_CMC_MD2.ID00034.3p-miR | TJU_CMC_MD2.ID00034.hairpin | YES | NO | NO | NO | NO | NO | NO | NO |
| TJU_CMC_MD2.ID00035.3p-miR | TJU_CMC_MD2.ID00035.hairpin | YES | NO | NO | NO | NO | NO | NO | NO |
| TJU_CMC_MD2.ID00036.3p-miR | TJU_CMC_MD2.ID00036.hairpin | YES | NO | NO | NO | NO | NO | NO | NO |
| TJU_CMC_MD2.ID00037.3p-miR | TJU_CMC_MD2.ID00037.hairpin | YES | NO | NO | NO | NO | NO | NO | NO |
| TJU_CMC_MD2.ID00038.3p-miR | TJU_CMC_MD2.ID00038.hairpin | YES | NO | NO | NO | NO | NO | NO | NO |
| TJU_CMC_MD2.ID00039.3p-miR | TJU_CMC_MD2.ID00039.hairpin | YES | NO | NO | NO | NO | NO | NO | NO |
| TJU_CMC_MD2.ID00040.5p-miR | TJU_CMC_MD2.ID00040.hairpin | YES | YES | YES | YES | NO | NO | NO | NO |
| TJU_CMC_MD2.ID00041.3p-miR | TJU_CMC_MD2.ID00041.hairpin | YES | NO | NO | NO | NO | NO | NO | NO |
| TJU_CMC_MD2.ID00041.5p-miR | TJU_CMC_MD2.ID00041.hairpin | YES | YES | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00042.3p-miR | TJU_CMC_MD2.ID00042.hairpin | YES | NO | NO | NO | NO | NO | NO | NO |
| TJU_CMC_MD2.ID00043.5p-miR | TJU_CMC_MD2.ID00043.hairpin | YES | NO | NO | YES | NO | NO | NO | NO |
| TJU_CMC_MD2.ID00044.3p-miR | TJU_CMC_MD2.ID00044.hairpin | YES | NO | NO | NO | NO | NO | NO | NO |
| TJU_CMC_MD2.ID00045.5p-miR | TJU_CMC_MD2.ID00045.hairpin | YES | NO | YES | YES | NO | NO | NO | NO |
| TJU_CMC_MD2.ID00046.3p-miR | TJU_CMC_MD2.ID00046.hairpin | YES | NO | NO | NO | NO | NO | NO | NO |
| TJU_CMC_MD2.ID00046.5p-miR | TJU_CMC_MD2.ID00046.hairpin | YES | YES | YES | YES | NO | NO | NO | NO |
| TJU_CMC_MD2.ID00047.3p-miR | TJU_CMC_MD2.ID00047.hairpin | YES | NO | NO | NO | NO | NO | NO | NO |
| TJU_CMC_MD2.ID00048.5p-miR | TJU_CMC_MD2.ID00048.hairpin | YES | YES | YES | YES | NO | NO | NO | NO |
| TJU_CMC_MD2.ID00049.5p-miR | TJU_CMC_MD2.ID00049.hairpin | YES | NO | NO | NO | NO | NO | NO | NO |
| TJU_CMC_MD2.ID00050.5p-miR | TJU_CMC_MD2.ID00050.hairpin | YES | NO | YES | NO | NO | NO | NO | NO |
| TJU_CMC_MD2.ID00051.3p-miR | TJU_CMC_MD2.ID00051.hairpin | YES | NO | NO | NO | NO | NO | NO | NO |
| TJU_CMC_MD2.ID00052.3p-miR | TJU_CMC_MD2.ID00052.hairpin | YES | NO | NO | NO | NO | NO | NO | NO |
| TJU_CMC_MD2.ID00053.5p-miR | TJU_CMC_MD2.ID00053.hairpin | YES | YES | NO | YES | YES | NO | NO | NO |
| TJU_CMC_MD2.ID00054.5p-miR | TJU_CMC_MD2.ID00054.hairpin | YES | YES | NO | YES | YES | NO | NO | NO |
| TJU_CMC_MD2.ID00055.5p-miR | TJU_CMC_MD2.ID00055.hairpin | YES | YES | YES | YES | YES | NO | NO | NO |
| TJU_CMC_MD2.ID00056.3p-miR | TJU_CMC_MD2.ID00056.hairpin | YES | NO | NO | NO | NO | NO | NO | NO |
| TJU_CMC_MD2.ID00057.3p-miR | TJU_CMC_MD2.ID00057.hairpin | YES | NO | NO | NO | NO | NO | NO | NO |
| TJU_CMC_MD2.ID00058.5p-miR | TJU_CMC_MD2.ID00058.hairpin | YES | YES | NO | YES | YES | NO | NO | NO |
| TJU_CMC_MD2.ID00059.5p-miR | TJU_CMC_MD2.ID00059.hairpin | YES | YES | YES | YES | NO | NO | NO | NO |
| TJU_CMC_MD2.ID00060.3p-miR | TJU_CMC_MD2.ID00060.hairpin | YES | NO | NO | NO | NO | NO | NO | NO |
| TJU_CMC_MD2.ID00061.3p-miR | TJU_CMC_MD2.ID00061.hairpin | YES | NO | NO | NO | NO | NO | NO | NO |
| TJU_CMC_MD2.ID00062.5p-miR | TJU_CMC_MD2.ID00062.hairpin | YES | YES | YES | NO | YES | NO | NO | NO |
| TJU_CMC_MD2.ID00063.5p-miR | TJU_CMC_MD2.ID00063.hairpin | YES | YES | YES | YES | NO | NO | NO | NO |
| TJU_CMC_MD2.ID00064.3p-miR | TJU_CMC_MD2.ID00064.hairpin | YES | NO | NO | NO | NO | NO | NO | NO |
| TJU_CMC_MD2.ID00065.3p-miR | TJU_CMC_MD2.ID00065.hairpin | YES | NO | NO | NO | NO | NO | NO | NO |
| TJU_CMC_MD2.ID00066.3p-miR | TJU_CMC_MD2.ID00066.hairpin | YES | NO | NO | NO | NO | NO | NO | NO |
| TJU_CMC_MD2.ID00067.3p-miR | TJU_CMC_MD2.ID00067.hairpin | YES | NO | NO | NO | NO | NO | NO | NO |
| TJU_CMC_MD2.ID00068.5p-miR | TJU_CMC_MD2.ID00068.hairpin | YES | NO | YES | YES | NO | NO | NO | NO |
| TJU_CMC_MD2.ID00069.3p-miR | TJU_CMC_MD2.ID00069.hairpin | YES | NO | NO | NO | NO | NO | NO | NO |
| TJU_CMC_MD2.ID00070.5p-miR | TJU_CMC_MD2.ID00070.hairpin | YES | YES | YES | YES | YES | NO | NO | NO |
| TJU_CMC_MD2.ID00071.3p-miR | TJU_CMC_MD2.ID00071.hairpin | YES | NO | NO | NO | NO | NO | NO | NO |
| TJU_CMC_MD2.ID00072.5p-miR | TJU_CMC_MD2.ID00072.hairpin | YES | YES | YES | YES | NO | NO | NO | NO |
| TJU_CMC_MD2.ID00073.3p-miR | TJU_CMC_MD2.ID00073.hairpin | YES | NO | NO | NO | NO | NO | NO | NO |
| TJU_CMC_MD2.ID00074.3p-miR | TJU_CMC_MD2.ID00074.hairpin | YES | NO | NO | NO | NO | NO | NO | NO |
| TJU_CMC_MD2.ID00075.5p-miR | TJU_CMC_MD2.ID00075.hairpin | YES | YES | YES | NO | YES | NO | NO | NO |
| TJU_CMC_MD2.ID00076.5p-miR | TJU_CMC_MD2.ID00076.hairpin | YES | YES | YES | YES | YES | NO | NO | NO |
| TJU_CMC_MD2.ID00077.3p-miR | TJU_CMC_MD2.ID00077.hairpin | YES | NO | NO | NO | NO | NO | NO | NO |
| TJU_CMC_MD2.ID00078.3p-miR | TJU_CMC_MD2.ID00078.hairpin | YES | NO | NO | NO | NO | NO | NO | NO |
| TJU_CMC_MD2.ID00079.3p-miR | TJU_CMC_MD2.ID00079.hairpin | YES | YES | YES | NO | NO | NO | NO | NO |
| TJU_CMC_MD2.ID00080.3p-miR | TJU_CMC_MD2.ID00080.hairpin | YES | NO | NO | NO | NO | NO | NO | NO |
| TJU_CMC_MD2.ID00081.3p-miR | TJU_CMC_MD2.ID00081.hairpin | YES | NO | NO | NO | NO | NO | NO | NO |
| TJU_CMC_MD2.ID00082.3p-miR | TJU_CMC_MD2.ID00082.hairpin | YES | NO | NO | NO | NO | NO | NO | NO |
| TJU_CMC_MD2.ID00083.3p-miR | TJU_CMC_MD2.ID00083.hairpin | YES | NO | NO | NO | NO | NO | NO | NO |
| TJU_CMC_MD2.ID00084.5p-miR | TJU_CMC_MD2.ID00084.hairpin | YES | YES | YES | NO | YES | NO | NO | NO |
| TJU_CMC_MD2.ID00085.3p-miR | TJU_CMC_MD2.ID00085.hairpin | YES | NO | NO | NO | NO | NO | NO | NO |
| TJU_CMC_MD2.ID00086.3p-miR | TJU_CMC_MD2.ID00086.hairpin | YES | NO | NO | NO | NO | NO | NO | NO |
| TJU_CMC_MD2.ID00087.3p-miR | TJU_CMC_MD2.ID00087.hairpin | YES | NO | NO | NO | NO | NO | NO | NO |
| TJU_CMC_MD2.ID00088.5p-miR | TJU_CMC_MD2.ID00088.hairpin | YES | YES | YES | YES | NO | NO | NO | NO |
| TJU_CMC_MD2.ID00089.3p-miR | TJU_CMC_MD2.ID00089.hairpin | YES | NO | NO | NO | NO | NO | NO | NO |
| TJU_CMC_MD2.ID00090.3p-miR | TJU_CMC_MD2.ID00090.hairpin | YES | NO | NO | NO | NO | NO | NO | NO |
| TJU_CMC_MD2.ID00091.5p-miR | TJU_CMC_MD2.ID00091.hairpin | YES | YES | YES | YES | YES | NO | NO | NO |
| TJU_CMC_MD2.ID00092.3p-miR | TJU_CMC_MD2.ID00092.hairpin | YES | NO | NO | NO | NO | NO | NO | NO |
| TJU_CMC_MD2.ID00093.5p-miR | TJU_CMC_MD2.ID00093.hairpin | YES | YES | YES | YES | NO | YES | NO | NO |
| TJU_CMC_MD2.ID00094.3p-miR | TJU_CMC_MD2.ID00094.hairpin | YES | NO | NO | NO | NO | NO | NO | NO |
| TJU_CMC_MD2.ID00095.5p-miR | TJU_CMC_MD2.ID00095.hairpin | YES | YES | YES | YES | YES | NO | NO | NO |
| TJU_CMC_MD2.ID00096.5p-miR | TJU_CMC_MD2.ID00096.hairpin | YES | NO | NO | NO | NO | NO | NO | NO |
| TJU_CMC_MD2.ID00097.5p-miR | TJU_CMC_MD2.ID00097.hairpin | YES | YES | NO | YES | NO | NO | NO | NO |
| TJU_CMC_MD2.ID00098.5p-miR | TJU_CMC_MD2.ID00098.hairpin | YES | YES | YES | YES | NO | NO | NO | NO |
| TJU_CMC_MD2.ID00099.3p-miR | TJU_CMC_MD2.ID00099.hairpin | YES | NO | NO | NO | NO | NO | NO | NO |
| TJU_CMC_MD2.ID00100.5p-miR | TJU_CMC_MD2.ID00100.hairpin | YES | YES | YES | YES | YES | NO | NO | NO |
| TJU_CMC_MD2.ID00101.3p-miR | TJU_CMC_MD2.ID00101.hairpin | YES | NO | NO | NO | NO | NO | NO | NO |
| TJU_CMC_MD2.ID00102.3p-miR | TJU_CMC_MD2.ID00102.hairpin | YES | NO | NO | NO | NO | NO | NO | NO |
| TJU_CMC_MD2.ID00103.5p-miR | TJU_CMC_MD2.ID00103.hairpin | YES | NO | NO | NO | NO | YES | NO | NO |
| TJU_CMC_MD2.ID00104.5p-miR | TJU_CMC_MD2.ID00104.hairpin | YES | YES | YES | YES | NO | NO | NO | NO |
| TJU_CMC_MD2.ID00105.5p-miR | TJU_CMC_MD2.ID00105.hairpin | YES | YES | YES | NO | YES | NO | NO | NO |
| TJU_CMC_MD2.ID00106.5p-miR | TJU_CMC_MD2.ID00106.hairpin | YES | NO | YES | NO | NO | NO | NO | NO |
| TJU_CMC_MD2.ID00107.3p-miR | TJU_CMC_MD2.ID00107.hairpin | YES | NO | NO | NO | NO | NO | NO | NO |
| TJU_CMC_MD2.ID00108.3p-miR | TJU_CMC_MD2.ID00108.hairpin | YES | NO | NO | NO | NO | NO | NO | NO |
| TJU_CMC_MD2.ID00109.3p-miR | TJU_CMC_MD2.ID00109.hairpin | YES | NO | NO | NO | NO | NO | NO | NO |
| TJU_CMC_MD2.ID00110.5p-miR | TJU_CMC_MD2.ID00110.hairpin | YES | YES | YES | YES | YES | NO | NO | NO |
| TJU_CMC_MD2.ID00111.3p-miR | TJU_CMC_MD2.ID00111.hairpin | YES | NO | NO | NO | NO | NO | NO | NO |
| TJU_CMC_MD2.ID00112.5p-miR | TJU_CMC_MD2.ID00112.hairpin | YES | NO | NO | NO | NO | NO | NO | NO |
| TJU_CMC_MD2.ID00113.5p-miR | TJU_CMC_MD2.ID00113.hairpin | YES | YES | YES | NO | YES | NO | NO | NO |
| TJU_CMC_MD2.ID00114.5p-miR | TJU_CMC_MD2.ID00114.hairpin | YES | YES | YES | YES | YES | NO | NO | NO |
| TJU_CMC_MD2.ID00115.5p-miR | TJU_CMC_MD2.ID00115.hairpin | YES | YES | YES | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00116.3p-miR | TJU_CMC_MD2.ID00116.hairpin | YES | NO | NO | NO | NO | NO | NO | NO |
| TJU_CMC_MD2.ID00117.5p-miR | TJU_CMC_MD2.ID00117.hairpin | YES | YES | YES | YES | NO | YES | NO | NO |
| TJU_CMC_MD2.ID00118.5p-miR | TJU_CMC_MD2.ID00118.hairpin | YES | NO | YES | YES | YES | NO | NO | NO |
| TJU_CMC_MD2.ID00119.3p-miR | TJU_CMC_MD2.ID00119.hairpin | YES | NO | NO | NO | NO | NO | NO | NO |
| TJU_CMC_MD2.ID00120.3p-miR | TJU_CMC_MD2.ID00120.hairpin | YES | NO | NO | NO | NO | NO | NO | NO |
| TJU_CMC_MD2.ID00121.5p-miR | TJU_CMC_MD2.ID00121.hairpin | YES | NO | NO | NO | NO | NO | NO | NO |
| TJU_CMC_MD2.ID00122.3p-miR | TJU_CMC_MD2.ID00122.hairpin | YES | NO | NO | NO | NO | NO | NO | NO |
| TJU_CMC_MD2.ID00122.5p-miR | TJU_CMC_MD2.ID00122.hairpin | YES | YES | YES | NO | YES | NO | NO | NO |
| TJU_CMC_MD2.ID00123.5p-miR | TJU_CMC_MD2.ID00123.hairpin | YES | YES | YES | YES | YES | NO | NO | NO |
| TJU_CMC_MD2.ID00124.5p-miR | TJU_CMC_MD2.ID00124.hairpin | YES | YES | YES | YES | YES | NO | NO | NO |
| TJU_CMC_MD2.ID00125.3p-miR | TJU_CMC_MD2.ID00125.hairpin | YES | NO | NO | NO | NO | NO | NO | NO |
| TJU_CMC_MD2.ID00126.5p-miR | TJU_CMC_MD2.ID00126.hairpin | YES | YES | YES | NO | NO | NO | NO | NO |
| TJU_CMC_MD2.ID00127.3p-miR | TJU_CMC_MD2.ID00127.hairpin | YES | NO | NO | NO | NO | NO | NO | NO |
| TJU_CMC_MD2.ID00128.3p-miR | TJU_CMC_MD2.ID00128.hairpin | YES | NO | NO | NO | NO | NO | NO | NO |
| TJU_CMC_MD2.ID00129.5p-miR | TJU_CMC_MD2.ID00129.hairpin | YES | YES | YES | YES | YES | NO | NO | NO |
| TJU_CMC_MD2.ID00130.3p-miR | TJU_CMC_MD2.ID00130.hairpin | YES | NO | NO | NO | NO | NO | NO | NO |
| TJU_CMC_MD2.ID00131.5p-miR | TJU_CMC_MD2.ID00131.hairpin | YES | YES | YES | YES | YES | NO | NO | NO |
| TJU_CMC_MD2.ID00132.5p-miR | TJU_CMC_MD2.ID00132.hairpin | YES | YES | YES | YES | YES | NO | NO | NO |
| TJU_CMC_MD2.ID00133.3p-miR | TJU_CMC_MD2.ID00133.hairpin | YES | NO | NO | NO | NO | NO | NO | NO |
| TJU_CMC_MD2.ID00134.3p-miR | TJU_CMC_MD2.ID00134.hairpin | YES | NO | NO | NO | NO | NO | NO | NO |
| TJU_CMC_MD2.ID00135.5p-miR | TJU_CMC_MD2.ID00135.hairpin | YES | NO | NO | NO | NO | NO | NO | NO |
| TJU_CMC_MD2.ID00136.5p-miR | TJU_CMC_MD2.ID00136.hairpin | YES | YES | YES | YES | NO | NO | NO | NO |
| TJU_CMC_MD2.ID00137.3p-miR | TJU_CMC_MD2.ID00137.hairpin | YES | NO | NO | NO | NO | NO | NO | NO |
| TJU_CMC_MD2.ID00138.3p-miR | TJU_CMC_MD2.ID00138.hairpin | YES | NO | NO | NO | NO | NO | NO | NO |
| TJU_CMC_MD2.ID00139.5p-miR | TJU_CMC_MD2.ID00139.hairpin | YES | YES | YES | YES | NO | NO | NO | NO |
| TJU_CMC_MD2.ID00140.3p-miR | TJU_CMC_MD2.ID00140.hairpin | YES | NO | NO | NO | NO | NO | NO | NO |
| TJU_CMC_MD2.ID00141.3p-miR | TJU_CMC_MD2.ID00141.hairpin | YES | NO | NO | NO | NO | NO | NO | NO |
| TJU_CMC_MD2.ID00142.3p-miR | TJU_CMC_MD2.ID00142.hairpin | YES | NO | NO | NO | NO | NO | NO | NO |
| TJU_CMC_MD2.ID00143.3p-miR | TJU_CMC_MD2.ID00143.hairpin | YES | YES | YES | YES | NO | NO | NO | NO |
| TJU_CMC_MD2.ID00144.3p-miR | TJU_CMC_MD2.ID00144.hairpin | YES | NO | NO | NO | NO | NO | NO | NO |
| TJU_CMC_MD2.ID00145.3p-miR | TJU_CMC_MD2.ID00145.hairpin | YES | NO | NO | NO | NO | NO | NO | NO |
| TJU_CMC_MD2.ID00145.5p-miR | TJU_CMC_MD2.ID00145.hairpin | YES | YES | YES | YES | YES | NO | NO | NO |
| TJU_CMC_MD2.ID00146.3p-miR | TJU_CMC_MD2.ID00146.hairpin | YES | NO | NO | NO | NO | NO | NO | NO |
| TJU_CMC_MD2.ID00146.5p-miR | TJU_CMC_MD2.ID00146.hairpin | YES | YES | YES | NO | YES | NO | NO | NO |
| TJU_CMC_MD2.ID00147.5p-miR | TJU_CMC_MD2.ID00147.hairpin | YES | NO | NO | NO | YES | NO | NO | NO |
| TJU_CMC_MD2.ID00148.5p-miR | TJU_CMC_MD2.ID00148.hairpin | YES | NO | NO | NO | NO | NO | NO | NO |
| TJU_CMC_MD2.ID00149.3p-miR | TJU_CMC_MD2.ID00149.hairpin | YES | NO | NO | NO | NO | NO | NO | NO |
| TJU_CMC_MD2.ID00150.5p-miR | TJU_CMC_MD2.ID00150.hairpin | YES | YES | YES | NO | NO | NO | NO | NO |
| TJU_CMC_MD2.ID00151.3p-miR | TJU_CMC_MD2.ID00151.hairpin | YES | NO | NO | NO | NO | NO | NO | NO |
| TJU_CMC_MD2.ID00152.3p-miR | TJU_CMC_MD2.ID00152.hairpin | YES | NO | NO | NO | NO | NO | NO | NO |
| TJU_CMC_MD2.ID00153.3p-miR | TJU_CMC_MD2.ID00153.hairpin | YES | NO | NO | NO | NO | NO | NO | NO |
| TJU_CMC_MD2.ID00154.3p-miR | TJU_CMC_MD2.ID00154.hairpin | YES | NO | NO | NO | NO | NO | NO | NO |
| TJU_CMC_MD2.ID00155.5p-miR | TJU_CMC_MD2.ID00155.hairpin | YES | NO | NO | NO | NO | NO | NO | NO |
| TJU_CMC_MD2.ID00156.5p-miR | TJU_CMC_MD2.ID00156.hairpin | YES | YES | YES | YES | YES | NO | NO | NO |
| TJU_CMC_MD2.ID00157.3p-miR | TJU_CMC_MD2.ID00157.hairpin | YES | NO | NO | NO | NO | NO | NO | NO |
| TJU_CMC_MD2.ID00158.5p-miR | TJU_CMC_MD2.ID00158.hairpin | YES | YES | YES | YES | YES | NO | NO | NO |
| TJU_CMC_MD2.ID00159.5p-miR | TJU_CMC_MD2.ID00159.hairpin | YES | YES | YES | YES | NO | NO | NO | NO |
| TJU_CMC_MD2.ID00160.5p-miR | TJU_CMC_MD2.ID00160.hairpin | YES | YES | YES | YES | NO | NO | NO | NO |
| TJU_CMC_MD2.ID00161.3p-miR | TJU_CMC_MD2.ID00161.hairpin | YES | NO | NO | NO | NO | NO | NO | NO |
| TJU_CMC_MD2.ID00162.3p-miR | TJU_CMC_MD2.ID00162.hairpin | YES | NO | NO | NO | NO | NO | NO | NO |
| TJU_CMC_MD2.ID00163.5p-miR | TJU_CMC_MD2.ID00163.hairpin | YES | YES | YES | YES | NO | NO | NO | NO |
| TJU_CMC_MD2.ID00164.5p-miR | TJU_CMC_MD2.ID00164.hairpin | YES | YES | YES | YES | YES | NO | NO | NO |
| TJU_CMC_MD2.ID00165.3p-miR | TJU_CMC_MD2.ID00165.hairpin | YES | NO | NO | NO | NO | NO | NO | NO |
| TJU_CMC_MD2.ID00166.5p-miR | TJU_CMC_MD2.ID00166.hairpin | YES | YES | YES | YES | YES | YES | NO | NO |
| TJU_CMC_MD2.ID00167.5p-miR | TJU_CMC_MD2.ID00167.hairpin | YES | YES | YES | YES | YES | YES | NO | NO |
| TJU_CMC_MD2.ID00168.3p-miR | TJU_CMC_MD2.ID00168.hairpin | YES | NO | NO | NO | NO | NO | NO | NO |
| TJU_CMC_MD2.ID00169.3p-miR | TJU_CMC_MD2.ID00169.hairpin | YES | NO | NO | NO | NO | NO | NO | NO |
| TJU_CMC_MD2.ID00170.3p-miR | TJU_CMC_MD2.ID00170.hairpin | YES | NO | NO | NO | NO | NO | NO | NO |
| TJU_CMC_MD2.ID00171.3p-miR | TJU_CMC_MD2.ID00171.hairpin | YES | NO | NO | NO | NO | NO | NO | NO |
| TJU_CMC_MD2.ID00172.3p-miR | TJU_CMC_MD2.ID00172.hairpin | YES | NO | NO | NO | NO | NO | NO | NO |
| TJU_CMC_MD2.ID00173.3p-miR | TJU_CMC_MD2.ID00173.hairpin | YES | NO | NO | NO | NO | NO | NO | NO |
| TJU_CMC_MD2.ID00174.5p-miR | TJU_CMC_MD2.ID00174.hairpin | YES | YES | NO | YES | YES | YES | NO | NO |
| TJU_CMC_MD2.ID00175.3p-miR | TJU_CMC_MD2.ID00175.hairpin | YES | NO | NO | NO | NO | NO | NO | NO |
| TJU_CMC_MD2.ID00176.5p-miR | TJU_CMC_MD2.ID00176.hairpin | YES | YES | YES | YES | NO | NO | NO | NO |
| TJU_CMC_MD2.ID00177.5p-miR | TJU_CMC_MD2.ID00177.hairpin | YES | YES | YES | YES | NO | NO | NO | NO |
| TJU_CMC_MD2.ID00178.5p-miR | TJU_CMC_MD2.ID00178.hairpin | YES | YES | YES | YES | YES | NO | NO | NO |
| TJU_CMC_MD2.ID00179.3p-miR | TJU_CMC_MD2.ID00179.hairpin | YES | NO | NO | NO | NO | NO | NO | NO |
| TJU_CMC_MD2.ID00180.5p-miR | TJU_CMC_MD2.ID00180.hairpin | YES | YES | YES | YES | YES | NO | NO | NO |
| TJU_CMC_MD2.ID00181.5p-miR | TJU_CMC_MD2.ID00181.hairpin | YES | NO | YES | YES | NO | NO | NO | NO |
| TJU_CMC_MD2.ID00182.5p-miR | TJU_CMC_MD2.ID00182.hairpin | YES | YES | YES | YES | YES | NO | NO | NO |
| TJU_CMC_MD2.ID00183.3p-miR | TJU_CMC_MD2.ID00183.hairpin | YES | NO | NO | NO | NO | NO | NO | NO |
| TJU_CMC_MD2.ID00183.5p-miR | TJU_CMC_MD2.ID00183.hairpin | YES | NO | NO | YES | NO | NO | NO | NO |
| TJU_CMC_MD2.ID00184.3p-miR | TJU_CMC_MD2.ID00184.hairpin | YES | NO | NO | NO | NO | NO | NO | NO |
| TJU_CMC_MD2.ID00185.5p-miR | TJU_CMC_MD2.ID00185.hairpin | YES | YES | YES | YES | NO | NO | NO | NO |
| TJU_CMC_MD2.ID00186.5p-miR | TJU_CMC_MD2.ID00186.hairpin | YES | YES | YES | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
| --- | --- | --- | --- | --- | --- | --- | --- | --- | --- |
| TJU_CMC_MD2.ID00187.3p-miR | TJU_CMC_MD2.ID00187.hairpin | YES | NO | NO | NO | NO | NO | NO | NO |
| TJU_CMC_MD2.ID00188.3p-miR | TJU_CMC_MD2.ID00188.hairpin | YES | NO | NO | NO | NO | NO | NO | NO |
| TJU_CMC_MD2.ID00189.5p-miR | TJU_CMC_MD2.ID00189.hairpin | YES | YES | NO | YES | YES | NO | NO | NO |
| TJU_CMC_MD2.ID00190.3p-miR | TJU_CMC_MD2.ID00190.hairpin | YES | NO | NO | NO | NO | NO | NO | NO |
| TJU_CMC_MD2.ID00191.5p-miR | TJU_CMC_MD2.ID00191.hairpin | YES | NO | YES | NO | YES | NO | NO | NO |
| TJU_CMC_MD2.ID00192.3p-miR | TJU_CMC_MD2.ID00192.hairpin | YES | NO | NO | NO | NO | NO | NO | NO |
| TJU_CMC_MD2.ID00193.5p-miR | TJU_CMC_MD2.ID00193.hairpin | YES | YES | YES | NO | NO | NO | NO | NO |
| TJU_CMC_MD2.ID00194.3p-miR | TJU_CMC_MD2.ID00194.hairpin | YES | NO | NO | NO | NO | NO | NO | NO |
| TJU_CMC_MD2.ID00195.3p-miR | TJU_CMC_MD2.ID00195.hairpin | YES | NO | NO | NO | NO | NO | NO | NO |
| TJU_CMC_MD2.ID00196.3p-miR | TJU_CMC_MD2.ID00196.hairpin | YES | NO | NO | NO | NO | NO | NO | NO |
| TJU_CMC_MD2.ID00197.5p-miR | TJU_CMC_MD2.ID00197.hairpin | YES | YES | YES | YES | NO | NO | NO | NO |
| TJU_CMC_MD2.ID00198.3p-miR | TJU_CMC_MD2.ID00198.hairpin | YES | NO | NO | NO | NO | NO | NO | NO |
| TJU_CMC_MD2.ID00199.3p-miR | TJU_CMC_MD2.ID00199.hairpin | YES | NO | NO | NO | NO | NO | NO | NO |
| TJU_CMC_MD2.ID00200.5p-miR | TJU_CMC_MD2.ID00200.hairpin | YES | NO | NO | NO | NO | NO | NO | NO |
| TJU_CMC_MD2.ID00201.3p-miR | TJU_CMC_MD2.ID00201.hairpin | YES | NO | NO | NO | NO | NO | NO | NO |
| TJU_CMC_MD2.ID00202.5p-miR | TJU_CMC_MD2.ID00202.hairpin | YES | YES | YES | YES | NO | YES | NO | NO |
| TJU_CMC_MD2.ID00203.3p-miR | TJU_CMC_MD2.ID00203.hairpin | YES | NO | NO | NO | NO | NO | NO | NO |
| TJU_CMC_MD2.ID00204.5p-miR | TJU_CMC_MD2.ID00204.hairpin | YES | YES | YES | YES | YES | NO | NO | NO |
| TJU_CMC_MD2.ID00205.3p-miR | TJU_CMC_MD2.ID00205.hairpin | YES | YES | YES | YES | YES | NO | NO | NO |
| TJU_CMC_MD2.ID00206.3p-miR | TJU_CMC_MD2.ID00206.hairpin | YES | NO | NO | NO | NO | NO | NO | NO |
| TJU_CMC_MD2.ID00207.5p-miR | TJU_CMC_MD2.ID00207.hairpin | YES | YES | YES | NO | YES | NO | NO | NO |
| TJU_CMC_MD2.ID00208.5p-miR | TJU_CMC_MD2.ID00208.hairpin | YES | YES | YES | YES | YES | NO | NO | NO |
| TJU_CMC_MD2.ID00209.3p-miR | TJU_CMC_MD2.ID00209.hairpin | YES | NO | NO | NO | NO | NO | NO | NO |
| TJU_CMC_MD2.ID00210.5p-miR | TJU_CMC_MD2.ID00210.hairpin | YES | YES | YES | NO | NO | NO | NO | NO |
| TJU_CMC_MD2.ID00211.3p-miR | TJU_CMC_MD2.ID00211.hairpin | YES | NO | NO | NO | NO | NO | NO | NO |
| TJU_CMC_MD2.ID00212.3p-miR | TJU_CMC_MD2.ID00212.hairpin | YES | NO | NO | NO | NO | NO | NO | NO |
| TJU_CMC_MD2.ID00213.3p-miR | TJU_CMC_MD2.ID00213.hairpin | YES | NO | NO | NO | NO | NO | NO | NO |
| TJU_CMC_MD2.ID00214.3p-miR | TJU_CMC_MD2.ID00214.hairpin | YES | NO | NO | NO | NO | NO | NO | NO |
| TJU_CMC_MD2.ID00215.3p-miR | TJU_CMC_MD2.ID00215.hairpin | YES | NO | NO | NO | NO | NO | NO | NO |
| TJU_CMC_MD2.ID00216.3p-miR | TJU_CMC_MD2.ID00216.hairpin | YES | NO | NO | NO | NO | NO | NO | NO |
| TJU_CMC_MD2.ID00217.3p-miR | TJU_CMC_MD2.ID00217.hairpin | YES | NO | NO | NO | NO | NO | NO | NO |
| TJU_CMC_MD2.ID00217.5p-miR | TJU_CMC_MD2.ID00217.hairpin | YES | NO | NO | NO | NO | NO | NO | NO |
| TJU_CMC_MD2.ID00218.3p-miR | TJU_CMC_MD2.ID00218.hairpin | YES | NO | NO | NO | NO | NO | NO | NO |
| TJU_CMC_MD2.ID00219.3p-miR | TJU_CMC_MD2.ID00219.hairpin | YES | NO | NO | NO | NO | NO | NO | NO |
| TJU_CMC_MD2.ID00220.3p-miR | TJU_CMC_MD2.ID00220.hairpin | YES | NO | NO | NO | NO | NO | NO | NO |
| TJU_CMC_MD2.ID00221.5p-miR | TJU_CMC_MD2.ID00221.hairpin | YES | YES | NO | YES | NO | NO | NO | NO |
| TJU_CMC_MD2.ID00222.3p-miR | TJU_CMC_MD2.ID00222.hairpin | YES | NO | NO | NO | NO | NO | NO | NO |
| TJU_CMC_MD2.ID00223.5p-miR | TJU_CMC_MD2.ID00223.hairpin | YES | YES | YES | YES | YES | NO | NO | NO |
| TJU_CMC_MD2.ID00224.5p-miR | TJU_CMC_MD2.ID00224.hairpin | YES | YES | NO | YES | YES | NO | NO | NO |
| TJU_CMC_MD2.ID00225.3p-miR | TJU_CMC_MD2.ID00225.hairpin | YES | NO | NO | NO | NO | NO | NO | NO |
| TJU_CMC_MD2.ID00226.5p-miR | TJU_CMC_MD2.ID00226.hairpin | YES | YES | YES | YES | YES | YES | NO | NO |
| TJU_CMC_MD2.ID00227.5p-miR | TJU_CMC_MD2.ID00227.hairpin | YES | YES | YES | NO | NO | NO | NO | NO |
| TJU_CMC_MD2.ID00228.5p-miR | TJU_CMC_MD2.ID00228.hairpin | YES | YES | YES | YES | NO | NO | NO | NO |
| TJU_CMC_MD2.ID00229.5p-miR | TJU_CMC_MD2.ID00229.hairpin | YES | YES | YES | YES | YES | NO | NO | NO |
| TJU_CMC_MD2.ID00230.5p-miR | TJU_CMC_MD2.ID00230.hairpin | YES | YES | YES | YES | NO | NO | NO | NO |
| TJU_CMC_MD2.ID00231.3p-miR | TJU_CMC_MD2.ID00231.hairpin | YES | YES | YES | NO | NO | NO | NO | NO |
| TJU_CMC_MD2.ID00231.5p-miR | TJU_CMC_MD2.ID00231.hairpin | YES | YES | YES | NO | NO | NO | NO | NO |
| TJU_CMC_MD2.ID00232.3p-miR | TJU_CMC_MD2.ID00232.hairpin | YES | NO | NO | NO | NO | NO | NO | NO |
| TJU_CMC_MD2.ID00233.5p-miR | TJU_CMC_MD2.ID00233.hairpin | YES | NO | YES | NO | YES | NO | NO | NO |
| TJU_CMC_MD2.ID00234.3p-miR | TJU_CMC_MD2.ID00234.hairpin | YES | NO | NO | NO | NO | NO | NO | NO |
| TJU_CMC_MD2.ID00235.5p-miR | TJU_CMC_MD2.ID00235.hairpin | YES | NO | NO | NO | NO | NO | NO | NO |
| TJU_CMC_MD2.ID00236.5p-miR | TJU_CMC_MD2.ID00236.hairpin | YES | NO | NO | NO | NO | NO | NO | NO |
| TJU_CMC_MD2.ID00237.5p-miR | TJU_CMC_MD2.ID00237.hairpin | YES | YES | YES | YES | YES | YES | NO | NO |
| TJU_CMC_MD2.ID00238.3p-miR | TJU_CMC_MD2.ID00238.hairpin | YES | NO | NO | NO | NO | NO | NO | NO |
| TJU_CMC_MD2.ID00239.3p-miR | TJU_CMC_MD2.ID00239.hairpin | YES | NO | NO | NO | NO | NO | NO | NO |
| TJU_CMC_MD2.ID00240.5p-miR | TJU_CMC_MD2.ID00240.hairpin | YES | YES | YES | YES | YES | NO | NO | NO |
| TJU_CMC_MD2.ID00241.3p-miR | TJU_CMC_MD2.ID00241.hairpin | YES | YES | YES | YES | NO | NO | NO | NO |
| TJU_CMC_MD2.ID00242.3p-miR | TJU_CMC_MD2.ID00242.hairpin | YES | NO | NO | NO | NO | NO | NO | NO |
| TJU_CMC_MD2.ID00243.3p-miR | TJU_CMC_MD2.ID00243.hairpin | YES | NO | NO | NO | NO | NO | NO | NO |
| TJU_CMC_MD2.ID00244.3p-miR | TJU_CMC_MD2.ID00244.hairpin | YES | NO | NO | NO | NO | NO | NO | NO |
| TJU_CMC_MD2.ID00245.3p-miR | TJU_CMC_MD2.ID00245.hairpin | YES | NO | NO | NO | NO | NO | NO | NO |
| TJU_CMC_MD2.ID00246.3p-miR | TJU_CMC_MD2.ID00246.hairpin | YES | NO | NO | NO | NO | NO | NO | NO |
| TJU_CMC_MD2.ID00247.3p-miR | TJU_CMC_MD2.ID00247.hairpin | YES | YES | YES | NO | NO | NO | NO | NO |
| TJU_CMC_MD2.ID00247.5p-miR | TJU_CMC_MD2.ID00247.hairpin | YES | YES | YES | YES | NO | NO | NO | NO |
| TJU_CMC_MD2.ID00248.5p-miR | TJU_CMC_MD2.ID00248.hairpin | YES | YES | NO | YES | NO | NO | NO | NO |
| TJU_CMC_MD2.ID00249.3p-miR | TJU_CMC_MD2.ID00249.hairpin | YES | NO | NO | NO | NO | NO | NO | NO |
| TJU_CMC_MD2.ID00250.5p-miR | TJU_CMC_MD2.ID00250.hairpin | YES | YES | YES | YES | NO | NO | NO | NO |
| TJU_CMC_MD2.ID00251.5p-miR | TJU_CMC_MD2.ID00251.hairpin | YES | YES | NO | YES | NO | NO | NO | NO |
| TJU_CMC_MD2.ID00252.5p-miR | TJU_CMC_MD2.ID00252.hairpin | YES | YES | YES | YES | NO | NO | NO | NO |
| TJU_CMC_MD2.ID00253.5p-miR | TJU_CMC_MD2.ID00253.hairpin | YES | YES | YES | YES | YES | NO | NO | NO |
| TJU_CMC_MD2.ID00254.3p-miR | TJU_CMC_MD2.ID00254.hairpin | YES | NO | NO | NO | NO | NO | NO | NO |
| TJU_CMC_MD2.ID00255.5p-miR | TJU_CMC_MD2.ID00255.hairpin | YES | YES | YES | NO | YES | NO | NO | NO |
| TJU_CMC_MD2.ID00256.3p-miR | TJU_CMC_MD2.ID00256.hairpin | YES | NO | YES | NO | NO | NO | NO | NO |
| TJU_CMC_MD2.ID00257.3p-miR | TJU_CMC_MD2.ID00257.hairpin | YES | NO | NO | NO | NO | NO | NO | NO |
| TJU_CMC_MD2.ID00258.5p-miR | TJU_CMC_MD2.ID00258.hairpin | YES | YES | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00259.5p-miR | TJU_CMC_MD2.ID00259.hairpin | YES | NO | YES | NO | NO | NO | NO | NO |
| TJU_CMC_MD2.ID00260.3p-miR | TJU_CMC_MD2.ID00260.hairpin | YES | NO | NO | NO | NO | NO | NO | NO |
| TJU_CMC_MD2.ID00261.3p-miR | TJU_CMC_MD2.ID00261.hairpin | YES | NO | NO | NO | NO | NO | NO | NO |
| TJU_CMC_MD2.ID00262.3p-miR | TJU_CMC_MD2.ID00262.hairpin | YES | NO | NO | NO | NO | NO | NO | NO |
| TJU_CMC_MD2.ID00263.3p-miR | TJU_CMC_MD2.ID00263.hairpin | YES | NO | NO | NO | NO | NO | NO | NO |
| TJU_CMC_MD2.ID00264.5p-miR | TJU_CMC_MD2.ID00264.hairpin | YES | YES | YES | YES | YES | NO | NO | NO |
| TJU_CMC_MD2.ID00265.3p-miR | TJU_CMC_MD2.ID00265.hairpin | YES | NO | NO | NO | NO | NO | NO | NO |
| TJU_CMC_MD2.ID00266.3p-miR | TJU_CMC_MD2.ID00266.hairpin | YES | NO | NO | NO | NO | NO | NO | NO |
| TJU_CMC_MD2.ID00267.3p-miR | TJU_CMC_MD2.ID00267.hairpin | YES | NO | NO | NO | NO | NO | NO | NO |
| TJU_CMC_MD2.ID00268.3p-miR | TJU_CMC_MD2.ID00268.hairpin | YES | NO | NO | NO | NO | NO | NO | NO |
| TJU_CMC_MD2.ID00269.3p-miR | TJU_CMC_MD2.ID00269.hairpin | YES | NO | NO | NO | NO | NO | NO | NO |
| TJU_CMC_MD2.ID00270.5p-miR | TJU_CMC_MD2.ID00270.hairpin | YES | YES | YES | YES | NO | NO | NO | NO |
| TJU_CMC_MD2.ID00271.5p-miR | TJU_CMC_MD2.ID00271.hairpin | YES | YES | YES | NO | NO | NO | NO | NO |
| TJU_CMC_MD2.ID00272.3p-miR | TJU_CMC_MD2.ID00272.hairpin | YES | NO | NO | NO | NO | NO | NO | NO |
| TJU_CMC_MD2.ID00273.3p-miR | TJU_CMC_MD2.ID00273.hairpin | YES | YES | YES | YES | YES | NO | NO | NO |
| TJU_CMC_MD2.ID00274.5p-miR | TJU_CMC_MD2.ID00274.hairpin | YES | YES | YES | YES | NO | NO | NO | NO |
| TJU_CMC_MD2.ID00275.3p-miR | TJU_CMC_MD2.ID00275.hairpin | YES | NO | NO | NO | NO | NO | NO | NO |
| TJU_CMC_MD2.ID00276.3p-miR | TJU_CMC_MD2.ID00276.hairpin | YES | NO | NO | NO | NO | NO | NO | NO |
| TJU_CMC_MD2.ID00277.3p-miR | TJU_CMC_MD2.ID00277.hairpin | YES | NO | NO | NO | NO | NO | NO | NO |
| TJU_CMC_MD2.ID00278.3p-miR | TJU_CMC_MD2.ID00278.hairpin | YES | NO | NO | NO | NO | NO | NO | NO |
| TJU_CMC_MD2.ID00279.5p-miR | TJU_CMC_MD2.ID00279.hairpin | YES | YES | YES | YES | YES | NO | NO | NO |
| TJU_CMC_MD2.ID00280.3p-miR | TJU_CMC_MD2.ID00280.hairpin | YES | NO | NO | NO | NO | NO | NO | NO |
| TJU_CMC_MD2.ID00281.5p-miR | TJU_CMC_MD2.ID00281.hairpin | YES | YES | NO | NO | NO | NO | NO | NO |
| TJU_CMC_MD2.ID00282.5p-miR | TJU_CMC_MD2.ID00282.hairpin | YES | YES | YES | NO | YES | NO | NO | NO |
| TJU_CMC_MD2.ID00283.3p-miR | TJU_CMC_MD2.ID00283.hairpin | YES | NO | NO | NO | NO | NO | NO | NO |
| TJU_CMC_MD2.ID00284.5p-miR | TJU_CMC_MD2.ID00284.hairpin | YES | YES | YES | NO | YES | NO | NO | NO |
| TJU_CMC_MD2.ID00285.3p-miR | TJU_CMC_MD2.ID00285.hairpin | YES | NO | NO | NO | NO | NO | NO | NO |
| TJU_CMC_MD2.ID00286.3p-miR | TJU_CMC_MD2.ID00286.hairpin | YES | NO | NO | NO | NO | NO | NO | NO |
| TJU_CMC_MD2.ID00287.3p-miR | TJU_CMC_MD2.ID00287.hairpin | YES | NO | NO | NO | NO | NO | NO | NO |
| TJU_CMC_MD2.ID00288.3p-miR | TJU_CMC_MD2.ID00288.hairpin | YES | NO | NO | NO | NO | NO | NO | NO |
| TJU_CMC_MD2.ID00288.5p-miR | TJU_CMC_MD2.ID00288.hairpin | YES | NO | YES | NO | NO | NO | NO | NO |
| TJU_CMC_MD2.ID00289.5p-miR | TJU_CMC_MD2.ID00289.hairpin | YES | YES | YES | NO | YES | NO | NO | NO |
| TJU_CMC_MD2.ID00290.5p-miR | TJU_CMC_MD2.ID00290.hairpin | YES | YES | NO | NO | NO | NO | NO | NO |
| TJU_CMC_MD2.ID00291.3p-miR | TJU_CMC_MD2.ID00291.hairpin | YES | NO | NO | NO | NO | NO | NO | NO |
| TJU_CMC_MD2.ID00292.3p-miR | TJU_CMC_MD2.ID00292.hairpin | YES | NO | NO | NO | NO | NO | NO | NO |
| TJU_CMC_MD2.ID00293.3p-miR | TJU_CMC_MD2.ID00293.hairpin | YES | YES | YES | YES | NO | NO | NO | NO |
| TJU_CMC_MD2.ID00293.5p-miR | TJU_CMC_MD2.ID00293.hairpin | YES | YES | YES | YES | YES | NO | NO | NO |
| TJU_CMC_MD2.ID00294.5p-miR | TJU_CMC_MD2.ID00294.hairpin | YES | YES | YES | YES | NO | NO | NO | NO |
| TJU_CMC_MD2.ID00295.3p-miR | TJU_CMC_MD2.ID00295.hairpin | YES | NO | NO | NO | NO | NO | NO | NO |
| TJU_CMC_MD2.ID00296.3p-miR | TJU_CMC_MD2.ID00296.hairpin | YES | NO | YES | NO | NO | NO | NO | NO |
| TJU_CMC_MD2.ID00297.5p-miR | TJU_CMC_MD2.ID00297.hairpin | YES | YES | YES | YES | YES | NO | NO | NO |
| TJU_CMC_MD2.ID00298.3p-miR | TJU_CMC_MD2.ID00298.hairpin | YES | NO | NO | NO | NO | NO | NO | NO |
| TJU_CMC_MD2.ID00299.3p-miR | TJU_CMC_MD2.ID00299.hairpin | YES | NO | NO | NO | NO | NO | NO | NO |
| TJU_CMC_MD2.ID00300.5p-miR | TJU_CMC_MD2.ID00300.hairpin | YES | YES | YES | YES | NO | YES | NO | NO |
| TJU_CMC_MD2.ID00301.3p-miR | TJU_CMC_MD2.ID00301.hairpin | YES | NO | NO | NO | NO | NO | NO | NO |
| TJU_CMC_MD2.ID00302.5p-miR | TJU_CMC_MD2.ID00302.hairpin | YES | YES | YES | NO | NO | NO | NO | NO |
| TJU_CMC_MD2.ID00303.5p-miR | TJU_CMC_MD2.ID00303.hairpin | YES | YES | NO | YES | NO | NO | NO | NO |
| TJU_CMC_MD2.ID00304.5p-miR | TJU_CMC_MD2.ID00304.hairpin | YES | NO | NO | NO | NO | NO | NO | NO |
| TJU_CMC_MD2.ID00305.3p-miR | TJU_CMC_MD2.ID00305.hairpin | YES | NO | NO | NO | NO | NO | NO | NO |
| TJU_CMC_MD2.ID00306.5p-miR | TJU_CMC_MD2.ID00306.hairpin | YES | NO | NO | NO | NO | NO | NO | NO |
| TJU_CMC_MD2.ID00307.5p-miR | TJU_CMC_MD2.ID00307.hairpin | YES | NO | NO | NO | NO | NO | NO | NO |
| TJU_CMC_MD2.ID00308.3p-miR | TJU_CMC_MD2.ID00308.hairpin | YES | NO | NO | NO | NO | NO | NO | NO |
| TJU_CMC_MD2.ID00309.5p-miR | TJU_CMC_MD2.ID00309.hairpin | YES | YES | YES | YES | NO | NO | NO | NO |
| TJU_CMC_MD2.ID00310.3p-miR | TJU_CMC_MD2.ID00310.hairpin | YES | NO | NO | NO | NO | NO | NO | NO |
| TJU_CMC_MD2.ID00311.5p-miR | TJU_CMC_MD2.ID00311.hairpin | YES | NO | NO | NO | NO | NO | NO | NO |
| TJU_CMC_MD2.ID00312.3p-miR | TJU_CMC_MD2.ID00312.hairpin | YES | NO | NO | NO | NO | NO | NO | NO |
| TJU_CMC_MD2.ID00313.3p-miR | TJU_CMC_MD2.ID00313.hairpin | YES | NO | NO | NO | NO | NO | NO | NO |
| TJU_CMC_MD2.ID00314.3p-miR | TJU_CMC_MD2.ID00314.hairpin | YES | NO | NO | NO | NO | NO | NO | NO |
| TJU_CMC_MD2.ID00314.5p-miR | TJU_CMC_MD2.ID00314.hairpin | YES | YES | NO | YES | YES | NO | NO | NO |
| TJU_CMC_MD2.ID00315.3p-miR | TJU_CMC_MD2.ID00315.hairpin | YES | NO | NO | NO | NO | NO | NO | NO |
| TJU_CMC_MD2.ID00315.5p-miR | TJU_CMC_MD2.ID00315.hairpin | YES | NO | NO | NO | NO | NO | NO | NO |
| TJU_CMC_MD2.ID00316.3p-miR | TJU_CMC_MD2.ID00316.hairpin | YES | NO | NO | NO | NO | NO | NO | NO |
| TJU_CMC_MD2.ID00317.5p-miR | TJU_CMC_MD2.ID00317.hairpin | YES | YES | YES | YES | YES | NO | NO | NO |
| TJU_CMC_MD2.ID00318.3p-miR | TJU_CMC_MD2.ID00318.hairpin | YES | NO | NO | NO | NO | NO | NO | NO |
| TJU_CMC_MD2.ID00319.3p-miR | TJU_CMC_MD2.ID00319.hairpin | YES | NO | NO | NO | NO | NO | NO | NO |
| TJU_CMC_MD2.ID00320.3p-miR | TJU_CMC_MD2.ID00320.hairpin | YES | NO | NO | NO | NO | NO | NO | NO |
| TJU_CMC_MD2.ID00321.5p-miR | TJU_CMC_MD2.ID00321.hairpin | YES | NO | YES | YES | YES | NO | NO | NO |
| TJU_CMC_MD2.ID00322.5p-miR | TJU_CMC_MD2.ID00322.hairpin | YES | YES | YES | YES | YES | NO | NO | NO |
| TJU_CMC_MD2.ID00323.3p-miR | TJU_CMC_MD2.ID00323.hairpin | YES | NO | NO | NO | NO | NO | NO | NO |
| TJU_CMC_MD2.ID00324.3p-miR | TJU_CMC_MD2.ID00324.hairpin | YES | NO | NO | NO | NO | NO | NO | NO |
| TJU_CMC_MD2.ID00325.3p-miR | TJU_CMC_MD2.ID00325.hairpin | YES | NO | NO | NO | NO | NO | NO | NO |
| TJU_CMC_MD2.ID00326.5p-miR | TJU_CMC_MD2.ID00326.hairpin | YES | NO | NO | YES | NO | NO | NO | NO |
| TJU_CMC_MD2.ID00327.3p-miR | TJU_CMC_MD2.ID00327.hairpin | YES | NO | NO | NO | NO | NO | NO | NO |
| TJU_CMC_MD2.ID00327.5p-miR | TJU_CMC_MD2.ID00327.hairpin | YES | NO | NO | YES | NO | NO | NO | NO |
| TJU_CMC_MD2.ID00328.3p-miR | TJU_CMC_MD2.ID00328.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00329.3p-miR | TJU_CMC_MD2.ID00329.hairpin | YES | NO | NO | NO | NO | NO | NO | NO |
| TJU_CMC_MD2.ID00330.5p-miR | TJU_CMC_MD2.ID00330.hairpin | YES | YES | NO | NO | YES | NO | NO | NO |
| TJU_CMC_MD2.ID00331.5p-miR | TJU_CMC_MD2.ID00331.hairpin | YES | YES | NO | NO | NO | NO | NO | NO |
| TJU_CMC_MD2.ID00332.3p-miR | TJU_CMC_MD2.ID00332.hairpin | YES | NO | NO | NO | NO | NO | NO | NO |
| TJU_CMC_MD2.ID00333.3p-miR | TJU_CMC_MD2.ID00333.hairpin | YES | NO | NO | NO | NO | NO | NO | NO |
| TJU_CMC_MD2.ID00334.3p-miR | TJU_CMC_MD2.ID00334.hairpin | YES | NO | NO | NO | NO | NO | NO | NO |
| TJU_CMC_MD2.ID00335.5p-miR | TJU_CMC_MD2.ID00335.hairpin | YES | YES | YES | YES | YES | NO | NO | NO |
| TJU_CMC_MD2.ID00336.3p-miR | TJU_CMC_MD2.ID00336.hairpin | YES | NO | NO | NO | NO | NO | NO | NO |
| TJU_CMC_MD2.ID00337.3p-miR | TJU_CMC_MD2.ID00337.hairpin | YES | NO | NO | NO | NO | NO | NO | NO |
| TJU_CMC_MD2.ID00338.3p-miR | TJU_CMC_MD2.ID00338.hairpin | YES | NO | NO | NO | NO | NO | NO | NO |
| TJU_CMC_MD2.ID00339.3p-miR | TJU_CMC_MD2.ID00339.hairpin | YES | NO | NO | NO | NO | NO | NO | NO |
| TJU_CMC_MD2.ID00340.5p-miR | TJU_CMC_MD2.ID00340.hairpin | YES | YES | YES | NO | NO | NO | NO | NO |
| TJU_CMC_MD2.ID00341.5p-miR | TJU_CMC_MD2.ID00341.hairpin | YES | YES | NO | YES | YES | NO | NO | NO |
| TJU_CMC_MD2.ID00342.5p-miR | TJU_CMC_MD2.ID00342.hairpin | YES | YES | YES | YES | NO | YES | NO | NO |
| TJU_CMC_MD2.ID00343.3p-miR | TJU_CMC_MD2.ID00343.hairpin | YES | YES | YES | YES | NO | NO | NO | NO |
| TJU_CMC_MD2.ID00344.5p-miR | TJU_CMC_MD2.ID00344.hairpin | YES | YES | NO | NO | NO | NO | NO | NO |
| TJU_CMC_MD2.ID00345.3p-miR | TJU_CMC_MD2.ID00345.hairpin | YES | NO | NO | NO | NO | NO | NO | NO |
| TJU_CMC_MD2.ID00346.3p-miR | TJU_CMC_MD2.ID00346.hairpin | YES | NO | NO | NO | NO | NO | NO | NO |
| TJU_CMC_MD2.ID00347.3p-miR | TJU_CMC_MD2.ID00347.hairpin | YES | NO | NO | NO | NO | NO | NO | NO |
| TJU_CMC_MD2.ID00348.3p-miR | TJU_CMC_MD2.ID00348.hairpin | YES | NO | NO | NO | NO | NO | NO | NO |
| TJU_CMC_MD2.ID00349.3p-miR | TJU_CMC_MD2.ID00349.hairpin | YES | NO | NO | NO | NO | NO | NO | NO |
| TJU_CMC_MD2.ID00350.3p-miR | TJU_CMC_MD2.ID00350.hairpin | YES | NO | NO | NO | NO | NO | NO | NO |
| TJU_CMC_MD2.ID00350.5p-miR | TJU_CMC_MD2.ID00350.hairpin | YES | NO | YES | NO | YES | NO | NO | NO |
| TJU_CMC_MD2.ID00351.3p-miR | TJU_CMC_MD2.ID00351.hairpin | YES | NO | NO | NO | NO | NO | NO | NO |
| TJU_CMC_MD2.ID00352.3p-miR | TJU_CMC_MD2.ID00352.hairpin | YES | NO | NO | NO | NO | NO | NO | NO |
| TJU_CMC_MD2.ID00353.5p-miR | TJU_CMC_MD2.ID00353.hairpin | YES | YES | NO | NO | NO | NO | NO | NO |
| TJU_CMC_MD2.ID00354.3p-miR | TJU_CMC_MD2.ID00354.hairpin | YES | NO | NO | NO | NO | NO | NO | NO |
| TJU_CMC_MD2.ID00355.5p-miR | TJU_CMC_MD2.ID00355.hairpin | YES | YES | YES | YES | NO | NO | NO | NO |
| TJU_CMC_MD2.ID00356.3p-miR | TJU_CMC_MD2.ID00356.hairpin | YES | NO | NO | NO | NO | NO | NO | NO |
| TJU_CMC_MD2.ID00357.3p-miR | TJU_CMC_MD2.ID00357.hairpin | YES | NO | NO | NO | NO | NO | NO | NO |
| TJU_CMC_MD2.ID00357.5p-miR | TJU_CMC_MD2.ID00357.hairpin | YES | NO | YES | YES | NO | NO | NO | NO |
| TJU_CMC_MD2.ID00358.3p-miR | TJU_CMC_MD2.ID00358.hairpin | YES | NO | YES | YES | YES | NO | NO | NO |
| TJU_CMC_MD2.ID00358.5p-miR | TJU_CMC_MD2.ID00358.hairpin | YES | NO | YES | NO | NO | NO | NO | NO |
| TJU_CMC_MD2.ID00359.5p-miR | TJU_CMC_MD2.ID00359.hairpin | YES | NO | YES | NO | NO | NO | NO | NO |
| TJU_CMC_MD2.ID00360.3p-miR | TJU_CMC_MD2.ID00360.hairpin | YES | NO | NO | NO | NO | NO | NO | NO |
| TJU_CMC_MD2.ID00361.3p-miR | TJU_CMC_MD2.ID00361.hairpin | YES | NO | NO | NO | NO | NO | NO | NO |
| TJU_CMC_MD2.ID00362.5p-miR | TJU_CMC_MD2.ID00362.hairpin | YES | YES | YES | YES | YES | NO | NO | NO |
| TJU_CMC_MD2.ID00363.3p-miR | TJU_CMC_MD2.ID00363.hairpin | YES | NO | NO | NO | NO | NO | NO | NO |
| TJU_CMC_MD2.ID00364.5p-miR | TJU_CMC_MD2.ID00364.hairpin | YES | YES | YES | YES | NO | YES | NO | NO |
| TJU_CMC_MD2.ID00365.3p-miR | TJU_CMC_MD2.ID00365.hairpin | YES | NO | NO | NO | NO | NO | NO | NO |
| TJU_CMC_MD2.ID00365.5p-miR | TJU_CMC_MD2.ID00365.hairpin | YES | YES | YES | NO | YES | NO | NO | NO |
| TJU_CMC_MD2.ID00366.3p-miR | TJU_CMC_MD2.ID00366.hairpin | YES | YES | YES | YES | YES | NO | NO | NO |
| TJU_CMC_MD2.ID00367.5p-miR | TJU_CMC_MD2.ID00367.hairpin | YES | YES | YES | NO | YES | NO | NO | NO |
| TJU_CMC_MD2.ID00368.3p-miR | TJU_CMC_MD2.ID00368.hairpin | YES | NO | NO | NO | NO | NO | NO | NO |
| TJU_CMC_MD2.ID00369.3p-miR | TJU_CMC_MD2.ID00369.hairpin | YES | NO | NO | NO | NO | NO | NO | NO |
| TJU_CMC_MD2.ID00370.3p-miR | TJU_CMC_MD2.ID00370.hairpin | YES | NO | NO | NO | NO | NO | NO | NO |
| TJU_CMC_MD2.ID00370.5p-miR | TJU_CMC_MD2.ID00370.hairpin | YES | YES | YES | YES | NO | NO | NO | NO |
| TJU_CMC_MD2.ID00371.5p-miR | TJU_CMC_MD2.ID00371.hairpin | YES | NO | YES | YES | NO | NO | NO | NO |
| TJU_CMC_MD2.ID00372.5p-miR | TJU_CMC_MD2.ID00372.hairpin | YES | YES | NO | YES | NO | NO | NO | NO |
| TJU_CMC_MD2.ID00373.3p-miR | TJU_CMC_MD2.ID00373.hairpin | YES | NO | NO | NO | NO | NO | NO | NO |
| TJU_CMC_MD2.ID00374.3p-miR | TJU_CMC_MD2.ID00374.hairpin | YES | NO | NO | NO | NO | NO | NO | NO |
| TJU_CMC_MD2.ID00375.3p-miR | TJU_CMC_MD2.ID00375.hairpin | YES | NO | NO | NO | NO | NO | NO | NO |
| TJU_CMC_MD2.ID00376.5p-miR | TJU_CMC_MD2.ID00376.hairpin | YES | YES | YES | YES | NO | NO | NO | NO |
| TJU_CMC_MD2.ID00377.3p-miR | TJU_CMC_MD2.ID00377.hairpin | YES | NO | NO | NO | NO | NO | NO | NO |
| TJU_CMC_MD2.ID00378.3p-miR | TJU_CMC_MD2.ID00378.hairpin | YES | NO | NO | NO | NO | NO | NO | NO |
| TJU_CMC_MD2.ID00379.3p-miR | TJU_CMC_MD2.ID00379.hairpin | YES | NO | NO | NO | NO | NO | NO | NO |
| TJU_CMC_MD2.ID00380.3p-miR | TJU_CMC_MD2.ID00380.hairpin | YES | NO | NO | NO | NO | NO | NO | NO |
| TJU_CMC_MD2.ID00381.3p-miR | TJU_CMC_MD2.ID00381.hairpin | YES | NO | NO | NO | NO | NO | NO | NO |
| TJU_CMC_MD2.ID00382.3p-miR | TJU_CMC_MD2.ID00382.hairpin | YES | NO | NO | NO | NO | NO | NO | NO |
| TJU_CMC_MD2.ID00382.5p-miR | TJU_CMC_MD2.ID00382.hairpin | YES | NO | NO | NO | NO | NO | NO | NO |
| TJU_CMC_MD2.ID00383.3p-miR | TJU_CMC_MD2.ID00383.hairpin | YES | NO | NO | NO | NO | NO | NO | NO |
| TJU_CMC_MD2.ID00383.5p-miR | TJU_CMC_MD2.ID00383.hairpin | YES | YES | YES | NO | NO | NO | NO | NO |
| TJU_CMC_MD2.ID00384.3p-miR | TJU_CMC_MD2.ID00384.hairpin | YES | NO | NO | NO | NO | NO | NO | NO |
| TJU_CMC_MD2.ID00385.5p-miR | TJU_CMC_MD2.ID00385.hairpin | YES | YES | YES | NO | NO | NO | NO | NO |
| TJU_CMC_MD2.ID00386.3p-miR | TJU_CMC_MD2.ID00386.hairpin | YES | YES | YES | YES | YES | NO | NO | NO |
| TJU_CMC_MD2.ID00387.3p-miR | TJU_CMC_MD2.ID00387.hairpin | YES | NO | NO | NO | NO | NO | NO | NO |
| TJU_CMC_MD2.ID00388.3p-miR | TJU_CMC_MD2.ID00388.hairpin | YES | NO | NO | NO | NO | NO | NO | NO |
| TJU_CMC_MD2.ID00389.5p-miR | TJU_CMC_MD2.ID00389.hairpin | YES | YES | YES | YES | NO | NO | NO | NO |
| TJU_CMC_MD2.ID00390.5p-miR | TJU_CMC_MD2.ID00390.hairpin | YES | YES | YES | YES | YES | NO | NO | NO |
| TJU_CMC_MD2.ID00391.5p-miR | TJU_CMC_MD2.ID00391.hairpin | YES | YES | YES | YES | YES | NO | NO | NO |
| TJU_CMC_MD2.ID00392.3p-miR | TJU_CMC_MD2.ID00392.hairpin | YES | YES | YES | NO | NO | NO | NO | NO |
| TJU_CMC_MD2.ID00392.5p-miR | TJU_CMC_MD2.ID00392.hairpin | YES | YES | NO | NO | NO | NO | NO | NO |
| TJU_CMC_MD2.ID00393.3p-miR | TJU_CMC_MD2.ID00393.hairpin | YES | NO | NO | NO | NO | NO | NO | NO |
| TJU_CMC_MD2.ID00394.3p-miR | TJU_CMC_MD2.ID00394.hairpin | YES | NO | NO | NO | NO | NO | NO | NO |
| TJU_CMC_MD2.ID00395.5p-miR | TJU_CMC_MD2.ID00395.hairpin | YES | YES | YES | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00396.3p-miR | TJU_CMC_MD2.ID00396.hairpin | YES | YES | YES | YES | NO | NO | NO | NO |
| TJU_CMC_MD2.ID00397.5p-miR | TJU_CMC_MD2.ID00397.hairpin | YES | YES | YES | YES | NO | NO | NO | NO |
| TJU_CMC_MD2.ID00398.3p-miR | TJU_CMC_MD2.ID00398.hairpin | YES | NO | NO | NO | NO | NO | NO | NO |
| TJU_CMC_MD2.ID00399.3p-miR | TJU_CMC_MD2.ID00399.hairpin | YES | NO | NO | NO | NO | NO | NO | NO |
| TJU_CMC_MD2.ID00400.5p-miR | TJU_CMC_MD2.ID00400.hairpin | YES | YES | YES | YES | YES | YES | NO | NO |
| TJU_CMC_MD2.ID00401.5p-miR | TJU_CMC_MD2.ID00401.hairpin | YES | NO | NO | NO | NO | NO | NO | NO |
| TJU_CMC_MD2.ID00402.5p-miR | TJU_CMC_MD2.ID00402.hairpin | YES | YES | YES | YES | NO | NO | NO | NO |
| TJU_CMC_MD2.ID00403.3p-miR | TJU_CMC_MD2.ID00403.hairpin | YES | NO | NO | NO | NO | NO | NO | NO |
| TJU_CMC_MD2.ID00404.3p-miR | TJU_CMC_MD2.ID00404.hairpin | YES | NO | NO | NO | NO | NO | NO | NO |
| TJU_CMC_MD2.ID00405.3p-miR | TJU_CMC_MD2.ID00405.hairpin | YES | NO | NO | NO | NO | NO | NO | NO |
| TJU_CMC_MD2.ID00406.3p-miR | TJU_CMC_MD2.ID00406.hairpin | YES | NO | NO | NO | NO | NO | NO | NO |
| TJU_CMC_MD2.ID00407.3p-miR | TJU_CMC_MD2.ID00407.hairpin | YES | NO | NO | NO | NO | NO | NO | NO |
| TJU_CMC_MD2.ID00408.5p-miR | TJU_CMC_MD2.ID00408.hairpin | YES | YES | YES | NO | YES | NO | NO | NO |
| TJU_CMC_MD2.ID00409.5p-miR | TJU_CMC_MD2.ID00409.hairpin | YES | YES | YES | YES | NO | NO | NO | NO |
| TJU_CMC_MD2.ID00410.3p-miR | TJU_CMC_MD2.ID00410.hairpin | YES | NO | NO | NO | NO | NO | NO | NO |
| TJU_CMC_MD2.ID00411.5p-miR | TJU_CMC_MD2.ID00411.hairpin | YES | YES | YES | YES | NO | NO | NO | NO |
| TJU_CMC_MD2.ID00412.3p-miR | TJU_CMC_MD2.ID00412.hairpin | YES | NO | NO | NO | NO | NO | NO | NO |
| TJU_CMC_MD2.ID00413.5p-miR | TJU_CMC_MD2.ID00413.hairpin | YES | YES | YES | YES | YES | NO | NO | NO |
| TJU_CMC_MD2.ID00414.3p-miR | TJU_CMC_MD2.ID00414.hairpin | YES | NO | NO | NO | NO | NO | NO | NO |
| TJU_CMC_MD2.ID00415.5p-miR | TJU_CMC_MD2.ID00415.hairpin | YES | YES | YES | YES | NO | NO | NO | NO |
| TJU_CMC_MD2.ID00416.5p-miR | TJU_CMC_MD2.ID00416.hairpin | YES | YES | YES | YES | YES | NO | NO | NO |
| TJU_CMC_MD2.ID00417.3p-miR | TJU_CMC_MD2.ID00417.hairpin | YES | NO | NO | NO | NO | NO | NO | NO |
| TJU_CMC_MD2.ID00418.5p-miR | TJU_CMC_MD2.ID00418.hairpin | YES | NO | YES | YES | YES | YES | NO | NO |
| TJU_CMC_MD2.ID00419.3p-miR | TJU_CMC_MD2.ID00419.hairpin | YES | NO | NO | NO | NO | NO | NO | NO |
| TJU_CMC_MD2.ID00420.3p-miR | TJU_CMC_MD2.ID00420.hairpin | YES | NO | NO | NO | NO | NO | NO | NO |
| TJU_CMC_MD2.ID00421.3p-miR | TJU_CMC_MD2.ID00421.hairpin | YES | NO | NO | NO | NO | NO | NO | NO |
| TJU_CMC_MD2.ID00422.3p-miR | TJU_CMC_MD2.ID00422.hairpin | YES | NO | NO | NO | NO | NO | NO | NO |
| TJU_CMC_MD2.ID00423.3p-miR | TJU_CMC_MD2.ID00423.hairpin | YES | NO | NO | NO | NO | NO | NO | NO |
| TJU_CMC_MD2.ID00424.5p-miR | TJU_CMC_MD2.ID00424.hairpin | YES | YES | YES | YES | NO | NO | NO | NO |
| TJU_CMC_MD2.ID00425.5p-miR | TJU_CMC_MD2.ID00425.hairpin | YES | YES | YES | YES | YES | NO | NO | NO |
| TJU_CMC_MD2.ID00426.3p-miR | TJU_CMC_MD2.ID00426.hairpin | YES | NO | NO | NO | NO | NO | NO | NO |
| TJU_CMC_MD2.ID00427.5p-miR | TJU_CMC_MD2.ID00427.hairpin | YES | YES | YES | YES | NO | NO | NO | NO |
| TJU_CMC_MD2.ID00428.3p-miR | TJU_CMC_MD2.ID00428.hairpin | YES | NO | NO | NO | NO | NO | NO | NO |
| TJU_CMC_MD2.ID00429.3p-miR | TJU_CMC_MD2.ID00429.hairpin | YES | NO | NO | NO | NO | NO | NO | NO |
| TJU_CMC_MD2.ID00430.3p-miR | TJU_CMC_MD2.ID00430.hairpin | YES | YES | YES | YES | YES | NO | NO | NO |
| TJU_CMC_MD2.ID00431.5p-miR | TJU_CMC_MD2.ID00431.hairpin | YES | NO | NO | YES | NO | NO | NO | NO |
| TJU_CMC_MD2.ID00432.3p-miR | TJU_CMC_MD2.ID00432.hairpin | YES | NO | NO | NO | NO | NO | NO | NO |
| TJU_CMC_MD2.ID00433.3p-miR | TJU_CMC_MD2.ID00433.hairpin | YES | NO | NO | NO | NO | NO | NO | NO |
| TJU_CMC_MD2.ID00434.3p-miR | TJU_CMC_MD2.ID00434.hairpin | YES | NO | NO | NO | NO | NO | NO | NO |
| TJU_CMC_MD2.ID00435.3p-miR | TJU_CMC_MD2.ID00435.hairpin | YES | NO | NO | NO | NO | NO | NO | NO |
| TJU_CMC_MD2.ID00435.5p-miR | TJU_CMC_MD2.ID00435.hairpin | YES | YES | YES | YES | NO | NO | NO | NO |
| TJU_CMC_MD2.ID00436.3p-miR | TJU_CMC_MD2.ID00436.hairpin | YES | NO | NO | NO | NO | NO | NO | NO |
| TJU_CMC_MD2.ID00437.3p-miR | TJU_CMC_MD2.ID00437.hairpin | YES | NO | NO | NO | NO | NO | NO | NO |
| TJU_CMC_MD2.ID00438.3p-miR | TJU_CMC_MD2.ID00438.hairpin | YES | NO | NO | NO | NO | NO | NO | NO |
| TJU_CMC_MD2.ID00439.3p-miR | TJU_CMC_MD2.ID00439.hairpin | YES | YES | YES | YES | YES | NO | NO | NO |
| TJU_CMC_MD2.ID00440.5p-miR | TJU_CMC_MD2.ID00440.hairpin | YES | YES | YES | YES | NO | NO | NO | NO |
| TJU_CMC_MD2.ID00441.3p-miR | TJU_CMC_MD2.ID00441.hairpin | YES | NO | NO | NO | NO | NO | NO | NO |
| TJU_CMC_MD2.ID00442.5p-miR | TJU_CMC_MD2.ID00442.hairpin | YES | YES | YES | YES | YES | NO | NO | NO |
| TJU_CMC_MD2.ID00443.5p-miR | TJU_CMC_MD2.ID00443.hairpin | YES | YES | YES | YES | YES | NO | NO | NO |
| TJU_CMC_MD2.ID00444.5p-miR | TJU_CMC_MD2.ID00444.hairpin | YES | YES | YES | YES | NO | NO | NO | NO |
| TJU_CMC_MD2.ID00445.3p-miR | TJU_CMC_MD2.ID00445.hairpin | YES | NO | NO | NO | NO | NO | NO | NO |
| TJU_CMC_MD2.ID00446.3p-miR | TJU_CMC_MD2.ID00446.hairpin | YES | NO | NO | NO | NO | NO | NO | NO |
| TJU_CMC_MD2.ID00447.5p-miR | TJU_CMC_MD2.ID00447.hairpin | YES | YES | NO | YES | NO | NO | NO | NO |
| TJU_CMC_MD2.ID00448.3p-miR | TJU_CMC_MD2.ID00448.hairpin | YES | NO | NO | NO | NO | NO | NO | NO |
| TJU_CMC_MD2.ID00448.5p-miR | TJU_CMC_MD2.ID00448.hairpin | YES | YES | YES | YES | YES | NO | NO | NO |
| TJU_CMC_MD2.ID00449.5p-miR | TJU_CMC_MD2.ID00449.hairpin | YES | YES | YES | YES | YES | NO | NO | NO |
| TJU_CMC_MD2.ID00450.3p-miR | TJU_CMC_MD2.ID00450.hairpin | YES | NO | NO | NO | NO | NO | NO | NO |
| TJU_CMC_MD2.ID00451.3p-miR | TJU_CMC_MD2.ID00451.hairpin | YES | NO | NO | NO | NO | NO | NO | NO |
| TJU_CMC_MD2.ID00452.3p-miR | TJU_CMC_MD2.ID00452.hairpin | YES | NO | NO | NO | NO | NO | NO | NO |
| TJU_CMC_MD2.ID00453.3p-miR | TJU_CMC_MD2.ID00453.hairpin | YES | NO | NO | NO | NO | NO | NO | NO |
| TJU_CMC_MD2.ID00454.3p-miR | TJU_CMC_MD2.ID00454.hairpin | YES | NO | NO | NO | NO | NO | NO | NO |
| TJU_CMC_MD2.ID00455.5p-miR | TJU_CMC_MD2.ID00455.hairpin | YES | NO | NO | NO | NO | NO | NO | NO |
| TJU_CMC_MD2.ID00456.5p-miR | TJU_CMC_MD2.ID00456.hairpin | YES | YES | YES | YES | NO | NO | NO | NO |
| TJU_CMC_MD2.ID00457.3p-miR | TJU_CMC_MD2.ID00457.hairpin | YES | NO | NO | NO | NO | NO | NO | NO |
| TJU_CMC_MD2.ID00458.5p-miR | TJU_CMC_MD2.ID00458.hairpin | YES | NO | NO | NO | NO | NO | NO | NO |
| TJU_CMC_MD2.ID00459.5p-miR | TJU_CMC_MD2.ID00459.hairpin | YES | YES | NO | YES | NO | NO | NO | NO |
| TJU_CMC_MD2.ID00460.5p-miR | TJU_CMC_MD2.ID00460.hairpin | YES | NO | YES | YES | YES | NO | NO | NO |
| TJU_CMC_MD2.ID00461.3p-miR | TJU_CMC_MD2.ID00461.hairpin | YES | YES | YES | YES | YES | NO | NO | NO |
| TJU_CMC_MD2.ID00462.3p-miR | TJU_CMC_MD2.ID00462.hairpin | YES | NO | NO | NO | NO | NO | NO | NO |
| TJU_CMC_MD2.ID00463.3p-miR | TJU_CMC_MD2.ID00463.hairpin | YES | NO | NO | NO | NO | NO | NO | NO |
| TJU_CMC_MD2.ID00464.3p-miR | TJU_CMC_MD2.ID00464.hairpin | YES | NO | NO | NO | NO | NO | NO | NO |
| TJU_CMC_MD2.ID00464.5p-miR | TJU_CMC_MD2.ID00464.hairpin | YES | YES | YES | NO | YES | NO | NO | NO |
| TJU_CMC_MD2.ID00465.5p-miR | TJU_CMC_MD2.ID00465.hairpin | YES | NO | NO | NO | NO | NO | NO | NO |
| TJU_CMC_MD2.ID00466.5p-miR | TJU_CMC_MD2.ID00466.hairpin | YES | YES | YES | YES | NO | NO | NO | NO |
| TJU_CMC_MD2.ID00467.5p-miR | TJU_CMC_MD2.ID00467.hairpin | YES | YES | NO | YES | YES | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00468.3p-miR | TJU_CMC_MD2.ID00468.hairpin | YES | NO | NO | NO | NO | NO | NO | NO |
| TJU_CMC_MD2.ID00469.3p-miR | TJU_CMC_MD2.ID00469.hairpin | YES | NO | NO | NO | NO | NO | NO | NO |
| TJU_CMC_MD2.ID00470.5p-miR | TJU_CMC_MD2.ID00470.hairpin | YES | YES | YES | NO | NO | NO | NO | NO |
| TJU_CMC_MD2.ID00471.3p-miR | TJU_CMC_MD2.ID00471.hairpin | YES | NO | NO | NO | NO | NO | NO | NO |
| TJU_CMC_MD2.ID00472.3p-miR | TJU_CMC_MD2.ID00472.hairpin | YES | YES | YES | NO | YES | NO | NO | NO |
| TJU_CMC_MD2.ID00472.5p-miR | TJU_CMC_MD2.ID00472.hairpin | YES | YES | YES | NO | YES | NO | NO | NO |
| TJU_CMC_MD2.ID00473.3p-miR | TJU_CMC_MD2.ID00473.hairpin | YES | NO | NO | NO | NO | NO | NO | NO |
| TJU_CMC_MD2.ID00474.3p-miR | TJU_CMC_MD2.ID00474.hairpin | YES | NO | NO | NO | NO | NO | NO | NO |
| TJU_CMC_MD2.ID00475.3p-miR | TJU_CMC_MD2.ID00475.hairpin | YES | NO | NO | NO | NO | NO | NO | NO |
| TJU_CMC_MD2.ID00476.3p-miR | TJU_CMC_MD2.ID00476.hairpin | YES | NO | NO | NO | NO | NO | NO | NO |
| TJU_CMC_MD2.ID00477.5p-miR | TJU_CMC_MD2.ID00477.hairpin | YES | YES | YES | NO | NO | NO | NO | NO |
| TJU_CMC_MD2.ID00478.3p-miR | TJU_CMC_MD2.ID00478.hairpin | YES | NO | NO | NO | NO | NO | NO | NO |
| TJU_CMC_MD2.ID00479.5p-miR | TJU_CMC_MD2.ID00479.hairpin | YES | YES | NO | NO | NO | NO | NO | NO |
| TJU_CMC_MD2.ID00480.3p-miR | TJU_CMC_MD2.ID00480.hairpin | YES | YES | YES | NO | NO | NO | NO | NO |
| TJU_CMC_MD2.ID00480.5p-miR | TJU_CMC_MD2.ID00480.hairpin | YES | YES | YES | NO | NO | NO | NO | NO |
| TJU_CMC_MD2.ID00481.5p-miR | TJU_CMC_MD2.ID00481.hairpin | YES | YES | YES | NO | YES | NO | NO | NO |
| TJU_CMC_MD2.ID00482.5p-miR | TJU_CMC_MD2.ID00482.hairpin | YES | NO | YES | YES | NO | NO | NO | NO |
| TJU_CMC_MD2.ID00483.3p-miR | TJU_CMC_MD2.ID00483.hairpin | YES | NO | NO | NO | NO | NO | NO | NO |
| TJU_CMC_MD2.ID00484.3p-miR | TJU_CMC_MD2.ID00484.hairpin | YES | NO | NO | NO | NO | NO | NO | NO |
| TJU_CMC_MD2.ID00485.5p-miR | TJU_CMC_MD2.ID00485.hairpin | YES | YES | YES | NO | NO | NO | NO | NO |
| TJU_CMC_MD2.ID00486.3p-miR | TJU_CMC_MD2.ID00486.hairpin | YES | NO | NO | NO | NO | NO | NO | NO |
| TJU_CMC_MD2.ID00487.3p-miR | TJU_CMC_MD2.ID00487.hairpin | YES | NO | NO | NO | NO | NO | NO | NO |
| TJU_CMC_MD2.ID00488.5p-miR | TJU_CMC_MD2.ID00488.hairpin | YES | YES | YES | YES | NO | NO | NO | NO |
| TJU_CMC_MD2.ID00489.3p-miR | TJU_CMC_MD2.ID00489.hairpin | YES | NO | NO | NO | NO | NO | NO | NO |
| TJU_CMC_MD2.ID00490.5p-miR | TJU_CMC_MD2.ID00490.hairpin | YES | YES | YES | YES | NO | NO | NO | NO |
| TJU_CMC_MD2.ID00491.5p-miR | TJU_CMC_MD2.ID00491.hairpin | YES | YES | YES | YES | NO | NO | NO | NO |
| TJU_CMC_MD2.ID00492.5p-miR | TJU_CMC_MD2.ID00492.hairpin | YES | YES | YES | YES | NO | NO | NO | NO |
| TJU_CMC_MD2.ID00493.3p-miR | TJU_CMC_MD2.ID00493.hairpin | YES | NO | NO | NO | NO | NO | NO | NO |
| TJU_CMC_MD2.ID00494.5p-miR | TJU_CMC_MD2.ID00494.hairpin | YES | YES | YES | NO | YES | NO | NO | NO |
| TJU_CMC_MD2.ID00495.5p-miR | TJU_CMC_MD2.ID00495.hairpin | YES | YES | YES | YES | NO | NO | NO | NO |
| TJU_CMC_MD2.ID00496.5p-miR | TJU_CMC_MD2.ID00496.hairpin | YES | YES | YES | YES | NO | NO | NO | NO |
| TJU_CMC_MD2.ID00497.3p-miR | TJU_CMC_MD2.ID00497.hairpin | YES | NO | NO | NO | NO | NO | NO | NO |
| TJU_CMC_MD2.ID00498.5p-miR | TJU_CMC_MD2.ID00498.hairpin | YES | YES | YES | YES | NO | NO | NO | NO |
| TJU_CMC_MD2.ID00499.3p-miR | TJU_CMC_MD2.ID00499.hairpin | YES | NO | NO | NO | NO | NO | NO | NO |
| TJU_CMC_MD2.ID00500.3p-miR | TJU_CMC_MD2.ID00500.hairpin | YES | NO | NO | NO | NO | NO | NO | NO |
| TJU_CMC_MD2.ID00501.5p-miR | TJU_CMC_MD2.ID00501.hairpin | YES | YES | YES | YES | YES | NO | NO | NO |
| TJU_CMC_MD2.ID00502.5p-miR | TJU_CMC_MD2.ID00502.hairpin | YES | YES | NO | YES | NO | NO | NO | NO |
| TJU_CMC_MD2.ID00503.5p-miR | TJU_CMC_MD2.ID00503.hairpin | YES | YES | NO | YES | NO | YES | NO | NO |
| TJU_CMC_MD2.ID00504.3p-miR | TJU_CMC_MD2.ID00504.hairpin | YES | NO | NO | NO | NO | NO | NO | NO |
| TJU_CMC_MD2.ID00505.3p-miR | TJU_CMC_MD2.ID00505.hairpin | YES | NO | NO | NO | NO | NO | NO | NO |
| TJU_CMC_MD2.ID00506.3p-miR | TJU_CMC_MD2.ID00506.hairpin | YES | NO | NO | NO | NO | NO | NO | NO |
| TJU_CMC_MD2.ID00507.3p-miR | TJU_CMC_MD2.ID00507.hairpin | YES | NO | NO | NO | NO | NO | NO | NO |
| TJU_CMC_MD2.ID00508.3p-miR | TJU_CMC_MD2.ID00508.hairpin | YES | NO | NO | NO | NO | NO | NO | NO |
| TJU_CMC_MD2.ID00509.3p-miR | TJU_CMC_MD2.ID00509.hairpin | YES | NO | NO | NO | NO | NO | NO | NO |
| TJU_CMC_MD2.ID00510.5p-miR | TJU_CMC_MD2.ID00510.hairpin | YES | NO | YES | YES | YES | NO | NO | NO |
| TJU_CMC_MD2.ID00511.5p-miR | TJU_CMC_MD2.ID00511.hairpin | YES | YES | YES | YES | NO | NO | NO | NO |
| TJU_CMC_MD2.ID00512.3p-miR | TJU_CMC_MD2.ID00512.hairpin | YES | NO | NO | NO | NO | NO | NO | NO |
| TJU_CMC_MD2.ID00513.3p-miR | TJU_CMC_MD2.ID00513.hairpin | YES | NO | NO | NO | NO | NO | NO | NO |
| TJU_CMC_MD2.ID00514.3p-miR | TJU_CMC_MD2.ID00514.hairpin | YES | NO | NO | NO | NO | NO | NO | NO |
| TJU_CMC_MD2.ID00515.5p-miR | TJU_CMC_MD2.ID00515.hairpin | YES | YES | NO | YES | NO | NO | NO | NO |
| TJU_CMC_MD2.ID00516.5p-miR | TJU_CMC_MD2.ID00516.hairpin | YES | YES | YES | NO | NO | NO | NO | NO |
| TJU_CMC_MD2.ID00517.5p-miR | TJU_CMC_MD2.ID00517.hairpin | YES | NO | NO | NO | NO | NO | NO | NO |
| TJU_CMC_MD2.ID00518.5p-miR | TJU_CMC_MD2.ID00518.hairpin | YES | YES | YES | YES | YES | NO | NO | NO |
| TJU_CMC_MD2.ID00519.3p-miR | TJU_CMC_MD2.ID00519.hairpin | YES | NO | NO | NO | NO | NO | NO | NO |
| TJU_CMC_MD2.ID00520.5p-miR | TJU_CMC_MD2.ID00520.hairpin | YES | YES | YES | YES | NO | NO | NO | NO |
| TJU_CMC_MD2.ID00521.5p-miR | TJU_CMC_MD2.ID00521.hairpin | YES | YES | YES | YES | YES | NO | NO | NO |
| TJU_CMC_MD2.ID00522.5p-miR | TJU_CMC_MD2.ID00522.hairpin | YES | YES | NO | YES | NO | NO | NO | NO |
| TJU_CMC_MD2.ID00523.3p-miR | TJU_CMC_MD2.ID00523.hairpin | YES | NO | NO | NO | NO | NO | NO | NO |
| TJU_CMC_MD2.ID00524.3p-miR | TJU_CMC_MD2.ID00524.hairpin | YES | NO | NO | NO | NO | NO | NO | NO |
| TJU_CMC_MD2.ID00525.3p-miR | TJU_CMC_MD2.ID00525.hairpin | YES | NO | NO | NO | NO | NO | NO | NO |
| TJU_CMC_MD2.ID00526.3p-miR | TJU_CMC_MD2.ID00526.hairpin | YES | YES | YES | NO | NO | NO | NO | NO |
| TJU_CMC_MD2.ID00526.5p-miR | TJU_CMC_MD2.ID00526.hairpin | YES | YES | YES | NO | NO | NO | NO | NO |
| TJU_CMC_MD2.ID00527.5p-miR | TJU_CMC_MD2.ID00527.hairpin | YES | NO | NO | NO | NO | NO | NO | NO |
| TJU_CMC_MD2.ID00528.3p-miR | TJU_CMC_MD2.ID00528.hairpin | YES | NO | NO | NO | NO | NO | NO | NO |
| TJU_CMC_MD2.ID00529.3p-miR | TJU_CMC_MD2.ID00529.hairpin | YES | NO | NO | NO | NO | NO | NO | NO |
| TJU_CMC_MD2.ID00529.5p-miR | TJU_CMC_MD2.ID00529.hairpin | YES | YES | YES | YES | YES | NO | NO | NO |
| TJU_CMC_MD2.ID00530.3p-miR | TJU_CMC_MD2.ID00530.hairpin | YES | YES | YES | YES | NO | NO | NO | NO |
| TJU_CMC_MD2.ID00531.5p-miR | TJU_CMC_MD2.ID00531.hairpin | YES | YES | YES | NO | NO | NO | NO | NO |
| TJU_CMC_MD2.ID00532.3p-miR | TJU_CMC_MD2.ID00532.hairpin | YES | NO | NO | NO | NO | NO | NO | NO |
| TJU_CMC_MD2.ID00532.5p-miR | TJU_CMC_MD2.ID00532.hairpin | YES | NO | YES | NO | NO | NO | NO | NO |
| TJU_CMC_MD2.ID00533.3p-miR | TJU_CMC_MD2.ID00533.hairpin | YES | NO | YES | YES | YES | NO | NO | NO |
| TJU_CMC_MD2.ID00533.5p-miR | TJU_CMC_MD2.ID00533.hairpin | YES | NO | YES | YES | YES | NO | NO | NO |
| TJU_CMC_MD2.ID00534.3p-miR | TJU_CMC_MD2.ID00534.hairpin | YES | NO | NO | NO | NO | NO | NO | NO |
| TJU_CMC_MD2.ID00535.3p-miR | TJU_CMC_MD2.ID00535.hairpin | YES | NO | NO | NO | NO | NO | NO | NO |
| TJU_CMC_MD2.ID00536.3p-miR | TJU_CMC_MD2.ID00536.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00537.3p-miR | TJU_CMC_MD2.ID00537.hairpin | YES | NO | NO | NO | NO | NO | NO | NO |
| TJU_CMC_MD2.ID00538.5p-miR | TJU_CMC_MD2.ID00538.hairpin | YES | YES | YES | YES | NO | NO | NO | NO |
| TJU_CMC_MD2.ID00539.3p-miR | TJU_CMC_MD2.ID00539.hairpin | YES | YES | NO | YES | YES | NO | NO | NO |
| TJU_CMC_MD2.ID00539.5p-miR | TJU_CMC_MD2.ID00539.hairpin | YES | NO | YES | YES | YES | NO | NO | NO |
| TJU_CMC_MD2.ID00540.3p-miR | TJU_CMC_MD2.ID00540.hairpin | YES | NO | NO | NO | NO | NO | NO | NO |
| TJU_CMC_MD2.ID00541.5p-miR | TJU_CMC_MD2.ID00541.hairpin | YES | YES | YES | YES | YES | NO | NO | NO |
| TJU_CMC_MD2.ID00542.3p-miR | TJU_CMC_MD2.ID00542.hairpin | YES | NO | NO | NO | NO | NO | NO | NO |
| TJU_CMC_MD2.ID00543.3p-miR | TJU_CMC_MD2.ID00543.hairpin | YES | NO | NO | NO | NO | NO | NO | NO |
| TJU_CMC_MD2.ID00544.3p-miR | TJU_CMC_MD2.ID00544.hairpin | YES | NO | NO | NO | NO | NO | NO | NO |
| TJU_CMC_MD2.ID00545.3p-miR | TJU_CMC_MD2.ID00545.hairpin | YES | NO | NO | NO | NO | NO | NO | NO |
| TJU_CMC_MD2.ID00546.5p-miR | TJU_CMC_MD2.ID00546.hairpin | YES | YES | YES | YES | NO | NO | NO | NO |
| TJU_CMC_MD2.ID00547.3p-miR | TJU_CMC_MD2.ID00547.hairpin | YES | NO | NO | NO | NO | NO | NO | NO |
| TJU_CMC_MD2.ID00548.3p-miR | TJU_CMC_MD2.ID00548.hairpin | YES | NO | NO | NO | NO | NO | NO | NO |
| TJU_CMC_MD2.ID00549.3p-miR | TJU_CMC_MD2.ID00549.hairpin | YES | NO | NO | NO | NO | NO | NO | NO |
| TJU_CMC_MD2.ID00550.3p-miR | TJU_CMC_MD2.ID00550.hairpin | YES | NO | NO | NO | NO | NO | NO | NO |
| TJU_CMC_MD2.ID00550.5p-miR | TJU_CMC_MD2.ID00550.hairpin | YES | YES | YES | YES | NO | NO | NO | NO |
| TJU_CMC_MD2.ID00551.3p-miR | TJU_CMC_MD2.ID00551.hairpin | YES | NO | NO | NO | NO | NO | NO | NO |
| TJU_CMC_MD2.ID00552.3p-miR | TJU_CMC_MD2.ID00552.hairpin | YES | NO | NO | NO | NO | NO | NO | NO |
| TJU_CMC_MD2.ID00553.3p-miR | TJU_CMC_MD2.ID00553.hairpin | YES | NO | NO | NO | NO | NO | NO | NO |
| TJU_CMC_MD2.ID00554.3p-miR | TJU_CMC_MD2.ID00554.hairpin | YES | NO | NO | NO | NO | NO | NO | NO |
| TJU_CMC_MD2.ID00555.3p-miR | TJU_CMC_MD2.ID00555.hairpin | YES | NO | NO | NO | NO | NO | NO | NO |
| TJU_CMC_MD2.ID00556.5p-miR | TJU_CMC_MD2.ID00556.hairpin | YES | NO | YES | NO | NO | NO | NO | NO |
| TJU_CMC_MD2.ID00557.3p-miR | TJU_CMC_MD2.ID00557.hairpin | YES | NO | NO | NO | NO | NO | NO | NO |
| TJU_CMC_MD2.ID00558.3p-miR | TJU_CMC_MD2.ID00558.hairpin | YES | YES | YES | YES | YES | NO | NO | NO |
| TJU_CMC_MD2.ID00558.5p-miR | TJU_CMC_MD2.ID00558.hairpin | YES | NO | YES | NO | YES | NO | NO | NO |
| TJU_CMC_MD2.ID00559.3p-miR | TJU_CMC_MD2.ID00559.hairpin | YES | NO | NO | NO | NO | NO | NO | NO |
| TJU_CMC_MD2.ID00560.3p-miR | TJU_CMC_MD2.ID00560.hairpin | YES | NO | NO | NO | NO | NO | NO | NO |
| TJU_CMC_MD2.ID00561.3p-miR | TJU_CMC_MD2.ID00561.hairpin | YES | NO | NO | NO | NO | NO | NO | NO |
| TJU_CMC_MD2.ID00562.3p-miR | TJU_CMC_MD2.ID00562.hairpin | YES | NO | NO | NO | NO | NO | NO | NO |
| TJU_CMC_MD2.ID00563.3p-miR | TJU_CMC_MD2.ID00563.hairpin | YES | NO | NO | NO | NO | NO | NO | NO |
| TJU_CMC_MD2.ID00564.5p-miR | TJU_CMC_MD2.ID00564.hairpin | YES | YES | YES | NO | NO | NO | NO | NO |
| TJU_CMC_MD2.ID00565.3p-miR | TJU_CMC_MD2.ID00565.hairpin | YES | NO | NO | NO | NO | NO | NO | NO |
| TJU_CMC_MD2.ID00566.5p-miR | TJU_CMC_MD2.ID00566.hairpin | YES | YES | NO | YES | NO | NO | NO | NO |
| TJU_CMC_MD2.ID00567.3p-miR | TJU_CMC_MD2.ID00567.hairpin | YES | NO | NO | NO | NO | NO | NO | NO |
| TJU_CMC_MD2.ID00568.3p-miR | TJU_CMC_MD2.ID00568.hairpin | YES | NO | NO | NO | NO | NO | NO | NO |
| TJU_CMC_MD2.ID00569.3p-miR | TJU_CMC_MD2.ID00569.hairpin | YES | NO | NO | NO | NO | NO | NO | NO |
| TJU_CMC_MD2.ID00570.3p-miR | TJU_CMC_MD2.ID00570.hairpin | YES | NO | NO | NO | NO | NO | NO | NO |
| TJU_CMC_MD2.ID00571.3p-miR | TJU_CMC_MD2.ID00571.hairpin | YES | NO | NO | NO | NO | NO | NO | NO |
| TJU_CMC_MD2.ID00572.5p-miR | TJU_CMC_MD2.ID00572.hairpin | YES | YES | YES | NO | NO | NO | NO | NO |
| TJU_CMC_MD2.ID00573.5p-miR | TJU_CMC_MD2.ID00573.hairpin | YES | YES | YES | YES | YES | NO | NO | NO |
| TJU_CMC_MD2.ID00574.3p-miR | TJU_CMC_MD2.ID00574.hairpin | YES | NO | NO | NO | NO | NO | NO | NO |
| TJU_CMC_MD2.ID00574.5p-miR | TJU_CMC_MD2.ID00574.hairpin | YES | YES | YES | YES | YES | NO | NO | NO |
| TJU_CMC_MD2.ID00575.5p-miR | TJU_CMC_MD2.ID00575.hairpin | YES | YES | YES | YES | YES | NO | NO | NO |
| TJU_CMC_MD2.ID00576.5p-miR | TJU_CMC_MD2.ID00576.hairpin | YES | YES | YES | YES | YES | NO | NO | NO |
| TJU_CMC_MD2.ID00577.3p-miR | TJU_CMC_MD2.ID00577.hairpin | YES | NO | NO | NO | NO | NO | NO | NO |
| TJU_CMC_MD2.ID00578.3p-miR | TJU_CMC_MD2.ID00578.hairpin | YES | NO | NO | NO | NO | NO | NO | NO |
| TJU_CMC_MD2.ID00579.3p-miR | TJU_CMC_MD2.ID00579.hairpin | YES | NO | NO | NO | NO | NO | NO | NO |
| TJU_CMC_MD2.ID00580.3p-miR | TJU_CMC_MD2.ID00580.hairpin | YES | NO | NO | NO | NO | NO | NO | NO |
| TJU_CMC_MD2.ID00581.3p-miR | TJU_CMC_MD2.ID00581.hairpin | YES | NO | NO | NO | NO | NO | NO | NO |
| TJU_CMC_MD2.ID00582.3p-miR | TJU_CMC_MD2.ID00582.hairpin | YES | NO | NO | NO | NO | NO | NO | NO |
| TJU_CMC_MD2.ID00583.3p-miR | TJU_CMC_MD2.ID00583.hairpin | YES | NO | NO | NO | NO | NO | NO | NO |
| TJU_CMC_MD2.ID00584.5p-miR | TJU_CMC_MD2.ID00584.hairpin | YES | NO | YES | NO | NO | NO | NO | NO |
| TJU_CMC_MD2.ID00585.5p-miR | TJU_CMC_MD2.ID00585.hairpin | YES | NO | YES | YES | NO | NO | NO | NO |
| TJU_CMC_MD2.ID00586.3p-miR | TJU_CMC_MD2.ID00586.hairpin | YES | NO | NO | NO | NO | NO | NO | NO |
| TJU_CMC_MD2.ID00587.3p-miR | TJU_CMC_MD2.ID00587.hairpin | YES | YES | NO | YES | YES | NO | NO | NO |
| TJU_CMC_MD2.ID00588.3p-miR | TJU_CMC_MD2.ID00588.hairpin | YES | YES | YES | YES | YES | NO | NO | NO |
| TJU_CMC_MD2.ID00589.3p-miR | TJU_CMC_MD2.ID00589.hairpin | YES | NO | NO | NO | NO | NO | NO | NO |
| TJU_CMC_MD2.ID00590.5p-miR | TJU_CMC_MD2.ID00590.hairpin | YES | YES | YES | YES | NO | NO | NO | NO |
| TJU_CMC_MD2.ID00591.3p-miR | TJU_CMC_MD2.ID00591.hairpin | YES | NO | NO | NO | NO | NO | NO | NO |
| TJU_CMC_MD2.ID00591.5p-miR | TJU_CMC_MD2.ID00591.hairpin | YES | YES | YES | YES | YES | NO | NO | NO |
| TJU_CMC_MD2.ID00592.3p-miR | TJU_CMC_MD2.ID00592.hairpin | YES | NO | NO | NO | NO | NO | NO | NO |
| TJU_CMC_MD2.ID00593.3p-miR | TJU_CMC_MD2.ID00593.hairpin | YES | NO | NO | NO | NO | NO | NO | NO |
| TJU_CMC_MD2.ID00594.3p-miR | TJU_CMC_MD2.ID00594.hairpin | YES | NO | NO | NO | NO | NO | NO | NO |
| TJU_CMC_MD2.ID00595.3p-miR | TJU_CMC_MD2.ID00595.hairpin | YES | NO | NO | NO | NO | NO | NO | NO |
| TJU_CMC_MD2.ID00596.5p-miR | TJU_CMC_MD2.ID00596.hairpin | YES | YES | YES | YES | YES | NO | NO | NO |
| TJU_CMC_MD2.ID00597.3p-miR | TJU_CMC_MD2.ID00597.hairpin | YES | NO | NO | NO | NO | NO | NO | NO |
| TJU_CMC_MD2.ID00598.3p-miR | TJU_CMC_MD2.ID00598.hairpin | YES | NO | NO | NO | NO | NO | NO | NO |
| TJU_CMC_MD2.ID00599.5p-miR | TJU_CMC_MD2.ID00599.hairpin | YES | YES | YES | YES | NO | NO | NO | NO |
| TJU_CMC_MD2.ID00600.3p-miR | TJU_CMC_MD2.ID00600.hairpin | YES | NO | NO | NO | NO | NO | NO | NO |
| TJU_CMC_MD2.ID00601.3p-miR | TJU_CMC_MD2.ID00601.hairpin | YES | NO | NO | NO | NO | NO | NO | NO |
| TJU_CMC_MD2.ID00602.3p-miR | TJU_CMC_MD2.ID00602.hairpin | YES | NO | NO | NO | NO | NO | NO | NO |
| TJU_CMC_MD2.ID00603.5p-miR | TJU_CMC_MD2.ID00603.hairpin | YES | YES | NO | NO | NO | NO | NO | NO |
| TJU_CMC_MD2.ID00604.3p-miR | TJU_CMC_MD2.ID00604.hairpin | YES | NO | NO | NO | NO | NO | NO | NO |
| TJU_CMC_MD2.ID00605.5p-miR | TJU_CMC_MD2.ID00605.hairpin | YES | YES | YES | YES | YES | NO | NO | NO |
| TJU_CMC_MD2.ID00606.5p-miR | TJU_CMC_MD2.ID00606.hairpin | YES | YES | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00607.3p-miR | TJU_CMC_MD2.ID00607.hairpin | YES | NO | NO | NO | NO | NO | NO | NO |
| TJU_CMC_MD2.ID00608.3p-miR | TJU_CMC_MD2.ID00608.hairpin | YES | NO | NO | NO | NO | NO | NO | NO |
| TJU_CMC_MD2.ID00609.5p-miR | TJU_CMC_MD2.ID00609.hairpin | YES | NO | YES | YES | NO | NO | NO | NO |
| TJU_CMC_MD2.ID00610.3p-miR | TJU_CMC_MD2.ID00610.hairpin | YES | NO | NO | NO | NO | NO | NO | NO |
| TJU_CMC_MD2.ID00611.5p-miR | TJU_CMC_MD2.ID00611.hairpin | YES | NO | YES | NO | NO | NO | NO | NO |
| TJU_CMC_MD2.ID00612.3p-miR | TJU_CMC_MD2.ID00612.hairpin | YES | NO | NO | NO | NO | NO | NO | NO |
| TJU_CMC_MD2.ID00613.3p-miR | TJU_CMC_MD2.ID00613.hairpin | YES | NO | NO | NO | NO | NO | NO | NO |
| TJU_CMC_MD2.ID00614.3p-miR | TJU_CMC_MD2.ID00614.hairpin | YES | NO | NO | NO | NO | NO | NO | NO |
| TJU_CMC_MD2.ID00615.5p-miR | TJU_CMC_MD2.ID00615.hairpin | YES | YES | YES | NO | NO | NO | NO | NO |
| TJU_CMC_MD2.ID00616.5p-miR | TJU_CMC_MD2.ID00616.hairpin | YES | YES | YES | YES | NO | NO | NO | NO |
| TJU_CMC_MD2.ID00617.3p-miR | TJU_CMC_MD2.ID00617.hairpin | YES | NO | NO | NO | NO | NO | NO | NO |
| TJU_CMC_MD2.ID00618.3p-miR | TJU_CMC_MD2.ID00618.hairpin | YES | YES | YES | NO | NO | NO | NO | NO |
| TJU_CMC_MD2.ID00619.5p-miR | TJU_CMC_MD2.ID00619.hairpin | YES | YES | YES | YES | NO | NO | NO | NO |
| TJU_CMC_MD2.ID00620.3p-miR | TJU_CMC_MD2.ID00620.hairpin | YES | NO | NO | NO | NO | NO | NO | NO |
| TJU_CMC_MD2.ID00621.3p-miR | TJU_CMC_MD2.ID00621.hairpin | YES | NO | NO | NO | NO | NO | NO | NO |
| TJU_CMC_MD2.ID00622.3p-miR | TJU_CMC_MD2.ID00622.hairpin | YES | NO | NO | NO | NO | NO | NO | NO |
| TJU_CMC_MD2.ID00623.3p-miR | TJU_CMC_MD2.ID00623.hairpin | YES | YES | YES | NO | YES | NO | NO | NO |
| TJU_CMC_MD2.ID00623.5p-miR | TJU_CMC_MD2.ID00623.hairpin | YES | YES | YES | YES | YES | NO | NO | NO |
| TJU_CMC_MD2.ID00624.3p-miR | TJU_CMC_MD2.ID00624.hairpin | YES | NO | NO | NO | NO | NO | NO | NO |
| TJU_CMC_MD2.ID00625.5p-miR | TJU_CMC_MD2.ID00625.hairpin | YES | YES | NO | YES | YES | NO | NO | NO |
| TJU_CMC_MD2.ID00626.5p-miR | TJU_CMC_MD2.ID00626.hairpin | YES | NO | NO | YES | NO | NO | NO | NO |
| TJU_CMC_MD2.ID00627.5p-miR | TJU_CMC_MD2.ID00627.hairpin | YES | YES | YES | YES | YES | NO | NO | NO |
| TJU_CMC_MD2.ID00628.5p-miR | TJU_CMC_MD2.ID00628.hairpin | YES | YES | YES | YES | NO | NO | NO | NO |
| TJU_CMC_MD2.ID00629.3p-miR | TJU_CMC_MD2.ID00629.hairpin | YES | NO | NO | NO | NO | NO | NO | NO |
| TJU_CMC_MD2.ID00630.3p-miR | TJU_CMC_MD2.ID00630.hairpin | YES | NO | NO | NO | NO | NO | NO | NO |
| TJU_CMC_MD2.ID00631.5p-miR | TJU_CMC_MD2.ID00631.hairpin | YES | YES | NO | YES | NO | NO | NO | NO |
| TJU_CMC_MD2.ID00632.3p-miR | TJU_CMC_MD2.ID00632.hairpin | YES | NO | NO | NO | NO | NO | NO | NO |
| TJU_CMC_MD2.ID00633.3p-miR | TJU_CMC_MD2.ID00633.hairpin | YES | NO | NO | NO | NO | NO | NO | NO |
| TJU_CMC_MD2.ID00634.5p-miR | TJU_CMC_MD2.ID00634.hairpin | YES | YES | YES | NO | NO | NO | NO | NO |
| TJU_CMC_MD2.ID00635.5p-miR | TJU_CMC_MD2.ID00635.hairpin | YES | YES | YES | YES | YES | NO | NO | NO |
| TJU_CMC_MD2.ID00636.3p-miR | TJU_CMC_MD2.ID00636.hairpin | YES | NO | NO | NO | NO | NO | NO | NO |
| TJU_CMC_MD2.ID00637.5p-miR | TJU_CMC_MD2.ID00637.hairpin | YES | NO | NO | YES | NO | NO | NO | NO |
| TJU_CMC_MD2.ID00638.5p-miR | TJU_CMC_MD2.ID00638.hairpin | YES | YES | YES | YES | YES | NO | NO | NO |
| TJU_CMC_MD2.ID00639.3p-miR | TJU_CMC_MD2.ID00639.hairpin | YES | YES | YES | NO | NO | NO | NO | NO |
| TJU_CMC_MD2.ID00639.5p-miR | TJU_CMC_MD2.ID00639.hairpin | YES | YES | YES | NO | NO | NO | NO | NO |
| TJU_CMC_MD2.ID00640.3p-miR | TJU_CMC_MD2.ID00640.hairpin | YES | NO | NO | NO | NO | NO | NO | NO |
| TJU_CMC_MD2.ID00640.5p-miR | TJU_CMC_MD2.ID00640.hairpin | YES | YES | YES | YES | NO | NO | NO | NO |
| TJU_CMC_MD2.ID00641.3p-miR | TJU_CMC_MD2.ID00641.hairpin | YES | NO | NO | NO | NO | NO | NO | NO |
| TJU_CMC_MD2.ID00642.3p-miR | TJU_CMC_MD2.ID00642.hairpin | YES | NO | NO | NO | NO | NO | NO | NO |
| TJU_CMC_MD2.ID00643.3p-miR | TJU_CMC_MD2.ID00643.hairpin | YES | NO | NO | NO | NO | NO | NO | NO |
| TJU_CMC_MD2.ID00644.5p-miR | TJU_CMC_MD2.ID00644.hairpin | YES | YES | YES | YES | YES | NO | NO | NO |
| TJU_CMC_MD2.ID00645.5p-miR | TJU_CMC_MD2.ID00645.hairpin | YES | YES | YES | NO | YES | NO | NO | NO |
| TJU_CMC_MD2.ID00646.5p-miR | TJU_CMC_MD2.ID00646.hairpin | YES | YES | YES | NO | YES | NO | NO | NO |
| TJU_CMC_MD2.ID00647.3p-miR | TJU_CMC_MD2.ID00647.hairpin | YES | NO | NO | NO | NO | NO | NO | NO |
| TJU_CMC_MD2.ID00648.5p-miR | TJU_CMC_MD2.ID00648.hairpin | YES | YES | NO | NO | YES | NO | NO | NO |
| TJU_CMC_MD2.ID00649.3p-miR | TJU_CMC_MD2.ID00649.hairpin | YES | NO | NO | NO | NO | NO | NO | NO |
| TJU_CMC_MD2.ID00649.5p-miR | TJU_CMC_MD2.ID00649.hairpin | YES | NO | YES | NO | NO | NO | NO | NO |
| TJU_CMC_MD2.ID00650.5p-miR | TJU_CMC_MD2.ID00650.hairpin | YES | NO | YES | NO | NO | NO | NO | NO |
| TJU_CMC_MD2.ID00651.3p-miR | TJU_CMC_MD2.ID00651.hairpin | YES | NO | NO | NO | NO | NO | NO | NO |
| TJU_CMC_MD2.ID00651.5p-miR | TJU_CMC_MD2.ID00651.hairpin | YES | YES | YES | YES | YES | NO | NO | NO |
| TJU_CMC_MD2.ID00652.5p-miR | TJU_CMC_MD2.ID00652.hairpin | YES | YES | YES | NO | YES | NO | NO | NO |
| TJU_CMC_MD2.ID00653.3p-miR | TJU_CMC_MD2.ID00653.hairpin | YES | NO | NO | NO | NO | NO | NO | NO |
| TJU_CMC_MD2.ID00654.3p-miR | TJU_CMC_MD2.ID00654.hairpin | YES | NO | NO | NO | NO | NO | NO | NO |
| TJU_CMC_MD2.ID00655.3p-miR | TJU_CMC_MD2.ID00655.hairpin | YES | NO | NO | NO | NO | NO | NO | NO |
| TJU_CMC_MD2.ID00656.5p-miR | TJU_CMC_MD2.ID00656.hairpin | YES | YES | YES | NO | YES | NO | NO | NO |
| TJU_CMC_MD2.ID00657.3p-miR | TJU_CMC_MD2.ID00657.hairpin | YES | YES | YES | NO | NO | NO | NO | NO |
| TJU_CMC_MD2.ID00657.5p-miR | TJU_CMC_MD2.ID00657.hairpin | YES | YES | YES | NO | NO | NO | NO | NO |
| TJU_CMC_MD2.ID00658.5p-miR | TJU_CMC_MD2.ID00658.hairpin | YES | YES | NO | NO | NO | NO | NO | NO |
| TJU_CMC_MD2.ID00659.3p-miR | TJU_CMC_MD2.ID00659.hairpin | YES | NO | NO | NO | NO | NO | NO | NO |
| TJU_CMC_MD2.ID00660.5p-miR | TJU_CMC_MD2.ID00660.hairpin | YES | YES | YES | NO | YES | NO | NO | NO |
| TJU_CMC_MD2.ID00661.5p-miR | TJU_CMC_MD2.ID00661.hairpin | YES | YES | YES | YES | YES | NO | NO | NO |
| TJU_CMC_MD2.ID00662.3p-miR | TJU_CMC_MD2.ID00662.hairpin | YES | NO | NO | NO | NO | NO | NO | NO |
| TJU_CMC_MD2.ID00663.5p-miR | TJU_CMC_MD2.ID00663.hairpin | YES | YES | YES | YES | NO | NO | NO | NO |
| TJU_CMC_MD2.ID00664.3p-miR | TJU_CMC_MD2.ID00664.hairpin | YES | NO | NO | NO | NO | NO | NO | NO |
| TJU_CMC_MD2.ID00665.3p-miR | TJU_CMC_MD2.ID00665.hairpin | YES | NO | NO | NO | NO | NO | NO | NO |
| TJU_CMC_MD2.ID00666.3p-miR | TJU_CMC_MD2.ID00666.hairpin | YES | NO | NO | NO | NO | NO | NO | NO |
| TJU_CMC_MD2.ID00667.5p-miR | TJU_CMC_MD2.ID00667.hairpin | YES | NO | NO | YES | NO | YES | NO | NO |
| TJU_CMC_MD2.ID00668.3p-miR | TJU_CMC_MD2.ID00668.hairpin | YES | NO | NO | NO | NO | NO | NO | NO |
| TJU_CMC_MD2.ID00669.3p-miR | TJU_CMC_MD2.ID00669.hairpin | YES | NO | NO | NO | NO | NO | NO | NO |
| TJU_CMC_MD2.ID00670.3p-miR | TJU_CMC_MD2.ID00670.hairpin | YES | NO | NO | NO | NO | NO | NO | NO |
| TJU_CMC_MD2.ID00671.5p-miR | TJU_CMC_MD2.ID00671.hairpin | YES | NO | YES | NO | NO | NO | NO | NO |
| TJU_CMC_MD2.ID00672.3p-miR | TJU_CMC_MD2.ID00672.hairpin | YES | NO | NO | NO | NO | NO | NO | NO |
| TJU_CMC_MD2.ID00672.5p-miR | TJU_CMC_MD2.ID00672.hairpin | YES | YES | YES | YES | NO | NO | NO | NO |
| TJU_CMC_MD2.ID00673.3p-miR | TJU_CMC_MD2.ID00673.hairpin | YES | NO | NO | NO | NO | NO | NO | NO |
| TJU_CMC_MD2.ID00674.3p-miR | TJU_CMC_MD2.ID00674.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00675.3p-miR | TJU_CMC_MD2.ID00675.hairpin | YES | NO | NO | NO | NO | NO | NO | NO |
| TJU_CMC_MD2.ID00676.3p-miR | TJU_CMC_MD2.ID00676.hairpin | YES | NO | NO | NO | NO | NO | NO | NO |
| TJU_CMC_MD2.ID00677.3p-miR | TJU_CMC_MD2.ID00677.hairpin | YES | NO | NO | NO | NO | NO | NO | NO |
| TJU_CMC_MD2.ID00678.3p-miR | TJU_CMC_MD2.ID00678.hairpin | YES | NO | NO | NO | NO | NO | NO | NO |
| TJU_CMC_MD2.ID00679.5p-miR | TJU_CMC_MD2.ID00679.hairpin | YES | YES | YES | YES | NO | NO | NO | NO |
| TJU_CMC_MD2.ID00680.5p-miR | TJU_CMC_MD2.ID00680.hairpin | YES | YES | YES | YES | NO | NO | NO | NO |
| TJU_CMC_MD2.ID00681.5p-miR | TJU_CMC_MD2.ID00681.hairpin | YES | YES | YES | YES | YES | NO | NO | NO |
| TJU_CMC_MD2.ID00682.3p-miR | TJU_CMC_MD2.ID00682.hairpin | YES | NO | NO | NO | NO | NO | NO | NO |
| TJU_CMC_MD2.ID00683.3p-miR | TJU_CMC_MD2.ID00683.hairpin | YES | NO | NO | NO | NO | NO | NO | NO |
| TJU_CMC_MD2.ID00684.3p-miR | TJU_CMC_MD2.ID00684.hairpin | YES | NO | NO | NO | NO | NO | NO | NO |
| TJU_CMC_MD2.ID00685.3p-miR | TJU_CMC_MD2.ID00685.hairpin | YES | NO | NO | NO | NO | NO | NO | NO |
| TJU_CMC_MD2.ID00685.5p-miR | TJU_CMC_MD2.ID00685.hairpin | YES | NO | YES | YES | YES | NO | NO | NO |
| TJU_CMC_MD2.ID00686.3p-miR | TJU_CMC_MD2.ID00686.hairpin | YES | NO | NO | NO | NO | NO | NO | NO |
| TJU_CMC_MD2.ID00687.3p-miR | TJU_CMC_MD2.ID00687.hairpin | YES | NO | NO | NO | NO | NO | NO | NO |
| TJU_CMC_MD2.ID00688.3p-miR | TJU_CMC_MD2.ID00688.hairpin | YES | NO | NO | NO | NO | NO | NO | NO |
| TJU_CMC_MD2.ID00689.3p-miR | TJU_CMC_MD2.ID00689.hairpin | YES | NO | NO | NO | NO | NO | NO | NO |
| TJU_CMC_MD2.ID00690.5p-miR | TJU_CMC_MD2.ID00690.hairpin | YES | YES | NO | NO | NO | YES | NO | NO |
| TJU_CMC_MD2.ID00691.3p-miR | TJU_CMC_MD2.ID00691.hairpin | YES | NO | NO | NO | NO | NO | NO | NO |
| TJU_CMC_MD2.ID00691.5p-miR | TJU_CMC_MD2.ID00691.hairpin | YES | YES | YES | YES | YES | NO | NO | NO |
| TJU_CMC_MD2.ID00692.3p-miR | TJU_CMC_MD2.ID00692.hairpin | YES | NO | NO | NO | NO | NO | NO | NO |
| TJU_CMC_MD2.ID00693.5p-miR | TJU_CMC_MD2.ID00693.hairpin | YES | YES | YES | NO | YES | NO | NO | NO |
| TJU_CMC_MD2.ID00694.5p-miR | TJU_CMC_MD2.ID00694.hairpin | YES | YES | YES | YES | NO | NO | NO | NO |
| TJU_CMC_MD2.ID00695.3p-miR | TJU_CMC_MD2.ID00695.hairpin | YES | NO | NO | NO | NO | NO | NO | NO |
| TJU_CMC_MD2.ID00696.5p-miR | TJU_CMC_MD2.ID00696.hairpin | YES | YES | YES | NO | NO | NO | NO | NO |
| TJU_CMC_MD2.ID00697.3p-miR | TJU_CMC_MD2.ID00697.hairpin | YES | NO | NO | NO | NO | NO | NO | NO |
| TJU_CMC_MD2.ID00698.3p-miR | TJU_CMC_MD2.ID00698.hairpin | YES | NO | NO | NO | NO | NO | NO | NO |
| TJU_CMC_MD2.ID00699.3p-miR | TJU_CMC_MD2.ID00699.hairpin | YES | YES | YES | NO | YES | NO | NO | NO |
| TJU_CMC_MD2.ID00700.5p-miR | TJU_CMC_MD2.ID00700.hairpin | YES | YES | YES | YES | NO | NO | NO | NO |
| TJU_CMC_MD2.ID00701.5p-miR | TJU_CMC_MD2.ID00701.hairpin | YES | YES | YES | YES | NO | NO | NO | NO |
| TJU_CMC_MD2.ID00702.5p-miR | TJU_CMC_MD2.ID00702.hairpin | YES | YES | YES | NO | NO | NO | NO | NO |
| TJU_CMC_MD2.ID00703.3p-miR | TJU_CMC_MD2.ID00703.hairpin | YES | NO | NO | NO | NO | NO | NO | NO |
| TJU_CMC_MD2.ID00704.5p-miR | TJU_CMC_MD2.ID00704.hairpin | YES | YES | NO | NO | NO | NO | NO | NO |
| TJU_CMC_MD2.ID00705.3p-miR | TJU_CMC_MD2.ID00705.hairpin | YES | NO | NO | NO | NO | NO | NO | NO |
| TJU_CMC_MD2.ID00706.5p-miR | TJU_CMC_MD2.ID00706.hairpin | YES | YES | NO | YES | YES | NO | NO | NO |
| TJU_CMC_MD2.ID00707.5p-miR | TJU_CMC_MD2.ID00707.hairpin | YES | YES | YES | YES | YES | NO | NO | NO |
| TJU_CMC_MD2.ID00708.5p-miR | TJU_CMC_MD2.ID00708.hairpin | YES | YES | YES | YES | YES | NO | NO | NO |
| TJU_CMC_MD2.ID00709.3p-miR | TJU_CMC_MD2.ID00709.hairpin | YES | NO | NO | NO | NO | NO | NO | NO |
| TJU_CMC_MD2.ID00710.3p-miR | TJU_CMC_MD2.ID00710.hairpin | YES | NO | NO | NO | NO | NO | NO | NO |
| TJU_CMC_MD2.ID00711.3p-miR | TJU_CMC_MD2.ID00711.hairpin | YES | NO | NO | NO | NO | NO | NO | NO |
| TJU_CMC_MD2.ID00712.3p-miR | TJU_CMC_MD2.ID00712.hairpin | YES | NO | NO | NO | NO | NO | NO | NO |
| TJU_CMC_MD2.ID00713.5p-miR | TJU_CMC_MD2.ID00713.hairpin | YES | YES | YES | YES | YES | YES | NO | NO |
| TJU_CMC_MD2.ID00714.3p-miR | TJU_CMC_MD2.ID00714.hairpin | YES | NO | NO | NO | NO | NO | NO | NO |
| TJU_CMC_MD2.ID00715.3p-miR | TJU_CMC_MD2.ID00715.hairpin | YES | NO | NO | NO | NO | NO | NO | NO |
| TJU_CMC_MD2.ID00716.3p-miR | TJU_CMC_MD2.ID00716.hairpin | YES | YES | YES | YES | YES | YES | NO | NO |
| TJU_CMC_MD2.ID00716.5p-miR | TJU_CMC_MD2.ID00716.hairpin | YES | YES | YES | YES | YES | NO | NO | NO |
| TJU_CMC_MD2.ID00717.3p-miR | TJU_CMC_MD2.ID00717.hairpin | YES | NO | NO | NO | NO | NO | NO | NO |
| TJU_CMC_MD2.ID00718.5p-miR | TJU_CMC_MD2.ID00718.hairpin | YES | YES | YES | YES | YES | NO | NO | NO |
| TJU_CMC_MD2.ID00719.5p-miR | TJU_CMC_MD2.ID00719.hairpin | YES | YES | YES | YES | YES | NO | NO | NO |
| TJU_CMC_MD2.ID00720.5p-miR | TJU_CMC_MD2.ID00720.hairpin | YES | YES | YES | YES | YES | NO | NO | NO |
| TJU_CMC_MD2.ID00721.5p-miR | TJU_CMC_MD2.ID00721.hairpin | YES | YES | YES | YES | YES | NO | NO | NO |
| TJU_CMC_MD2.ID00722.5p-miR | TJU_CMC_MD2.ID00722.hairpin | YES | YES | NO | YES | YES | NO | NO | NO |
| TJU_CMC_MD2.ID00723.5p-miR | TJU_CMC_MD2.ID00723.hairpin | YES | YES | YES | YES | NO | NO | NO | NO |
| TJU_CMC_MD2.ID00724.5p-miR | TJU_CMC_MD2.ID00724.hairpin | YES | YES | YES | NO | NO | NO | NO | NO |
| TJU_CMC_MD2.ID00725.3p-miR | TJU_CMC_MD2.ID00725.hairpin | YES | YES | YES | YES | YES | NO | NO | NO |
| TJU_CMC_MD2.ID00726.3p-miR | TJU_CMC_MD2.ID00726.hairpin | YES | YES | YES | YES | YES | YES | NO | NO |
| TJU_CMC_MD2.ID00726.5p-miR | TJU_CMC_MD2.ID00726.hairpin | YES | YES | YES | YES | YES | YES | NO | NO |
| TJU_CMC_MD2.ID00727.3p-miR | TJU_CMC_MD2.ID00727.hairpin | YES | NO | NO | NO | NO | NO | NO | NO |
| TJU_CMC_MD2.ID00728.3p-miR | TJU_CMC_MD2.ID00728.hairpin | YES | NO | NO | NO | NO | NO | NO | NO |
| TJU_CMC_MD2.ID00729.5p-miR | TJU_CMC_MD2.ID00729.hairpin | YES | YES | NO | YES | NO | NO | NO | NO |
| TJU_CMC_MD2.ID00730.3p-miR | TJU_CMC_MD2.ID00730.hairpin | YES | NO | NO | NO | NO | NO | NO | NO |
| TJU_CMC_MD2.ID00731.5p-miR | TJU_CMC_MD2.ID00731.hairpin | YES | YES | YES | YES | NO | NO | NO | NO |
| TJU_CMC_MD2.ID00732.3p-miR | TJU_CMC_MD2.ID00732.hairpin | YES | NO | NO | NO | NO | NO | NO | NO |
| TJU_CMC_MD2.ID00733.5p-miR | TJU_CMC_MD2.ID00733.hairpin | YES | NO | YES | NO | NO | NO | NO | NO |
| TJU_CMC_MD2.ID00734.5p-miR | TJU_CMC_MD2.ID00734.hairpin | YES | YES | YES | YES | YES | YES | NO | NO |
| TJU_CMC_MD2.ID00735.3p-miR | TJU_CMC_MD2.ID00735.hairpin | YES | NO | NO | NO | NO | NO | NO | NO |
| TJU_CMC_MD2.ID00736.5p-miR | TJU_CMC_MD2.ID00736.hairpin | YES | NO | YES | NO | NO | NO | NO | NO |
| TJU_CMC_MD2.ID00737.3p-miR | TJU_CMC_MD2.ID00737.hairpin | YES | YES | YES | YES | YES | YES | NO | NO |
| TJU_CMC_MD2.ID00738.5p-miR | TJU_CMC_MD2.ID00738.hairpin | YES | YES | YES | YES | NO | NO | NO | NO |
| TJU_CMC_MD2.ID00739.3p-miR | TJU_CMC_MD2.ID00739.hairpin | YES | NO | NO | NO | NO | NO | NO | NO |
| TJU_CMC_MD2.ID00740.3p-miR | TJU_CMC_MD2.ID00740.hairpin | YES | NO | NO | NO | NO | NO | NO | NO |
| TJU_CMC_MD2.ID00741.3p-miR | TJU_CMC_MD2.ID00741.hairpin | YES | NO | NO | NO | NO | NO | NO | NO |
| TJU_CMC_MD2.ID00742.3p-miR | TJU_CMC_MD2.ID00742.hairpin | YES | NO | NO | NO | NO | NO | NO | NO |
| TJU_CMC_MD2.ID00743.5p-miR | TJU_CMC_MD2.ID00743.hairpin | YES | YES | YES | YES | NO | NO | NO | NO |
| TJU_CMC_MD2.ID00744.3p-miR | TJU_CMC_MD2.ID00744.hairpin | YES | NO | NO | NO | NO | NO | NO | NO |
| TJU_CMC_MD2.ID00745.5p-miR | TJU_CMC_MD2.ID00745.hairpin | YES | YES | YES | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00746.5p-miR | TJU_CMC_MD2.ID00746.hairpin | YES | YES | YES | NO | YES | NO | NO | NO |
| TJU_CMC_MD2.ID00747.3p-miR | TJU_CMC_MD2.ID00747.hairpin | YES | NO | NO | NO | NO | NO | NO | NO |
| TJU_CMC_MD2.ID00748.3p-miR | TJU_CMC_MD2.ID00748.hairpin | YES | NO | NO | NO | NO | NO | NO | NO |
| TJU_CMC_MD2.ID00749.3p-miR | TJU_CMC_MD2.ID00749.hairpin | YES | NO | NO | NO | NO | NO | NO | NO |
| TJU_CMC_MD2.ID00750.3p-miR | TJU_CMC_MD2.ID00750.hairpin | YES | NO | NO | NO | NO | NO | NO | NO |
| TJU_CMC_MD2.ID00751.3p-miR | TJU_CMC_MD2.ID00751.hairpin | YES | NO | NO | NO | NO | NO | NO | NO |
| TJU_CMC_MD2.ID00752.3p-miR | TJU_CMC_MD2.ID00752.hairpin | YES | NO | NO | NO | NO | NO | NO | NO |
| TJU_CMC_MD2.ID00753.3p-miR | TJU_CMC_MD2.ID00753.hairpin | YES | NO | NO | NO | NO | NO | NO | NO |
| TJU_CMC_MD2.ID00754.3p-miR | TJU_CMC_MD2.ID00754.hairpin | YES | NO | NO | NO | NO | NO | NO | NO |
| TJU_CMC_MD2.ID00755.3p-miR | TJU_CMC_MD2.ID00755.hairpin | YES | NO | NO | NO | NO | NO | NO | NO |
| TJU_CMC_MD2.ID00755.5p-miR | TJU_CMC_MD2.ID00755.hairpin | YES | YES | YES | YES | YES | NO | NO | NO |
| TJU_CMC_MD2.ID00756.3p-miR | TJU_CMC_MD2.ID00756.hairpin | YES | NO | NO | NO | NO | NO | NO | NO |
| TJU_CMC_MD2.ID00757.3p-miR | TJU_CMC_MD2.ID00757.hairpin | YES | YES | YES | YES | YES | NO | NO | NO |
| TJU_CMC_MD2.ID00757.5p-miR | TJU_CMC_MD2.ID00757.hairpin | YES | YES | YES | YES | NO | NO | NO | NO |
| TJU_CMC_MD2.ID00758.5p-miR | TJU_CMC_MD2.ID00758.hairpin | YES | YES | YES | YES | YES | NO | NO | NO |
| TJU_CMC_MD2.ID00759.5p-miR | TJU_CMC_MD2.ID00759.hairpin | YES | YES | YES | YES | NO | NO | NO | NO |
| TJU_CMC_MD2.ID00760.3p-miR | TJU_CMC_MD2.ID00760.hairpin | YES | NO | NO | NO | NO | NO | NO | NO |
| TJU_CMC_MD2.ID00761.3p-miR | TJU_CMC_MD2.ID00761.hairpin | YES | NO | NO | NO | NO | NO | NO | NO |
| TJU_CMC_MD2.ID00762.3p-miR | TJU_CMC_MD2.ID00762.hairpin | YES | NO | NO | NO | NO | NO | NO | NO |
| TJU_CMC_MD2.ID00763.3p-miR | TJU_CMC_MD2.ID00763.hairpin | YES | NO | NO | NO | NO | NO | NO | NO |
| TJU_CMC_MD2.ID00764.5p-miR | TJU_CMC_MD2.ID00764.hairpin | YES | YES | YES | YES | NO | NO | NO | NO |
| TJU_CMC_MD2.ID00765.5p-miR | TJU_CMC_MD2.ID00765.hairpin | YES | NO | YES | YES | NO | NO | NO | NO |
| TJU_CMC_MD2.ID00766.5p-miR | TJU_CMC_MD2.ID00766.hairpin | YES | YES | YES | NO | NO | NO | NO | NO |
| TJU_CMC_MD2.ID00767.3p-miR | TJU_CMC_MD2.ID00767.hairpin | YES | NO | NO | NO | NO | NO | NO | NO |
| TJU_CMC_MD2.ID00768.3p-miR | TJU_CMC_MD2.ID00768.hairpin | YES | NO | NO | NO | NO | NO | NO | NO |
| TJU_CMC_MD2.ID00769.5p-miR | TJU_CMC_MD2.ID00769.hairpin | YES | NO | YES | YES | YES | NO | NO | NO |
| TJU_CMC_MD2.ID00770.3p-miR | TJU_CMC_MD2.ID00770.hairpin | YES | NO | NO | NO | NO | NO | NO | NO |
| TJU_CMC_MD2.ID00771.3p-miR | TJU_CMC_MD2.ID00771.hairpin | YES | YES | YES | YES | NO | NO | NO | NO |
| TJU_CMC_MD2.ID00771.5p-miR | TJU_CMC_MD2.ID00771.hairpin | YES | YES | YES | YES | YES | NO | NO | NO |
| TJU_CMC_MD2.ID00772.3p-miR | TJU_CMC_MD2.ID00772.hairpin | YES | NO | NO | NO | NO | NO | NO | NO |
| TJU_CMC_MD2.ID00772.5p-miR | TJU_CMC_MD2.ID00772.hairpin | YES | NO | YES | YES | NO | NO | NO | NO |
| TJU_CMC_MD2.ID00773.3p-miR | TJU_CMC_MD2.ID00773.hairpin | YES | NO | NO | NO | NO | NO | NO | NO |
| TJU_CMC_MD2.ID00774.3p-miR | TJU_CMC_MD2.ID00774.hairpin | YES | NO | NO | NO | NO | NO | NO | NO |
| TJU_CMC_MD2.ID00775.3p-miR | TJU_CMC_MD2.ID00775.hairpin | YES | NO | NO | NO | NO | NO | NO | NO |
| TJU_CMC_MD2.ID00776.3p-miR | TJU_CMC_MD2.ID00776.hairpin | YES | NO | NO | NO | NO | NO | NO | NO |
| TJU_CMC_MD2.ID00776.5p-miR | TJU_CMC_MD2.ID00776.hairpin | YES | YES | YES | YES | NO | NO | NO | NO |
| TJU_CMC_MD2.ID00777.3p-miR | TJU_CMC_MD2.ID00777.hairpin | YES | NO | NO | NO | NO | NO | NO | NO |
| TJU_CMC_MD2.ID00778.3p-miR | TJU_CMC_MD2.ID00778.hairpin | YES | NO | NO | NO | NO | NO | NO | NO |
| TJU_CMC_MD2.ID00779.3p-miR | TJU_CMC_MD2.ID00779.hairpin | YES | NO | NO | NO | NO | NO | NO | NO |
| TJU_CMC_MD2.ID00780.3p-miR | TJU_CMC_MD2.ID00780.hairpin | YES | NO | NO | NO | NO | NO | NO | NO |
| TJU_CMC_MD2.ID00781.3p-miR | TJU_CMC_MD2.ID00781.hairpin | YES | NO | NO | NO | NO | NO | NO | NO |
| TJU_CMC_MD2.ID00782.3p-miR | TJU_CMC_MD2.ID00782.hairpin | YES | NO | NO | NO | NO | NO | NO | NO |
| TJU_CMC_MD2.ID00783.3p-miR | TJU_CMC_MD2.ID00783.hairpin | YES | NO | NO | NO | NO | NO | NO | NO |
| TJU_CMC_MD2.ID00784.3p-miR | TJU_CMC_MD2.ID00784.hairpin | YES | NO | NO | NO | NO | NO | NO | NO |
| TJU_CMC_MD2.ID00785.3p-miR | TJU_CMC_MD2.ID00785.hairpin | YES | NO | NO | NO | NO | NO | NO | NO |
| TJU_CMC_MD2.ID00785.5p-miR | TJU_CMC_MD2.ID00785.hairpin | YES | YES | YES | YES | NO | NO | NO | NO |
| TJU_CMC_MD2.ID00786.5p-miR | TJU_CMC_MD2.ID00786.hairpin | YES | YES | YES | NO | NO | NO | NO | NO |
| TJU_CMC_MD2.ID00787.3p-miR | TJU_CMC_MD2.ID00787.hairpin | YES | NO | NO | NO | NO | NO | NO | NO |
| TJU_CMC_MD2.ID00788.5p-miR | TJU_CMC_MD2.ID00788.hairpin | YES | YES | YES | NO | NO | NO | NO | NO |
| TJU_CMC_MD2.ID00789.5p-miR | TJU_CMC_MD2.ID00789.hairpin | YES | YES | YES | YES | YES | NO | NO | NO |
| TJU_CMC_MD2.ID00790.3p-miR | TJU_CMC_MD2.ID00790.hairpin | YES | NO | NO | NO | NO | NO | NO | NO |
| TJU_CMC_MD2.ID00791.5p-miR | TJU_CMC_MD2.ID00791.hairpin | YES | YES | YES | YES | YES | NO | NO | NO |
| TJU_CMC_MD2.ID00792.3p-miR | TJU_CMC_MD2.ID00792.hairpin | YES | NO | NO | NO | NO | NO | NO | NO |
| TJU_CMC_MD2.ID00793.5p-miR | TJU_CMC_MD2.ID00793.hairpin | YES | YES | YES | YES | NO | NO | NO | NO |
| TJU_CMC_MD2.ID00794.3p-miR | TJU_CMC_MD2.ID00794.hairpin | YES | NO | NO | NO | NO | NO | NO | NO |
| TJU_CMC_MD2.ID00795.5p-miR | TJU_CMC_MD2.ID00795.hairpin | YES | NO | NO | NO | NO | NO | NO | NO |
| TJU_CMC_MD2.ID00796.3p-miR | TJU_CMC_MD2.ID00796.hairpin | YES | NO | NO | NO | NO | NO | NO | NO |
| TJU_CMC_MD2.ID00797.3p-miR | TJU_CMC_MD2.ID00797.hairpin | YES | NO | NO | NO | NO | NO | NO | NO |
| TJU_CMC_MD2.ID00798.3p-miR | TJU_CMC_MD2.ID00798.hairpin | YES | NO | NO | NO | NO | NO | NO | NO |
| TJU_CMC_MD2.ID00799.3p-miR | TJU_CMC_MD2.ID00799.hairpin | YES | NO | NO | NO | NO | NO | NO | NO |
| TJU_CMC_MD2.ID00800.5p-miR | TJU_CMC_MD2.ID00800.hairpin | YES | YES | YES | YES | YES | NO | NO | NO |
| TJU_CMC_MD2.ID00801.5p-miR | TJU_CMC_MD2.ID00801.hairpin | YES | YES | YES | YES | YES | NO | NO | NO |
| TJU_CMC_MD2.ID00802.5p-miR | TJU_CMC_MD2.ID00802.hairpin | YES | NO | NO | NO | YES | NO | NO | NO |
| TJU_CMC_MD2.ID00803.5p-miR | TJU_CMC_MD2.ID00803.hairpin | YES | NO | NO | YES | NO | NO | NO | NO |
| TJU_CMC_MD2.ID00804.3p-miR | TJU_CMC_MD2.ID00804.hairpin | YES | NO | NO | NO | NO | NO | NO | NO |
| TJU_CMC_MD2.ID00805.3p-miR | TJU_CMC_MD2.ID00805.hairpin | YES | NO | NO | NO | NO | NO | NO | NO |
| TJU_CMC_MD2.ID00806.5p-miR | TJU_CMC_MD2.ID00806.hairpin | YES | YES | YES | YES | NO | NO | NO | NO |
| TJU_CMC_MD2.ID00807.5p-miR | TJU_CMC_MD2.ID00807.hairpin | YES | NO | NO | NO | NO | NO | NO | NO |
| TJU_CMC_MD2.ID00808.3p-miR | TJU_CMC_MD2.ID00808.hairpin | YES | NO | NO | NO | NO | NO | NO | NO |
| TJU_CMC_MD2.ID00809.3p-miR | TJU_CMC_MD2.ID00809.hairpin | YES | NO | NO | NO | NO | NO | NO | NO |
| TJU_CMC_MD2.ID00810.3p-miR | TJU_CMC_MD2.ID00810.hairpin | YES | NO | NO | NO | NO | NO | NO | NO |
| TJU_CMC_MD2.ID00810.5p-miR | TJU_CMC_MD2.ID00810.hairpin | YES | YES | YES | NO | YES | NO | NO | NO |
| TJU_CMC_MD2.ID00811.3p-miR | TJU_CMC_MD2.ID00811.hairpin | YES | NO | NO | NO | NO | NO | NO | NO |
| TJU_CMC_MD2.ID00812.5p-miR | TJU_CMC_MD2.ID00812.hairpin | YES | YES | YES | NO | NO | NO | NO | NO |
| TJU_CMC_MD2.ID00813.5p-miR | TJU_CMC_MD2.ID00813.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00814.5p-miR | TJU_CMC_MD2.ID00814.hairpin | YES | YES | NO | YES | NO | NO | NO | NO |
| TJU_CMC_MD2.ID00815.5p-miR | TJU_CMC_MD2.ID00815.hairpin | YES | NO | YES | NO | YES | NO | NO | NO |
| TJU_CMC_MD2.ID00816.3p-miR | TJU_CMC_MD2.ID00816.hairpin | YES | NO | NO | NO | NO | NO | NO | NO |
| TJU_CMC_MD2.ID00817.3p-miR | TJU_CMC_MD2.ID00817.hairpin | YES | NO | NO | NO | NO | NO | NO | NO |
| TJU_CMC_MD2.ID00818.3p-miR | TJU_CMC_MD2.ID00818.hairpin | YES | NO | NO | NO | NO | NO | NO | NO |
| TJU_CMC_MD2.ID00819.3p-miR | TJU_CMC_MD2.ID00819.hairpin | YES | NO | NO | NO | NO | NO | NO | NO |
| TJU_CMC_MD2.ID00820.5p-miR | TJU_CMC_MD2.ID00820.hairpin | YES | NO | YES | NO | NO | NO | NO | NO |
| TJU_CMC_MD2.ID00821.3p-miR | TJU_CMC_MD2.ID00821.hairpin | YES | NO | NO | NO | NO | NO | NO | NO |
| TJU_CMC_MD2.ID00822.5p-miR | TJU_CMC_MD2.ID00822.hairpin | YES | YES | YES | YES | NO | NO | NO | NO |
| TJU_CMC_MD2.ID00823.3p-miR | TJU_CMC_MD2.ID00823.hairpin | YES | NO | NO | NO | NO | NO | NO | NO |
| TJU_CMC_MD2.ID00824.5p-miR | TJU_CMC_MD2.ID00824.hairpin | YES | YES | YES | YES | YES | NO | NO | NO |
| TJU_CMC_MD2.ID00825.3p-miR | TJU_CMC_MD2.ID00825.hairpin | YES | NO | NO | NO | NO | NO | NO | NO |
| TJU_CMC_MD2.ID00826.5p-miR | TJU_CMC_MD2.ID00826.hairpin | YES | YES | NO | YES | NO | NO | NO | NO |
| TJU_CMC_MD2.ID00827.3p-miR | TJU_CMC_MD2.ID00827.hairpin | YES | NO | NO | NO | NO | NO | NO | NO |
| TJU_CMC_MD2.ID00828.5p-miR | TJU_CMC_MD2.ID00828.hairpin | YES | YES | YES | YES | NO | YES | NO | NO |
| TJU_CMC_MD2.ID00829.5p-miR | TJU_CMC_MD2.ID00829.hairpin | YES | YES | YES | NO | NO | NO | NO | NO |
| TJU_CMC_MD2.ID00830.5p-miR | TJU_CMC_MD2.ID00830.hairpin | YES | YES | NO | YES | YES | NO | NO | NO |
| TJU_CMC_MD2.ID00831.5p-miR | TJU_CMC_MD2.ID00831.hairpin | YES | YES | NO | NO | NO | NO | NO | NO |
| TJU_CMC_MD2.ID00832.5p-miR | TJU_CMC_MD2.ID00832.hairpin | YES | NO | YES | NO | YES | NO | NO | NO |
| TJU_CMC_MD2.ID00833.5p-miR | TJU_CMC_MD2.ID00833.hairpin | YES | NO | NO | YES | YES | NO | NO | NO |
| TJU_CMC_MD2.ID00834.3p-miR | TJU_CMC_MD2.ID00834.hairpin | YES | NO | NO | NO | NO | NO | NO | NO |
| TJU_CMC_MD2.ID00835.5p-miR | TJU_CMC_MD2.ID00835.hairpin | YES | YES | YES | NO | YES | NO | NO | NO |
| TJU_CMC_MD2.ID00836.5p-miR | TJU_CMC_MD2.ID00836.hairpin | YES | YES | YES | YES | YES | NO | NO | NO |
| TJU_CMC_MD2.ID00837.5p-miR | TJU_CMC_MD2.ID00837.hairpin | YES | YES | YES | YES | YES | NO | NO | NO |
| TJU_CMC_MD2.ID00838.3p-miR | TJU_CMC_MD2.ID00838.hairpin | YES | NO | NO | NO | NO | NO | NO | NO |
| TJU_CMC_MD2.ID00839.3p-miR | TJU_CMC_MD2.ID00839.hairpin | YES | NO | NO | NO | NO | NO | NO | NO |
| TJU_CMC_MD2.ID00840.3p-miR | TJU_CMC_MD2.ID00840.hairpin | YES | NO | NO | NO | NO | NO | NO | NO |
| TJU_CMC_MD2.ID00840.5p-miR | TJU_CMC_MD2.ID00840.hairpin | YES | YES | YES | YES | YES | NO | NO | NO |
| TJU_CMC_MD2.ID00841.3p-miR | TJU_CMC_MD2.ID00841.hairpin | YES | NO | NO | NO | NO | NO | NO | NO |
| TJU_CMC_MD2.ID00842.3p-miR | TJU_CMC_MD2.ID00842.hairpin | YES | NO | NO | NO | NO | NO | NO | NO |
| TJU_CMC_MD2.ID00843.5p-miR | TJU_CMC_MD2.ID00843.hairpin | YES | NO | NO | NO | NO | NO | NO | NO |
| TJU_CMC_MD2.ID00844.3p-miR | TJU_CMC_MD2.ID00844.hairpin | YES | NO | NO | NO | NO | NO | NO | NO |
| TJU_CMC_MD2.ID00845.3p-miR | TJU_CMC_MD2.ID00845.hairpin | YES | NO | NO | NO | NO | NO | NO | NO |
| TJU_CMC_MD2.ID00846.3p-miR | TJU_CMC_MD2.ID00846.hairpin | YES | NO | NO | NO | NO | NO | NO | NO |
| TJU_CMC_MD2.ID00847.3p-miR | TJU_CMC_MD2.ID00847.hairpin | YES | NO | NO | NO | NO | NO | NO | NO |
| TJU_CMC_MD2.ID00848.5p-miR | TJU_CMC_MD2.ID00848.hairpin | YES | YES | YES | YES | NO | NO | NO | NO |
| TJU_CMC_MD2.ID00849.3p-miR | TJU_CMC_MD2.ID00849.hairpin | YES | NO | NO | NO | NO | NO | NO | NO |
| TJU_CMC_MD2.ID00850.3p-miR | TJU_CMC_MD2.ID00850.hairpin | YES | NO | NO | NO | NO | NO | NO | NO |
| TJU_CMC_MD2.ID00851.5p-miR | TJU_CMC_MD2.ID00851.hairpin | YES | YES | YES | NO | NO | NO | NO | NO |
| TJU_CMC_MD2.ID00852.5p-miR | TJU_CMC_MD2.ID00852.hairpin | YES | NO | YES | YES | YES | NO | NO | NO |
| TJU_CMC_MD2.ID00853.5p-miR | TJU_CMC_MD2.ID00853.hairpin | YES | NO | NO | NO | NO | NO | NO | NO |
| TJU_CMC_MD2.ID00854.5p-miR | TJU_CMC_MD2.ID00854.hairpin | YES | YES | NO | NO | NO | NO | NO | NO |
| TJU_CMC_MD2.ID00855.5p-miR | TJU_CMC_MD2.ID00855.hairpin | YES | NO | NO | NO | NO | NO | NO | NO |
| TJU_CMC_MD2.ID00856.3p-miR | TJU_CMC_MD2.ID00856.hairpin | YES | NO | NO | NO | NO | NO | NO | NO |
| TJU_CMC_MD2.ID00857.5p-miR | TJU_CMC_MD2.ID00857.hairpin | YES | YES | NO | YES | NO | NO | NO | NO |
| TJU_CMC_MD2.ID00858.5p-miR | TJU_CMC_MD2.ID00858.hairpin | YES | YES | YES | YES | YES | NO | NO | NO |
| TJU_CMC_MD2.ID00859.5p-miR | TJU_CMC_MD2.ID00859.hairpin | YES | YES | YES | NO | YES | NO | NO | NO |
| TJU_CMC_MD2.ID00860.3p-miR | TJU_CMC_MD2.ID00860.hairpin | YES | NO | NO | NO | NO | NO | NO | NO |
| TJU_CMC_MD2.ID00861.3p-miR | TJU_CMC_MD2.ID00861.hairpin | YES | NO | NO | NO | NO | NO | NO | NO |
| TJU_CMC_MD2.ID00862.3p-miR | TJU_CMC_MD2.ID00862.hairpin | YES | NO | NO | NO | NO | NO | NO | NO |
| TJU_CMC_MD2.ID00863.5p-miR | TJU_CMC_MD2.ID00863.hairpin | YES | YES | YES | YES | NO | NO | NO | NO |
| TJU_CMC_MD2.ID00864.3p-miR | TJU_CMC_MD2.ID00864.hairpin | YES | NO | NO | NO | NO | NO | NO | NO |
| TJU_CMC_MD2.ID00865.5p-miR | TJU_CMC_MD2.ID00865.hairpin | YES | YES | YES | YES | NO | NO | NO | NO |
| TJU_CMC_MD2.ID00866.3p-miR | TJU_CMC_MD2.ID00866.hairpin | YES | NO | NO | NO | NO | NO | NO | NO |
| TJU_CMC_MD2.ID00867.3p-miR | TJU_CMC_MD2.ID00867.hairpin | YES | NO | NO | NO | NO | NO | NO | NO |
| TJU_CMC_MD2.ID00868.5p-miR | TJU_CMC_MD2.ID00868.hairpin | YES | NO | NO | NO | NO | NO | NO | NO |
| TJU_CMC_MD2.ID00869.3p-miR | TJU_CMC_MD2.ID00869.hairpin | YES | NO | NO | NO | NO | NO | NO | NO |
| TJU_CMC_MD2.ID00870.5p-miR | TJU_CMC_MD2.ID00870.hairpin | YES | NO | YES | NO | NO | NO | NO | NO |
| TJU_CMC_MD2.ID00871.3p-miR | TJU_CMC_MD2.ID00871.hairpin | YES | NO | NO | NO | NO | NO | NO | NO |
| TJU_CMC_MD2.ID00872.3p-miR | TJU_CMC_MD2.ID00872.hairpin | YES | NO | NO | NO | NO | NO | NO | NO |
| TJU_CMC_MD2.ID00873.5p-miR | TJU_CMC_MD2.ID00873.hairpin | YES | NO | YES | NO | YES | NO | NO | NO |
| TJU_CMC_MD2.ID00874.3p-miR | TJU_CMC_MD2.ID00874.hairpin | YES | NO | NO | NO | NO | NO | NO | NO |
| TJU_CMC_MD2.ID00875.3p-miR | TJU_CMC_MD2.ID00875.hairpin | YES | NO | NO | NO | NO | NO | NO | NO |
| TJU_CMC_MD2.ID00876.3p-miR | TJU_CMC_MD2.ID00876.hairpin | YES | NO | NO | NO | NO | NO | NO | NO |
| TJU_CMC_MD2.ID00876.5p-miR | TJU_CMC_MD2.ID00876.hairpin | YES | YES | YES | NO | YES | NO | NO | NO |
| TJU_CMC_MD2.ID00877.5p-miR | TJU_CMC_MD2.ID00877.hairpin | YES | YES | YES | NO | NO | NO | NO | NO |
| TJU_CMC_MD2.ID00878.3p-miR | TJU_CMC_MD2.ID00878.hairpin | YES | NO | NO | NO | NO | NO | NO | NO |
| TJU_CMC_MD2.ID00879.3p-miR | TJU_CMC_MD2.ID00879.hairpin | YES | NO | NO | NO | NO | NO | NO | NO |
| TJU_CMC_MD2.ID00880.3p-miR | TJU_CMC_MD2.ID00880.hairpin | YES | NO | NO | NO | NO | NO | NO | NO |
| TJU_CMC_MD2.ID00881.3p-miR | TJU_CMC_MD2.ID00881.hairpin | YES | NO | NO | NO | NO | NO | NO | NO |
| TJU_CMC_MD2.ID00882.3p-miR | TJU_CMC_MD2.ID00882.hairpin | YES | NO | NO | NO | NO | NO | NO | NO |
| TJU_CMC_MD2.ID00883.3p-miR | TJU_CMC_MD2.ID00883.hairpin | YES | NO | NO | NO | NO | NO | NO | NO |
| TJU_CMC_MD2.ID00884.3p-miR | TJU_CMC_MD2.ID00884.hairpin | YES | NO | NO | NO | NO | NO | NO | NO |
| TJU_CMC_MD2.ID00885.3p-miR | TJU_CMC_MD2.ID00885.hairpin | YES | NO | NO | NO | NO | NO | NO | NO |
| TJU_CMC_MD2.ID00886.5p-miR | TJU_CMC_MD2.ID00886.hairpin | YES | YES | YES | NO | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00887.5p-miR | TJU_CMC_MD2.ID00887.hairpin | YES | NO | YES | NO | NO | NO | NO | NO |
| TJU_CMC_MD2.ID00888.5p-miR | TJU_CMC_MD2.ID00888.hairpin | YES | YES | YES | NO | YES | NO | NO | NO |
| TJU_CMC_MD2.ID00889.3p-miR | TJU_CMC_MD2.ID00889.hairpin | YES | NO | NO | NO | NO | NO | NO | NO |
| TJU_CMC_MD2.ID00890.3p-miR | TJU_CMC_MD2.ID00890.hairpin | YES | NO | NO | NO | NO | NO | NO | NO |
| TJU_CMC_MD2.ID00891.5p-miR | TJU_CMC_MD2.ID00891.hairpin | YES | NO | YES | YES | NO | NO | NO | NO |
| TJU_CMC_MD2.ID00892.3p-miR | TJU_CMC_MD2.ID00892.hairpin | YES | NO | NO | NO | NO | NO | NO | NO |
| TJU_CMC_MD2.ID00893.3p-miR | TJU_CMC_MD2.ID00893.hairpin | YES | NO | NO | NO | NO | NO | NO | NO |
| TJU_CMC_MD2.ID00894.5p-miR | TJU_CMC_MD2.ID00894.hairpin | YES | NO | YES | NO | NO | NO | NO | NO |
| TJU_CMC_MD2.ID00895.3p-miR | TJU_CMC_MD2.ID00895.hairpin | YES | NO | NO | NO | NO | NO | NO | NO |
| TJU_CMC_MD2.ID00896.5p-miR | TJU_CMC_MD2.ID00896.hairpin | YES | NO | YES | NO | NO | NO | NO | NO |
| TJU_CMC_MD2.ID00897.3p-miR | TJU_CMC_MD2.ID00897.hairpin | YES | NO | NO | NO | NO | NO | NO | NO |
| TJU_CMC_MD2.ID00898.3p-miR | TJU_CMC_MD2.ID00898.hairpin | YES | NO | NO | NO | NO | NO | NO | NO |
| TJU_CMC_MD2.ID00898.5p-miR | TJU_CMC_MD2.ID00898.hairpin | YES | NO | NO | NO | NO | NO | NO | NO |
| TJU_CMC_MD2.ID00899.5p-miR | TJU_CMC_MD2.ID00899.hairpin | YES | YES | NO | NO | NO | NO | NO | NO |
| TJU_CMC_MD2.ID00900.5p-miR | TJU_CMC_MD2.ID00900.hairpin | YES | YES | YES | YES | NO | NO | NO | NO |
| TJU_CMC_MD2.ID00901.3p-miR | TJU_CMC_MD2.ID00901.hairpin | YES | NO | NO | NO | NO | NO | NO | NO |
| TJU_CMC_MD2.ID00902.5p-miR | TJU_CMC_MD2.ID00902.hairpin | YES | YES | YES | NO | NO | NO | NO | NO |
| TJU_CMC_MD2.ID00903.5p-miR | TJU_CMC_MD2.ID00903.hairpin | YES | YES | YES | YES | YES | NO | NO | NO |
| TJU_CMC_MD2.ID00904.3p-miR | TJU_CMC_MD2.ID00904.hairpin | YES | NO | NO | NO | NO | NO | NO | NO |
| TJU_CMC_MD2.ID00905.3p-miR | TJU_CMC_MD2.ID00905.hairpin | YES | NO | NO | NO | NO | NO | NO | NO |
| TJU_CMC_MD2.ID00906.3p-miR | TJU_CMC_MD2.ID00906.hairpin | YES | NO | NO | NO | NO | NO | NO | NO |
| TJU_CMC_MD2.ID00907.5p-miR | TJU_CMC_MD2.ID00907.hairpin | YES | YES | YES | YES | YES | NO | NO | NO |
| TJU_CMC_MD2.ID00908.5p-miR | TJU_CMC_MD2.ID00908.hairpin | YES | YES | NO | YES | NO | NO | NO | NO |
| TJU_CMC_MD2.ID00909.3p-miR | TJU_CMC_MD2.ID00909.hairpin | YES | NO | NO | NO | NO | NO | NO | NO |
| TJU_CMC_MD2.ID00910.3p-miR | TJU_CMC_MD2.ID00910.hairpin | YES | NO | NO | NO | NO | NO | NO | NO |
| TJU_CMC_MD2.ID00911.5p-miR | TJU_CMC_MD2.ID00911.hairpin | YES | NO | YES | NO | NO | NO | NO | NO |
| TJU_CMC_MD2.ID00912.5p-miR | TJU_CMC_MD2.ID00912.hairpin | YES | NO | NO | YES | NO | NO | NO | NO |
| TJU_CMC_MD2.ID00913.5p-miR | TJU_CMC_MD2.ID00913.hairpin | YES | YES | NO | YES | NO | NO | NO | NO |
| TJU_CMC_MD2.ID00914.3p-miR | TJU_CMC_MD2.ID00914.hairpin | YES | NO | NO | NO | NO | NO | NO | NO |
| TJU_CMC_MD2.ID00915.3p-miR | TJU_CMC_MD2.ID00915.hairpin | YES | NO | NO | NO | NO | NO | NO | NO |
| TJU_CMC_MD2.ID00916.5p-miR | TJU_CMC_MD2.ID00916.hairpin | YES | YES | YES | YES | YES | NO | NO | NO |
| TJU_CMC_MD2.ID00917.5p-miR | TJU_CMC_MD2.ID00917.hairpin | YES | NO | YES | NO | YES | NO | NO | NO |
| TJU_CMC_MD2.ID00918.5p-miR | TJU_CMC_MD2.ID00918.hairpin | YES | NO | YES | YES | NO | NO | NO | NO |
| TJU_CMC_MD2.ID00919.3p-miR | TJU_CMC_MD2.ID00919.hairpin | YES | NO | NO | NO | NO | NO | NO | NO |
| TJU_CMC_MD2.ID00919.5p-miR | TJU_CMC_MD2.ID00919.hairpin | YES | YES | YES | NO | NO | NO | NO | NO |
| TJU_CMC_MD2.ID00920.5p-miR | TJU_CMC_MD2.ID00920.hairpin | YES | NO | NO | YES | NO | NO | NO | NO |
| TJU_CMC_MD2.ID00921.3p-miR | TJU_CMC_MD2.ID00921.hairpin | YES | NO | NO | NO | NO | NO | NO | NO |
| TJU_CMC_MD2.ID00922.3p-miR | TJU_CMC_MD2.ID00922.hairpin | YES | NO | NO | NO | NO | NO | NO | NO |
| TJU_CMC_MD2.ID00923.3p-miR | TJU_CMC_MD2.ID00923.hairpin | YES | NO | NO | NO | NO | NO | NO | NO |
| TJU_CMC_MD2.ID00924.3p-miR | TJU_CMC_MD2.ID00924.hairpin | YES | NO | NO | NO | NO | NO | NO | NO |
| TJU_CMC_MD2.ID00925.5p-miR | TJU_CMC_MD2.ID00925.hairpin | YES | YES | YES | YES | YES | NO | NO | NO |
| TJU_CMC_MD2.ID00926.5p-miR | TJU_CMC_MD2.ID00926.hairpin | YES | YES | YES | NO | YES | NO | NO | NO |
| TJU_CMC_MD2.ID00927.3p-miR | TJU_CMC_MD2.ID00927.hairpin | YES | NO | NO | NO | NO | NO | NO | NO |
| TJU_CMC_MD2.ID00928.3p-miR | TJU_CMC_MD2.ID00928.hairpin | YES | NO | NO | NO | NO | NO | NO | NO |
| TJU_CMC_MD2.ID00928.5p-miR | TJU_CMC_MD2.ID00928.hairpin | YES | YES | YES | YES | YES | YES | NO | NO |
| TJU_CMC_MD2.ID00929.5p-miR | TJU_CMC_MD2.ID00929.hairpin | YES | NO | YES | YES | YES | YES | NO | NO |
| TJU_CMC_MD2.ID00930.3p-miR | TJU_CMC_MD2.ID00930.hairpin | YES | NO | NO | NO | NO | NO | NO | NO |
| TJU_CMC_MD2.ID00931.3p-miR | TJU_CMC_MD2.ID00931.hairpin | YES | NO | NO | NO | NO | NO | NO | NO |
| TJU_CMC_MD2.ID00932.3p-miR | TJU_CMC_MD2.ID00932.hairpin | YES | NO | NO | NO | NO | NO | NO | NO |
| TJU_CMC_MD2.ID00933.3p-miR | TJU_CMC_MD2.ID00933.hairpin | YES | NO | NO | NO | NO | NO | NO | NO |
| TJU_CMC_MD2.ID00934.3p-miR | TJU_CMC_MD2.ID00934.hairpin | YES | YES | YES | YES | YES | NO | NO | NO |
| TJU_CMC_MD2.ID00935.5p-miR | TJU_CMC_MD2.ID00935.hairpin | YES | YES | YES | YES | YES | YES | NO | NO |
| TJU_CMC_MD2.ID00936.5p-miR | TJU_CMC_MD2.ID00936.hairpin | YES | YES | YES | YES | YES | YES | NO | NO |
| TJU_CMC_MD2.ID00937.5p-miR | TJU_CMC_MD2.ID00937.hairpin | YES | YES | YES | YES | YES | NO | NO | NO |
| TJU_CMC_MD2.ID00938.5p-miR | TJU_CMC_MD2.ID00938.hairpin | YES | YES | YES | YES | YES | YES | NO | NO |
| TJU_CMC_MD2.ID00939.5p-miR | TJU_CMC_MD2.ID00939.hairpin | YES | YES | YES | YES | YES | NO | NO | NO |
| TJU_CMC_MD2.ID00940.3p-miR | TJU_CMC_MD2.ID00940.hairpin | YES | NO | NO | NO | NO | NO | NO | NO |
| TJU_CMC_MD2.ID00941.3p-miR | TJU_CMC_MD2.ID00941.hairpin | YES | NO | NO | NO | NO | NO | NO | NO |
| TJU_CMC_MD2.ID00942.3p-miR | TJU_CMC_MD2.ID00942.hairpin | YES | NO | NO | NO | NO | NO | NO | NO |
| TJU_CMC_MD2.ID00942.5p-miR | TJU_CMC_MD2.ID00942.hairpin | YES | NO | YES | YES | YES | NO | NO | NO |
| TJU_CMC_MD2.ID00943.3p-miR | TJU_CMC_MD2.ID00943.hairpin | YES | NO | NO | NO | NO | NO | NO | NO |
| TJU_CMC_MD2.ID00944.5p-miR | TJU_CMC_MD2.ID00944.hairpin | YES | YES | YES | NO | NO | NO | NO | NO |
| TJU_CMC_MD2.ID00945.3p-miR | TJU_CMC_MD2.ID00945.hairpin | YES | NO | NO | NO | NO | NO | NO | NO |
| TJU_CMC_MD2.ID00946.5p-miR | TJU_CMC_MD2.ID00946.hairpin | YES | NO | YES | NO | NO | NO | NO | NO |
| TJU_CMC_MD2.ID00947.3p-miR | TJU_CMC_MD2.ID00947.hairpin | YES | NO | NO | NO | NO | NO | NO | NO |
| TJU_CMC_MD2.ID00948.5p-miR | TJU_CMC_MD2.ID00948.hairpin | YES | YES | NO | YES | NO | NO | NO | NO |
| TJU_CMC_MD2.ID00949.3p-miR | TJU_CMC_MD2.ID00949.hairpin | YES | NO | NO | NO | NO | NO | NO | NO |
| TJU_CMC_MD2.ID00950.3p-miR | TJU_CMC_MD2.ID00950.hairpin | YES | NO | NO | NO | NO | NO | NO | NO |
| TJU_CMC_MD2.ID00951.5p-miR | TJU_CMC_MD2.ID00951.hairpin | YES | NO | YES | NO | NO | NO | NO | NO |
| TJU_CMC_MD2.ID00952.5p-miR | TJU_CMC_MD2.ID00952.hairpin | YES | YES | YES | NO | YES | NO | NO | NO |
| TJU_CMC_MD2.ID00953.5p-miR | TJU_CMC_MD2.ID00953.hairpin | YES | YES | YES | YES | NO | NO | NO | NO |
| TJU_CMC_MD2.ID00954.3p-miR | TJU_CMC_MD2.ID00954.hairpin | YES | NO | NO | NO | NO | NO | NO | NO |
| TJU_CMC_MD2.ID00955.3p-miR | TJU_CMC_MD2.ID00955.hairpin | YES | NO | NO | NO | NO | NO | NO | NO |
| TJU_CMC_MD2.ID00956.5p-miR | TJU_CMC_MD2.ID00956.hairpin | YES | NO | YES | NO | YES | NO | NO | NO |
| TJU_CMC_MD2.ID00957.5p-miR | TJU_CMC_MD2.ID00957.hairpin | YES | YES | YES | NO | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID00958.3p-miR | TJU_CMC_MD2.ID00958.hairpin | YES | NO | NO | NO | NO | NO | NO | NO |
| TJU_CMC_MD2.ID00959.3p-miR | TJU_CMC_MD2.ID00959.hairpin | YES | NO | NO | NO | NO | NO | NO | NO |
| TJU_CMC_MD2.ID00960.5p-miR | TJU_CMC_MD2.ID00960.hairpin | YES | YES | YES | NO | NO | NO | NO | NO |
| TJU_CMC_MD2.ID00961.3p-miR | TJU_CMC_MD2.ID00961.hairpin | YES | NO | NO | NO | NO | NO | NO | NO |
| TJU_CMC_MD2.ID00962.3p-miR | TJU_CMC_MD2.ID00962.hairpin | YES | NO | NO | NO | NO | NO | NO | NO |
| TJU_CMC_MD2.ID00963.3p-miR | TJU_CMC_MD2.ID00963.hairpin | YES | NO | NO | NO | NO | NO | NO | NO |
| TJU_CMC_MD2.ID00964.5p-miR | TJU_CMC_MD2.ID00964.hairpin | YES | NO | YES | NO | YES | NO | NO | NO |
| TJU_CMC_MD2.ID00965.3p-miR | TJU_CMC_MD2.ID00965.hairpin | YES | NO | NO | NO | NO | NO | NO | NO |
| TJU_CMC_MD2.ID00966.5p-miR | TJU_CMC_MD2.ID00966.hairpin | YES | YES | YES | YES | NO | NO | NO | NO |
| TJU_CMC_MD2.ID00967.5p-miR | TJU_CMC_MD2.ID00967.hairpin | YES | YES | YES | NO | NO | NO | NO | NO |
| TJU_CMC_MD2.ID00968.3p-miR | TJU_CMC_MD2.ID00968.hairpin | YES | NO | NO | NO | NO | NO | NO | NO |
| TJU_CMC_MD2.ID00969.3p-miR | TJU_CMC_MD2.ID00969.hairpin | YES | NO | NO | NO | NO | NO | NO | NO |
| TJU_CMC_MD2.ID00970.3p-miR | TJU_CMC_MD2.ID00970.hairpin | YES | NO | NO | NO | NO | NO | NO | NO |
| TJU_CMC_MD2.ID00971.3p-miR | TJU_CMC_MD2.ID00971.hairpin | YES | NO | NO | NO | NO | NO | NO | NO |
| TJU_CMC_MD2.ID00971.5p-miR | TJU_CMC_MD2.ID00971.hairpin | YES | NO | YES | NO | NO | NO | NO | NO |
| TJU_CMC_MD2.ID00972.5p-miR | TJU_CMC_MD2.ID00972.hairpin | YES | YES | NO | NO | YES | NO | NO | NO |
| TJU_CMC_MD2.ID00973.3p-miR | TJU_CMC_MD2.ID00973.hairpin | YES | NO | NO | NO | NO | NO | NO | NO |
| TJU_CMC_MD2.ID00974.3p-miR | TJU_CMC_MD2.ID00974.hairpin | YES | NO | NO | NO | NO | NO | NO | NO |
| TJU_CMC_MD2.ID00975.5p-miR | TJU_CMC_MD2.ID00975.hairpin | YES | YES | YES | YES | NO | NO | NO | NO |
| TJU_CMC_MD2.ID00976.3p-miR | TJU_CMC_MD2.ID00976.hairpin | YES | NO | NO | NO | NO | NO | NO | NO |
| TJU_CMC_MD2.ID00977.3p-miR | TJU_CMC_MD2.ID00977.hairpin | YES | NO | NO | NO | NO | NO | NO | NO |
| TJU_CMC_MD2.ID00978.5p-miR | TJU_CMC_MD2.ID00978.hairpin | YES | YES | NO | NO | NO | NO | NO | NO |
| TJU_CMC_MD2.ID00979.5p-miR | TJU_CMC_MD2.ID00979.hairpin | YES | YES | YES | YES | YES | NO | NO | NO |
| TJU_CMC_MD2.ID00980.3p-miR | TJU_CMC_MD2.ID00980.hairpin | YES | NO | NO | NO | NO | NO | NO | NO |
| TJU_CMC_MD2.ID00981.3p-miR | TJU_CMC_MD2.ID00981.hairpin | YES | NO | NO | NO | NO | NO | NO | NO |
| TJU_CMC_MD2.ID00982.3p-miR | TJU_CMC_MD2.ID00982.hairpin | YES | NO | NO | NO | NO | NO | NO | NO |
| TJU_CMC_MD2.ID00983.3p-miR | TJU_CMC_MD2.ID00983.hairpin | YES | NO | NO | NO | NO | NO | NO | NO |
| TJU_CMC_MD2.ID00984.5p-miR | TJU_CMC_MD2.ID00984.hairpin | YES | YES | YES | NO | YES | NO | NO | NO |
| TJU_CMC_MD2.ID00985.3p-miR | TJU_CMC_MD2.ID00985.hairpin | YES | NO | NO | NO | NO | NO | NO | NO |
| TJU_CMC_MD2.ID00986.5p-miR | TJU_CMC_MD2.ID00986.hairpin | YES | NO | YES | NO | YES | NO | NO | NO |
| TJU_CMC_MD2.ID00987.3p-miR | TJU_CMC_MD2.ID00987.hairpin | YES | NO | NO | NO | NO | NO | NO | NO |
| TJU_CMC_MD2.ID00988.3p-miR | TJU_CMC_MD2.ID00988.hairpin | YES | NO | NO | NO | NO | NO | NO | NO |
| TJU_CMC_MD2.ID00989.5p-miR | TJU_CMC_MD2.ID00989.hairpin | YES | YES | YES | YES | NO | NO | NO | NO |
| TJU_CMC_MD2.ID00990.5p-miR | TJU_CMC_MD2.ID00990.hairpin | YES | YES | YES | YES | YES | NO | NO | NO |
| TJU_CMC_MD2.ID00991.5p-miR | TJU_CMC_MD2.ID00991.hairpin | YES | YES | YES | YES | YES | YES | NO | NO |
| TJU_CMC_MD2.ID00992.5p-miR | TJU_CMC_MD2.ID00992.hairpin | YES | YES | YES | YES | NO | NO | NO | NO |
| TJU_CMC_MD2.ID00993.5p-miR | TJU_CMC_MD2.ID00993.hairpin | YES | NO | YES | NO | YES | NO | NO | NO |
| TJU_CMC_MD2.ID00994.3p-miR | TJU_CMC_MD2.ID00994.hairpin | YES | NO | NO | NO | NO | NO | NO | NO |
| TJU_CMC_MD2.ID00995.5p-miR | TJU_CMC_MD2.ID00995.hairpin | YES | YES | YES | YES | NO | NO | NO | NO |
| TJU_CMC_MD2.ID00996.5p-miR | TJU_CMC_MD2.ID00996.hairpin | YES | YES | YES | NO | YES | NO | NO | NO |
| TJU_CMC_MD2.ID00997.3p-miR | TJU_CMC_MD2.ID00997.hairpin | YES | NO | NO | NO | NO | NO | NO | NO |
| TJU_CMC_MD2.ID00998.3p-miR | TJU_CMC_MD2.ID00998.hairpin | YES | NO | NO | NO | NO | NO | NO | NO |
| TJU_CMC_MD2.ID00999.3p-miR | TJU_CMC_MD2.ID00999.hairpin | YES | NO | NO | NO | NO | NO | NO | NO |
| TJU_CMC_MD2.ID01000.3p-miR | TJU_CMC_MD2.ID01000.hairpin | YES | NO | NO | NO | NO | NO | NO | NO |
| TJU_CMC_MD2.ID01001.3p-miR | TJU_CMC_MD2.ID01001.hairpin | YES | NO | NO | NO | NO | NO | NO | NO |
| TJU_CMC_MD2.ID01002.3p-miR | TJU_CMC_MD2.ID01002.hairpin | YES | NO | NO | NO | NO | NO | NO | NO |
| TJU_CMC_MD2.ID01003.3p-miR | TJU_CMC_MD2.ID01003.hairpin | YES | NO | NO | NO | NO | NO | NO | NO |
| TJU_CMC_MD2.ID01004.3p-miR | TJU_CMC_MD2.ID01004.hairpin | YES | NO | NO | NO | NO | NO | NO | NO |
| TJU_CMC_MD2.ID01005.5p-miR | TJU_CMC_MD2.ID01005.hairpin | YES | NO | NO | NO | NO | NO | NO | NO |
| TJU_CMC_MD2.ID01006.3p-miR | TJU_CMC_MD2.ID01006.hairpin | YES | NO | NO | NO | NO | NO | NO | NO |
| TJU_CMC_MD2.ID01007.5p-miR | TJU_CMC_MD2.ID01007.hairpin | YES | NO | YES | YES | YES | NO | NO | NO |
| TJU_CMC_MD2.ID01008.3p-miR | TJU_CMC_MD2.ID01008.hairpin | YES | NO | NO | NO | NO | NO | NO | NO |
| TJU_CMC_MD2.ID01009.5p-miR | TJU_CMC_MD2.ID01009.hairpin | YES | YES | YES | NO | NO | NO | NO | NO |
| TJU_CMC_MD2.ID01010.5p-miR | TJU_CMC_MD2.ID01010.hairpin | YES | YES | YES | YES | YES | YES | NO | NO |
| TJU_CMC_MD2.ID01011.5p-miR | TJU_CMC_MD2.ID01011.hairpin | YES | NO | YES | YES | YES | NO | NO | NO |
| TJU_CMC_MD2.ID01012.3p-miR | TJU_CMC_MD2.ID01012.hairpin | YES | NO | NO | NO | NO | NO | NO | NO |
| TJU_CMC_MD2.ID01013.3p-miR | TJU_CMC_MD2.ID01013.hairpin | YES | NO | NO | NO | NO | NO | NO | NO |
| TJU_CMC_MD2.ID01014.3p-miR | TJU_CMC_MD2.ID01014.hairpin | YES | NO | NO | NO | NO | NO | NO | NO |
| TJU_CMC_MD2.ID01015.3p-miR | TJU_CMC_MD2.ID01015.hairpin | YES | NO | NO | NO | NO | NO | NO | NO |
| TJU_CMC_MD2.ID01016.5p-miR | TJU_CMC_MD2.ID01016.hairpin | YES | NO | YES | YES | NO | NO | NO | NO |
| TJU_CMC_MD2.ID01017.3p-miR | TJU_CMC_MD2.ID01017.hairpin | YES | NO | NO | NO | NO | NO | NO | NO |
| TJU_CMC_MD2.ID01018.3p-miR | TJU_CMC_MD2.ID01018.hairpin | YES | NO | NO | NO | NO | NO | NO | NO |
| TJU_CMC_MD2.ID01019.3p-miR | TJU_CMC_MD2.ID01019.hairpin | YES | NO | NO | NO | NO | NO | NO | NO |
| TJU_CMC_MD2.ID01020.5p-miR | TJU_CMC_MD2.ID01020.hairpin | YES | YES | NO | YES | NO | NO | NO | NO |
| TJU_CMC_MD2.ID01021.3p-miR | TJU_CMC_MD2.ID01021.hairpin | YES | NO | NO | NO | NO | NO | NO | NO |
| TJU_CMC_MD2.ID01022.5p-miR | TJU_CMC_MD2.ID01022.hairpin | YES | YES | NO | NO | NO | NO | NO | NO |
| TJU_CMC_MD2.ID01023.3p-miR | TJU_CMC_MD2.ID01023.hairpin | YES | NO | NO | NO | NO | NO | NO | NO |
| TJU_CMC_MD2.ID01023.5p-miR | TJU_CMC_MD2.ID01023.hairpin | YES | NO | YES | NO | YES | NO | NO | NO |
| TJU_CMC_MD2.ID01024.5p-miR | TJU_CMC_MD2.ID01024.hairpin | YES | YES | YES | YES | YES | NO | NO | NO |
| TJU_CMC_MD2.ID01025.3p-miR | TJU_CMC_MD2.ID01025.hairpin | YES | NO | YES | NO | NO | NO | NO | NO |
| TJU_CMC_MD2.ID01025.5p-miR | TJU_CMC_MD2.ID01025.hairpin | YES | NO | YES | NO | NO | NO | NO | NO |
| TJU_CMC_MD2.ID01026.3p-miR | TJU_CMC_MD2.ID01026.hairpin | YES | NO | NO | NO | NO | NO | NO | NO |
| TJU_CMC_MD2.ID01027.5p-miR | TJU_CMC_MD2.ID01027.hairpin | YES | NO | YES | NO | NO | NO | NO | NO |
| TJU_CMC_MD2.ID01028.3p-miR | TJU_CMC_MD2.ID01028.hairpin | YES | NO | NO | NO | NO | NO | NO | NO |
| TJU_CMC_MD2.ID01028.5p-miR | TJU_CMC_MD2.ID01028.hairpin | YES | NO | YES | NO | YES | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01029.5p-miR | TJU_CMC_MD2.ID01029.hairpin | YES | NO | NO | YES | NO | NO | NO | NO |
| TJU_CMC_MD2.ID01030.3p-miR | TJU_CMC_MD2.ID01030.hairpin | YES | NO | NO | NO | NO | NO | NO | NO |
| TJU_CMC_MD2.ID01031.5p-miR | TJU_CMC_MD2.ID01031.hairpin | YES | YES | YES | NO | NO | NO | NO | NO |
| TJU_CMC_MD2.ID01032.3p-miR | TJU_CMC_MD2.ID01032.hairpin | YES | NO | NO | NO | NO | NO | NO | NO |
| TJU_CMC_MD2.ID01033.5p-miR | TJU_CMC_MD2.ID01033.hairpin | YES | YES | YES | YES | NO | YES | NO | NO |
| TJU_CMC_MD2.ID01034.5p-miR | TJU_CMC_MD2.ID01034.hairpin | YES | NO | YES | NO | NO | YES | NO | NO |
| TJU_CMC_MD2.ID01035.3p-miR | TJU_CMC_MD2.ID01035.hairpin | YES | NO | NO | NO | NO | NO | NO | NO |
| TJU_CMC_MD2.ID01036.3p-miR | TJU_CMC_MD2.ID01036.hairpin | YES | NO | NO | NO | NO | NO | NO | NO |
| TJU_CMC_MD2.ID01037.5p-miR | TJU_CMC_MD2.ID01037.hairpin | YES | NO | YES | NO | NO | NO | NO | NO |
| TJU_CMC_MD2.ID01038.3p-miR | TJU_CMC_MD2.ID01038.hairpin | YES | NO | YES | NO | YES | NO | NO | NO |
| TJU_CMC_MD2.ID01038.5p-miR | TJU_CMC_MD2.ID01038.hairpin | YES | NO | YES | NO | YES | NO | NO | NO |
| TJU_CMC_MD2.ID01039.5p-miR | TJU_CMC_MD2.ID01039.hairpin | YES | YES | NO | NO | NO | NO | NO | NO |
| TJU_CMC_MD2.ID01040.5p-miR | TJU_CMC_MD2.ID01040.hairpin | YES | YES | YES | YES | NO | NO | NO | NO |
| TJU_CMC_MD2.ID01041.5p-miR | TJU_CMC_MD2.ID01041.hairpin | YES | NO | NO | NO | NO | NO | NO | NO |
| TJU_CMC_MD2.ID01042.5p-miR | TJU_CMC_MD2.ID01042.hairpin | YES | NO | NO | NO | NO | NO | NO | NO |
| TJU_CMC_MD2.ID01043.5p-miR | TJU_CMC_MD2.ID01043.hairpin | YES | YES | NO | YES | YES | YES | NO | NO |
| TJU_CMC_MD2.ID01044.5p-miR | TJU_CMC_MD2.ID01044.hairpin | YES | NO | NO | NO | NO | NO | NO | NO |
| TJU_CMC_MD2.ID01045.5p-miR | TJU_CMC_MD2.ID01045.hairpin | YES | YES | YES | YES | YES | NO | NO | NO |
| TJU_CMC_MD2.ID01046.3p-miR | TJU_CMC_MD2.ID01046.hairpin | YES | NO | NO | NO | NO | NO | NO | NO |
| TJU_CMC_MD2.ID01046.5p-miR | TJU_CMC_MD2.ID01046.hairpin | YES | YES | YES | YES | YES | NO | NO | NO |
| TJU_CMC_MD2.ID01047.3p-miR | TJU_CMC_MD2.ID01047.hairpin | YES | NO | NO | NO | NO | NO | NO | NO |
| TJU_CMC_MD2.ID01048.5p-miR | TJU_CMC_MD2.ID01048.hairpin | YES | NO | YES | NO | NO | NO | NO | NO |
| TJU_CMC_MD2.ID01049.5p-miR | TJU_CMC_MD2.ID01049.hairpin | YES | YES | YES | YES | YES | NO | NO | NO |
| TJU_CMC_MD2.ID01050.3p-miR | TJU_CMC_MD2.ID01050.hairpin | YES | YES | YES | YES | YES | NO | NO | NO |
| TJU_CMC_MD2.ID01051.5p-miR | TJU_CMC_MD2.ID01051.hairpin | YES | NO | YES | NO | NO | NO | NO | NO |
| TJU_CMC_MD2.ID01052.3p-miR | TJU_CMC_MD2.ID01052.hairpin | YES | NO | NO | NO | NO | NO | NO | NO |
| TJU_CMC_MD2.ID01053.3p-miR | TJU_CMC_MD2.ID01053.hairpin | YES | NO | NO | NO | NO | NO | NO | NO |
| TJU_CMC_MD2.ID01054.5p-miR | TJU_CMC_MD2.ID01054.hairpin | YES | YES | YES | YES | YES | NO | NO | NO |
| TJU_CMC_MD2.ID01055.3p-miR | TJU_CMC_MD2.ID01055.hairpin | YES | NO | NO | NO | NO | NO | NO | NO |
| TJU_CMC_MD2.ID01056.5p-miR | TJU_CMC_MD2.ID01056.hairpin | YES | YES | YES | NO | YES | NO | NO | NO |
| TJU_CMC_MD2.ID01057.5p-miR | TJU_CMC_MD2.ID01057.hairpin | YES | NO | YES | YES | YES | NO | NO | NO |
| TJU_CMC_MD2.ID01058.5p-miR | TJU_CMC_MD2.ID01058.hairpin | YES | YES | YES | YES | NO | NO | NO | NO |
| TJU_CMC_MD2.ID01059.3p-miR | TJU_CMC_MD2.ID01059.hairpin | YES | NO | NO | NO | NO | NO | NO | NO |
| TJU_CMC_MD2.ID01060.3p-miR | TJU_CMC_MD2.ID01060.hairpin | YES | NO | NO | NO | NO | NO | NO | NO |
| TJU_CMC_MD2.ID01061.5p-miR | TJU_CMC_MD2.ID01061.hairpin | YES | YES | YES | YES | YES | YES | NO | NO |
| TJU_CMC_MD2.ID01062.3p-miR | TJU_CMC_MD2.ID01062.hairpin | YES | NO | NO | NO | NO | NO | NO | NO |
| TJU_CMC_MD2.ID01063.5p-miR | TJU_CMC_MD2.ID01063.hairpin | YES | YES | YES | YES | YES | NO | NO | NO |
| TJU_CMC_MD2.ID01064.5p-miR | TJU_CMC_MD2.ID01064.hairpin | YES | YES | YES | YES | YES | NO | NO | NO |
| TJU_CMC_MD2.ID01065.5p-miR | TJU_CMC_MD2.ID01065.hairpin | YES | YES | NO | NO | NO | NO | NO | NO |
| TJU_CMC_MD2.ID01066.3p-miR | TJU_CMC_MD2.ID01066.hairpin | YES | NO | NO | NO | NO | NO | NO | NO |
| TJU_CMC_MD2.ID01067.5p-miR | TJU_CMC_MD2.ID01067.hairpin | YES | YES | NO | NO | NO | NO | NO | NO |
| TJU_CMC_MD2.ID01068.3p-miR | TJU_CMC_MD2.ID01068.hairpin | YES | NO | NO | NO | NO | NO | NO | NO |
| TJU_CMC_MD2.ID01069.3p-miR | TJU_CMC_MD2.ID01069.hairpin | YES | NO | NO | NO | NO | NO | NO | NO |
| TJU_CMC_MD2.ID01070.3p-miR | TJU_CMC_MD2.ID01070.hairpin | YES | NO | NO | NO | NO | NO | NO | NO |
| TJU_CMC_MD2.ID01071.5p-miR | TJU_CMC_MD2.ID01071.hairpin | YES | NO | NO | YES | NO | NO | NO | NO |
| TJU_CMC_MD2.ID01072.5p-miR | TJU_CMC_MD2.ID01072.hairpin | YES | YES | NO | NO | NO | NO | NO | NO |
| TJU_CMC_MD2.ID01073.3p-miR | TJU_CMC_MD2.ID01073.hairpin | YES | NO | NO | NO | NO | NO | NO | NO |
| TJU_CMC_MD2.ID01074.3p-miR | TJU_CMC_MD2.ID01074.hairpin | YES | NO | NO | NO | NO | NO | NO | NO |
| TJU_CMC_MD2.ID01075.3p-miR | TJU_CMC_MD2.ID01075.hairpin | YES | NO | NO | NO | NO | NO | NO | NO |
| TJU_CMC_MD2.ID01076.5p-miR | TJU_CMC_MD2.ID01076.hairpin | YES | YES | YES | YES | NO | NO | NO | NO |
| TJU_CMC_MD2.ID01077.3p-miR | TJU_CMC_MD2.ID01077.hairpin | YES | NO | NO | NO | NO | NO | NO | NO |
| TJU_CMC_MD2.ID01078.3p-miR | TJU_CMC_MD2.ID01078.hairpin | YES | NO | NO | NO | NO | NO | NO | NO |
| TJU_CMC_MD2.ID01079.5p-miR | TJU_CMC_MD2.ID01079.hairpin | YES | NO | NO | YES | NO | NO | NO | NO |
| TJU_CMC_MD2.ID01080.3p-miR | TJU_CMC_MD2.ID01080.hairpin | YES | NO | NO | NO | NO | NO | NO | NO |
| TJU_CMC_MD2.ID01081.3p-miR | TJU_CMC_MD2.ID01081.hairpin | YES | NO | NO | NO | NO | NO | NO | NO |
| TJU_CMC_MD2.ID01082.3p-miR | TJU_CMC_MD2.ID01082.hairpin | YES | NO | NO | NO | NO | NO | NO | NO |
| TJU_CMC_MD2.ID01083.3p-miR | TJU_CMC_MD2.ID01083.hairpin | YES | NO | NO | NO | NO | NO | NO | NO |
| TJU_CMC_MD2.ID01084.3p-miR | TJU_CMC_MD2.ID01084.hairpin | YES | NO | NO | NO | NO | NO | NO | NO |
| TJU_CMC_MD2.ID01085.3p-miR | TJU_CMC_MD2.ID01085.hairpin | YES | NO | NO | NO | NO | NO | NO | NO |
| TJU_CMC_MD2.ID01086.3p-miR | TJU_CMC_MD2.ID01086.hairpin | YES | NO | NO | NO | NO | NO | NO | NO |
| TJU_CMC_MD2.ID01087.3p-miR | TJU_CMC_MD2.ID01087.hairpin | YES | NO | NO | NO | NO | NO | NO | NO |
| TJU_CMC_MD2.ID01088.3p-miR | TJU_CMC_MD2.ID01088.hairpin | YES | NO | NO | NO | NO | NO | NO | NO |
| TJU_CMC_MD2.ID01089.3p-miR | TJU_CMC_MD2.ID01089.hairpin | YES | NO | NO | NO | NO | NO | NO | NO |
| TJU_CMC_MD2.ID01090.3p-miR | TJU_CMC_MD2.ID01090.hairpin | YES | NO | NO | NO | NO | NO | NO | NO |
| TJU_CMC_MD2.ID01091.3p-miR | TJU_CMC_MD2.ID01091.hairpin | YES | NO | NO | NO | NO | NO | NO | NO |
| TJU_CMC_MD2.ID01092.5p-miR | TJU_CMC_MD2.ID01092.hairpin | YES | NO | YES | YES | NO | NO | NO | NO |
| TJU_CMC_MD2.ID01093.5p-miR | TJU_CMC_MD2.ID01093.hairpin | YES | YES | NO | YES | NO | NO | NO | NO |
| TJU_CMC_MD2.ID01094.3p-miR | TJU_CMC_MD2.ID01094.hairpin | YES | NO | NO | NO | NO | NO | NO | NO |
| TJU_CMC_MD2.ID01095.5p-miR | TJU_CMC_MD2.ID01095.hairpin | YES | YES | YES | YES | YES | NO | NO | NO |
| TJU_CMC_MD2.ID01096.3p-miR | TJU_CMC_MD2.ID01096.hairpin | YES | NO | NO | NO | NO | NO | NO | NO |
| TJU_CMC_MD2.ID01097.3p-miR | TJU_CMC_MD2.ID01097.hairpin | YES | NO | NO | NO | NO | NO | NO | NO |
| TJU_CMC_MD2.ID01098.3p-miR | TJU_CMC_MD2.ID01098.hairpin | YES | NO | NO | NO | NO | NO | NO | NO |
| TJU_CMC_MD2.ID01099.5p-miR | TJU_CMC_MD2.ID01099.hairpin | YES | YES | NO | NO | NO | NO | NO | NO |
| TJU_CMC_MD2.ID01100.5p-miR | TJU_CMC_MD2.ID01100.hairpin | YES | YES | YES | NO | YES | NO | NO | NO |
| TJU_CMC_MD2.ID01101.3p-miR | TJU_CMC_MD2.ID01101.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01102.5p-miR | TJU_CMC_MD2.ID01102.hairpin | YES | YES | YES | YES | YES | YES | NO | NO |
| TJU_CMC_MD2.ID01103.3p-miR | TJU_CMC_MD2.ID01103.hairpin | YES | NO | NO | NO | NO | NO | NO | NO |
| TJU_CMC_MD2.ID01104.3p-miR | TJU_CMC_MD2.ID01104.hairpin | YES | NO | NO | NO | NO | NO | NO | NO |
| TJU_CMC_MD2.ID01104.5p-miR | TJU_CMC_MD2.ID01104.hairpin | YES | YES | YES | YES | YES | NO | NO | NO |
| TJU_CMC_MD2.ID01105.5p-miR | TJU_CMC_MD2.ID01105.hairpin | YES | YES | YES | YES | YES | YES | NO | NO |
| TJU_CMC_MD2.ID01106.5p-miR | TJU_CMC_MD2.ID01106.hairpin | YES | YES | YES | YES | NO | NO | NO | NO |
| TJU_CMC_MD2.ID01107.3p-miR | TJU_CMC_MD2.ID01107.hairpin | YES | NO | NO | NO | NO | NO | NO | NO |
| TJU_CMC_MD2.ID01108.3p-miR | TJU_CMC_MD2.ID01108.hairpin | YES | NO | NO | NO | NO | NO | NO | NO |
| TJU_CMC_MD2.ID01109.5p-miR | TJU_CMC_MD2.ID01109.hairpin | YES | YES | YES | NO | YES | NO | NO | NO |
| TJU_CMC_MD2.ID01110.3p-miR | TJU_CMC_MD2.ID01110.hairpin | YES | NO | NO | NO | NO | NO | NO | NO |
| TJU_CMC_MD2.ID01111.3p-miR | TJU_CMC_MD2.ID01111.hairpin | YES | NO | NO | NO | NO | NO | NO | NO |
| TJU_CMC_MD2.ID01112.3p-miR | TJU_CMC_MD2.ID01112.hairpin | YES | NO | NO | NO | NO | NO | NO | NO |
| TJU_CMC_MD2.ID01113.3p-miR | TJU_CMC_MD2.ID01113.hairpin | YES | NO | NO | NO | NO | NO | NO | NO |
| TJU_CMC_MD2.ID01114.3p-miR | TJU_CMC_MD2.ID01114.hairpin | YES | NO | NO | NO | NO | NO | NO | NO |
| TJU_CMC_MD2.ID01115.3p-miR | TJU_CMC_MD2.ID01115.hairpin | YES | NO | NO | NO | NO | NO | NO | NO |
| TJU_CMC_MD2.ID01116.3p-miR | TJU_CMC_MD2.ID01116.hairpin | YES | NO | NO | NO | NO | NO | NO | NO |
| TJU_CMC_MD2.ID01117.5p-miR | TJU_CMC_MD2.ID01117.hairpin | YES | YES | NO | NO | NO | NO | NO | NO |
| TJU_CMC_MD2.ID01118.3p-miR | TJU_CMC_MD2.ID01118.hairpin | YES | NO | NO | NO | NO | NO | NO | NO |
| TJU_CMC_MD2.ID01119.3p-miR | TJU_CMC_MD2.ID01119.hairpin | YES | NO | NO | NO | NO | NO | NO | NO |
| TJU_CMC_MD2.ID01120.5p-miR | TJU_CMC_MD2.ID01120.hairpin | YES | NO | YES | YES | NO | NO | NO | NO |
| TJU_CMC_MD2.ID01121.5p-miR | TJU_CMC_MD2.ID01121.hairpin | YES | YES | NO | YES | NO | NO | NO | NO |
| TJU_CMC_MD2.ID01122.5p-miR | TJU_CMC_MD2.ID01122.hairpin | YES | YES | YES | YES | NO | NO | NO | NO |
| TJU_CMC_MD2.ID01123.3p-miR | TJU_CMC_MD2.ID01123.hairpin | YES | NO | NO | NO | NO | NO | NO | NO |
| TJU_CMC_MD2.ID01124.3p-miR | TJU_CMC_MD2.ID01124.hairpin | YES | NO | NO | NO | NO | NO | NO | NO |
| TJU_CMC_MD2.ID01125.3p-miR | TJU_CMC_MD2.ID01125.hairpin | YES | NO | NO | NO | NO | NO | NO | NO |
| TJU_CMC_MD2.ID01126.3p-miR | TJU_CMC_MD2.ID01126.hairpin | YES | NO | NO | NO | NO | NO | NO | NO |
| TJU_CMC_MD2.ID01127.3p-miR | TJU_CMC_MD2.ID01127.hairpin | YES | NO | NO | NO | NO | NO | NO | NO |
| TJU_CMC_MD2.ID01128.5p-miR | TJU_CMC_MD2.ID01128.hairpin | YES | YES | YES | YES | NO | NO | NO | NO |
| TJU_CMC_MD2.ID01129.5p-miR | TJU_CMC_MD2.ID01129.hairpin | YES | YES | YES | YES | NO | NO | NO | NO |
| TJU_CMC_MD2.ID01130.5p-miR | TJU_CMC_MD2.ID01130.hairpin | YES | YES | YES | YES | NO | NO | NO | NO |
| TJU_CMC_MD2.ID01131.5p-miR | TJU_CMC_MD2.ID01131.hairpin | YES | YES | YES | YES | YES | NO | NO | NO |
| TJU_CMC_MD2.ID01132.3p-miR | TJU_CMC_MD2.ID01132.hairpin | YES | NO | NO | NO | NO | NO | NO | NO |
| TJU_CMC_MD2.ID01133.3p-miR | TJU_CMC_MD2.ID01133.hairpin | YES | NO | NO | NO | NO | NO | NO | NO |
| TJU_CMC_MD2.ID01134.3p-miR | TJU_CMC_MD2.ID01134.hairpin | YES | NO | NO | NO | NO | NO | NO | NO |
| TJU_CMC_MD2.ID01135.5p-miR | TJU_CMC_MD2.ID01135.hairpin | YES | YES | YES | YES | YES | NO | NO | NO |
| TJU_CMC_MD2.ID01136.3p-miR | TJU_CMC_MD2.ID01136.hairpin | YES | NO | NO | NO | NO | NO | NO | NO |
| TJU_CMC_MD2.ID01137.5p-miR | TJU_CMC_MD2.ID01137.hairpin | YES | NO | NO | YES | YES | NO | NO | NO |
| TJU_CMC_MD2.ID01138.3p-miR | TJU_CMC_MD2.ID01138.hairpin | YES | NO | NO | NO | NO | NO | NO | NO |
| TJU_CMC_MD2.ID01139.3p-miR | TJU_CMC_MD2.ID01139.hairpin | YES | NO | NO | NO | NO | NO | NO | NO |
| TJU_CMC_MD2.ID01140.3p-miR | TJU_CMC_MD2.ID01140.hairpin | YES | NO | NO | NO | NO | NO | NO | NO |
| TJU_CMC_MD2.ID01141.5p-miR | TJU_CMC_MD2.ID01141.hairpin | YES | YES | NO | NO | YES | NO | NO | NO |
| TJU_CMC_MD2.ID01142.3p-miR | TJU_CMC_MD2.ID01142.hairpin | YES | NO | NO | NO | NO | NO | NO | NO |
| TJU_CMC_MD2.ID01143.3p-miR | TJU_CMC_MD2.ID01143.hairpin | YES | NO | NO | NO | NO | NO | NO | NO |
| TJU_CMC_MD2.ID01144.3p-miR | TJU_CMC_MD2.ID01144.hairpin | YES | NO | NO | NO | NO | NO | NO | NO |
| TJU_CMC_MD2.ID01145.3p-miR | TJU_CMC_MD2.ID01145.hairpin | YES | NO | NO | NO | NO | NO | NO | NO |
| TJU_CMC_MD2.ID01145.5p-miR | TJU_CMC_MD2.ID01145.hairpin | YES | YES | YES | YES | YES | NO | NO | NO |
| TJU_CMC_MD2.ID01146.5p-miR | TJU_CMC_MD2.ID01146.hairpin | YES | YES | NO | YES | NO | YES | NO | NO |
| TJU_CMC_MD2.ID01147.3p-miR | TJU_CMC_MD2.ID01147.hairpin | YES | NO | NO | NO | NO | NO | NO | NO |
| TJU_CMC_MD2.ID01148.5p-miR | TJU_CMC_MD2.ID01148.hairpin | YES | YES | NO | YES | YES | NO | NO | NO |
| TJU_CMC_MD2.ID01149.3p-miR | TJU_CMC_MD2.ID01149.hairpin | YES | NO | NO | NO | NO | NO | NO | NO |
| TJU_CMC_MD2.ID01150.3p-miR | TJU_CMC_MD2.ID01150.hairpin | YES | YES | NO | YES | NO | NO | NO | NO |
| TJU_CMC_MD2.ID01151.3p-miR | TJU_CMC_MD2.ID01151.hairpin | YES | NO | NO | NO | NO | NO | NO | NO |
| TJU_CMC_MD2.ID01152.3p-miR | TJU_CMC_MD2.ID01152.hairpin | YES | NO | NO | NO | NO | NO | NO | NO |
| TJU_CMC_MD2.ID01153.3p-miR | TJU_CMC_MD2.ID01153.hairpin | YES | NO | NO | NO | NO | NO | NO | NO |
| TJU_CMC_MD2.ID01154.5p-miR | TJU_CMC_MD2.ID01154.hairpin | YES | NO | YES | NO | NO | NO | NO | NO |
| TJU_CMC_MD2.ID01155.5p-miR | TJU_CMC_MD2.ID01155.hairpin | YES | NO | YES | NO | NO | NO | NO | NO |
| TJU_CMC_MD2.ID01156.3p-miR | TJU_CMC_MD2.ID01156.hairpin | YES | NO | NO | NO | NO | NO | NO | NO |
| TJU_CMC_MD2.ID01157.5p-miR | TJU_CMC_MD2.ID01157.hairpin | YES | YES | NO | NO | NO | YES | NO | NO |
| TJU_CMC_MD2.ID01158.3p-miR | TJU_CMC_MD2.ID01158.hairpin | YES | NO | NO | NO | NO | NO | NO | NO |
| TJU_CMC_MD2.ID01159.5p-miR | TJU_CMC_MD2.ID01159.hairpin | YES | NO | NO | NO | NO | YES | NO | NO |
| TJU_CMC_MD2.ID01160.3p-miR | TJU_CMC_MD2.ID01160.hairpin | YES | NO | NO | NO | NO | NO | NO | NO |
| TJU_CMC_MD2.ID01161.5p-miR | TJU_CMC_MD2.ID01161.hairpin | YES | YES | YES | YES | YES | NO | NO | NO |
| TJU_CMC_MD2.ID01162.3p-miR | TJU_CMC_MD2.ID01162.hairpin | YES | NO | NO | NO | NO | NO | NO | NO |
| TJU_CMC_MD2.ID01163.3p-miR | TJU_CMC_MD2.ID01163.hairpin | YES | NO | NO | NO | NO | NO | NO | NO |
| TJU_CMC_MD2.ID01164.3p-miR | TJU_CMC_MD2.ID01164.hairpin | YES | NO | NO | NO | NO | NO | NO | NO |
| TJU_CMC_MD2.ID01165.3p-miR | TJU_CMC_MD2.ID01165.hairpin | YES | NO | NO | NO | NO | NO | NO | NO |
| TJU_CMC_MD2.ID01166.3p-miR | TJU_CMC_MD2.ID01166.hairpin | YES | NO | NO | NO | NO | NO | NO | NO |
| TJU_CMC_MD2.ID01167.3p-miR | TJU_CMC_MD2.ID01167.hairpin | YES | YES | YES | YES | YES | NO | NO | NO |
| TJU_CMC_MD2.ID01167.5p-miR | TJU_CMC_MD2.ID01167.hairpin | YES | YES | YES | YES | YES | NO | NO | NO |
| TJU_CMC_MD2.ID01168.5p-miR | TJU_CMC_MD2.ID01168.hairpin | YES | NO | NO | NO | NO | NO | NO | NO |
| TJU_CMC_MD2.ID01169.5p-miR | TJU_CMC_MD2.ID01169.hairpin | YES | YES | YES | YES | YES | NO | NO | NO |
| TJU_CMC_MD2.ID01170.3p-miR | TJU_CMC_MD2.ID01170.hairpin | YES | NO | NO | NO | NO | NO | NO | NO |
| TJU_CMC_MD2.ID01171.3p-miR | TJU_CMC_MD2.ID01171.hairpin | YES | NO | NO | NO | NO | NO | NO | NO |
| TJU_CMC_MD2.ID01172.3p-miR | TJU_CMC_MD2.ID01172.hairpin | YES | NO | NO | NO | NO | NO | NO | NO |
| TJU_CMC_MD2.ID01173.3p-miR | TJU_CMC_MD2.ID01173.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01174.5p-miR | TJU_CMC_MD2.ID01174.hairpin | YES | YES | YES | YES | NO | NO | NO | NO |
| TJU_CMC_MD2.ID01175.3p-miR | TJU_CMC_MD2.ID01175.hairpin | YES | NO | NO | NO | NO | NO | NO | NO |
| TJU_CMC_MD2.ID01176.5p-miR | TJU_CMC_MD2.ID01176.hairpin | YES | YES | NO | YES | NO | NO | NO | NO |
| TJU_CMC_MD2.ID01177.5p-miR | TJU_CMC_MD2.ID01177.hairpin | YES | YES | NO | YES | NO | NO | NO | NO |
| TJU_CMC_MD2.ID01178.5p-miR | TJU_CMC_MD2.ID01178.hairpin | YES | YES | YES | YES | NO | NO | NO | NO |
| TJU_CMC_MD2.ID01179.3p-miR | TJU_CMC_MD2.ID01179.hairpin | YES | NO | NO | NO | NO | NO | NO | NO |
| TJU_CMC_MD2.ID01180.3p-miR | TJU_CMC_MD2.ID01180.hairpin | YES | NO | NO | NO | NO | NO | NO | NO |
| TJU_CMC_MD2.ID01181.3p-miR | TJU_CMC_MD2.ID01181.hairpin | YES | NO | NO | NO | NO | NO | NO | NO |
| TJU_CMC_MD2.ID01181.5p-miR | TJU_CMC_MD2.ID01181.hairpin | YES | YES | YES | YES | NO | NO | NO | NO |
| TJU_CMC_MD2.ID01182.5p-miR | TJU_CMC_MD2.ID01182.hairpin | YES | YES | YES | YES | NO | NO | NO | NO |
| TJU_CMC_MD2.ID01183.3p-miR | TJU_CMC_MD2.ID01183.hairpin | YES | NO | NO | NO | NO | NO | NO | NO |
| TJU_CMC_MD2.ID01184.3p-miR | TJU_CMC_MD2.ID01184.hairpin | YES | NO | NO | NO | NO | NO | NO | NO |
| TJU_CMC_MD2.ID01185.3p-miR | TJU_CMC_MD2.ID01185.hairpin | YES | NO | YES | NO | NO | NO | NO | NO |
| TJU_CMC_MD2.ID01186.3p-miR | TJU_CMC_MD2.ID01186.hairpin | YES | NO | NO | NO | NO | NO | NO | NO |
| TJU_CMC_MD2.ID01187.3p-miR | TJU_CMC_MD2.ID01187.hairpin | YES | NO | NO | NO | NO | NO | NO | NO |
| TJU_CMC_MD2.ID01188.3p-miR | TJU_CMC_MD2.ID01188.hairpin | YES | NO | NO | NO | NO | NO | NO | NO |
| TJU_CMC_MD2.ID01188.5p-miR | TJU_CMC_MD2.ID01188.hairpin | YES | YES | NO | NO | NO | NO | NO | NO |
| TJU_CMC_MD2.ID01189.5p-miR | TJU_CMC_MD2.ID01189.hairpin | YES | NO | NO | NO | NO | NO | NO | NO |
| TJU_CMC_MD2.ID01190.5p-miR | TJU_CMC_MD2.ID01190.hairpin | YES | NO | NO | NO | NO | NO | NO | NO |
| TJU_CMC_MD2.ID01191.5p-miR | TJU_CMC_MD2.ID01191.hairpin | YES | YES | YES | YES | NO | NO | NO | NO |
| TJU_CMC_MD2.ID01192.5p-miR | TJU_CMC_MD2.ID01192.hairpin | YES | YES | YES | YES | YES | NO | NO | NO |
| TJU_CMC_MD2.ID01193.3p-miR | TJU_CMC_MD2.ID01193.hairpin | YES | NO | NO | NO | NO | NO | NO | NO |
| TJU_CMC_MD2.ID01194.3p-miR | TJU_CMC_MD2.ID01194.hairpin | YES | NO | NO | NO | NO | NO | NO | NO |
| TJU_CMC_MD2.ID01194.5p-miR | TJU_CMC_MD2.ID01194.hairpin | YES | NO | NO | YES | NO | NO | NO | NO |
| TJU_CMC_MD2.ID01195.3p-miR | TJU_CMC_MD2.ID01195.hairpin | YES | NO | NO | NO | NO | NO | NO | NO |
| TJU_CMC_MD2.ID01196.3p-miR | TJU_CMC_MD2.ID01196.hairpin | YES | NO | NO | NO | NO | NO | NO | NO |
| TJU_CMC_MD2.ID01197.3p-miR | TJU_CMC_MD2.ID01197.hairpin | YES | NO | NO | NO | NO | NO | NO | NO |
| TJU_CMC_MD2.ID01198.3p-miR | TJU_CMC_MD2.ID01198.hairpin | YES | NO | NO | NO | NO | NO | NO | NO |
| TJU_CMC_MD2.ID01198.5p-miR | TJU_CMC_MD2.ID01198.hairpin | YES | YES | YES | NO | NO | NO | NO | NO |
| TJU_CMC_MD2.ID01199.5p-miR | TJU_CMC_MD2.ID01199.hairpin | YES | NO | NO | YES | NO | NO | NO | NO |
| TJU_CMC_MD2.ID01200.3p-miR | TJU_CMC_MD2.ID01200.hairpin | YES | NO | NO | NO | NO | NO | NO | NO |
| TJU_CMC_MD2.ID01201.5p-miR | TJU_CMC_MD2.ID01201.hairpin | YES | NO | NO | NO | NO | NO | NO | NO |
| TJU_CMC_MD2.ID01202.5p-miR | TJU_CMC_MD2.ID01202.hairpin | YES | YES | NO | NO | NO | NO | NO | NO |
| TJU_CMC_MD2.ID01203.3p-miR | TJU_CMC_MD2.ID01203.hairpin | YES | NO | NO | NO | NO | NO | NO | NO |
| TJU_CMC_MD2.ID01204.3p-miR | TJU_CMC_MD2.ID01204.hairpin | YES | NO | NO | NO | NO | NO | NO | NO |
| TJU_CMC_MD2.ID01205.5p-miR | TJU_CMC_MD2.ID01205.hairpin | YES | YES | YES | YES | YES | NO | NO | NO |
| TJU_CMC_MD2.ID01206.3p-miR | TJU_CMC_MD2.ID01206.hairpin | YES | NO | NO | NO | NO | NO | NO | NO |
| TJU_CMC_MD2.ID01207.3p-miR | TJU_CMC_MD2.ID01207.hairpin | YES | NO | NO | NO | NO | NO | NO | NO |
| TJU_CMC_MD2.ID01208.3p-miR | TJU_CMC_MD2.ID01208.hairpin | YES | NO | NO | NO | NO | NO | NO | NO |
| TJU_CMC_MD2.ID01208.5p-miR | TJU_CMC_MD2.ID01208.hairpin | YES | YES | NO | NO | NO | NO | NO | NO |
| TJU_CMC_MD2.ID01209.3p-miR | TJU_CMC_MD2.ID01209.hairpin | YES | NO | NO | NO | NO | NO | NO | NO |
| TJU_CMC_MD2.ID01210.3p-miR | TJU_CMC_MD2.ID01210.hairpin | YES | NO | NO | NO | NO | NO | NO | NO |
| TJU_CMC_MD2.ID01211.3p-miR | TJU_CMC_MD2.ID01211.hairpin | YES | NO | NO | NO | NO | NO | NO | NO |
| TJU_CMC_MD2.ID01212.5p-miR | TJU_CMC_MD2.ID01212.hairpin | YES | YES | YES | YES | YES | NO | NO | NO |
| TJU_CMC_MD2.ID01213.5p-miR | TJU_CMC_MD2.ID01213.hairpin | YES | YES | YES | YES | NO | NO | NO | NO |
| TJU_CMC_MD2.ID01214.5p-miR | TJU_CMC_MD2.ID01214.hairpin | YES | YES | YES | NO | NO | NO | NO | NO |
| TJU_CMC_MD2.ID01215.5p-miR | TJU_CMC_MD2.ID01215.hairpin | YES | YES | YES | YES | NO | NO | NO | NO |
| TJU_CMC_MD2.ID01216.3p-miR | TJU_CMC_MD2.ID01216.hairpin | YES | NO | NO | NO | NO | NO | NO | NO |
| TJU_CMC_MD2.ID01217.5p-miR | TJU_CMC_MD2.ID01217.hairpin | YES | YES | NO | NO | NO | NO | NO | NO |
| TJU_CMC_MD2.ID01218.3p-miR | TJU_CMC_MD2.ID01218.hairpin | YES | NO | NO | NO | NO | NO | NO | NO |
| TJU_CMC_MD2.ID01219.3p-miR | TJU_CMC_MD2.ID01219.hairpin | YES | NO | NO | NO | NO | NO | NO | NO |
| TJU_CMC_MD2.ID01220.5p-miR | TJU_CMC_MD2.ID01220.hairpin | YES | YES | YES | NO | YES | NO | NO | NO |
| TJU_CMC_MD2.ID01221.3p-miR | TJU_CMC_MD2.ID01221.hairpin | YES | NO | NO | NO | NO | NO | NO | NO |
| TJU_CMC_MD2.ID01222.3p-miR | TJU_CMC_MD2.ID01222.hairpin | YES | NO | NO | NO | NO | NO | NO | NO |
| TJU_CMC_MD2.ID01223.5p-miR | TJU_CMC_MD2.ID01223.hairpin | YES | NO | NO | NO | NO | NO | NO | NO |
| TJU_CMC_MD2.ID01224.5p-miR | TJU_CMC_MD2.ID01224.hairpin | YES | NO | NO | NO | NO | NO | NO | NO |
| TJU_CMC_MD2.ID01225.3p-miR | TJU_CMC_MD2.ID01225.hairpin | YES | NO | NO | NO | NO | NO | NO | NO |
| TJU_CMC_MD2.ID01226.5p-miR | TJU_CMC_MD2.ID01226.hairpin | YES | YES | YES | YES | NO | NO | NO | NO |
| TJU_CMC_MD2.ID01227.5p-miR | TJU_CMC_MD2.ID01227.hairpin | YES | YES | YES | YES | NO | NO | NO | NO |
| TJU_CMC_MD2.ID01228.3p-miR | TJU_CMC_MD2.ID01228.hairpin | YES | NO | NO | NO | NO | NO | NO | NO |
| TJU_CMC_MD2.ID01229.3p-miR | TJU_CMC_MD2.ID01229.hairpin | YES | NO | NO | NO | NO | NO | NO | NO |
| TJU_CMC_MD2.ID01230.3p-miR | TJU_CMC_MD2.ID01230.hairpin | YES | NO | NO | NO | NO | NO | NO | NO |
| TJU_CMC_MD2.ID01231.3p-miR | TJU_CMC_MD2.ID01231.hairpin | YES | NO | NO | NO | NO | NO | NO | NO |
| TJU_CMC_MD2.ID01232.3p-miR | TJU_CMC_MD2.ID01232.hairpin | YES | NO | NO | NO | NO | NO | NO | NO |
| TJU_CMC_MD2.ID01233.3p-miR | TJU_CMC_MD2.ID01233.hairpin | YES | NO | NO | NO | NO | NO | NO | NO |
| TJU_CMC_MD2.ID01234.3p-miR | TJU_CMC_MD2.ID01234.hairpin | YES | NO | NO | NO | NO | NO | NO | NO |
| TJU_CMC_MD2.ID01235.3p-miR | TJU_CMC_MD2.ID01235.hairpin | YES | NO | NO | NO | NO | NO | NO | NO |
| TJU_CMC_MD2.ID01236.5p-miR | TJU_CMC_MD2.ID01236.hairpin | YES | NO | YES | NO | NO | NO | NO | NO |
| TJU_CMC_MD2.ID01237.3p-miR | TJU_CMC_MD2.ID01237.hairpin | YES | NO | NO | NO | NO | NO | NO | NO |
| TJU_CMC_MD2.ID01238.5p-miR | TJU_CMC_MD2.ID01238.hairpin | YES | YES | YES | YES | NO | NO | NO | NO |
| TJU_CMC_MD2.ID01239.3p-miR | TJU_CMC_MD2.ID01239.hairpin | YES | NO | NO | NO | NO | NO | NO | NO |
| TJU_CMC_MD2.ID01240.5p-miR | TJU_CMC_MD2.ID01240.hairpin | YES | YES | YES | NO | NO | NO | NO | NO |
| TJU_CMC_MD2.ID01241.3p-miR | TJU_CMC_MD2.ID01241.hairpin | YES | NO | NO | NO | NO | NO | NO | NO |
| TJU_CMC_MD2.ID01242.3p-miR | TJU_CMC_MD2.ID01242.hairpin | YES | NO | NO | NO | NO | NO | NO | NO |
| TJU_CMC_MD2.ID01243.3p-miR | TJU_CMC_MD2.ID01243.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01244.3p-miR | TJU_CMC_MD2.ID01244.hairpin | YES | NO | NO | NO | NO | NO | NO | NO |
| TJU_CMC_MD2.ID01245.3p-miR | TJU_CMC_MD2.ID01245.hairpin | YES | NO | NO | NO | NO | NO | NO | NO |
| TJU_CMC_MD2.ID01246.3p-miR | TJU_CMC_MD2.ID01246.hairpin | YES | NO | NO | NO | NO | NO | NO | NO |
| TJU_CMC_MD2.ID01247.3p-miR | TJU_CMC_MD2.ID01247.hairpin | YES | NO | NO | NO | NO | NO | NO | NO |
| TJU_CMC_MD2.ID01248.3p-miR | TJU_CMC_MD2.ID01248.hairpin | YES | NO | NO | NO | NO | NO | NO | NO |
| TJU_CMC_MD2.ID01249.5p-miR | TJU_CMC_MD2.ID01249.hairpin | YES | YES | YES | YES | YES | YES | NO | NO |
| TJU_CMC_MD2.ID01250.3p-miR | TJU_CMC_MD2.ID01250.hairpin | YES | YES | YES | YES | YES | NO | NO | NO |
| TJU_CMC_MD2.ID01250.5p-miR | TJU_CMC_MD2.ID01250.hairpin | YES | NO | YES | NO | NO | NO | NO | NO |
| TJU_CMC_MD2.ID01251.3p-miR | TJU_CMC_MD2.ID01251.hairpin | YES | NO | NO | NO | NO | NO | NO | NO |
| TJU_CMC_MD2.ID01252.3p-miR | TJU_CMC_MD2.ID01252.hairpin | YES | NO | NO | NO | NO | NO | NO | NO |
| TJU_CMC_MD2.ID01253.3p-miR | TJU_CMC_MD2.ID01253.hairpin | YES | NO | NO | NO | NO | NO | NO | NO |
| TJU_CMC_MD2.ID01254.5p-miR | TJU_CMC_MD2.ID01254.hairpin | YES | YES | YES | NO | NO | NO | NO | NO |
| TJU_CMC_MD2.ID01255.5p-miR | TJU_CMC_MD2.ID01255.hairpin | YES | YES | NO | NO | NO | NO | NO | NO |
| TJU_CMC_MD2.ID01256.3p-miR | TJU_CMC_MD2.ID01256.hairpin | YES | NO | NO | NO | NO | NO | NO | NO |
| TJU_CMC_MD2.ID01257.3p-miR | TJU_CMC_MD2.ID01257.hairpin | YES | NO | NO | NO | NO | NO | NO | NO |
| TJU_CMC_MD2.ID01258.3p-miR | TJU_CMC_MD2.ID01258.hairpin | YES | NO | NO | NO | NO | NO | NO | NO |
| TJU_CMC_MD2.ID01259.3p-miR | TJU_CMC_MD2.ID01259.hairpin | YES | NO | NO | NO | NO | NO | NO | NO |
| TJU_CMC_MD2.ID01260.3p-miR | TJU_CMC_MD2.ID01260.hairpin | YES | NO | NO | NO | NO | NO | NO | NO |
| TJU_CMC_MD2.ID01261.5p-miR | TJU_CMC_MD2.ID01261.hairpin | YES | YES | YES | YES | YES | NO | NO | NO |
| TJU_CMC_MD2.ID01262.3p-miR | TJU_CMC_MD2.ID01262.hairpin | YES | NO | NO | NO | NO | NO | NO | NO |
| TJU_CMC_MD2.ID01263.5p-miR | TJU_CMC_MD2.ID01263.hairpin | YES | NO | YES | YES | NO | NO | NO | NO |
| TJU_CMC_MD2.ID01264.3p-miR | TJU_CMC_MD2.ID01264.hairpin | YES | NO | NO | NO | NO | NO | NO | NO |
| TJU_CMC_MD2.ID01265.3p-miR | TJU_CMC_MD2.ID01265.hairpin | YES | NO | NO | NO | NO | NO | NO | NO |
| TJU_CMC_MD2.ID01266.3p-miR | TJU_CMC_MD2.ID01266.hairpin | YES | NO | NO | NO | NO | NO | NO | NO |
| TJU_CMC_MD2.ID01267.3p-miR | TJU_CMC_MD2.ID01267.hairpin | YES | NO | NO | NO | NO | NO | NO | NO |
| TJU_CMC_MD2.ID01268.3p-miR | TJU_CMC_MD2.ID01268.hairpin | YES | NO | NO | NO | NO | NO | NO | NO |
| TJU_CMC_MD2.ID01269.3p-miR | TJU_CMC_MD2.ID01269.hairpin | YES | NO | NO | NO | NO | NO | NO | NO |
| TJU_CMC_MD2.ID01270.3p-miR | TJU_CMC_MD2.ID01270.hairpin | YES | NO | NO | NO | NO | NO | NO | NO |
| TJU_CMC_MD2.ID01271.3p-miR | TJU_CMC_MD2.ID01271.hairpin | YES | NO | NO | NO | NO | NO | NO | NO |
| TJU_CMC_MD2.ID01272.3p-miR | TJU_CMC_MD2.ID01272.hairpin | YES | NO | NO | NO | NO | NO | NO | NO |
| TJU_CMC_MD2.ID01273.3p-miR | TJU_CMC_MD2.ID01273.hairpin | YES | NO | NO | NO | NO | NO | NO | NO |
| TJU_CMC_MD2.ID01273.5p-miR | TJU_CMC_MD2.ID01273.hairpin | YES | NO | YES | NO | NO | NO | NO | NO |
| TJU_CMC_MD2.ID01274.5p-miR | TJU_CMC_MD2.ID01274.hairpin | YES | NO | YES | YES | NO | NO | NO | NO |
| TJU_CMC_MD2.ID01275.5p-miR | TJU_CMC_MD2.ID01275.hairpin | YES | NO | YES | YES | NO | NO | NO | NO |
| TJU_CMC_MD2.ID01276.5p-miR | TJU_CMC_MD2.ID01276.hairpin | YES | YES | YES | NO | NO | NO | NO | NO |
| TJU_CMC_MD2.ID01277.5p-miR | TJU_CMC_MD2.ID01277.hairpin | YES | YES | YES | YES | NO | NO | NO | NO |
| TJU_CMC_MD2.ID01278.3p-miR | TJU_CMC_MD2.ID01278.hairpin | YES | NO | YES | NO | NO | YES | NO | NO |
| TJU_CMC_MD2.ID01278.5p-miR | TJU_CMC_MD2.ID01278.hairpin | YES | NO | YES | NO | NO | YES | NO | NO |
| TJU_CMC_MD2.ID01279.5p-miR | TJU_CMC_MD2.ID01279.hairpin | YES | YES | YES | YES | NO | NO | NO | NO |
| TJU_CMC_MD2.ID01280.3p-miR | TJU_CMC_MD2.ID01280.hairpin | YES | NO | NO | NO | NO | NO | NO | NO |
| TJU_CMC_MD2.ID01281.3p-miR | TJU_CMC_MD2.ID01281.hairpin | YES | NO | NO | NO | NO | NO | NO | NO |
| TJU_CMC_MD2.ID01282.3p-miR | TJU_CMC_MD2.ID01282.hairpin | YES | NO | NO | NO | NO | NO | NO | NO |
| TJU_CMC_MD2.ID01283.3p-miR | TJU_CMC_MD2.ID01283.hairpin | YES | NO | NO | NO | NO | NO | NO | NO |
| TJU_CMC_MD2.ID01284.3p-miR | TJU_CMC_MD2.ID01284.hairpin | YES | NO | NO | NO | NO | NO | NO | NO |
| TJU_CMC_MD2.ID01285.3p-miR | TJU_CMC_MD2.ID01285.hairpin | YES | NO | NO | NO | NO | NO | NO | NO |
| TJU_CMC_MD2.ID01286.3p-miR | TJU_CMC_MD2.ID01286.hairpin | YES | NO | NO | NO | NO | NO | NO | NO |
| TJU_CMC_MD2.ID01287.5p-miR | TJU_CMC_MD2.ID01287.hairpin | YES | NO | NO | NO | NO | NO | NO | NO |
| TJU_CMC_MD2.ID01288.3p-miR | TJU_CMC_MD2.ID01288.hairpin | YES | NO | NO | NO | NO | NO | NO | NO |
| TJU_CMC_MD2.ID01289.5p-miR | TJU_CMC_MD2.ID01289.hairpin | YES | YES | YES | YES | YES | NO | NO | NO |
| TJU_CMC_MD2.ID01290.3p-miR | TJU_CMC_MD2.ID01290.hairpin | YES | NO | NO | NO | NO | NO | NO | NO |
| TJU_CMC_MD2.ID01291.3p-miR | TJU_CMC_MD2.ID01291.hairpin | YES | YES | YES | YES | NO | NO | NO | NO |
| TJU_CMC_MD2.ID01292.5p-miR | TJU_CMC_MD2.ID01292.hairpin | YES | YES | NO | YES | NO | NO | NO | NO |
| TJU_CMC_MD2.ID01293.5p-miR | TJU_CMC_MD2.ID01293.hairpin | YES | NO | YES | NO | NO | NO | NO | NO |
| TJU_CMC_MD2.ID01294.3p-miR | TJU_CMC_MD2.ID01294.hairpin | YES | NO | NO | NO | NO | NO | NO | NO |
| TJU_CMC_MD2.ID01295.3p-miR | TJU_CMC_MD2.ID01295.hairpin | YES | NO | NO | NO | NO | NO | NO | NO |
| TJU_CMC_MD2.ID01296.5p-miR | TJU_CMC_MD2.ID01296.hairpin | YES | YES | YES | NO | YES | NO | NO | NO |
| TJU_CMC_MD2.ID01297.5p-miR | TJU_CMC_MD2.ID01297.hairpin | YES | YES | YES | NO | NO | NO | NO | NO |
| TJU_CMC_MD2.ID01298.5p-miR | TJU_CMC_MD2.ID01298.hairpin | YES | NO | YES | NO | YES | YES | NO | NO |
| TJU_CMC_MD2.ID01299.3p-miR | TJU_CMC_MD2.ID01299.hairpin | YES | NO | NO | NO | NO | NO | NO | NO |
| TJU_CMC_MD2.ID01300.3p-miR | TJU_CMC_MD2.ID01300.hairpin | YES | NO | NO | NO | NO | NO | NO | NO |
| TJU_CMC_MD2.ID01301.3p-miR | TJU_CMC_MD2.ID01301.hairpin | YES | NO | NO | NO | NO | NO | NO | NO |
| TJU_CMC_MD2.ID01302.5p-miR | TJU_CMC_MD2.ID01302.hairpin | YES | YES | YES | YES | YES | NO | NO | NO |
| TJU_CMC_MD2.ID01303.5p-miR | TJU_CMC_MD2.ID01303.hairpin | YES | YES | YES | YES | YES | NO | NO | NO |
| TJU_CMC_MD2.ID01304.5p-miR | TJU_CMC_MD2.ID01304.hairpin | YES | YES | YES | YES | NO | NO | NO | NO |
| TJU_CMC_MD2.ID01305.3p-miR | TJU_CMC_MD2.ID01305.hairpin | YES | NO | NO | NO | NO | NO | NO | NO |
| TJU_CMC_MD2.ID01306.5p-miR | TJU_CMC_MD2.ID01306.hairpin | YES | YES | YES | YES | YES | NO | NO | NO |
| TJU_CMC_MD2.ID01307.3p-miR | TJU_CMC_MD2.ID01307.hairpin | YES | NO | NO | NO | NO | NO | NO | NO |
| TJU_CMC_MD2.ID01308.3p-miR | TJU_CMC_MD2.ID01308.hairpin | YES | NO | NO | NO | NO | NO | NO | NO |
| TJU_CMC_MD2.ID01309.3p-miR | TJU_CMC_MD2.ID01309.hairpin | YES | NO | NO | NO | NO | NO | NO | NO |
| TJU_CMC_MD2.ID01310.3p-miR | TJU_CMC_MD2.ID01310.hairpin | YES | NO | NO | NO | NO | NO | NO | NO |
| TJU_CMC_MD2.ID01310.5p-miR | TJU_CMC_MD2.ID01310.hairpin | YES | NO | NO | NO | NO | YES | NO | NO |
| TJU_CMC_MD2.ID01311.3p-miR | TJU_CMC_MD2.ID01311.hairpin | YES | NO | NO | NO | NO | NO | NO | NO |
| TJU_CMC_MD2.ID01312.5p-miR | TJU_CMC_MD2.ID01312.hairpin | YES | YES | YES | YES | YES | NO | NO | NO |
| TJU_CMC_MD2.ID01313.3p-miR | TJU_CMC_MD2.ID01313.hairpin | YES | NO | NO | NO | NO | NO | NO | NO |
| TJU_CMC_MD2.ID01314.5p-miR | TJU_CMC_MD2.ID01314.hairpin | YES | YES | YES | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01315.3p-miR | TJU_CMC_MD2.ID01315.hairpin | YES | NO | NO | NO | NO | NO | NO | NO |
| TJU_CMC_MD2.ID01316.5p-miR | TJU_CMC_MD2.ID01316.hairpin | YES | YES | YES | YES | NO | YES | NO | NO |
| TJU_CMC_MD2.ID01317.5p-miR | TJU_CMC_MD2.ID01317.hairpin | YES | YES | NO | NO | YES | NO | NO | NO |
| TJU_CMC_MD2.ID01318.3p-miR | TJU_CMC_MD2.ID01318.hairpin | YES | YES | NO | YES | NO | NO | NO | NO |
| TJU_CMC_MD2.ID01319.5p-miR | TJU_CMC_MD2.ID01319.hairpin | YES | NO | NO | NO | NO | NO | NO | NO |
| TJU_CMC_MD2.ID01320.3p-miR | TJU_CMC_MD2.ID01320.hairpin | YES | NO | NO | NO | NO | NO | NO | NO |
| TJU_CMC_MD2.ID01321.5p-miR | TJU_CMC_MD2.ID01321.hairpin | YES | NO | NO | YES | NO | NO | NO | NO |
| TJU_CMC_MD2.ID01322.3p-miR | TJU_CMC_MD2.ID01322.hairpin | YES | NO | NO | NO | NO | NO | NO | NO |
| TJU_CMC_MD2.ID01322.5p-miR | TJU_CMC_MD2.ID01322.hairpin | YES | NO | YES | YES | NO | NO | NO | NO |
| TJU_CMC_MD2.ID01323.3p-miR | TJU_CMC_MD2.ID01323.hairpin | YES | NO | NO | NO | NO | NO | NO | NO |
| TJU_CMC_MD2.ID01324.5p-miR | TJU_CMC_MD2.ID01324.hairpin | YES | NO | NO | YES | NO | YES | NO | NO |
| TJU_CMC_MD2.ID01325.3p-miR | TJU_CMC_MD2.ID01325.hairpin | YES | NO | NO | NO | NO | NO | NO | NO |
| TJU_CMC_MD2.ID01326.3p-miR | TJU_CMC_MD2.ID01326.hairpin | YES | YES | YES | YES | NO | NO | NO | NO |
| TJU_CMC_MD2.ID01326.5p-miR | TJU_CMC_MD2.ID01326.hairpin | YES | YES | YES | YES | YES | NO | NO | NO |
| TJU_CMC_MD2.ID01327.3p-miR | TJU_CMC_MD2.ID01327.hairpin | YES | NO | NO | NO | NO | NO | NO | NO |
| TJU_CMC_MD2.ID01328.3p-miR | TJU_CMC_MD2.ID01328.hairpin | YES | NO | NO | NO | NO | NO | NO | NO |
| TJU_CMC_MD2.ID01329.3p-miR | TJU_CMC_MD2.ID01329.hairpin | YES | NO | NO | NO | NO | NO | NO | NO |
| TJU_CMC_MD2.ID01330.3p-miR | TJU_CMC_MD2.ID01330.hairpin | YES | NO | NO | NO | NO | NO | NO | NO |
| TJU_CMC_MD2.ID01331.3p-miR | TJU_CMC_MD2.ID01331.hairpin | YES | NO | NO | NO | NO | NO | NO | NO |
| TJU_CMC_MD2.ID01332.3p-miR | TJU_CMC_MD2.ID01332.hairpin | YES | NO | NO | NO | NO | NO | NO | NO |
| TJU_CMC_MD2.ID01333.3p-miR | TJU_CMC_MD2.ID01333.hairpin | YES | NO | NO | NO | NO | NO | NO | NO |
| TJU_CMC_MD2.ID01334.3p-miR | TJU_CMC_MD2.ID01334.hairpin | YES | NO | NO | NO | NO | NO | NO | NO |
| TJU_CMC_MD2.ID01334.5p-miR | TJU_CMC_MD2.ID01334.hairpin | YES | NO | NO | NO | NO | NO | NO | NO |
| TJU_CMC_MD2.ID01335.3p-miR | TJU_CMC_MD2.ID01335.hairpin | YES | NO | NO | NO | NO | NO | NO | NO |
| TJU_CMC_MD2.ID01336.3p-miR | TJU_CMC_MD2.ID01336.hairpin | YES | NO | NO | NO | NO | NO | NO | NO |
| TJU_CMC_MD2.ID01337.3p-miR | TJU_CMC_MD2.ID01337.hairpin | YES | NO | NO | NO | NO | NO | NO | NO |
| TJU_CMC_MD2.ID01338.5p-miR | TJU_CMC_MD2.ID01338.hairpin | YES | NO | YES | YES | NO | NO | NO | NO |
| TJU_CMC_MD2.ID01339.3p-miR | TJU_CMC_MD2.ID01339.hairpin | YES | YES | NO | NO | NO | NO | NO | NO |
| TJU_CMC_MD2.ID01340.5p-miR | TJU_CMC_MD2.ID01340.hairpin | YES | NO | YES | YES | NO | NO | NO | NO |
| TJU_CMC_MD2.ID01341.5p-miR | TJU_CMC_MD2.ID01341.hairpin | YES | YES | YES | NO | NO | NO | NO | NO |
| TJU_CMC_MD2.ID01342.5p-miR | TJU_CMC_MD2.ID01342.hairpin | YES | YES | YES | NO | NO | NO | NO | NO |
| TJU_CMC_MD2.ID01343.5p-miR | TJU_CMC_MD2.ID01343.hairpin | YES | YES | YES | NO | YES | NO | NO | NO |
| TJU_CMC_MD2.ID01344.3p-miR | TJU_CMC_MD2.ID01344.hairpin | YES | NO | NO | NO | NO | NO | NO | NO |
| TJU_CMC_MD2.ID01345.3p-miR | TJU_CMC_MD2.ID01345.hairpin | YES | NO | NO | NO | NO | NO | NO | NO |
| TJU_CMC_MD2.ID01346.3p-miR | TJU_CMC_MD2.ID01346.hairpin | YES | NO | NO | NO | NO | NO | NO | NO |
| TJU_CMC_MD2.ID01347.3p-miR | TJU_CMC_MD2.ID01347.hairpin | YES | NO | NO | NO | NO | NO | NO | NO |
| TJU_CMC_MD2.ID01348.3p-miR | TJU_CMC_MD2.ID01348.hairpin | YES | NO | NO | NO | NO | NO | NO | NO |
| TJU_CMC_MD2.ID01349.3p-miR | TJU_CMC_MD2.ID01349.hairpin | YES | NO | YES | NO | NO | NO | NO | NO |
| TJU_CMC_MD2.ID01349.5p-miR | TJU_CMC_MD2.ID01349.hairpin | YES | YES | YES | NO | NO | NO | NO | NO |
| TJU_CMC_MD2.ID01350.3p-miR | TJU_CMC_MD2.ID01350.hairpin | YES | YES | YES | NO | YES | NO | NO | NO |
| TJU_CMC_MD2.ID01351.3p-miR | TJU_CMC_MD2.ID01351.hairpin | YES | NO | NO | NO | NO | NO | NO | NO |
| TJU_CMC_MD2.ID01351.5p-miR | TJU_CMC_MD2.ID01351.hairpin | YES | NO | YES | NO | NO | NO | NO | NO |
| TJU_CMC_MD2.ID01352.3p-miR | TJU_CMC_MD2.ID01352.hairpin | YES | NO | NO | NO | NO | NO | NO | NO |
| TJU_CMC_MD2.ID01353.3p-miR | TJU_CMC_MD2.ID01353.hairpin | YES | NO | NO | NO | NO | NO | NO | NO |
| TJU_CMC_MD2.ID01354.3p-miR | TJU_CMC_MD2.ID01354.hairpin | YES | NO | NO | NO | NO | NO | NO | NO |
| TJU_CMC_MD2.ID01355.3p-miR | TJU_CMC_MD2.ID01355.hairpin | YES | NO | NO | NO | NO | NO | NO | NO |
| TJU_CMC_MD2.ID01356.3p-miR | TJU_CMC_MD2.ID01356.hairpin | YES | NO | NO | NO | NO | NO | NO | NO |
| TJU_CMC_MD2.ID01357.5p-miR | TJU_CMC_MD2.ID01357.hairpin | YES | YES | YES | YES | NO | NO | NO | NO |
| TJU_CMC_MD2.ID01358.5p-miR | TJU_CMC_MD2.ID01358.hairpin | YES | YES | YES | NO | NO | YES | NO | NO |
| TJU_CMC_MD2.ID01359.5p-miR | TJU_CMC_MD2.ID01359.hairpin | YES | NO | YES | YES | YES | NO | NO | NO |
| TJU_CMC_MD2.ID01360.3p-miR | TJU_CMC_MD2.ID01360.hairpin | YES | NO | NO | NO | NO | NO | NO | NO |
| TJU_CMC_MD2.ID01361.5p-miR | TJU_CMC_MD2.ID01361.hairpin | YES | NO | NO | YES | NO | NO | NO | NO |
| TJU_CMC_MD2.ID01362.5p-miR | TJU_CMC_MD2.ID01362.hairpin | YES | YES | YES | YES | YES | NO | NO | NO |
| TJU_CMC_MD2.ID01363.3p-miR | TJU_CMC_MD2.ID01363.hairpin | YES | NO | NO | NO | NO | NO | NO | NO |
| TJU_CMC_MD2.ID01364.3p-miR | TJU_CMC_MD2.ID01364.hairpin | YES | NO | NO | NO | NO | NO | NO | NO |
| TJU_CMC_MD2.ID01365.3p-miR | TJU_CMC_MD2.ID01365.hairpin | YES | NO | NO | NO | NO | NO | NO | NO |
| TJU_CMC_MD2.ID01366.5p-miR | TJU_CMC_MD2.ID01366.hairpin | YES | YES | NO | NO | NO | NO | NO | NO |
| TJU_CMC_MD2.ID01367.5p-miR | TJU_CMC_MD2.ID01367.hairpin | YES | YES | NO | NO | NO | NO | NO | NO |
| TJU_CMC_MD2.ID01368.3p-miR | TJU_CMC_MD2.ID01368.hairpin | YES | YES | YES | NO | YES | NO | NO | NO |
| TJU_CMC_MD2.ID01369.3p-miR | TJU_CMC_MD2.ID01369.hairpin | YES | NO | NO | NO | NO | NO | NO | NO |
| TJU_CMC_MD2.ID01370.5p-miR | TJU_CMC_MD2.ID01370.hairpin | YES | YES | YES | YES | NO | NO | NO | NO |
| TJU_CMC_MD2.ID01371.3p-miR | TJU_CMC_MD2.ID01371.hairpin | YES | NO | NO | NO | NO | NO | NO | NO |
| TJU_CMC_MD2.ID01371.5p-miR | TJU_CMC_MD2.ID01371.hairpin | YES | NO | NO | NO | NO | YES | NO | NO |
| TJU_CMC_MD2.ID01372.3p-miR | TJU_CMC_MD2.ID01372.hairpin | YES | NO | NO | NO | NO | NO | NO | NO |
| TJU_CMC_MD2.ID01373.3p-miR | TJU_CMC_MD2.ID01373.hairpin | YES | NO | NO | NO | NO | NO | NO | NO |
| TJU_CMC_MD2.ID01374.3p-miR | TJU_CMC_MD2.ID01374.hairpin | YES | NO | NO | NO | NO | NO | NO | NO |
| TJU_CMC_MD2.ID01375.5p-miR | TJU_CMC_MD2.ID01375.hairpin | YES | YES | NO | NO | YES | NO | NO | NO |
| TJU_CMC_MD2.ID01376.5p-miR | TJU_CMC_MD2.ID01376.hairpin | YES | YES | YES | YES | NO | NO | NO | NO |
| TJU_CMC_MD2.ID01377.3p-miR | TJU_CMC_MD2.ID01377.hairpin | YES | NO | NO | NO | NO | NO | NO | NO |
| TJU_CMC_MD2.ID01378.5p-miR | TJU_CMC_MD2.ID01378.hairpin | YES | YES | YES | YES | NO | NO | NO | NO |
| TJU_CMC_MD2.ID01379.3p-miR | TJU_CMC_MD2.ID01379.hairpin | YES | NO | NO | NO | NO | NO | NO | NO |
| TJU_CMC_MD2.ID01380.3p-miR | TJU_CMC_MD2.ID01380.hairpin | YES | NO | NO | NO | NO | NO | NO | NO |
| TJU_CMC_MD2.ID01381.3p-miR | TJU_CMC_MD2.ID01381.hairpin | YES | NO | NO | NO | NO | NO | NO | NO |
| TJU_CMC_MD2.ID01382.3p-miR | TJU_CMC_MD2.ID01382.hairpin | YES | NO | NO | NO | NO | NO | NO | NO |
| TJU_CMC_MD2.ID01383.3p-miR | TJU_CMC_MD2.ID01383.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01384.5p-miR | TJU_CMC_MD2.ID01384.hairpin | YES | YES | YES | NO | NO | NO | NO | NO |
| TJU_CMC_MD2.ID01385.5p-miR | TJU_CMC_MD2.ID01385.hairpin | YES | YES | NO | NO | NO | NO | NO | NO |
| TJU_CMC_MD2.ID01386.5p-miR | TJU_CMC_MD2.ID01386.hairpin | YES | NO | NO | YES | YES | NO | NO | NO |
| TJU_CMC_MD2.ID01387.3p-miR | TJU_CMC_MD2.ID01387.hairpin | YES | NO | NO | NO | NO | NO | NO | NO |
| TJU_CMC_MD2.ID01388.5p-miR | TJU_CMC_MD2.ID01388.hairpin | YES | NO | YES | NO | YES | NO | NO | NO |
| TJU_CMC_MD2.ID01389.5p-miR | TJU_CMC_MD2.ID01389.hairpin | YES | YES | NO | NO | YES | NO | NO | NO |
| TJU_CMC_MD2.ID01390.3p-miR | TJU_CMC_MD2.ID01390.hairpin | YES | NO | NO | NO | NO | NO | NO | NO |
| TJU_CMC_MD2.ID01391.3p-miR | TJU_CMC_MD2.ID01391.hairpin | YES | NO | NO | NO | NO | NO | NO | NO |
| TJU_CMC_MD2.ID01392.3p-miR | TJU_CMC_MD2.ID01392.hairpin | YES | NO | NO | NO | NO | NO | NO | NO |
| TJU_CMC_MD2.ID01393.3p-miR | TJU_CMC_MD2.ID01393.hairpin | YES | NO | NO | NO | NO | NO | NO | NO |
| TJU_CMC_MD2.ID01394.5p-miR | TJU_CMC_MD2.ID01394.hairpin | YES | YES | YES | YES | NO | NO | NO | NO |
| TJU_CMC_MD2.ID01395.5p-miR | TJU_CMC_MD2.ID01395.hairpin | YES | YES | YES | YES | YES | NO | NO | NO |
| TJU_CMC_MD2.ID01396.3p-miR | TJU_CMC_MD2.ID01396.hairpin | YES | NO | NO | NO | NO | NO | NO | NO |
| TJU_CMC_MD2.ID01397.5p-miR | TJU_CMC_MD2.ID01397.hairpin | YES | YES | YES | NO | NO | NO | NO | NO |
| TJU_CMC_MD2.ID01398.3p-miR | TJU_CMC_MD2.ID01398.hairpin | YES | NO | NO | NO | NO | NO | NO | NO |
| TJU_CMC_MD2.ID01399.3p-miR | TJU_CMC_MD2.ID01399.hairpin | YES | NO | NO | NO | NO | NO | NO | NO |
| TJU_CMC_MD2.ID01400.3p-miR | TJU_CMC_MD2.ID01400.hairpin | YES | NO | NO | NO | NO | NO | NO | NO |
| TJU_CMC_MD2.ID01401.3p-miR | TJU_CMC_MD2.ID01401.hairpin | YES | NO | NO | NO | NO | NO | NO | NO |
| TJU_CMC_MD2.ID01402.5p-miR | TJU_CMC_MD2.ID01402.hairpin | YES | YES | YES | YES | YES | NO | NO | NO |
| TJU_CMC_MD2.ID01403.5p-miR | TJU_CMC_MD2.ID01403.hairpin | YES | YES | YES | NO | NO | NO | NO | NO |
| TJU_CMC_MD2.ID01404.5p-miR | TJU_CMC_MD2.ID01404.hairpin | YES | YES | NO | YES | NO | NO | NO | NO |
| TJU_CMC_MD2.ID01405.5p-miR | TJU_CMC_MD2.ID01405.hairpin | YES | YES | YES | YES | NO | NO | NO | NO |
| TJU_CMC_MD2.ID01406.5p-miR | TJU_CMC_MD2.ID01406.hairpin | YES | YES | YES | NO | NO | NO | NO | NO |
| TJU_CMC_MD2.ID01407.3p-miR | TJU_CMC_MD2.ID01407.hairpin | YES | NO | NO | NO | NO | NO | NO | NO |
| TJU_CMC_MD2.ID01408.3p-miR | TJU_CMC_MD2.ID01408.hairpin | YES | NO | NO | NO | NO | NO | NO | NO |
| TJU_CMC_MD2.ID01408.5p-miR | TJU_CMC_MD2.ID01408.hairpin | YES | YES | YES | YES | YES | NO | NO | NO |
| TJU_CMC_MD2.ID01409.3p-miR | TJU_CMC_MD2.ID01409.hairpin | YES | NO | NO | NO | NO | NO | NO | NO |
| TJU_CMC_MD2.ID01410.5p-miR | TJU_CMC_MD2.ID01410.hairpin | YES | YES | YES | YES | NO | NO | NO | NO |
| TJU_CMC_MD2.ID01411.3p-miR | TJU_CMC_MD2.ID01411.hairpin | YES | NO | NO | NO | NO | NO | NO | NO |
| TJU_CMC_MD2.ID01412.5p-miR | TJU_CMC_MD2.ID01412.hairpin | YES | YES | YES | YES | YES | NO | NO | NO |
| TJU_CMC_MD2.ID01413.3p-miR | TJU_CMC_MD2.ID01413.hairpin | YES | NO | NO | NO | NO | NO | NO | NO |
| TJU_CMC_MD2.ID01414.3p-miR | TJU_CMC_MD2.ID01414.hairpin | YES | NO | NO | NO | NO | NO | NO | NO |
| TJU_CMC_MD2.ID01415.3p-miR | TJU_CMC_MD2.ID01415.hairpin | YES | NO | NO | NO | NO | NO | NO | NO |
| TJU_CMC_MD2.ID01415.5p-miR | TJU_CMC_MD2.ID01415.hairpin | YES | YES | YES | YES | NO | NO | NO | NO |
| TJU_CMC_MD2.ID01416.3p-miR | TJU_CMC_MD2.ID01416.hairpin | YES | NO | NO | NO | NO | NO | NO | NO |
| TJU_CMC_MD2.ID01417.3p-miR | TJU_CMC_MD2.ID01417.hairpin | YES | NO | NO | NO | NO | NO | NO | NO |
| TJU_CMC_MD2.ID01418.3p-miR | TJU_CMC_MD2.ID01418.hairpin | YES | NO | NO | NO | NO | NO | NO | NO |
| TJU_CMC_MD2.ID01419.3p-miR | TJU_CMC_MD2.ID01419.hairpin | YES | NO | NO | NO | NO | NO | NO | NO |
| TJU_CMC_MD2.ID01420.3p-miR | TJU_CMC_MD2.ID01420.hairpin | YES | NO | NO | NO | NO | NO | NO | NO |
| TJU_CMC_MD2.ID01421.3p-miR | TJU_CMC_MD2.ID01421.hairpin | YES | NO | NO | NO | NO | NO | NO | NO |
| TJU_CMC_MD2.ID01422.3p-miR | TJU_CMC_MD2.ID01422.hairpin | YES | NO | YES | NO | YES | NO | NO | NO |
| TJU_CMC_MD2.ID01423.3p-miR | TJU_CMC_MD2.ID01423.hairpin | YES | YES | YES | NO | NO | NO | NO | NO |
| TJU_CMC_MD2.ID01424.5p-miR | TJU_CMC_MD2.ID01424.hairpin | YES | YES | NO | NO | NO | YES | NO | NO |
| TJU_CMC_MD2.ID01425.3p-miR | TJU_CMC_MD2.ID01425.hairpin | YES | NO | NO | NO | NO | NO | NO | NO |
| TJU_CMC_MD2.ID01426.5p-miR | TJU_CMC_MD2.ID01426.hairpin | YES | YES | YES | YES | NO | NO | NO | NO |
| TJU_CMC_MD2.ID01427.3p-miR | TJU_CMC_MD2.ID01427.hairpin | YES | NO | NO | NO | NO | NO | NO | NO |
| TJU_CMC_MD2.ID01428.3p-miR | TJU_CMC_MD2.ID01428.hairpin | YES | NO | NO | NO | NO | NO | NO | NO |
| TJU_CMC_MD2.ID01429.5p-miR | TJU_CMC_MD2.ID01429.hairpin | YES | YES | YES | YES | YES | NO | NO | NO |
| TJU_CMC_MD2.ID01430.3p-miR | TJU_CMC_MD2.ID01430.hairpin | YES | NO | NO | NO | NO | NO | NO | NO |
| TJU_CMC_MD2.ID01431.3p-miR | TJU_CMC_MD2.ID01431.hairpin | YES | NO | NO | NO | NO | NO | NO | NO |
| TJU_CMC_MD2.ID01432.3p-miR | TJU_CMC_MD2.ID01432.hairpin | YES | NO | NO | NO | NO | NO | NO | NO |
| TJU_CMC_MD2.ID01433.5p-miR | TJU_CMC_MD2.ID01433.hairpin | YES | YES | NO | NO | YES | NO | NO | NO |
| TJU_CMC_MD2.ID01434.5p-miR | TJU_CMC_MD2.ID01434.hairpin | YES | YES | YES | NO | NO | NO | NO | NO |
| TJU_CMC_MD2.ID01435.3p-miR | TJU_CMC_MD2.ID01435.hairpin | YES | NO | NO | NO | NO | NO | NO | NO |
| TJU_CMC_MD2.ID01436.3p-miR | TJU_CMC_MD2.ID01436.hairpin | YES | YES | NO | NO | YES | NO | NO | NO |
| TJU_CMC_MD2.ID01436.5p-miR | TJU_CMC_MD2.ID01436.hairpin | YES | YES | NO | YES | YES | NO | NO | NO |
| TJU_CMC_MD2.ID01437.5p-miR | TJU_CMC_MD2.ID01437.hairpin | YES | NO | NO | NO | NO | NO | NO | NO |
| TJU_CMC_MD2.ID01438.3p-miR | TJU_CMC_MD2.ID01438.hairpin | YES | NO | NO | NO | NO | NO | NO | NO |
| TJU_CMC_MD2.ID01439.3p-miR | TJU_CMC_MD2.ID01439.hairpin | YES | NO | NO | NO | NO | NO | NO | NO |
| TJU_CMC_MD2.ID01440.3p-miR | TJU_CMC_MD2.ID01440.hairpin | YES | NO | NO | NO | NO | NO | NO | NO |
| TJU_CMC_MD2.ID01441.5p-miR | TJU_CMC_MD2.ID01441.hairpin | YES | YES | NO | YES | NO | NO | NO | NO |
| TJU_CMC_MD2.ID01442.3p-miR | TJU_CMC_MD2.ID01442.hairpin | YES | NO | NO | NO | NO | NO | NO | NO |
| TJU_CMC_MD2.ID01443.3p-miR | TJU_CMC_MD2.ID01443.hairpin | YES | NO | NO | NO | NO | NO | NO | NO |
| TJU_CMC_MD2.ID01444.5p-miR | TJU_CMC_MD2.ID01444.hairpin | YES | YES | YES | NO | YES | NO | NO | NO |
| TJU_CMC_MD2.ID01445.3p-miR | TJU_CMC_MD2.ID01445.hairpin | YES | NO | NO | NO | NO | NO | NO | NO |
| TJU_CMC_MD2.ID01446.5p-miR | TJU_CMC_MD2.ID01446.hairpin | YES | YES | YES | YES | YES | NO | NO | NO |
| TJU_CMC_MD2.ID01447.5p-miR | TJU_CMC_MD2.ID01447.hairpin | YES | YES | NO | YES | NO | NO | NO | NO |
| TJU_CMC_MD2.ID01448.5p-miR | TJU_CMC_MD2.ID01448.hairpin | YES | NO | YES | YES | NO | NO | NO | NO |
| TJU_CMC_MD2.ID01449.3p-miR | TJU_CMC_MD2.ID01449.hairpin | YES | NO | NO | NO | NO | NO | NO | NO |
| TJU_CMC_MD2.ID01450.5p-miR | TJU_CMC_MD2.ID01450.hairpin | YES | YES | YES | NO | YES | NO | NO | NO |
| TJU_CMC_MD2.ID01451.3p-miR | TJU_CMC_MD2.ID01451.hairpin | YES | NO | NO | NO | NO | NO | NO | NO |
| TJU_CMC_MD2.ID01452.3p-miR | TJU_CMC_MD2.ID01452.hairpin | YES | NO | NO | NO | NO | NO | NO | NO |
| TJU_CMC_MD2.ID01453.3p-miR | TJU_CMC_MD2.ID01453.hairpin | YES | NO | NO | NO | NO | NO | NO | NO |
| TJU_CMC_MD2.ID01454.3p-miR | TJU_CMC_MD2.ID01454.hairpin | YES | YES | NO | NO | NO | NO | NO | NO |
| TJU_CMC_MD2.ID01455.5p-miR | TJU_CMC_MD2.ID01455.hairpin | YES | YES | NO | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01456.3p-miR | TJU_CMC_MD2.ID01456.hairpin | YES | NO | NO | NO | NO | NO | NO | NO |
| TJU_CMC_MD2.ID01457.3p-miR | TJU_CMC_MD2.ID01457.hairpin | YES | NO | NO | NO | NO | NO | NO | NO |
| TJU_CMC_MD2.ID01458.5p-miR | TJU_CMC_MD2.ID01458.hairpin | YES | NO | NO | NO | NO | NO | NO | NO |
| TJU_CMC_MD2.ID01459.3p-miR | TJU_CMC_MD2.ID01459.hairpin | YES | NO | NO | NO | NO | NO | NO | NO |
| TJU_CMC_MD2.ID01460.3p-miR | TJU_CMC_MD2.ID01460.hairpin | YES | NO | NO | NO | NO | NO | NO | NO |
| TJU_CMC_MD2.ID01461.3p-miR | TJU_CMC_MD2.ID01461.hairpin | YES | NO | NO | NO | NO | NO | NO | NO |
| TJU_CMC_MD2.ID01462.3p-miR | TJU_CMC_MD2.ID01462.hairpin | YES | NO | NO | NO | NO | NO | NO | NO |
| TJU_CMC_MD2.ID01463.3p-miR | TJU_CMC_MD2.ID01463.hairpin | YES | NO | NO | NO | NO | NO | NO | NO |
| TJU_CMC_MD2.ID01464.5p-miR | TJU_CMC_MD2.ID01464.hairpin | YES | YES | YES | YES | NO | NO | NO | NO |
| TJU_CMC_MD2.ID01465.5p-miR | TJU_CMC_MD2.ID01465.hairpin | YES | YES | YES | YES | YES | NO | NO | NO |
| TJU_CMC_MD2.ID01466.3p-miR | TJU_CMC_MD2.ID01466.hairpin | YES | YES | YES | YES | YES | NO | NO | NO |
| TJU_CMC_MD2.ID01467.3p-miR | TJU_CMC_MD2.ID01467.hairpin | YES | NO | NO | NO | NO | NO | NO | NO |
| TJU_CMC_MD2.ID01468.3p-miR | TJU_CMC_MD2.ID01468.hairpin | YES | NO | NO | NO | NO | NO | NO | NO |
| TJU_CMC_MD2.ID01469.5p-miR | TJU_CMC_MD2.ID01469.hairpin | YES | NO | NO | NO | NO | NO | NO | NO |
| TJU_CMC_MD2.ID01470.3p-miR | TJU_CMC_MD2.ID01470.hairpin | YES | NO | NO | NO | NO | NO | NO | NO |
| TJU_CMC_MD2.ID01471.5p-miR | TJU_CMC_MD2.ID01471.hairpin | YES | NO | YES | YES | NO | NO | NO | NO |
| TJU_CMC_MD2.ID01472.3p-miR | TJU_CMC_MD2.ID01472.hairpin | YES | NO | NO | NO | NO | NO | NO | NO |
| TJU_CMC_MD2.ID01473.3p-miR | TJU_CMC_MD2.ID01473.hairpin | YES | NO | NO | NO | NO | NO | NO | NO |
| TJU_CMC_MD2.ID01474.3p-miR | TJU_CMC_MD2.ID01474.hairpin | YES | NO | NO | NO | NO | NO | NO | NO |
| TJU_CMC_MD2.ID01475.5p-miR | TJU_CMC_MD2.ID01475.hairpin | YES | NO | NO | YES | YES | NO | NO | NO |
| TJU_CMC_MD2.ID01476.3p-miR | TJU_CMC_MD2.ID01476.hairpin | YES | NO | NO | NO | NO | NO | NO | NO |
| TJU_CMC_MD2.ID01477.5p-miR | TJU_CMC_MD2.ID01477.hairpin | YES | YES | NO | YES | YES | NO | NO | NO |
| TJU_CMC_MD2.ID01478.3p-miR | TJU_CMC_MD2.ID01478.hairpin | YES | NO | NO | NO | NO | NO | NO | NO |
| TJU_CMC_MD2.ID01479.5p-miR | TJU_CMC_MD2.ID01479.hairpin | YES | YES | YES | NO | NO | NO | NO | NO |
| TJU_CMC_MD2.ID01480.5p-miR | TJU_CMC_MD2.ID01480.hairpin | YES | YES | YES | YES | NO | NO | NO | NO |
| TJU_CMC_MD2.ID01481.5p-miR | TJU_CMC_MD2.ID01481.hairpin | YES | YES | YES | NO | YES | NO | NO | NO |
| TJU_CMC_MD2.ID01482.5p-miR | TJU_CMC_MD2.ID01482.hairpin | YES | YES | NO | YES | NO | NO | NO | NO |
| TJU_CMC_MD2.ID01483.5p-miR | TJU_CMC_MD2.ID01483.hairpin | YES | YES | YES | NO | YES | YES | NO | NO |
| TJU_CMC_MD2.ID01484.3p-miR | TJU_CMC_MD2.ID01484.hairpin | YES | NO | NO | NO | NO | NO | NO | NO |
| TJU_CMC_MD2.ID01485.5p-miR | TJU_CMC_MD2.ID01485.hairpin | YES | YES | NO | YES | YES | NO | NO | NO |
| TJU_CMC_MD2.ID01486.3p-miR | TJU_CMC_MD2.ID01486.hairpin | YES | NO | NO | NO | NO | NO | NO | NO |
| TJU_CMC_MD2.ID01487.3p-miR | TJU_CMC_MD2.ID01487.hairpin | YES | NO | NO | NO | NO | NO | NO | NO |
| TJU_CMC_MD2.ID01488.5p-miR | TJU_CMC_MD2.ID01488.hairpin | YES | YES | YES | YES | YES | YES | NO | NO |
| TJU_CMC_MD2.ID01489.3p-miR | TJU_CMC_MD2.ID01489.hairpin | YES | NO | NO | NO | NO | NO | NO | NO |
| TJU_CMC_MD2.ID01490.3p-miR | TJU_CMC_MD2.ID01490.hairpin | YES | NO | NO | NO | NO | NO | NO | NO |
| TJU_CMC_MD2.ID01491.3p-miR | TJU_CMC_MD2.ID01491.hairpin | YES | NO | NO | NO | NO | NO | NO | NO |
| TJU_CMC_MD2.ID01492.3p-miR | TJU_CMC_MD2.ID01492.hairpin | YES | NO | NO | NO | NO | NO | NO | NO |
| TJU_CMC_MD2.ID01493.3p-miR | TJU_CMC_MD2.ID01493.hairpin | YES | NO | NO | NO | NO | NO | NO | NO |
| TJU_CMC_MD2.ID01494.5p-miR | TJU_CMC_MD2.ID01494.hairpin | YES | YES | YES | YES | NO | NO | NO | NO |
| TJU_CMC_MD2.ID01495.3p-miR | TJU_CMC_MD2.ID01495.hairpin | YES | NO | NO | NO | NO | NO | NO | NO |
| TJU_CMC_MD2.ID01496.3p-miR | TJU_CMC_MD2.ID01496.hairpin | YES | NO | NO | NO | NO | NO | NO | NO |
| TJU_CMC_MD2.ID01497.5p-miR | TJU_CMC_MD2.ID01497.hairpin | YES | NO | YES | NO | NO | NO | NO | NO |
| TJU_CMC_MD2.ID01498.3p-miR | TJU_CMC_MD2.ID01498.hairpin | YES | NO | NO | NO | NO | NO | NO | NO |
| TJU_CMC_MD2.ID01499.5p-miR | TJU_CMC_MD2.ID01499.hairpin | YES | YES | YES | NO | YES | NO | NO | NO |
| TJU_CMC_MD2.ID01500.3p-miR | TJU_CMC_MD2.ID01500.hairpin | YES | NO | NO | NO | NO | NO | NO | NO |
| TJU_CMC_MD2.ID01501.5p-miR | TJU_CMC_MD2.ID01501.hairpin | YES | YES | YES | NO | NO | NO | NO | NO |
| TJU_CMC_MD2.ID01502.3p-miR | TJU_CMC_MD2.ID01502.hairpin | YES | NO | NO | NO | NO | NO | NO | NO |
| TJU_CMC_MD2.ID01503.3p-miR | TJU_CMC_MD2.ID01503.hairpin | YES | NO | NO | NO | NO | NO | NO | NO |
| TJU_CMC_MD2.ID01504.3p-miR | TJU_CMC_MD2.ID01504.hairpin | YES | NO | NO | NO | NO | NO | NO | NO |
| TJU_CMC_MD2.ID01505.3p-miR | TJU_CMC_MD2.ID01505.hairpin | YES | NO | NO | NO | NO | NO | NO | NO |
| TJU_CMC_MD2.ID01505.5p-miR | TJU_CMC_MD2.ID01505.hairpin | YES | NO | NO | NO | NO | NO | NO | NO |
| TJU_CMC_MD2.ID01506.3p-miR | TJU_CMC_MD2.ID01506.hairpin | YES | NO | NO | NO | NO | NO | NO | NO |
| TJU_CMC_MD2.ID01507.3p-miR | TJU_CMC_MD2.ID01507.hairpin | YES | YES | YES | NO | YES | NO | NO | NO |
| TJU_CMC_MD2.ID01508.5p-miR | TJU_CMC_MD2.ID01508.hairpin | YES | NO | YES | NO | NO | NO | NO | NO |
| TJU_CMC_MD2.ID01509.3p-miR | TJU_CMC_MD2.ID01509.hairpin | YES | NO | NO | NO | NO | NO | NO | NO |
| TJU_CMC_MD2.ID01510.3p-miR | TJU_CMC_MD2.ID01510.hairpin | YES | NO | NO | NO | NO | NO | NO | NO |
| TJU_CMC_MD2.ID01511.5p-miR | TJU_CMC_MD2.ID01511.hairpin | YES | YES | YES | YES | NO | NO | NO | NO |
| TJU_CMC_MD2.ID01512.3p-miR | TJU_CMC_MD2.ID01512.hairpin | YES | NO | NO | NO | NO | NO | NO | NO |
| TJU_CMC_MD2.ID01513.5p-miR | TJU_CMC_MD2.ID01513.hairpin | YES | YES | YES | NO | NO | NO | NO | NO |
| TJU_CMC_MD2.ID01514.3p-miR | TJU_CMC_MD2.ID01514.hairpin | YES | YES | NO | NO | NO | NO | NO | NO |
| TJU_CMC_MD2.ID01515.3p-miR | TJU_CMC_MD2.ID01515.hairpin | YES | NO | NO | NO | NO | NO | NO | NO |
| TJU_CMC_MD2.ID01516.3p-miR | TJU_CMC_MD2.ID01516.hairpin | YES | NO | NO | NO | NO | NO | NO | NO |
| TJU_CMC_MD2.ID01517.3p-miR | TJU_CMC_MD2.ID01517.hairpin | YES | NO | NO | NO | NO | NO | NO | NO |
| TJU_CMC_MD2.ID01518.3p-miR | TJU_CMC_MD2.ID01518.hairpin | YES | NO | NO | NO | NO | NO | NO | NO |
| TJU_CMC_MD2.ID01519.5p-miR | TJU_CMC_MD2.ID01519.hairpin | YES | YES | YES | YES | NO | NO | NO | NO |
| TJU_CMC_MD2.ID01520.3p-miR | TJU_CMC_MD2.ID01520.hairpin | YES | NO | NO | NO | NO | NO | NO | NO |
| TJU_CMC_MD2.ID01521.3p-miR | TJU_CMC_MD2.ID01521.hairpin | YES | NO | NO | NO | NO | NO | NO | NO |
| TJU_CMC_MD2.ID01522.3p-miR | TJU_CMC_MD2.ID01522.hairpin | YES | NO | NO | NO | NO | NO | NO | NO |
| TJU_CMC_MD2.ID01523.3p-miR | TJU_CMC_MD2.ID01523.hairpin | YES | NO | NO | NO | NO | NO | NO | NO |
| TJU_CMC_MD2.ID01524.3p-miR | TJU_CMC_MD2.ID01524.hairpin | YES | NO | NO | NO | NO | NO | NO | NO |
| TJU_CMC_MD2.ID01525.3p-miR | TJU_CMC_MD2.ID01525.hairpin | YES | NO | NO | NO | NO | NO | NO | NO |
| TJU_CMC_MD2.ID01526.3p-miR | TJU_CMC_MD2.ID01526.hairpin | YES | NO | NO | NO | NO | NO | NO | NO |
| TJU_CMC_MD2.ID01527.3p-miR | TJU_CMC_MD2.ID01527.hairpin | YES | YES | YES | YES | NO | NO | NO | NO |
| TJU_CMC_MD2.ID01528.3p-miR | TJU_CMC_MD2.ID01528.hairpin | YES | NO | NO | NO | NO | NO | NO | NO |
| TJU_CMC_MD2.ID01529.5p-miR | TJU_CMC_MD2.ID01529.hairpin | YES | NO | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01530.5p-miR | TJU_CMC_MD2.ID01530.hairpin | YES | YES | YES | NO | NO | YES | NO | NO |
| TJU_CMC_MD2.ID01531.3p-miR | TJU_CMC_MD2.ID01531.hairpin | YES | NO | NO | NO | NO | NO | NO | NO |
| TJU_CMC_MD2.ID01532.3p-miR | TJU_CMC_MD2.ID01532.hairpin | YES | NO | NO | NO | NO | NO | NO | NO |
| TJU_CMC_MD2.ID01533.3p-miR | TJU_CMC_MD2.ID01533.hairpin | YES | NO | NO | NO | NO | NO | NO | NO |
| TJU_CMC_MD2.ID01534.3p-miR | TJU_CMC_MD2.ID01534.hairpin | YES | NO | NO | NO | NO | NO | NO | NO |
| TJU_CMC_MD2.ID01535.3p-miR | TJU_CMC_MD2.ID01535.hairpin | YES | NO | NO | NO | NO | NO | NO | NO |
| TJU_CMC_MD2.ID01536.3p-miR | TJU_CMC_MD2.ID01536.hairpin | YES | NO | NO | NO | NO | NO | NO | NO |
| TJU_CMC_MD2.ID01537.3p-miR | TJU_CMC_MD2.ID01537.hairpin | YES | NO | NO | NO | NO | NO | NO | NO |
| TJU_CMC_MD2.ID01538.3p-miR | TJU_CMC_MD2.ID01538.hairpin | YES | NO | NO | NO | NO | NO | NO | NO |
| TJU_CMC_MD2.ID01539.3p-miR | TJU_CMC_MD2.ID01539.hairpin | YES | NO | NO | NO | NO | NO | NO | NO |
| TJU_CMC_MD2.ID01540.3p-miR | TJU_CMC_MD2.ID01540.hairpin | YES | NO | NO | NO | NO | NO | NO | NO |
| TJU_CMC_MD2.ID01541.3p-miR | TJU_CMC_MD2.ID01541.hairpin | YES | NO | NO | NO | NO | NO | NO | NO |
| TJU_CMC_MD2.ID01542.3p-miR | TJU_CMC_MD2.ID01542.hairpin | YES | NO | NO | NO | NO | NO | NO | NO |
| TJU_CMC_MD2.ID01543.3p-miR | TJU_CMC_MD2.ID01543.hairpin | YES | NO | NO | NO | NO | NO | NO | NO |
| TJU_CMC_MD2.ID01544.3p-miR | TJU_CMC_MD2.ID01544.hairpin | YES | NO | NO | NO | NO | NO | NO | NO |
| TJU_CMC_MD2.ID01545.3p-miR | TJU_CMC_MD2.ID01545.hairpin | YES | NO | NO | NO | NO | NO | NO | NO |
| TJU_CMC_MD2.ID01546.5p-miR | TJU_CMC_MD2.ID01546.hairpin | YES | YES | YES | NO | NO | NO | NO | NO |
| TJU_CMC_MD2.ID01547.3p-miR | TJU_CMC_MD2.ID01547.hairpin | YES | NO | NO | NO | NO | NO | NO | NO |
| TJU_CMC_MD2.ID01548.5p-miR | TJU_CMC_MD2.ID01548.hairpin | YES | YES | NO | YES | NO | NO | NO | NO |
| TJU_CMC_MD2.ID01549.5p-miR | TJU_CMC_MD2.ID01549.hairpin | YES | YES | YES | NO | NO | NO | NO | NO |
| TJU_CMC_MD2.ID01550.3p-miR | TJU_CMC_MD2.ID01550.hairpin | YES | NO | NO | NO | NO | NO | NO | NO |
| TJU_CMC_MD2.ID01551.3p-miR | TJU_CMC_MD2.ID01551.hairpin | YES | NO | NO | NO | NO | NO | NO | NO |
| TJU_CMC_MD2.ID01552.5p-miR | TJU_CMC_MD2.ID01552.hairpin | YES | YES | NO | YES | YES | NO | NO | NO |
| TJU_CMC_MD2.ID01553.3p-miR | TJU_CMC_MD2.ID01553.hairpin | YES | NO | NO | NO | NO | NO | NO | NO |
| TJU_CMC_MD2.ID01554.3p-miR | TJU_CMC_MD2.ID01554.hairpin | YES | NO | NO | NO | NO | NO | NO | NO |
| TJU_CMC_MD2.ID01555.5p-miR | TJU_CMC_MD2.ID01555.hairpin | YES | YES | YES | YES | YES | NO | NO | NO |
| TJU_CMC_MD2.ID01556.3p-miR | TJU_CMC_MD2.ID01556.hairpin | YES | NO | YES | NO | YES | NO | NO | NO |
| TJU_CMC_MD2.ID01557.5p-miR | TJU_CMC_MD2.ID01557.hairpin | YES | NO | YES | YES | NO | NO | NO | NO |
| TJU_CMC_MD2.ID01558.3p-miR | TJU_CMC_MD2.ID01558.hairpin | YES | NO | NO | NO | NO | NO | NO | NO |
| TJU_CMC_MD2.ID01559.3p-miR | TJU_CMC_MD2.ID01559.hairpin | YES | NO | NO | NO | NO | NO | NO | NO |
| TJU_CMC_MD2.ID01560.3p-miR | TJU_CMC_MD2.ID01560.hairpin | YES | NO | NO | NO | NO | NO | NO | NO |
| TJU_CMC_MD2.ID01561.3p-miR | TJU_CMC_MD2.ID01561.hairpin | YES | NO | NO | NO | NO | NO | NO | NO |
| TJU_CMC_MD2.ID01562.3p-miR | TJU_CMC_MD2.ID01562.hairpin | YES | NO | NO | NO | NO | NO | NO | NO |
| TJU_CMC_MD2.ID01563.5p-miR | TJU_CMC_MD2.ID01563.hairpin | YES | YES | YES | YES | NO | NO | NO | NO |
| TJU_CMC_MD2.ID01564.3p-miR | TJU_CMC_MD2.ID01564.hairpin | YES | NO | NO | NO | NO | NO | NO | NO |
| TJU_CMC_MD2.ID01565.5p-miR | TJU_CMC_MD2.ID01565.hairpin | YES | YES | NO | YES | NO | NO | NO | NO |
| TJU_CMC_MD2.ID01566.3p-miR | TJU_CMC_MD2.ID01566.hairpin | YES | NO | NO | NO | NO | NO | NO | NO |
| TJU_CMC_MD2.ID01567.5p-miR | TJU_CMC_MD2.ID01567.hairpin | YES | NO | NO | YES | NO | NO | NO | NO |
| TJU_CMC_MD2.ID01568.3p-miR | TJU_CMC_MD2.ID01568.hairpin | YES | NO | NO | NO | NO | NO | NO | NO |
| TJU_CMC_MD2.ID01569.3p-miR | TJU_CMC_MD2.ID01569.hairpin | YES | NO | NO | NO | NO | NO | NO | NO |
| TJU_CMC_MD2.ID01570.3p-miR | TJU_CMC_MD2.ID01570.hairpin | YES | NO | NO | NO | NO | NO | NO | NO |
| TJU_CMC_MD2.ID01571.3p-miR | TJU_CMC_MD2.ID01571.hairpin | YES | NO | NO | NO | NO | NO | NO | NO |
| TJU_CMC_MD2.ID01572.5p-miR | TJU_CMC_MD2.ID01572.hairpin | YES | NO | YES | NO | NO | NO | NO | NO |
| TJU_CMC_MD2.ID01573.5p-miR | TJU_CMC_MD2.ID01573.hairpin | YES | YES | NO | NO | NO | NO | NO | NO |
| TJU_CMC_MD2.ID01574.5p-miR | TJU_CMC_MD2.ID01574.hairpin | YES | YES | YES | YES | NO | NO | NO | NO |
| TJU_CMC_MD2.ID01575.5p-miR | TJU_CMC_MD2.ID01575.hairpin | YES | YES | YES | NO | NO | NO | NO | NO |
| TJU_CMC_MD2.ID01576.3p-miR | TJU_CMC_MD2.ID01576.hairpin | YES | NO | NO | NO | NO | NO | NO | NO |
| TJU_CMC_MD2.ID01577.3p-miR | TJU_CMC_MD2.ID01577.hairpin | YES | YES | NO | YES | YES | NO | NO | NO |
| TJU_CMC_MD2.ID01578.5p-miR | TJU_CMC_MD2.ID01578.hairpin | YES | NO | YES | NO | NO | NO | NO | NO |
| TJU_CMC_MD2.ID01579.5p-miR | TJU_CMC_MD2.ID01579.hairpin | YES | NO | YES | YES | NO | NO | NO | NO |
| TJU_CMC_MD2.ID01580.3p-miR | TJU_CMC_MD2.ID01580.hairpin | YES | NO | NO | NO | NO | NO | NO | NO |
| TJU_CMC_MD2.ID01581.5p-miR | TJU_CMC_MD2.ID01581.hairpin | YES | YES | YES | YES | NO | NO | NO | NO |
| TJU_CMC_MD2.ID01582.3p-miR | TJU_CMC_MD2.ID01582.hairpin | YES | NO | NO | NO | NO | NO | NO | NO |
| TJU_CMC_MD2.ID01583.3p-miR | TJU_CMC_MD2.ID01583.hairpin | YES | NO | NO | NO | NO | NO | NO | NO |
| TJU_CMC_MD2.ID01584.3p-miR | TJU_CMC_MD2.ID01584.hairpin | YES | NO | NO | NO | NO | NO | NO | NO |
| TJU_CMC_MD2.ID01585.3p-miR | TJU_CMC_MD2.ID01585.hairpin | YES | NO | NO | NO | NO | NO | NO | NO |
| TJU_CMC_MD2.ID01586.3p-miR | TJU_CMC_MD2.ID01586.hairpin | YES | NO | NO | NO | NO | NO | NO | NO |
| TJU_CMC_MD2.ID01587.3p-miR | TJU_CMC_MD2.ID01587.hairpin | YES | NO | NO | NO | NO | NO | NO | NO |
| TJU_CMC_MD2.ID01587.5p-miR | TJU_CMC_MD2.ID01587.hairpin | YES | YES | YES | NO | NO | NO | NO | NO |
| TJU_CMC_MD2.ID01588.3p-miR | TJU_CMC_MD2.ID01588.hairpin | YES | NO | NO | NO | NO | NO | NO | NO |
| TJU_CMC_MD2.ID01589.3p-miR | TJU_CMC_MD2.ID01589.hairpin | YES | NO | NO | NO | NO | NO | NO | NO |
| TJU_CMC_MD2.ID01590.3p-miR | TJU_CMC_MD2.ID01590.hairpin | YES | NO | NO | NO | NO | NO | NO | NO |
| TJU_CMC_MD2.ID01591.3p-miR | TJU_CMC_MD2.ID01591.hairpin | YES | NO | NO | NO | NO | NO | NO | NO |
| TJU_CMC_MD2.ID01592.3p-miR | TJU_CMC_MD2.ID01592.hairpin | YES | NO | NO | NO | NO | NO | NO | NO |
| TJU_CMC_MD2.ID01593.5p-miR | TJU_CMC_MD2.ID01593.hairpin | YES | NO | YES | YES | NO | NO | NO | NO |
| TJU_CMC_MD2.ID01594.3p-miR | TJU_CMC_MD2.ID01594.hairpin | YES | NO | NO | NO | NO | NO | NO | NO |
| TJU_CMC_MD2.ID01595.3p-miR | TJU_CMC_MD2.ID01595.hairpin | YES | NO | NO | NO | NO | NO | NO | NO |
| TJU_CMC_MD2.ID01596.5p-miR | TJU_CMC_MD2.ID01596.hairpin | YES | YES | NO | YES | NO | NO | NO | NO |
| TJU_CMC_MD2.ID01597.3p-miR | TJU_CMC_MD2.ID01597.hairpin | YES | NO | NO | NO | NO | NO | NO | NO |
| TJU_CMC_MD2.ID01598.3p-miR | TJU_CMC_MD2.ID01598.hairpin | YES | NO | NO | NO | NO | NO | NO | NO |
| TJU_CMC_MD2.ID01599.3p-miR | TJU_CMC_MD2.ID01599.hairpin | YES | NO | NO | NO | NO | NO | NO | NO |
| TJU_CMC_MD2.ID01600.3p-miR | TJU_CMC_MD2.ID01600.hairpin | YES | NO | NO | NO | NO | NO | NO | NO |
| TJU_CMC_MD2.ID01601.3p-miR | TJU_CMC_MD2.ID01601.hairpin | YES | NO | NO | NO | NO | NO | NO | NO |
| TJU_CMC_MD2.ID01602.5p-miR | TJU_CMC_MD2.ID01602.hairpin | YES | YES | YES | YES | NO | NO | NO | NO |
| TJU_CMC_MD2.ID01603.3p-miR | TJU_CMC_MD2.ID01603.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01604.3p-miR | TJU_CMC_MD2.ID01604.hairpin | YES | NO | NO | NO | NO | NO | NO | NO |
| TJU_CMC_MD2.ID01605.3p-miR | TJU_CMC_MD2.ID01605.hairpin | YES | YES | YES | NO | YES | NO | NO | NO |
| TJU_CMC_MD2.ID01606.3p-miR | TJU_CMC_MD2.ID01606.hairpin | YES | NO | NO | NO | NO | NO | NO | NO |
| TJU_CMC_MD2.ID01607.3p-miR | TJU_CMC_MD2.ID01607.hairpin | YES | YES | YES | YES | YES | NO | NO | NO |
| TJU_CMC_MD2.ID01607.5p-miR | TJU_CMC_MD2.ID01607.hairpin | YES | YES | YES | YES | YES | NO | NO | NO |
| TJU_CMC_MD2.ID01608.3p-miR | TJU_CMC_MD2.ID01608.hairpin | YES | NO | NO | NO | NO | NO | NO | NO |
| TJU_CMC_MD2.ID01609.5p-miR | TJU_CMC_MD2.ID01609.hairpin | YES | YES | YES | YES | NO | NO | NO | NO |
| TJU_CMC_MD2.ID01610.5p-miR | TJU_CMC_MD2.ID01610.hairpin | YES | YES | YES | YES | YES | NO | NO | NO |
| TJU_CMC_MD2.ID01611.5p-miR | TJU_CMC_MD2.ID01611.hairpin | YES | YES | YES | YES | YES | NO | NO | NO |
| TJU_CMC_MD2.ID01612.3p-miR | TJU_CMC_MD2.ID01612.hairpin | YES | NO | NO | NO | NO | NO | NO | NO |
| TJU_CMC_MD2.ID01613.3p-miR | TJU_CMC_MD2.ID01613.hairpin | YES | NO | NO | NO | NO | NO | NO | NO |
| TJU_CMC_MD2.ID01613.5p-miR | TJU_CMC_MD2.ID01613.hairpin | YES | YES | YES | YES | YES | NO | NO | NO |
| TJU_CMC_MD2.ID01614.5p-miR | TJU_CMC_MD2.ID01614.hairpin | YES | YES | YES | NO | YES | NO | NO | NO |
| TJU_CMC_MD2.ID01615.3p-miR | TJU_CMC_MD2.ID01615.hairpin | YES | NO | NO | NO | NO | NO | NO | NO |
| TJU_CMC_MD2.ID01616.3p-miR | TJU_CMC_MD2.ID01616.hairpin | YES | NO | NO | NO | NO | NO | NO | NO |
| TJU_CMC_MD2.ID01617.3p-miR | TJU_CMC_MD2.ID01617.hairpin | YES | NO | NO | NO | NO | NO | NO | NO |
| TJU_CMC_MD2.ID01618.3p-miR | TJU_CMC_MD2.ID01618.hairpin | YES | NO | NO | NO | NO | NO | NO | NO |
| TJU_CMC_MD2.ID01619.3p-miR | TJU_CMC_MD2.ID01619.hairpin | YES | NO | NO | NO | NO | NO | NO | NO |
| TJU_CMC_MD2.ID01620.3p-miR | TJU_CMC_MD2.ID01620.hairpin | YES | NO | NO | NO | NO | NO | NO | NO |
| TJU_CMC_MD2.ID01621.3p-miR | TJU_CMC_MD2.ID01621.hairpin | YES | NO | NO | NO | NO | NO | NO | NO |
| TJU_CMC_MD2.ID01622.3p-miR | TJU_CMC_MD2.ID01622.hairpin | YES | NO | NO | NO | NO | NO | NO | NO |
| TJU_CMC_MD2.ID01623.3p-miR | TJU_CMC_MD2.ID01623.hairpin | YES | NO | NO | NO | NO | NO | NO | NO |
| TJU_CMC_MD2.ID01624.5p-miR | TJU_CMC_MD2.ID01624.hairpin | YES | NO | NO | YES | YES | NO | NO | NO |
| TJU_CMC_MD2.ID01625.3p-miR | TJU_CMC_MD2.ID01625.hairpin | YES | NO | NO | NO | NO | NO | NO | NO |
| TJU_CMC_MD2.ID01626.3p-miR | TJU_CMC_MD2.ID01626.hairpin | YES | NO | NO | NO | NO | NO | NO | NO |
| TJU_CMC_MD2.ID01627.5p-miR | TJU_CMC_MD2.ID01627.hairpin | YES | YES | YES | YES | YES | NO | NO | NO |
| TJU_CMC_MD2.ID01628.5p-miR | TJU_CMC_MD2.ID01628.hairpin | YES | YES | NO | NO | NO | NO | NO | NO |
| TJU_CMC_MD2.ID01629.5p-miR | TJU_CMC_MD2.ID01629.hairpin | YES | YES | YES | NO | NO | NO | NO | NO |
| TJU_CMC_MD2.ID01630.5p-miR | TJU_CMC_MD2.ID01630.hairpin | YES | NO | YES | NO | NO | NO | NO | NO |
| TJU_CMC_MD2.ID01631.3p-miR | TJU_CMC_MD2.ID01631.hairpin | YES | YES | NO | NO | NO | NO | NO | NO |
| TJU_CMC_MD2.ID01632.5p-miR | TJU_CMC_MD2.ID01632.hairpin | YES | YES | YES | YES | NO | NO | NO | NO |
| TJU_CMC_MD2.ID01633.3p-miR | TJU_CMC_MD2.ID01633.hairpin | YES | NO | NO | NO | NO | NO | NO | NO |
| TJU_CMC_MD2.ID01634.3p-miR | TJU_CMC_MD2.ID01634.hairpin | YES | NO | NO | NO | NO | NO | NO | NO |
| TJU_CMC_MD2.ID01635.3p-miR | TJU_CMC_MD2.ID01635.hairpin | YES | NO | NO | NO | NO | NO | NO | NO |
| TJU_CMC_MD2.ID01636.5p-miR | TJU_CMC_MD2.ID01636.hairpin | YES | YES | YES | YES | NO | NO | NO | NO |
| TJU_CMC_MD2.ID01637.3p-miR | TJU_CMC_MD2.ID01637.hairpin | YES | NO | NO | NO | NO | NO | NO | NO |
| TJU_CMC_MD2.ID01638.3p-miR | TJU_CMC_MD2.ID01638.hairpin | YES | NO | NO | NO | NO | NO | NO | NO |
| TJU_CMC_MD2.ID01639.5p-miR | TJU_CMC_MD2.ID01639.hairpin | YES | YES | NO | YES | NO | NO | NO | NO |
| TJU_CMC_MD2.ID01640.5p-miR | TJU_CMC_MD2.ID01640.hairpin | YES | YES | NO | NO | NO | NO | NO | NO |
| TJU_CMC_MD2.ID01641.3p-miR | TJU_CMC_MD2.ID01641.hairpin | YES | NO | NO | NO | NO | NO | NO | NO |
| TJU_CMC_MD2.ID01642.3p-miR | TJU_CMC_MD2.ID01642.hairpin | YES | NO | NO | NO | NO | NO | NO | NO |
| TJU_CMC_MD2.ID01642.5p-miR | TJU_CMC_MD2.ID01642.hairpin | YES | YES | YES | YES | YES | NO | NO | NO |
| TJU_CMC_MD2.ID01643.3p-miR | TJU_CMC_MD2.ID01643.hairpin | YES | NO | NO | NO | NO | NO | NO | NO |
| TJU_CMC_MD2.ID01644.3p-miR | TJU_CMC_MD2.ID01644.hairpin | YES | NO | NO | NO | NO | NO | NO | NO |
| TJU_CMC_MD2.ID01645.5p-miR | TJU_CMC_MD2.ID01645.hairpin | YES | YES | YES | YES | NO | NO | NO | NO |
| TJU_CMC_MD2.ID01646.3p-miR | TJU_CMC_MD2.ID01646.hairpin | YES | NO | YES | NO | NO | NO | NO | NO |
| TJU_CMC_MD2.ID01646.5p-miR | TJU_CMC_MD2.ID01646.hairpin | YES | NO | YES | NO | NO | NO | NO | NO |
| TJU_CMC_MD2.ID01647.5p-miR | TJU_CMC_MD2.ID01647.hairpin | YES | NO | YES | NO | NO | NO | NO | NO |
| TJU_CMC_MD2.ID01648.3p-miR | TJU_CMC_MD2.ID01648.hairpin | YES | NO | NO | NO | NO | NO | NO | NO |
| TJU_CMC_MD2.ID01648.5p-miR | TJU_CMC_MD2.ID01648.hairpin | YES | YES | NO | YES | NO | NO | NO | NO |
| TJU_CMC_MD2.ID01649.5p-miR | TJU_CMC_MD2.ID01649.hairpin | YES | YES | YES | YES | NO | NO | NO | NO |
| TJU_CMC_MD2.ID01650.3p-miR | TJU_CMC_MD2.ID01650.hairpin | YES | NO | NO | NO | NO | NO | NO | NO |
| TJU_CMC_MD2.ID01651.5p-miR | TJU_CMC_MD2.ID01651.hairpin | YES | YES | NO | NO | NO | NO | NO | NO |
| TJU_CMC_MD2.ID01652.3p-miR | TJU_CMC_MD2.ID01652.hairpin | YES | NO | NO | NO | NO | NO | NO | NO |
| TJU_CMC_MD2.ID01653.5p-miR | TJU_CMC_MD2.ID01653.hairpin | YES | NO | NO | NO | NO | NO | NO | NO |
| TJU_CMC_MD2.ID01654.3p-miR | TJU_CMC_MD2.ID01654.hairpin | YES | NO | NO | NO | NO | NO | NO | NO |
| TJU_CMC_MD2.ID01655.3p-miR | TJU_CMC_MD2.ID01655.hairpin | YES | NO | NO | NO | NO | NO | NO | NO |
| TJU_CMC_MD2.ID01656.3p-miR | TJU_CMC_MD2.ID01656.hairpin | YES | NO | NO | NO | NO | NO | NO | NO |
| TJU_CMC_MD2.ID01657.5p-miR | TJU_CMC_MD2.ID01657.hairpin | YES | YES | YES | NO | NO | NO | NO | NO |
| TJU_CMC_MD2.ID01658.3p-miR | TJU_CMC_MD2.ID01658.hairpin | YES | NO | NO | NO | NO | NO | NO | NO |
| TJU_CMC_MD2.ID01659.3p-miR | TJU_CMC_MD2.ID01659.hairpin | YES | NO | NO | NO | NO | NO | NO | NO |
| TJU_CMC_MD2.ID01660.3p-miR | TJU_CMC_MD2.ID01660.hairpin | YES | NO | NO | NO | NO | NO | NO | NO |
| TJU_CMC_MD2.ID01661.3p-miR | TJU_CMC_MD2.ID01661.hairpin | YES | NO | NO | NO | NO | NO | NO | NO |
| TJU_CMC_MD2.ID01662.3p-miR | TJU_CMC_MD2.ID01662.hairpin | YES | NO | NO | NO | NO | NO | NO | NO |
| TJU_CMC_MD2.ID01663.3p-miR | TJU_CMC_MD2.ID01663.hairpin | YES | NO | NO | NO | NO | NO | NO | NO |
| TJU_CMC_MD2.ID01664.3p-miR | TJU_CMC_MD2.ID01664.hairpin | YES | NO | NO | NO | NO | NO | NO | NO |
| TJU_CMC_MD2.ID01664.5p-miR | TJU_CMC_MD2.ID01664.hairpin | YES | YES | YES | YES | NO | NO | NO | NO |
| TJU_CMC_MD2.ID01665.3p-miR | TJU_CMC_MD2.ID01665.hairpin | YES | NO | NO | NO | NO | NO | NO | NO |
| TJU_CMC_MD2.ID01666.3p-miR | TJU_CMC_MD2.ID01666.hairpin | YES | NO | YES | YES | NO | NO | NO | NO |
| TJU_CMC_MD2.ID01666.5p-miR | TJU_CMC_MD2.ID01666.hairpin | YES | NO | YES | YES | NO | NO | NO | NO |
| TJU_CMC_MD2.ID01667.3p-miR | TJU_CMC_MD2.ID01667.hairpin | YES | NO | NO | NO | NO | NO | NO | NO |
| TJU_CMC_MD2.ID01668.5p-miR | TJU_CMC_MD2.ID01668.hairpin | YES | YES | YES | YES | NO | NO | NO | NO |
| TJU_CMC_MD2.ID01669.3p-miR | TJU_CMC_MD2.ID01669.hairpin | YES | NO | NO | NO | NO | NO | NO | NO |
| TJU_CMC_MD2.ID01670.5p-miR | TJU_CMC_MD2.ID01670.hairpin | YES | NO | NO | NO | NO | NO | NO | NO |
| TJU_CMC_MD2.ID01671.3p-miR | TJU_CMC_MD2.ID01671.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01672.5p-miR | TJU_CMC_MD2.ID01672.hairpin | YES | YES | YES | NO | NO | NO | NO | NO |
| TJU_CMC_MD2.ID01673.3p-miR | TJU_CMC_MD2.ID01673.hairpin | YES | NO | NO | NO | NO | NO | NO | NO |
| TJU_CMC_MD2.ID01674.3p-miR | TJU_CMC_MD2.ID01674.hairpin | YES | NO | NO | NO | NO | NO | NO | NO |
| TJU_CMC_MD2.ID01674.5p-miR | TJU_CMC_MD2.ID01674.hairpin | YES | YES | YES | YES | YES | NO | NO | NO |
| TJU_CMC_MD2.ID01675.5p-miR | TJU_CMC_MD2.ID01675.hairpin | YES | YES | YES | NO | NO | YES | NO | NO |
| TJU_CMC_MD2.ID01676.3p-miR | TJU_CMC_MD2.ID01676.hairpin | YES | NO | NO | NO | NO | NO | NO | NO |
| TJU_CMC_MD2.ID01677.3p-miR | TJU_CMC_MD2.ID01677.hairpin | YES | NO | NO | NO | NO | NO | NO | NO |
| TJU_CMC_MD2.ID01678.3p-miR | TJU_CMC_MD2.ID01678.hairpin | YES | YES | YES | YES | NO | NO | NO | NO |
| TJU_CMC_MD2.ID01679.5p-miR | TJU_CMC_MD2.ID01679.hairpin | YES | YES | YES | YES | NO | NO | NO | NO |
| TJU_CMC_MD2.ID01680.3p-miR | TJU_CMC_MD2.ID01680.hairpin | YES | YES | YES | NO | YES | NO | NO | NO |
| TJU_CMC_MD2.ID01680.5p-miR | TJU_CMC_MD2.ID01680.hairpin | YES | NO | NO | NO | YES | NO | NO | NO |
| TJU_CMC_MD2.ID01681.3p-miR | TJU_CMC_MD2.ID01681.hairpin | YES | NO | NO | NO | NO | NO | NO | NO |
| TJU_CMC_MD2.ID01682.3p-miR | TJU_CMC_MD2.ID01682.hairpin | YES | NO | NO | NO | NO | NO | NO | NO |
| TJU_CMC_MD2.ID01683.5p-miR | TJU_CMC_MD2.ID01683.hairpin | YES | YES | NO | NO | NO | NO | NO | NO |
| TJU_CMC_MD2.ID01684.3p-miR | TJU_CMC_MD2.ID01684.hairpin | YES | NO | NO | NO | NO | NO | NO | NO |
| TJU_CMC_MD2.ID01685.5p-miR | TJU_CMC_MD2.ID01685.hairpin | YES | YES | YES | YES | NO | NO | NO | NO |
| TJU_CMC_MD2.ID01686.5p-miR | TJU_CMC_MD2.ID01686.hairpin | YES | NO | NO | NO | NO | YES | NO | NO |
| TJU_CMC_MD2.ID01687.3p-miR | TJU_CMC_MD2.ID01687.hairpin | YES | NO | NO | NO | NO | NO | NO | NO |
| TJU_CMC_MD2.ID01688.3p-miR | TJU_CMC_MD2.ID01688.hairpin | YES | NO | NO | NO | NO | NO | NO | NO |
| TJU_CMC_MD2.ID01689.3p-miR | TJU_CMC_MD2.ID01689.hairpin | YES | NO | NO | NO | NO | NO | NO | NO |
| TJU_CMC_MD2.ID01690.3p-miR | TJU_CMC_MD2.ID01690.hairpin | YES | NO | NO | NO | NO | NO | NO | NO |
| TJU_CMC_MD2.ID01691.5p-miR | TJU_CMC_MD2.ID01691.hairpin | YES | YES | NO | YES | NO | YES | NO | NO |
| TJU_CMC_MD2.ID01692.3p-miR | TJU_CMC_MD2.ID01692.hairpin | YES | NO | NO | NO | NO | NO | NO | NO |
| TJU_CMC_MD2.ID01692.5p-miR | TJU_CMC_MD2.ID01692.hairpin | YES | YES | YES | YES | YES | NO | NO | NO |
| TJU_CMC_MD2.ID01693.5p-miR | TJU_CMC_MD2.ID01693.hairpin | YES | YES | YES | YES | YES | NO | NO | NO |
| TJU_CMC_MD2.ID01694.5p-miR | TJU_CMC_MD2.ID01694.hairpin | YES | NO | YES | NO | NO | NO | NO | NO |
| TJU_CMC_MD2.ID01695.3p-miR | TJU_CMC_MD2.ID01695.hairpin | YES | NO | NO | NO | NO | NO | NO | NO |
| TJU_CMC_MD2.ID01696.3p-miR | TJU_CMC_MD2.ID01696.hairpin | YES | NO | NO | NO | NO | NO | NO | NO |
| TJU_CMC_MD2.ID01697.5p-miR | TJU_CMC_MD2.ID01697.hairpin | YES | NO | NO | NO | NO | NO | NO | NO |
| TJU_CMC_MD2.ID01698.3p-miR | TJU_CMC_MD2.ID01698.hairpin | YES | NO | NO | NO | NO | NO | NO | NO |
| TJU_CMC_MD2.ID01699.5p-miR | TJU_CMC_MD2.ID01699.hairpin | YES | YES | YES | YES | YES | NO | NO | NO |
| TJU_CMC_MD2.ID01700.3p-miR | TJU_CMC_MD2.ID01700.hairpin | YES | NO | NO | NO | NO | NO | NO | NO |
| TJU_CMC_MD2.ID01701.3p-miR | TJU_CMC_MD2.ID01701.hairpin | YES | NO | NO | NO | NO | NO | NO | NO |
| TJU_CMC_MD2.ID01702.3p-miR | TJU_CMC_MD2.ID01702.hairpin | YES | NO | NO | NO | NO | NO | NO | NO |
| TJU_CMC_MD2.ID01703.3p-miR | TJU_CMC_MD2.ID01703.hairpin | YES | NO | NO | NO | NO | NO | NO | NO |
| TJU_CMC_MD2.ID01704.5p-miR | TJU_CMC_MD2.ID01704.hairpin | YES | NO | NO | NO | NO | NO | NO | NO |
| TJU_CMC_MD2.ID01705.3p-miR | TJU_CMC_MD2.ID01705.hairpin | YES | NO | NO | NO | NO | NO | NO | NO |
| TJU_CMC_MD2.ID01706.3p-miR | TJU_CMC_MD2.ID01706.hairpin | YES | NO | NO | NO | NO | NO | NO | NO |
| TJU_CMC_MD2.ID01707.5p-miR | TJU_CMC_MD2.ID01707.hairpin | YES | YES | YES | YES | NO | NO | NO | NO |
| TJU_CMC_MD2.ID01708.5p-miR | TJU_CMC_MD2.ID01708.hairpin | YES | YES | YES | NO | NO | NO | NO | NO |
| TJU_CMC_MD2.ID01709.3p-miR | TJU_CMC_MD2.ID01709.hairpin | YES | NO | NO | NO | NO | NO | NO | NO |
| TJU_CMC_MD2.ID01710.3p-miR | TJU_CMC_MD2.ID01710.hairpin | YES | NO | NO | NO | NO | NO | NO | NO |
| TJU_CMC_MD2.ID01711.3p-miR | TJU_CMC_MD2.ID01711.hairpin | YES | NO | NO | NO | NO | NO | NO | NO |
| TJU_CMC_MD2.ID01712.5p-miR | TJU_CMC_MD2.ID01712.hairpin | YES | YES | NO | YES | NO | NO | NO | NO |
| TJU_CMC_MD2.ID01713.5p-miR | TJU_CMC_MD2.ID01713.hairpin | YES | YES | YES | YES | NO | NO | NO | NO |
| TJU_CMC_MD2.ID01714.3p-miR | TJU_CMC_MD2.ID01714.hairpin | YES | NO | NO | NO | NO | NO | NO | NO |
| TJU_CMC_MD2.ID01715.3p-miR | TJU_CMC_MD2.ID01715.hairpin | YES | YES | YES | NO | NO | NO | NO | NO |
| TJU_CMC_MD2.ID01716.3p-miR | TJU_CMC_MD2.ID01716.hairpin | YES | NO | NO | NO | NO | NO | NO | NO |
| TJU_CMC_MD2.ID01717.3p-miR | TJU_CMC_MD2.ID01717.hairpin | YES | NO | NO | NO | NO | NO | NO | NO |
| TJU_CMC_MD2.ID01718.3p-miR | TJU_CMC_MD2.ID01718.hairpin | YES | NO | NO | NO | NO | NO | NO | NO |
| TJU_CMC_MD2.ID01719.3p-miR | TJU_CMC_MD2.ID01719.hairpin | YES | NO | NO | NO | NO | NO | NO | NO |
| TJU_CMC_MD2.ID01720.5p-miR | TJU_CMC_MD2.ID01720.hairpin | YES | NO | NO | NO | NO | NO | NO | NO |
| TJU_CMC_MD2.ID01721.3p-miR | TJU_CMC_MD2.ID01721.hairpin | YES | NO | NO | NO | NO | NO | NO | NO |
| TJU_CMC_MD2.ID01722.3p-miR | TJU_CMC_MD2.ID01722.hairpin | YES | NO | NO | NO | NO | NO | NO | NO |
| TJU_CMC_MD2.ID01723.5p-miR | TJU_CMC_MD2.ID01723.hairpin | YES | NO | YES | YES | NO | NO | NO | NO |
| TJU_CMC_MD2.ID01724.3p-miR | TJU_CMC_MD2.ID01724.hairpin | YES | NO | NO | NO | NO | NO | NO | NO |
| TJU_CMC_MD2.ID01725.3p-miR | TJU_CMC_MD2.ID01725.hairpin | YES | NO | NO | NO | NO | NO | NO | NO |
| TJU_CMC_MD2.ID01726.3p-miR | TJU_CMC_MD2.ID01726.hairpin | YES | NO | NO | NO | NO | NO | NO | NO |
| TJU_CMC_MD2.ID01727.5p-miR | TJU_CMC_MD2.ID01727.hairpin | YES | NO | NO | YES | NO | NO | NO | NO |
| TJU_CMC_MD2.ID01728.3p-miR | TJU_CMC_MD2.ID01728.hairpin | YES | NO | NO | NO | NO | NO | NO | NO |
| TJU_CMC_MD2.ID01729.3p-miR | TJU_CMC_MD2.ID01729.hairpin | YES | NO | NO | NO | NO | NO | NO | NO |
| TJU_CMC_MD2.ID01730.3p-miR | TJU_CMC_MD2.ID01730.hairpin | YES | NO | NO | NO | NO | NO | NO | NO |
| TJU_CMC_MD2.ID01731.5p-miR | TJU_CMC_MD2.ID01731.hairpin | YES | YES | YES | YES | NO | NO | NO | NO |
| TJU_CMC_MD2.ID01732.3p-miR | TJU_CMC_MD2.ID01732.hairpin | YES | NO | NO | NO | NO | NO | NO | NO |
| TJU_CMC_MD2.ID01733.3p-miR | TJU_CMC_MD2.ID01733.hairpin | YES | NO | NO | NO | NO | NO | NO | NO |
| TJU_CMC_MD2.ID01734.5p-miR | TJU_CMC_MD2.ID01734.hairpin | YES | YES | YES | YES | NO | NO | NO | NO |
| TJU_CMC_MD2.ID01735.3p-miR | TJU_CMC_MD2.ID01735.hairpin | YES | NO | NO | NO | NO | NO | NO | NO |
| TJU_CMC_MD2.ID01736.3p-miR | TJU_CMC_MD2.ID01736.hairpin | YES | NO | NO | NO | NO | NO | NO | NO |
| TJU_CMC_MD2.ID01737.3p-miR | TJU_CMC_MD2.ID01737.hairpin | YES | NO | NO | NO | NO | NO | NO | NO |
| TJU_CMC_MD2.ID01738.5p-miR | TJU_CMC_MD2.ID01738.hairpin | YES | YES | NO | YES | NO | NO | NO | NO |
| TJU_CMC_MD2.ID01739.3p-miR | TJU_CMC_MD2.ID01739.hairpin | YES | NO | NO | NO | NO | NO | NO | NO |
| TJU_CMC_MD2.ID01740.5p-miR | TJU_CMC_MD2.ID01740.hairpin | YES | NO | NO | NO | NO | NO | NO | NO |
| TJU_CMC_MD2.ID01741.5p-miR | TJU_CMC_MD2.ID01741.hairpin | YES | NO | NO | NO | NO | NO | NO | NO |
| TJU_CMC_MD2.ID01742.3p-miR | TJU_CMC_MD2.ID01742.hairpin | YES | NO | NO | NO | NO | NO | NO | NO |
| TJU_CMC_MD2.ID01743.5p-miR | TJU_CMC_MD2.ID01743.hairpin | YES | YES | YES | YES | YES | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01744.3p-miR | TJU_CMC_MD2.ID01744.hairpin | YES | NO | NO | NO | NO | NO | NO | NO |
| TJU_CMC_MD2.ID01745.3p-miR | TJU_CMC_MD2.ID01745.hairpin | YES | NO | NO | NO | NO | NO | NO | NO |
| TJU_CMC_MD2.ID01746.3p-miR | TJU_CMC_MD2.ID01746.hairpin | YES | NO | NO | NO | NO | NO | NO | NO |
| TJU_CMC_MD2.ID01747.5p-miR | TJU_CMC_MD2.ID01747.hairpin | YES | NO | NO | YES | NO | NO | NO | NO |
| TJU_CMC_MD2.ID01748.3p-miR | TJU_CMC_MD2.ID01748.hairpin | YES | NO | NO | NO | NO | NO | NO | NO |
| TJU_CMC_MD2.ID01749.3p-miR | TJU_CMC_MD2.ID01749.hairpin | YES | NO | NO | NO | NO | NO | NO | NO |
| TJU_CMC_MD2.ID01750.5p-miR | TJU_CMC_MD2.ID01750.hairpin | YES | NO | NO | YES | NO | NO | NO | NO |
| TJU_CMC_MD2.ID01751.5p-miR | TJU_CMC_MD2.ID01751.hairpin | YES | YES | YES | NO | NO | NO | NO | NO |
| TJU_CMC_MD2.ID01752.5p-miR | TJU_CMC_MD2.ID01752.hairpin | YES | NO | YES | NO | NO | NO | NO | NO |
| TJU_CMC_MD2.ID01753.3p-miR | TJU_CMC_MD2.ID01753.hairpin | YES | NO | NO | NO | NO | NO | NO | NO |
| TJU_CMC_MD2.ID01754.3p-miR | TJU_CMC_MD2.ID01754.hairpin | YES | NO | NO | NO | NO | NO | NO | NO |
| TJU_CMC_MD2.ID01755.3p-miR | TJU_CMC_MD2.ID01755.hairpin | YES | NO | NO | NO | NO | NO | NO | NO |
| TJU_CMC_MD2.ID01756.5p-miR | TJU_CMC_MD2.ID01756.hairpin | YES | NO | NO | NO | NO | NO | NO | NO |
| TJU_CMC_MD2.ID01757.3p-miR | TJU_CMC_MD2.ID01757.hairpin | YES | NO | NO | NO | NO | NO | NO | NO |
| TJU_CMC_MD2.ID01758.3p-miR | TJU_CMC_MD2.ID01758.hairpin | YES | NO | NO | NO | NO | NO | NO | NO |
| TJU_CMC_MD2.ID01759.3p-miR | TJU_CMC_MD2.ID01759.hairpin | YES | NO | NO | NO | NO | NO | NO | NO |
| TJU_CMC_MD2.ID01760.3p-miR | TJU_CMC_MD2.ID01760.hairpin | YES | NO | NO | NO | NO | NO | NO | NO |
| TJU_CMC_MD2.ID01761.3p-miR | TJU_CMC_MD2.ID01761.hairpin | YES | YES | YES | YES | NO | NO | NO | NO |
| TJU_CMC_MD2.ID01762.5p-miR | TJU_CMC_MD2.ID01762.hairpin | YES | YES | NO | NO | YES | NO | NO | NO |
| TJU_CMC_MD2.ID01763.5p-miR | TJU_CMC_MD2.ID01763.hairpin | YES | NO | NO | NO | NO | NO | NO | NO |
| TJU_CMC_MD2.ID01764.5p-miR | TJU_CMC_MD2.ID01764.hairpin | YES | YES | YES | NO | YES | NO | NO | NO |
| TJU_CMC_MD2.ID01765.3p-miR | TJU_CMC_MD2.ID01765.hairpin | YES | NO | NO | NO | NO | NO | NO | NO |
| TJU_CMC_MD2.ID01766.5p-miR | TJU_CMC_MD2.ID01766.hairpin | YES | YES | NO | NO | NO | NO | NO | NO |
| TJU_CMC_MD2.ID01767.5p-miR | TJU_CMC_MD2.ID01767.hairpin | YES | NO | YES | YES | NO | NO | NO | NO |
| TJU_CMC_MD2.ID01768.3p-miR | TJU_CMC_MD2.ID01768.hairpin | YES | NO | NO | NO | NO | NO | NO | NO |
| TJU_CMC_MD2.ID01769.5p-miR | TJU_CMC_MD2.ID01769.hairpin | YES | YES | YES | YES | NO | YES | NO | NO |
| TJU_CMC_MD2.ID01770.3p-miR | TJU_CMC_MD2.ID01770.hairpin | YES | YES | YES | NO | NO | NO | NO | NO |
| TJU_CMC_MD2.ID01771.5p-miR | TJU_CMC_MD2.ID01771.hairpin | YES | YES | NO | YES | NO | NO | NO | NO |
| TJU_CMC_MD2.ID01772.3p-miR | TJU_CMC_MD2.ID01772.hairpin | YES | NO | NO | NO | NO | NO | NO | NO |
| TJU_CMC_MD2.ID01772.5p-miR | TJU_CMC_MD2.ID01772.hairpin | YES | YES | YES | YES | NO | NO | NO | NO |
| TJU_CMC_MD2.ID01773.3p-miR | TJU_CMC_MD2.ID01773.hairpin | YES | NO | NO | NO | NO | NO | NO | NO |
| TJU_CMC_MD2.ID01774.5p-miR | TJU_CMC_MD2.ID01774.hairpin | YES | YES | YES | NO | NO | NO | NO | NO |
| TJU_CMC_MD2.ID01775.3p-miR | TJU_CMC_MD2.ID01775.hairpin | YES | NO | NO | NO | NO | NO | NO | NO |
| TJU_CMC_MD2.ID01776.3p-miR | TJU_CMC_MD2.ID01776.hairpin | YES | NO | NO | NO | NO | NO | NO | NO |
| TJU_CMC_MD2.ID01777.3p-miR | TJU_CMC_MD2.ID01777.hairpin | YES | NO | NO | NO | NO | NO | NO | NO |
| TJU_CMC_MD2.ID01778.3p-miR | TJU_CMC_MD2.ID01778.hairpin | YES | NO | NO | NO | NO | NO | NO | NO |
| TJU_CMC_MD2.ID01779.3p-miR | TJU_CMC_MD2.ID01779.hairpin | YES | NO | NO | NO | NO | NO | NO | NO |
| TJU_CMC_MD2.ID01780.5p-miR | TJU_CMC_MD2.ID01780.hairpin | YES | NO | YES | NO | NO | NO | NO | NO |
| TJU_CMC_MD2.ID01781.5p-miR | TJU_CMC_MD2.ID01781.hairpin | YES | YES | YES | YES | NO | NO | NO | NO |
| TJU_CMC_MD2.ID01782.3p-miR | TJU_CMC_MD2.ID01782.hairpin | YES | NO | NO | NO | NO | NO | NO | NO |
| TJU_CMC_MD2.ID01783.3p-miR | TJU_CMC_MD2.ID01783.hairpin | YES | NO | NO | NO | NO | NO | NO | NO |
| TJU_CMC_MD2.ID01784.5p-miR | TJU_CMC_MD2.ID01784.hairpin | YES | YES | YES | YES | NO | NO | NO | NO |
| TJU_CMC_MD2.ID01785.3p-miR | TJU_CMC_MD2.ID01785.hairpin | YES | NO | NO | NO | NO | NO | NO | NO |
| TJU_CMC_MD2.ID01786.5p-miR | TJU_CMC_MD2.ID01786.hairpin | YES | YES | YES | NO | NO | NO | NO | NO |
| TJU_CMC_MD2.ID01787.3p-miR | TJU_CMC_MD2.ID01787.hairpin | YES | NO | NO | NO | NO | NO | NO | NO |
| TJU_CMC_MD2.ID01788.3p-miR | TJU_CMC_MD2.ID01788.hairpin | YES | NO | NO | NO | NO | NO | NO | NO |
| TJU_CMC_MD2.ID01789.3p-miR | TJU_CMC_MD2.ID01789.hairpin | YES | NO | NO | NO | NO | NO | NO | NO |
| TJU_CMC_MD2.ID01790.5p-miR | TJU_CMC_MD2.ID01790.hairpin | YES | YES | YES | YES | YES | NO | NO | NO |
| TJU_CMC_MD2.ID01791.3p-miR | TJU_CMC_MD2.ID01791.hairpin | YES | NO | NO | NO | NO | NO | NO | NO |
| TJU_CMC_MD2.ID01792.5p-miR | TJU_CMC_MD2.ID01792.hairpin | YES | YES | YES | YES | YES | NO | NO | NO |
| TJU_CMC_MD2.ID01793.3p-miR | TJU_CMC_MD2.ID01793.hairpin | YES | YES | YES | NO | YES | NO | NO | NO |
| TJU_CMC_MD2.ID01793.5p-miR | TJU_CMC_MD2.ID01793.hairpin | YES | YES | YES | YES | YES | NO | NO | NO |
| TJU_CMC_MD2.ID01794.5p-miR | TJU_CMC_MD2.ID01794.hairpin | YES | YES | YES | YES | NO | NO | NO | NO |
| TJU_CMC_MD2.ID01795.5p-miR | TJU_CMC_MD2.ID01795.hairpin | YES | YES | NO | NO | YES | NO | NO | NO |
| TJU_CMC_MD2.ID01796.3p-miR | TJU_CMC_MD2.ID01796.hairpin | YES | NO | NO | NO | NO | NO | NO | NO |
| TJU_CMC_MD2.ID01797.3p-miR | TJU_CMC_MD2.ID01797.hairpin | YES | NO | NO | NO | NO | NO | NO | NO |
| TJU_CMC_MD2.ID01798.3p-miR | TJU_CMC_MD2.ID01798.hairpin | YES | NO | NO | NO | NO | NO | NO | NO |
| TJU_CMC_MD2.ID01799.5p-miR | TJU_CMC_MD2.ID01799.hairpin | YES | YES | NO | NO | NO | NO | NO | NO |
| TJU_CMC_MD2.ID01800.5p-miR | TJU_CMC_MD2.ID01800.hairpin | YES | NO | NO | NO | NO | NO | NO | NO |
| TJU_CMC_MD2.ID01801.3p-miR | TJU_CMC_MD2.ID01801.hairpin | YES | NO | NO | NO | NO | NO | NO | NO |
| TJU_CMC_MD2.ID01801.5p-miR | TJU_CMC_MD2.ID01801.hairpin | YES | YES | NO | NO | YES | NO | NO | NO |
| TJU_CMC_MD2.ID01802.5p-miR | TJU_CMC_MD2.ID01802.hairpin | YES | NO | YES | YES | YES | NO | NO | NO |
| TJU_CMC_MD2.ID01803.5p-miR | TJU_CMC_MD2.ID01803.hairpin | YES | YES | YES | YES | YES | NO | NO | NO |
| TJU_CMC_MD2.ID01804.3p-miR | TJU_CMC_MD2.ID01804.hairpin | YES | NO | NO | NO | NO | NO | NO | NO |
| TJU_CMC_MD2.ID01805.3p-miR | TJU_CMC_MD2.ID01805.hairpin | YES | NO | NO | NO | NO | NO | NO | NO |
| TJU_CMC_MD2.ID01805.5p-miR | TJU_CMC_MD2.ID01805.hairpin | YES | NO | YES | YES | NO | NO | NO | NO |
| TJU_CMC_MD2.ID01806.3p-miR | TJU_CMC_MD2.ID01806.hairpin | YES | NO | NO | NO | NO | NO | NO | NO |
| TJU_CMC_MD2.ID01807.3p-miR | TJU_CMC_MD2.ID01807.hairpin | YES | NO | NO | NO | NO | NO | NO | NO |
| TJU_CMC_MD2.ID01808.5p-miR | TJU_CMC_MD2.ID01808.hairpin | YES | YES | YES | YES | YES | NO | NO | NO |
| TJU_CMC_MD2.ID01809.3p-miR | TJU_CMC_MD2.ID01809.hairpin | YES | NO | NO | NO | NO | NO | NO | NO |
| TJU_CMC_MD2.ID01810.3p-miR | TJU_CMC_MD2.ID01810.hairpin | YES | NO | NO | NO | NO | NO | NO | NO |
| TJU_CMC_MD2.ID01811.5p-miR | TJU_CMC_MD2.ID01811.hairpin | YES | YES | YES | NO | NO | NO | NO | NO |
| TJU_CMC_MD2.ID01812.5p-miR | TJU_CMC_MD2.ID01812.hairpin | YES | YES | YES | NO | YES | NO | NO | NO |
| TJU_CMC_MD2.ID01813.3p-miR | TJU_CMC_MD2.ID01813.hairpin | YES | NO | NO | NO | NO | NO | NO | NO |
| TJU_CMC_MD2.ID01813.5p-miR | TJU_CMC_MD2.ID01813.hairpin | YES | NO | YES | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01814.3p-miR | TJU_CMC_MD2.ID01814.hairpin | YES | NO | NO | NO | NO | NO | NO | NO |
| TJU_CMC_MD2.ID01815.5p-miR | TJU_CMC_MD2.ID01815.hairpin | YES | YES | YES | NO | NO | NO | NO | NO |
| TJU_CMC_MD2.ID01816.3p-miR | TJU_CMC_MD2.ID01816.hairpin | YES | NO | NO | NO | NO | NO | NO | NO |
| TJU_CMC_MD2.ID01817.3p-miR | TJU_CMC_MD2.ID01817.hairpin | YES | NO | NO | NO | NO | NO | NO | NO |
| TJU_CMC_MD2.ID01818.3p-miR | TJU_CMC_MD2.ID01818.hairpin | YES | NO | NO | NO | NO | NO | NO | NO |
| TJU_CMC_MD2.ID01819.5p-miR | TJU_CMC_MD2.ID01819.hairpin | YES | YES | YES | YES | NO | NO | NO | NO |
| TJU_CMC_MD2.ID01820.3p-miR | TJU_CMC_MD2.ID01820.hairpin | YES | NO | NO | NO | NO | NO | NO | NO |
| TJU_CMC_MD2.ID01821.3p-miR | TJU_CMC_MD2.ID01821.hairpin | YES | NO | NO | NO | NO | NO | NO | NO |
| TJU_CMC_MD2.ID01822.3p-miR | TJU_CMC_MD2.ID01822.hairpin | YES | NO | NO | NO | NO | NO | NO | NO |
| TJU_CMC_MD2.ID01822.5p-miR | TJU_CMC_MD2.ID01822.hairpin | YES | YES | NO | YES | YES | NO | NO | NO |
| TJU_CMC_MD2.ID01823.5p-miR | TJU_CMC_MD2.ID01823.hairpin | YES | NO | YES | YES | NO | NO | NO | NO |
| TJU_CMC_MD2.ID01824.3p-miR | TJU_CMC_MD2.ID01824.hairpin | YES | NO | NO | NO | NO | NO | NO | NO |
| TJU_CMC_MD2.ID01825.3p-miR | TJU_CMC_MD2.ID01825.hairpin | YES | NO | NO | NO | NO | NO | NO | NO |
| TJU_CMC_MD2.ID01826.3p-miR | TJU_CMC_MD2.ID01826.hairpin | YES | NO | NO | NO | NO | NO | NO | NO |
| TJU_CMC_MD2.ID01826.5p-miR | TJU_CMC_MD2.ID01826.hairpin | YES | NO | NO | NO | NO | NO | NO | NO |
| TJU_CMC_MD2.ID01827.3p-miR | TJU_CMC_MD2.ID01827.hairpin | YES | NO | NO | NO | NO | NO | NO | NO |
| TJU_CMC_MD2.ID01828.3p-miR | TJU_CMC_MD2.ID01828.hairpin | YES | YES | YES | YES | YES | NO | NO | NO |
| TJU_CMC_MD2.ID01829.5p-miR | TJU_CMC_MD2.ID01829.hairpin | YES | YES | YES | YES | YES | NO | NO | NO |
| TJU_CMC_MD2.ID01830.5p-miR | TJU_CMC_MD2.ID01830.hairpin | YES | YES | YES | YES | YES | NO | NO | NO |
| TJU_CMC_MD2.ID01831.3p-miR | TJU_CMC_MD2.ID01831.hairpin | YES | NO | NO | NO | NO | NO | NO | NO |
| TJU_CMC_MD2.ID01832.5p-miR | TJU_CMC_MD2.ID01832.hairpin | YES | YES | YES | NO | NO | NO | NO | NO |
| TJU_CMC_MD2.ID01833.3p-miR | TJU_CMC_MD2.ID01833.hairpin | YES | YES | YES | YES | YES | YES | NO | NO |
| TJU_CMC_MD2.ID01834.5p-miR | TJU_CMC_MD2.ID01834.hairpin | YES | YES | YES | YES | NO | NO | NO | NO |
| TJU_CMC_MD2.ID01835.3p-miR | TJU_CMC_MD2.ID01835.hairpin | YES | NO | NO | NO | NO | NO | NO | NO |
| TJU_CMC_MD2.ID01836.5p-miR | TJU_CMC_MD2.ID01836.hairpin | YES | YES | NO | NO | YES | NO | NO | NO |
| TJU_CMC_MD2.ID01837.3p-miR | TJU_CMC_MD2.ID01837.hairpin | YES | NO | NO | NO | NO | NO | NO | NO |
| TJU_CMC_MD2.ID01838.5p-miR | TJU_CMC_MD2.ID01838.hairpin | YES | YES | YES | NO | NO | NO | NO | NO |
| TJU_CMC_MD2.ID01839.3p-miR | TJU_CMC_MD2.ID01839.hairpin | YES | NO | NO | NO | NO | NO | NO | NO |
| TJU_CMC_MD2.ID01840.5p-miR | TJU_CMC_MD2.ID01840.hairpin | YES | YES | YES | YES | NO | NO | NO | NO |
| TJU_CMC_MD2.ID01841.3p-miR | TJU_CMC_MD2.ID01841.hairpin | YES | NO | NO | NO | NO | NO | NO | NO |
| TJU_CMC_MD2.ID01842.3p-miR | TJU_CMC_MD2.ID01842.hairpin | YES | NO | NO | NO | NO | NO | NO | NO |
| TJU_CMC_MD2.ID01842.5p-miR | TJU_CMC_MD2.ID01842.hairpin | YES | YES | YES | YES | NO | NO | NO | NO |
| TJU_CMC_MD2.ID01843.3p-miR | TJU_CMC_MD2.ID01843.hairpin | YES | NO | NO | NO | NO | NO | NO | NO |
| TJU_CMC_MD2.ID01844.5p-miR | TJU_CMC_MD2.ID01844.hairpin | YES | YES | YES | NO | NO | NO | NO | NO |
| TJU_CMC_MD2.ID01845.5p-miR | TJU_CMC_MD2.ID01845.hairpin | YES | YES | YES | YES | NO | NO | NO | NO |
| TJU_CMC_MD2.ID01846.5p-miR | TJU_CMC_MD2.ID01846.hairpin | YES | NO | NO | YES | NO | NO | NO | NO |
| TJU_CMC_MD2.ID01847.5p-miR | TJU_CMC_MD2.ID01847.hairpin | YES | YES | YES | YES | NO | YES | NO | NO |
| TJU_CMC_MD2.ID01848.5p-miR | TJU_CMC_MD2.ID01848.hairpin | YES | YES | YES | YES | YES | NO | NO | NO |
| TJU_CMC_MD2.ID01849.5p-miR | TJU_CMC_MD2.ID01849.hairpin | YES | YES | YES | NO | YES | NO | NO | NO |
| TJU_CMC_MD2.ID01850.5p-miR | TJU_CMC_MD2.ID01850.hairpin | YES | YES | YES | NO | NO | NO | NO | NO |
| TJU_CMC_MD2.ID01851.5p-miR | TJU_CMC_MD2.ID01851.hairpin | YES | YES | YES | YES | YES | NO | NO | NO |
| TJU_CMC_MD2.ID01852.3p-miR | TJU_CMC_MD2.ID01852.hairpin | YES | NO | NO | NO | NO | NO | NO | NO |
| TJU_CMC_MD2.ID01853.3p-miR | TJU_CMC_MD2.ID01853.hairpin | YES | NO | NO | NO | NO | NO | NO | NO |
| TJU_CMC_MD2.ID01854.5p-miR | TJU_CMC_MD2.ID01854.hairpin | YES | YES | YES | YES | NO | NO | NO | NO |
| TJU_CMC_MD2.ID01855.3p-miR | TJU_CMC_MD2.ID01855.hairpin | YES | NO | NO | NO | NO | NO | NO | NO |
| TJU_CMC_MD2.ID01856.3p-miR | TJU_CMC_MD2.ID01856.hairpin | YES | NO | NO | NO | NO | NO | NO | NO |
| TJU_CMC_MD2.ID01857.3p-miR | TJU_CMC_MD2.ID01857.hairpin | YES | NO | NO | NO | NO | NO | NO | NO |
| TJU_CMC_MD2.ID01858.3p-miR | TJU_CMC_MD2.ID01858.hairpin | YES | NO | NO | NO | NO | NO | NO | NO |
| TJU_CMC_MD2.ID01859.5p-miR | TJU_CMC_MD2.ID01859.hairpin | YES | YES | NO | YES | YES | NO | NO | NO |
| TJU_CMC_MD2.ID01860.3p-miR | TJU_CMC_MD2.ID01860.hairpin | YES | NO | NO | NO | NO | NO | NO | NO |
| TJU_CMC_MD2.ID01860.5p-miR | TJU_CMC_MD2.ID01860.hairpin | YES | YES | YES | YES | NO | NO | NO | NO |
| TJU_CMC_MD2.ID01861.3p-miR | TJU_CMC_MD2.ID01861.hairpin | YES | NO | NO | NO | NO | NO | NO | NO |
| TJU_CMC_MD2.ID01862.5p-miR | TJU_CMC_MD2.ID01862.hairpin | YES | NO | NO | NO | NO | NO | NO | NO |
| TJU_CMC_MD2.ID01863.5p-miR | TJU_CMC_MD2.ID01863.hairpin | YES | YES | YES | YES | NO | NO | NO | NO |
| TJU_CMC_MD2.ID01864.5p-miR | TJU_CMC_MD2.ID01864.hairpin | YES | YES | YES | NO | NO | NO | NO | NO |
| TJU_CMC_MD2.ID01865.3p-miR | TJU_CMC_MD2.ID01865.hairpin | YES | NO | NO | NO | NO | NO | NO | NO |
| TJU_CMC_MD2.ID01866.5p-miR | TJU_CMC_MD2.ID01866.hairpin | YES | YES | NO | NO | NO | NO | NO | NO |
| TJU_CMC_MD2.ID01867.3p-miR | TJU_CMC_MD2.ID01867.hairpin | YES | NO | NO | NO | NO | NO | NO | NO |
| TJU_CMC_MD2.ID01868.3p-miR | TJU_CMC_MD2.ID01868.hairpin | YES | NO | NO | NO | NO | NO | NO | NO |
| TJU_CMC_MD2.ID01869.3p-miR | TJU_CMC_MD2.ID01869.hairpin | YES | NO | NO | NO | NO | NO | NO | NO |
| TJU_CMC_MD2.ID01870.5p-miR | TJU_CMC_MD2.ID01870.hairpin | YES | NO | NO | NO | NO | NO | NO | NO |
| TJU_CMC_MD2.ID01871.3p-miR | TJU_CMC_MD2.ID01871.hairpin | YES | NO | NO | NO | NO | NO | NO | NO |
| TJU_CMC_MD2.ID01872.3p-miR | TJU_CMC_MD2.ID01872.hairpin | YES | NO | NO | NO | NO | NO | NO | NO |
| TJU_CMC_MD2.ID01873.3p-miR | TJU_CMC_MD2.ID01873.hairpin | YES | NO | NO | NO | NO | NO | NO | NO |
| TJU_CMC_MD2.ID01874.3p-miR | TJU_CMC_MD2.ID01874.hairpin | YES | NO | NO | NO | NO | NO | NO | NO |
| TJU_CMC_MD2.ID01875.3p-miR | TJU_CMC_MD2.ID01875.hairpin | YES | YES | YES | YES | NO | NO | NO | NO |
| TJU_CMC_MD2.ID01876.3p-miR | TJU_CMC_MD2.ID01876.hairpin | YES | NO | NO | NO | NO | NO | NO | NO |
| TJU_CMC_MD2.ID01877.3p-miR | TJU_CMC_MD2.ID01877.hairpin | YES | NO | NO | NO | NO | NO | NO | NO |
| TJU_CMC_MD2.ID01878.5p-miR | TJU_CMC_MD2.ID01878.hairpin | YES | YES | YES | YES | YES | NO | NO | NO |
| TJU_CMC_MD2.ID01879.5p-miR | TJU_CMC_MD2.ID01879.hairpin | YES | NO | NO | NO | NO | NO | NO | NO |
| TJU_CMC_MD2.ID01880.5p-miR | TJU_CMC_MD2.ID01880.hairpin | YES | NO | YES | YES | YES | NO | NO | NO |
| TJU_CMC_MD2.ID01881.5p-miR | TJU_CMC_MD2.ID01881.hairpin | YES | YES | YES | YES | NO | NO | NO | NO |
| TJU_CMC_MD2.ID01882.5p-miR | TJU_CMC_MD2.ID01882.hairpin | YES | NO | NO | NO | NO | NO | NO | NO |
| TJU_CMC_MD2.ID01883.5p-miR | TJU_CMC_MD2.ID01883.hairpin | YES | YES | NO | NO | NO | NO | NO | NO |
| TJU_CMC_MD2.ID01884.5p-miR | TJU_CMC_MD2.ID01884.hairpin | YES | YES | YES | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01885.5p-miR | TJU_CMC_MD2.ID01885.hairpin | YES | NO | NO | NO | NO | NO | NO | NO |
| TJU_CMC_MD2.ID01886.3p-miR | TJU_CMC_MD2.ID01886.hairpin | YES | NO | NO | NO | NO | NO | NO | NO |
| TJU_CMC_MD2.ID01887.5p-miR | TJU_CMC_MD2.ID01887.hairpin | YES | YES | YES | YES | YES | NO | NO | NO |
| TJU_CMC_MD2.ID01888.3p-miR | TJU_CMC_MD2.ID01888.hairpin | YES | NO | NO | NO | NO | NO | NO | NO |
| TJU_CMC_MD2.ID01889.3p-miR | TJU_CMC_MD2.ID01889.hairpin | YES | NO | NO | NO | NO | NO | NO | NO |
| TJU_CMC_MD2.ID01890.5p-miR | TJU_CMC_MD2.ID01890.hairpin | YES | NO | NO | NO | NO | NO | NO | NO |
| TJU_CMC_MD2.ID01891.3p-miR | TJU_CMC_MD2.ID01891.hairpin | YES | NO | NO | NO | NO | NO | NO | NO |
| TJU_CMC_MD2.ID01892.3p-miR | TJU_CMC_MD2.ID01892.hairpin | YES | NO | NO | NO | NO | NO | NO | NO |
| TJU_CMC_MD2.ID01893.3p-miR | TJU_CMC_MD2.ID01893.hairpin | YES | YES | YES | YES | NO | NO | NO | NO |
| TJU_CMC_MD2.ID01893.5p-miR | TJU_CMC_MD2.ID01893.hairpin | YES | YES | YES | NO | NO | NO | NO | NO |
| TJU_CMC_MD2.ID01894.3p-miR | TJU_CMC_MD2.ID01894.hairpin | YES | NO | NO | NO | NO | NO | NO | NO |
| TJU_CMC_MD2.ID01895.5p-miR | TJU_CMC_MD2.ID01895.hairpin | YES | NO | NO | NO | NO | NO | NO | NO |
| TJU_CMC_MD2.ID01896.3p-miR | TJU_CMC_MD2.ID01896.hairpin | YES | NO | NO | NO | NO | NO | NO | NO |
| TJU_CMC_MD2.ID01897.3p-miR | TJU_CMC_MD2.ID01897.hairpin | YES | NO | NO | NO | NO | NO | NO | NO |
| TJU_CMC_MD2.ID01898.3p-miR | TJU_CMC_MD2.ID01898.hairpin | YES | NO | NO | NO | NO | NO | NO | NO |
| TJU_CMC_MD2.ID01899.5p-miR | TJU_CMC_MD2.ID01899.hairpin | YES | NO | NO | NO | NO | NO | NO | NO |
| TJU_CMC_MD2.ID01900.5p-miR | TJU_CMC_MD2.ID01900.hairpin | YES | YES | YES | YES | NO | NO | NO | NO |
| TJU_CMC_MD2.ID01901.5p-miR | TJU_CMC_MD2.ID01901.hairpin | YES | NO | YES | NO | NO | NO | NO | NO |
| TJU_CMC_MD2.ID01902.5p-miR | TJU_CMC_MD2.ID01902.hairpin | YES | NO | YES | YES | YES | NO | NO | NO |
| TJU_CMC_MD2.ID01903.3p-miR | TJU_CMC_MD2.ID01903.hairpin | YES | NO | NO | NO | NO | NO | NO | NO |
| TJU_CMC_MD2.ID01904.3p-miR | TJU_CMC_MD2.ID01904.hairpin | YES | NO | NO | NO | NO | NO | NO | NO |
| TJU_CMC_MD2.ID01905.5p-miR | TJU_CMC_MD2.ID01905.hairpin | YES | YES | YES | NO | NO | NO | NO | NO |
| TJU_CMC_MD2.ID01906.3p-miR | TJU_CMC_MD2.ID01906.hairpin | YES | NO | NO | NO | NO | NO | NO | NO |
| TJU_CMC_MD2.ID01907.5p-miR | TJU_CMC_MD2.ID01907.hairpin | YES | YES | YES | NO | YES | NO | NO | NO |
| TJU_CMC_MD2.ID01908.3p-miR | TJU_CMC_MD2.ID01908.hairpin | YES | NO | NO | NO | NO | NO | NO | NO |
| TJU_CMC_MD2.ID01909.3p-miR | TJU_CMC_MD2.ID01909.hairpin | YES | NO | NO | NO | NO | NO | NO | NO |
| TJU_CMC_MD2.ID01910.3p-miR | TJU_CMC_MD2.ID01910.hairpin | YES | NO | NO | NO | NO | NO | NO | NO |
| TJU_CMC_MD2.ID01911.5p-miR | TJU_CMC_MD2.ID01911.hairpin | YES | NO | YES | YES | NO | NO | NO | NO |
| TJU_CMC_MD2.ID01912.5p-miR | TJU_CMC_MD2.ID01912.hairpin | YES | YES | YES | YES | NO | NO | NO | NO |
| TJU_CMC_MD2.ID01913.3p-miR | TJU_CMC_MD2.ID01913.hairpin | YES | NO | NO | NO | NO | NO | NO | NO |
| TJU_CMC_MD2.ID01914.5p-miR | TJU_CMC_MD2.ID01914.hairpin | YES | NO | YES | YES | NO | NO | NO | NO |
| TJU_CMC_MD2.ID01915.5p-miR | TJU_CMC_MD2.ID01915.hairpin | YES | NO | YES | NO | NO | NO | NO | NO |
| TJU_CMC_MD2.ID01916.5p-miR | TJU_CMC_MD2.ID01916.hairpin | YES | NO | NO | NO | NO | NO | NO | NO |
| TJU_CMC_MD2.ID01917.3p-miR | TJU_CMC_MD2.ID01917.hairpin | YES | NO | NO | NO | NO | NO | NO | NO |
| TJU_CMC_MD2.ID01918.5p-miR | TJU_CMC_MD2.ID01918.hairpin | YES | YES | YES | YES | YES | NO | NO | NO |
| TJU_CMC_MD2.ID01919.5p-miR | TJU_CMC_MD2.ID01919.hairpin | YES | YES | YES | YES | YES | YES | NO | NO |
| TJU_CMC_MD2.ID01920.3p-miR | TJU_CMC_MD2.ID01920.hairpin | YES | NO | NO | NO | NO | NO | NO | NO |
| TJU_CMC_MD2.ID01921.5p-miR | TJU_CMC_MD2.ID01921.hairpin | YES | NO | NO | NO | NO | YES | NO | NO |
| TJU_CMC_MD2.ID01922.3p-miR | TJU_CMC_MD2.ID01922.hairpin | YES | NO | NO | NO | NO | NO | NO | NO |
| TJU_CMC_MD2.ID01923.3p-miR | TJU_CMC_MD2.ID01923.hairpin | YES | NO | NO | NO | NO | NO | NO | NO |
| TJU_CMC_MD2.ID01924.5p-miR | TJU_CMC_MD2.ID01924.hairpin | YES | YES | YES | YES | YES | NO | NO | NO |
| TJU_CMC_MD2.ID01925.5p-miR | TJU_CMC_MD2.ID01925.hairpin | YES | YES | YES | YES | YES | NO | NO | NO |
| TJU_CMC_MD2.ID01926.3p-miR | TJU_CMC_MD2.ID01926.hairpin | YES | NO | NO | NO | NO | NO | NO | NO |
| TJU_CMC_MD2.ID01927.5p-miR | TJU_CMC_MD2.ID01927.hairpin | YES | YES | YES | NO | NO | NO | NO | NO |
| TJU_CMC_MD2.ID01928.3p-miR | TJU_CMC_MD2.ID01928.hairpin | YES | NO | NO | NO | NO | NO | NO | NO |
| TJU_CMC_MD2.ID01929.3p-miR | TJU_CMC_MD2.ID01929.hairpin | YES | NO | NO | NO | NO | NO | NO | NO |
| TJU_CMC_MD2.ID01930.3p-miR | TJU_CMC_MD2.ID01930.hairpin | YES | NO | NO | NO | NO | NO | NO | NO |
| TJU_CMC_MD2.ID01931.5p-miR | TJU_CMC_MD2.ID01931.hairpin | YES | NO | YES | NO | NO | NO | NO | NO |
| TJU_CMC_MD2.ID01932.5p-miR | TJU_CMC_MD2.ID01932.hairpin | YES | NO | YES | NO | NO | NO | NO | NO |
| TJU_CMC_MD2.ID01933.3p-miR | TJU_CMC_MD2.ID01933.hairpin | YES | NO | NO | NO | NO | NO | NO | NO |
| TJU_CMC_MD2.ID01934.5p-miR | TJU_CMC_MD2.ID01934.hairpin | YES | YES | YES | NO | NO | NO | NO | NO |
| TJU_CMC_MD2.ID01935.5p-miR | TJU_CMC_MD2.ID01935.hairpin | YES | NO | YES | YES | NO | NO | NO | NO |
| TJU_CMC_MD2.ID01936.5p-miR | TJU_CMC_MD2.ID01936.hairpin | YES | YES | YES | YES | NO | NO | NO | NO |
| TJU_CMC_MD2.ID01937.3p-miR | TJU_CMC_MD2.ID01937.hairpin | YES | NO | NO | NO | NO | NO | NO | NO |
| TJU_CMC_MD2.ID01938.5p-miR | TJU_CMC_MD2.ID01938.hairpin | YES | YES | YES | YES | NO | NO | NO | NO |
| TJU_CMC_MD2.ID01939.5p-miR | TJU_CMC_MD2.ID01939.hairpin | YES | YES | YES | YES | NO | NO | NO | NO |
| TJU_CMC_MD2.ID01940.3p-miR | TJU_CMC_MD2.ID01940.hairpin | YES | NO | NO | NO | NO | NO | NO | NO |
| TJU_CMC_MD2.ID01941.5p-miR | TJU_CMC_MD2.ID01941.hairpin | YES | NO | YES | NO | NO | NO | NO | NO |
| TJU_CMC_MD2.ID01942.3p-miR | TJU_CMC_MD2.ID01942.hairpin | YES | NO | NO | NO | NO | NO | NO | NO |
| TJU_CMC_MD2.ID01943.5p-miR | TJU_CMC_MD2.ID01943.hairpin | YES | NO | NO | YES | YES | NO | NO | NO |
| TJU_CMC_MD2.ID01944.5p-miR | TJU_CMC_MD2.ID01944.hairpin | YES | NO | YES | YES | NO | NO | NO | NO |
| TJU_CMC_MD2.ID01945.3p-miR | TJU_CMC_MD2.ID01945.hairpin | YES | NO | NO | NO | NO | NO | NO | NO |
| TJU_CMC_MD2.ID01946.3p-miR | TJU_CMC_MD2.ID01946.hairpin | YES | NO | NO | NO | NO | NO | NO | NO |
| TJU_CMC_MD2.ID01947.5p-miR | TJU_CMC_MD2.ID01947.hairpin | YES | YES | YES | NO | NO | NO | NO | NO |
| TJU_CMC_MD2.ID01948.5p-miR | TJU_CMC_MD2.ID01948.hairpin | YES | NO | NO | YES | NO | NO | NO | NO |
| TJU_CMC_MD2.ID01949.3p-miR | TJU_CMC_MD2.ID01949.hairpin | YES | NO | NO | NO | NO | NO | NO | NO |
| TJU_CMC_MD2.ID01950.3p-miR | TJU_CMC_MD2.ID01950.hairpin | YES | NO | NO | NO | NO | NO | NO | NO |
| TJU_CMC_MD2.ID01950.5p-miR | TJU_CMC_MD2.ID01950.hairpin | YES | NO | YES | YES | YES | NO | NO | NO |
| TJU_CMC_MD2.ID01951.3p-miR | TJU_CMC_MD2.ID01951.hairpin | YES | NO | NO | NO | NO | NO | NO | NO |
| TJU_CMC_MD2.ID01952.5p-miR | TJU_CMC_MD2.ID01952.hairpin | YES | NO | YES | YES | NO | NO | NO | NO |
| TJU_CMC_MD2.ID01953.5p-miR | TJU_CMC_MD2.ID01953.hairpin | YES | YES | YES | NO | NO | NO | NO | NO |
| TJU_CMC_MD2.ID01954.3p-miR | TJU_CMC_MD2.ID01954.hairpin | YES | NO | NO | NO | NO | NO | NO | NO |
| TJU_CMC_MD2.ID01955.3p-miR | TJU_CMC_MD2.ID01955.hairpin | YES | NO | NO | NO | NO | NO | NO | NO |
| TJU_CMC_MD2.ID01956.5p-miR | TJU_CMC_MD2.ID01956.hairpin | YES | NO | YES | NO | NO | NO | NO | NO |
| TJU_CMC_MD2.ID01957.3p-miR | TJU_CMC_MD2.ID01957.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID01958.3p-miR | TJU_CMC_MD2.ID01958.hairpin | YES | NO | NO | NO | NO | NO | NO | NO |
| TJU_CMC_MD2.ID01959.3p-miR | TJU_CMC_MD2.ID01959.hairpin | YES | NO | NO | NO | NO | NO | NO | NO |
| TJU_CMC_MD2.ID01959.5p-miR | TJU_CMC_MD2.ID01959.hairpin | YES | NO | NO | YES | NO | NO | NO | NO |
| TJU_CMC_MD2.ID01960.3p-miR | TJU_CMC_MD2.ID01960.hairpin | YES | NO | NO | NO | NO | NO | NO | NO |
| TJU_CMC_MD2.ID01961.5p-miR | TJU_CMC_MD2.ID01961.hairpin | YES | YES | YES | YES | NO | NO | NO | NO |
| TJU_CMC_MD2.ID01962.3p-miR | TJU_CMC_MD2.ID01962.hairpin | YES | NO | NO | NO | NO | NO | NO | NO |
| TJU_CMC_MD2.ID01963.3p-miR | TJU_CMC_MD2.ID01963.hairpin | YES | NO | NO | NO | NO | NO | NO | NO |
| TJU_CMC_MD2.ID01963.5p-miR | TJU_CMC_MD2.ID01963.hairpin | YES | NO | NO | NO | NO | NO | NO | NO |
| TJU_CMC_MD2.ID01964.3p-miR | TJU_CMC_MD2.ID01964.hairpin | YES | NO | NO | NO | NO | NO | NO | NO |
| TJU_CMC_MD2.ID01965.5p-miR | TJU_CMC_MD2.ID01965.hairpin | YES | NO | NO | NO | NO | NO | NO | NO |
| TJU_CMC_MD2.ID01966.5p-miR | TJU_CMC_MD2.ID01966.hairpin | YES | YES | YES | YES | YES | YES | NO | NO |
| TJU_CMC_MD2.ID01967.5p-miR | TJU_CMC_MD2.ID01967.hairpin | YES | NO | YES | YES | YES | NO | NO | NO |
| TJU_CMC_MD2.ID01968.3p-miR | TJU_CMC_MD2.ID01968.hairpin | YES | NO | NO | NO | NO | NO | NO | NO |
| TJU_CMC_MD2.ID01969.3p-miR | TJU_CMC_MD2.ID01969.hairpin | YES | NO | NO | NO | NO | NO | NO | NO |
| TJU_CMC_MD2.ID01970.3p-miR | TJU_CMC_MD2.ID01970.hairpin | YES | NO | NO | NO | NO | NO | NO | NO |
| TJU_CMC_MD2.ID01971.3p-miR | TJU_CMC_MD2.ID01971.hairpin | YES | YES | YES | NO | NO | NO | NO | NO |
| TJU_CMC_MD2.ID01972.5p-miR | TJU_CMC_MD2.ID01972.hairpin | YES | YES | YES | YES | NO | NO | NO | NO |
| TJU_CMC_MD2.ID01973.3p-miR | TJU_CMC_MD2.ID01973.hairpin | YES | NO | NO | NO | NO | NO | NO | NO |
| TJU_CMC_MD2.ID01974.5p-miR | TJU_CMC_MD2.ID01974.hairpin | YES | NO | YES | YES | YES | NO | NO | NO |
| TJU_CMC_MD2.ID01975.3p-miR | TJU_CMC_MD2.ID01975.hairpin | YES | NO | NO | NO | NO | NO | NO | NO |
| TJU_CMC_MD2.ID01976.5p-miR | TJU_CMC_MD2.ID01976.hairpin | YES | YES | YES | YES | NO | NO | NO | NO |
| TJU_CMC_MD2.ID01977.3p-miR | TJU_CMC_MD2.ID01977.hairpin | YES | NO | NO | NO | NO | NO | NO | NO |
| TJU_CMC_MD2.ID01978.5p-miR | TJU_CMC_MD2.ID01978.hairpin | YES | NO | NO | NO | NO | NO | NO | NO |
| TJU_CMC_MD2.ID01979.3p-miR | TJU_CMC_MD2.ID01979.hairpin | YES | NO | NO | NO | NO | NO | NO | NO |
| TJU_CMC_MD2.ID01980.5p-miR | TJU_CMC_MD2.ID01980.hairpin | YES | YES | YES | NO | YES | NO | NO | NO |
| TJU_CMC_MD2.ID01981.3p-miR | TJU_CMC_MD2.ID01981.hairpin | YES | NO | NO | NO | NO | NO | NO | NO |
| TJU_CMC_MD2.ID01982.5p-miR | TJU_CMC_MD2.ID01982.hairpin | YES | YES | YES | YES | NO | NO | NO | NO |
| TJU_CMC_MD2.ID01983.3p-miR | TJU_CMC_MD2.ID01983.hairpin | YES | NO | NO | NO | NO | NO | NO | NO |
| TJU_CMC_MD2.ID01984.3p-miR | TJU_CMC_MD2.ID01984.hairpin | YES | NO | NO | NO | NO | NO | NO | NO |
| TJU_CMC_MD2.ID01985.5p-miR | TJU_CMC_MD2.ID01985.hairpin | YES | NO | NO | NO | NO | NO | NO | NO |
| TJU_CMC_MD2.ID01986.5p-miR | TJU_CMC_MD2.ID01986.hairpin | YES | NO | YES | YES | NO | NO | NO | NO |
| TJU_CMC_MD2.ID01987.3p-miR | TJU_CMC_MD2.ID01987.hairpin | YES | NO | NO | NO | NO | NO | NO | NO |
| TJU_CMC_MD2.ID01988.5p-miR | TJU_CMC_MD2.ID01988.hairpin | YES | NO | YES | YES | NO | NO | NO | NO |
| TJU_CMC_MD2.ID01989.5p-miR | TJU_CMC_MD2.ID01989.hairpin | YES | NO | NO | YES | NO | NO | NO | NO |
| TJU_CMC_MD2.ID01990.3p-miR | TJU_CMC_MD2.ID01990.hairpin | YES | NO | NO | NO | NO | NO | NO | NO |
| TJU_CMC_MD2.ID01991.5p-miR | TJU_CMC_MD2.ID01991.hairpin | YES | NO | YES | NO | YES | NO | NO | NO |
| TJU_CMC_MD2.ID01992.3p-miR | TJU_CMC_MD2.ID01992.hairpin | YES | NO | NO | NO | NO | NO | NO | NO |
| TJU_CMC_MD2.ID01993.3p-miR | TJU_CMC_MD2.ID01993.hairpin | YES | NO | NO | NO | NO | NO | NO | NO |
| TJU_CMC_MD2.ID01994.3p-miR | TJU_CMC_MD2.ID01994.hairpin | YES | NO | NO | NO | NO | NO | NO | NO |
| TJU_CMC_MD2.ID01995.3p-miR | TJU_CMC_MD2.ID01995.hairpin | YES | NO | NO | NO | NO | NO | NO | NO |
| TJU_CMC_MD2.ID01996.3p-miR | TJU_CMC_MD2.ID01996.hairpin | YES | NO | NO | NO | NO | NO | NO | NO |
| TJU_CMC_MD2.ID01997.5p-miR | TJU_CMC_MD2.ID01997.hairpin | YES | YES | YES | NO | NO | NO | NO | NO |
| TJU_CMC_MD2.ID01998.3p-miR | TJU_CMC_MD2.ID01998.hairpin | YES | NO | NO | NO | NO | NO | NO | NO |
| TJU_CMC_MD2.ID01999.3p-miR | TJU_CMC_MD2.ID01999.hairpin | YES | NO | NO | NO | NO | NO | NO | NO |
| TJU_CMC_MD2.ID01999.5p-miR | TJU_CMC_MD2.ID01999.hairpin | YES | NO | YES | YES | YES | NO | NO | NO |
| TJU_CMC_MD2.ID02000.3p-miR | TJU_CMC_MD2.ID02000.hairpin | YES | NO | NO | NO | NO | NO | NO | NO |
| TJU_CMC_MD2.ID02001.5p-miR | TJU_CMC_MD2.ID02001.hairpin | YES | NO | YES | YES | YES | NO | NO | NO |
| TJU_CMC_MD2.ID02002.5p-miR | TJU_CMC_MD2.ID02002.hairpin | YES | YES | NO | NO | NO | NO | NO | NO |
| TJU_CMC_MD2.ID02003.3p-miR | TJU_CMC_MD2.ID02003.hairpin | YES | NO | NO | NO | NO | NO | NO | NO |
| TJU_CMC_MD2.ID02004.3p-miR | TJU_CMC_MD2.ID02004.hairpin | YES | NO | NO | NO | NO | NO | NO | NO |
| TJU_CMC_MD2.ID02005.5p-miR | TJU_CMC_MD2.ID02005.hairpin | YES | NO | NO | NO | NO | NO | NO | NO |
| TJU_CMC_MD2.ID02006.3p-miR | TJU_CMC_MD2.ID02006.hairpin | YES | NO | NO | NO | NO | NO | NO | NO |
| TJU_CMC_MD2.ID02007.3p-miR | TJU_CMC_MD2.ID02007.hairpin | YES | NO | NO | NO | NO | NO | NO | NO |
| TJU_CMC_MD2.ID02008.5p-miR | TJU_CMC_MD2.ID02008.hairpin | YES | NO | YES | YES | YES | NO | NO | NO |
| TJU_CMC_MD2.ID02009.5p-miR | TJU_CMC_MD2.ID02009.hairpin | YES | YES | NO | YES | NO | NO | NO | NO |
| TJU_CMC_MD2.ID02010.3p-miR | TJU_CMC_MD2.ID02010.hairpin | YES | NO | NO | NO | NO | NO | NO | NO |
| TJU_CMC_MD2.ID02011.3p-miR | TJU_CMC_MD2.ID02011.hairpin | YES | NO | NO | NO | NO | NO | NO | NO |
| TJU_CMC_MD2.ID02012.5p-miR | TJU_CMC_MD2.ID02012.hairpin | YES | YES | NO | YES | NO | NO | NO | NO |
| TJU_CMC_MD2.ID02013.3p-miR | TJU_CMC_MD2.ID02013.hairpin | YES | NO | NO | NO | NO | NO | NO | NO |
| TJU_CMC_MD2.ID02014.5p-miR | TJU_CMC_MD2.ID02014.hairpin | YES | NO | NO | NO | NO | NO | NO | NO |
| TJU_CMC_MD2.ID02015.5p-miR | TJU_CMC_MD2.ID02015.hairpin | YES | NO | YES | NO | NO | NO | NO | NO |
| TJU_CMC_MD2.ID02016.3p-miR | TJU_CMC_MD2.ID02016.hairpin | YES | NO | NO | NO | NO | NO | NO | NO |
| TJU_CMC_MD2.ID02017.3p-miR | TJU_CMC_MD2.ID02017.hairpin | YES | NO | NO | NO | NO | NO | NO | NO |
| TJU_CMC_MD2.ID02018.3p-miR | TJU_CMC_MD2.ID02018.hairpin | YES | NO | NO | NO | NO | NO | NO | NO |
| TJU_CMC_MD2.ID02019.3p-miR | TJU_CMC_MD2.ID02019.hairpin | YES | NO | NO | NO | NO | NO | NO | NO |
| TJU_CMC_MD2.ID02020.3p-miR | TJU_CMC_MD2.ID02020.hairpin | YES | NO | NO | NO | NO | NO | NO | NO |
| TJU_CMC_MD2.ID02021.3p-miR | TJU_CMC_MD2.ID02021.hairpin | YES | NO | NO | NO | NO | NO | NO | NO |
| TJU_CMC_MD2.ID02022.5p-miR | TJU_CMC_MD2.ID02022.hairpin | YES | YES | YES | NO | YES | NO | NO | NO |
| TJU_CMC_MD2.ID02023.5p-miR | TJU_CMC_MD2.ID02023.hairpin | YES | YES | YES | YES | NO | NO | NO | NO |
| TJU_CMC_MD2.ID02024.3p-miR | TJU_CMC_MD2.ID02024.hairpin | YES | NO | NO | NO | NO | NO | NO | NO |
| TJU_CMC_MD2.ID02025.5p-miR | TJU_CMC_MD2.ID02025.hairpin | YES | YES | YES | YES | YES | NO | NO | NO |
| TJU_CMC_MD2.ID02026.5p-miR | TJU_CMC_MD2.ID02026.hairpin | YES | YES | YES | YES | YES | NO | NO | NO |
| TJU_CMC_MD2.ID02027.3p-miR | TJU_CMC_MD2.ID02027.hairpin | YES | NO | NO | NO | NO | NO | NO | NO |
| TJU_CMC_MD2.ID02028.3p-miR | TJU_CMC_MD2.ID02028.hairpin | YES | NO | NO | NO | NO | NO | NO | NO |
| TJU_CMC_MD2.ID02029.5p-miR | TJU_CMC_MD2.ID02029.hairpin | YES | YES | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02030.3p-miR | TJU_CMC_MD2.ID02030.hairpin | YES | NO | NO | NO | NO | NO | NO | NO |
| TJU_CMC_MD2.ID02031.5p-miR | TJU_CMC_MD2.ID02031.hairpin | YES | YES | YES | YES | YES | NO | NO | NO |
| TJU_CMC_MD2.ID02032.5p-miR | TJU_CMC_MD2.ID02032.hairpin | YES | NO | NO | NO | NO | NO | NO | NO |
| TJU_CMC_MD2.ID02033.5p-miR | TJU_CMC_MD2.ID02033.hairpin | YES | YES | YES | YES | NO | NO | NO | NO |
| TJU_CMC_MD2.ID02034.5p-miR | TJU_CMC_MD2.ID02034.hairpin | YES | YES | YES | YES | YES | NO | NO | NO |
| TJU_CMC_MD2.ID02035.5p-miR | TJU_CMC_MD2.ID02035.hairpin | YES | YES | YES | YES | YES | NO | NO | NO |
| TJU_CMC_MD2.ID02036.3p-miR | TJU_CMC_MD2.ID02036.hairpin | YES | NO | NO | NO | NO | NO | NO | NO |
| TJU_CMC_MD2.ID02037.5p-miR | TJU_CMC_MD2.ID02037.hairpin | YES | NO | NO | NO | NO | NO | NO | NO |
| TJU_CMC_MD2.ID02038.5p-miR | TJU_CMC_MD2.ID02038.hairpin | YES | YES | YES | YES | NO | NO | NO | NO |
| TJU_CMC_MD2.ID02039.3p-miR | TJU_CMC_MD2.ID02039.hairpin | YES | NO | NO | NO | NO | NO | NO | NO |
| TJU_CMC_MD2.ID02040.5p-miR | TJU_CMC_MD2.ID02040.hairpin | YES | YES | YES | YES | NO | NO | NO | NO |
| TJU_CMC_MD2.ID02041.3p-miR | TJU_CMC_MD2.ID02041.hairpin | YES | NO | NO | NO | NO | NO | NO | NO |
| TJU_CMC_MD2.ID02042.5p-miR | TJU_CMC_MD2.ID02042.hairpin | YES | NO | YES | NO | NO | NO | NO | NO |
| TJU_CMC_MD2.ID02043.3p-miR | TJU_CMC_MD2.ID02043.hairpin | YES | NO | YES | NO | NO | NO | NO | NO |
| TJU_CMC_MD2.ID02043.5p-miR | TJU_CMC_MD2.ID02043.hairpin | YES | NO | YES | NO | NO | NO | NO | NO |
| TJU_CMC_MD2.ID02044.3p-miR | TJU_CMC_MD2.ID02044.hairpin | YES | NO | NO | NO | NO | NO | NO | NO |
| TJU_CMC_MD2.ID02045.3p-miR | TJU_CMC_MD2.ID02045.hairpin | YES | NO | NO | NO | NO | NO | NO | NO |
| TJU_CMC_MD2.ID02046.3p-miR | TJU_CMC_MD2.ID02046.hairpin | YES | NO | NO | NO | NO | NO | NO | NO |
| TJU_CMC_MD2.ID02047.5p-miR | TJU_CMC_MD2.ID02047.hairpin | YES | NO | NO | NO | NO | NO | NO | NO |
| TJU_CMC_MD2.ID02048.3p-miR | TJU_CMC_MD2.ID02048.hairpin | YES | NO | NO | NO | NO | NO | NO | NO |
| TJU_CMC_MD2.ID02049.3p-miR | TJU_CMC_MD2.ID02049.hairpin | YES | NO | NO | NO | NO | NO | NO | NO |
| TJU_CMC_MD2.ID02050.3p-miR | TJU_CMC_MD2.ID02050.hairpin | YES | NO | NO | NO | NO | NO | NO | NO |
| TJU_CMC_MD2.ID02050.5p-miR | TJU_CMC_MD2.ID02050.hairpin | YES | YES | YES | YES | YES | NO | NO | NO |
| TJU_CMC_MD2.ID02051.3p-miR | TJU_CMC_MD2.ID02051.hairpin | YES | NO | NO | NO | NO | NO | NO | NO |
| TJU_CMC_MD2.ID02052.5p-miR | TJU_CMC_MD2.ID02052.hairpin | YES | NO | NO | NO | NO | YES | NO | NO |
| TJU_CMC_MD2.ID02053.5p-miR | TJU_CMC_MD2.ID02053.hairpin | YES | NO | YES | NO | NO | NO | NO | NO |
| TJU_CMC_MD2.ID02054.3p-miR | TJU_CMC_MD2.ID02054.hairpin | YES | NO | NO | NO | NO | NO | NO | NO |
| TJU_CMC_MD2.ID02055.5p-miR | TJU_CMC_MD2.ID02055.hairpin | YES | YES | YES | YES | YES | NO | NO | NO |
| TJU_CMC_MD2.ID02056.3p-miR | TJU_CMC_MD2.ID02056.hairpin | YES | NO | NO | NO | NO | NO | NO | NO |
| TJU_CMC_MD2.ID02057.3p-miR | TJU_CMC_MD2.ID02057.hairpin | YES | NO | NO | NO | NO | NO | NO | NO |
| TJU_CMC_MD2.ID02058.5p-miR | TJU_CMC_MD2.ID02058.hairpin | YES | NO | YES | NO | NO | NO | NO | NO |
| TJU_CMC_MD2.ID02059.3p-miR | TJU_CMC_MD2.ID02059.hairpin | YES | NO | YES | NO | YES | NO | NO | NO |
| TJU_CMC_MD2.ID02059.5p-miR | TJU_CMC_MD2.ID02059.hairpin | YES | NO | YES | NO | YES | NO | NO | NO |
| TJU_CMC_MD2.ID02060.3p-miR | TJU_CMC_MD2.ID02060.hairpin | YES | NO | NO | NO | NO | NO | NO | NO |
| TJU_CMC_MD2.ID02061.3p-miR | TJU_CMC_MD2.ID02061.hairpin | YES | NO | NO | NO | NO | NO | NO | NO |
| TJU_CMC_MD2.ID02062.3p-miR | TJU_CMC_MD2.ID02062.hairpin | YES | NO | NO | NO | NO | NO | NO | NO |
| TJU_CMC_MD2.ID02063.5p-miR | TJU_CMC_MD2.ID02063.hairpin | YES | YES | YES | YES | YES | NO | NO | NO |
| TJU_CMC_MD2.ID02064.5p-miR | TJU_CMC_MD2.ID02064.hairpin | YES | YES | NO | YES | NO | NO | NO | NO |
| TJU_CMC_MD2.ID02065.5p-miR | TJU_CMC_MD2.ID02065.hairpin | YES | NO | NO | NO | NO | NO | NO | NO |
| TJU_CMC_MD2.ID02066.5p-miR | TJU_CMC_MD2.ID02066.hairpin | YES | YES | NO | NO | NO | NO | NO | NO |
| TJU_CMC_MD2.ID02067.3p-miR | TJU_CMC_MD2.ID02067.hairpin | YES | NO | NO | NO | NO | NO | NO | NO |
| TJU_CMC_MD2.ID02068.5p-miR | TJU_CMC_MD2.ID02068.hairpin | YES | YES | NO | NO | NO | NO | NO | NO |
| TJU_CMC_MD2.ID02069.5p-miR | TJU_CMC_MD2.ID02069.hairpin | YES | YES | NO | YES | YES | NO | NO | NO |
| TJU_CMC_MD2.ID02070.5p-miR | TJU_CMC_MD2.ID02070.hairpin | YES | YES | YES | YES | YES | NO | NO | NO |
| TJU_CMC_MD2.ID02071.3p-miR | TJU_CMC_MD2.ID02071.hairpin | YES | NO | NO | NO | NO | NO | NO | NO |
| TJU_CMC_MD2.ID02072.3p-miR | TJU_CMC_MD2.ID02072.hairpin | YES | NO | NO | NO | NO | NO | NO | NO |
| TJU_CMC_MD2.ID02073.5p-miR | TJU_CMC_MD2.ID02073.hairpin | YES | YES | YES | YES | YES | NO | NO | NO |
| TJU_CMC_MD2.ID02074.3p-miR | TJU_CMC_MD2.ID02074.hairpin | YES | NO | NO | NO | NO | NO | NO | NO |
| TJU_CMC_MD2.ID02074.5p-miR | TJU_CMC_MD2.ID02074.hairpin | YES | YES | YES | YES | YES | NO | NO | NO |
| TJU_CMC_MD2.ID02075.3p-miR | TJU_CMC_MD2.ID02075.hairpin | YES | NO | NO | NO | NO | NO | NO | NO |
| TJU_CMC_MD2.ID02076.5p-miR | TJU_CMC_MD2.ID02076.hairpin | YES | YES | YES | YES | NO | YES | NO | NO |
| TJU_CMC_MD2.ID02077.3p-miR | TJU_CMC_MD2.ID02077.hairpin | YES | NO | NO | NO | NO | NO | NO | NO |
| TJU_CMC_MD2.ID02078.5p-miR | TJU_CMC_MD2.ID02078.hairpin | YES | YES | YES | YES | YES | NO | NO | NO |
| TJU_CMC_MD2.ID02079.5p-miR | TJU_CMC_MD2.ID02079.hairpin | YES | YES | NO | NO | NO | NO | NO | NO |
| TJU_CMC_MD2.ID02080.3p-miR | TJU_CMC_MD2.ID02080.hairpin | YES | NO | NO | NO | NO | NO | NO | NO |
| TJU_CMC_MD2.ID02081.5p-miR | TJU_CMC_MD2.ID02081.hairpin | YES | YES | YES | NO | YES | NO | NO | NO |
| TJU_CMC_MD2.ID02082.3p-miR | TJU_CMC_MD2.ID02082.hairpin | YES | NO | NO | NO | NO | NO | NO | NO |
| TJU_CMC_MD2.ID02083.3p-miR | TJU_CMC_MD2.ID02083.hairpin | YES | NO | NO | NO | NO | NO | NO | NO |
| TJU_CMC_MD2.ID02084.3p-miR | TJU_CMC_MD2.ID02084.hairpin | YES | NO | NO | NO | NO | NO | NO | NO |
| TJU_CMC_MD2.ID02085.3p-miR | TJU_CMC_MD2.ID02085.hairpin | YES | NO | NO | NO | NO | NO | NO | NO |
| TJU_CMC_MD2.ID02085.5p-miR | TJU_CMC_MD2.ID02085.hairpin | YES | YES | YES | YES | YES | NO | NO | NO |
| TJU_CMC_MD2.ID02086.5p-miR | TJU_CMC_MD2.ID02086.hairpin | YES | NO | NO | NO | NO | NO | NO | NO |
| TJU_CMC_MD2.ID02087.5p-miR | TJU_CMC_MD2.ID02087.hairpin | YES | NO | YES | NO | NO | NO | NO | NO |
| TJU_CMC_MD2.ID02088.3p-miR | TJU_CMC_MD2.ID02088.hairpin | YES | NO | NO | NO | NO | NO | NO | NO |
| TJU_CMC_MD2.ID02088.5p-miR | TJU_CMC_MD2.ID02088.hairpin | YES | NO | YES | NO | YES | NO | NO | NO |
| TJU_CMC_MD2.ID02089.3p-miR | TJU_CMC_MD2.ID02089.hairpin | YES | NO | NO | NO | NO | NO | NO | NO |
| TJU_CMC_MD2.ID02090.3p-miR | TJU_CMC_MD2.ID02090.hairpin | YES | NO | NO | NO | NO | NO | NO | NO |
| TJU_CMC_MD2.ID02091.5p-miR | TJU_CMC_MD2.ID02091.hairpin | YES | YES | YES | YES | NO | NO | NO | NO |
| TJU_CMC_MD2.ID02092.5p-miR | TJU_CMC_MD2.ID02092.hairpin | YES | YES | YES | NO | NO | NO | NO | NO |
| TJU_CMC_MD2.ID02093.5p-miR | TJU_CMC_MD2.ID02093.hairpin | YES | YES | YES | NO | NO | NO | NO | NO |
| TJU_CMC_MD2.ID02094.3p-miR | TJU_CMC_MD2.ID02094.hairpin | YES | NO | NO | NO | NO | NO | NO | NO |
| TJU_CMC_MD2.ID02095.3p-miR | TJU_CMC_MD2.ID02095.hairpin | YES | NO | NO | NO | NO | NO | NO | NO |
| TJU_CMC_MD2.ID02096.3p-miR | TJU_CMC_MD2.ID02096.hairpin | YES | NO | NO | NO | NO | NO | NO | NO |
| TJU_CMC_MD2.ID02096.5p-miR | TJU_CMC_MD2.ID02096.hairpin | YES | YES | YES | YES | YES | NO | NO | NO |
| TJU_CMC_MD2.ID02097.3p-miR | TJU_CMC_MD2.ID02097.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02098.3p-miR | TJU_CMC_MD2.ID02098.hairpin | YES | NO | NO | NO | NO | NO | NO | NO |
| TJU_CMC_MD2.ID02099.5p-miR | TJU_CMC_MD2.ID02099.hairpin | YES | YES | NO | YES | NO | NO | NO | NO |
| TJU_CMC_MD2.ID02100.3p-miR | TJU_CMC_MD2.ID02100.hairpin | YES | NO | NO | NO | NO | NO | NO | NO |
| TJU_CMC_MD2.ID02101.3p-miR | TJU_CMC_MD2.ID02101.hairpin | YES | NO | NO | NO | NO | NO | NO | NO |
| TJU_CMC_MD2.ID02102.5p-miR | TJU_CMC_MD2.ID02102.hairpin | YES | YES | YES | YES | YES | NO | NO | NO |
| TJU_CMC_MD2.ID02103.5p-miR | TJU_CMC_MD2.ID02103.hairpin | YES | YES | YES | YES | NO | NO | NO | NO |
| TJU_CMC_MD2.ID02104.5p-miR | TJU_CMC_MD2.ID02104.hairpin | YES | YES | NO | YES | YES | YES | NO | NO |
| TJU_CMC_MD2.ID02105.3p-miR | TJU_CMC_MD2.ID02105.hairpin | YES | NO | NO | NO | NO | NO | NO | NO |
| TJU_CMC_MD2.ID02106.3p-miR | TJU_CMC_MD2.ID02106.hairpin | YES | NO | NO | NO | NO | NO | NO | NO |
| TJU_CMC_MD2.ID02107.5p-miR | TJU_CMC_MD2.ID02107.hairpin | YES | YES | YES | YES | NO | NO | NO | NO |
| TJU_CMC_MD2.ID02108.3p-miR | TJU_CMC_MD2.ID02108.hairpin | YES | NO | NO | NO | NO | NO | NO | NO |
| TJU_CMC_MD2.ID02109.5p-miR | TJU_CMC_MD2.ID02109.hairpin | YES | NO | YES | NO | NO | NO | NO | NO |
| TJU_CMC_MD2.ID02110.5p-miR | TJU_CMC_MD2.ID02110.hairpin | YES | YES | YES | YES | YES | NO | NO | NO |
| TJU_CMC_MD2.ID02111.3p-miR | TJU_CMC_MD2.ID02111.hairpin | YES | NO | NO | NO | NO | NO | NO | NO |
| TJU_CMC_MD2.ID02112.3p-miR | TJU_CMC_MD2.ID02112.hairpin | YES | NO | NO | NO | NO | NO | NO | NO |
| TJU_CMC_MD2.ID02113.5p-miR | TJU_CMC_MD2.ID02113.hairpin | YES | YES | YES | NO | NO | NO | NO | NO |
| TJU_CMC_MD2.ID02114.3p-miR | TJU_CMC_MD2.ID02114.hairpin | YES | NO | NO | NO | NO | NO | NO | NO |
| TJU_CMC_MD2.ID02115.5p-miR | TJU_CMC_MD2.ID02115.hairpin | YES | NO | NO | NO | NO | NO | NO | NO |
| TJU_CMC_MD2.ID02116.3p-miR | TJU_CMC_MD2.ID02116.hairpin | YES | NO | NO | NO | NO | NO | NO | NO |
| TJU_CMC_MD2.ID02117.3p-miR | TJU_CMC_MD2.ID02117.hairpin | YES | NO | YES | NO | NO | NO | NO | NO |
| TJU_CMC_MD2.ID02118.3p-miR | TJU_CMC_MD2.ID02118.hairpin | YES | NO | NO | NO | NO | NO | NO | NO |
| TJU_CMC_MD2.ID02119.3p-miR | TJU_CMC_MD2.ID02119.hairpin | YES | NO | NO | NO | NO | NO | NO | NO |
| TJU_CMC_MD2.ID02120.3p-miR | TJU_CMC_MD2.ID02120.hairpin | YES | NO | NO | NO | NO | NO | NO | NO |
| TJU_CMC_MD2.ID02121.3p-miR | TJU_CMC_MD2.ID02121.hairpin | YES | NO | NO | NO | NO | NO | NO | NO |
| TJU_CMC_MD2.ID02122.5p-miR | TJU_CMC_MD2.ID02122.hairpin | YES | NO | NO | NO | NO | NO | NO | NO |
| TJU_CMC_MD2.ID02123.3p-miR | TJU_CMC_MD2.ID02123.hairpin | YES | NO | NO | NO | NO | NO | NO | NO |
| TJU_CMC_MD2.ID02124.5p-miR | TJU_CMC_MD2.ID02124.hairpin | YES | NO | NO | NO | NO | NO | NO | NO |
| TJU_CMC_MD2.ID02125.3p-miR | TJU_CMC_MD2.ID02125.hairpin | YES | NO | NO | NO | NO | NO | NO | NO |
| TJU_CMC_MD2.ID02125.5p-miR | TJU_CMC_MD2.ID02125.hairpin | YES | NO | NO | NO | NO | NO | NO | NO |
| TJU_CMC_MD2.ID02126.3p-miR | TJU_CMC_MD2.ID02126.hairpin | YES | NO | NO | NO | NO | NO | NO | NO |
| TJU_CMC_MD2.ID02126.5p-miR | TJU_CMC_MD2.ID02126.hairpin | YES | NO | YES | NO | NO | NO | NO | NO |
| TJU_CMC_MD2.ID02127.5p-miR | TJU_CMC_MD2.ID02127.hairpin | YES | NO | YES | NO | NO | NO | NO | NO |
| TJU_CMC_MD2.ID02128.5p-miR | TJU_CMC_MD2.ID02128.hairpin | YES | NO | YES | NO | NO | NO | NO | NO |
| TJU_CMC_MD2.ID02129.5p-miR | TJU_CMC_MD2.ID02129.hairpin | YES | NO | YES | NO | YES | NO | NO | NO |
| TJU_CMC_MD2.ID02130.3p-miR | TJU_CMC_MD2.ID02130.hairpin | YES | NO | NO | NO | NO | NO | NO | NO |
| TJU_CMC_MD2.ID02131.5p-miR | TJU_CMC_MD2.ID02131.hairpin | YES | NO | NO | NO | NO | NO | NO | NO |
| TJU_CMC_MD2.ID02132.3p-miR | TJU_CMC_MD2.ID02132.hairpin | YES | NO | NO | NO | NO | NO | NO | NO |
| TJU_CMC_MD2.ID02133.5p-miR | TJU_CMC_MD2.ID02133.hairpin | YES | YES | YES | YES | NO | NO | NO | NO |
| TJU_CMC_MD2.ID02134.5p-miR | TJU_CMC_MD2.ID02134.hairpin | YES | YES | YES | YES | NO | NO | NO | NO |
| TJU_CMC_MD2.ID02135.5p-miR | TJU_CMC_MD2.ID02135.hairpin | YES | YES | YES | YES | NO | NO | NO | NO |
| TJU_CMC_MD2.ID02136.5p-miR | TJU_CMC_MD2.ID02136.hairpin | YES | NO | NO | NO | NO | NO | NO | NO |
| TJU_CMC_MD2.ID02137.5p-miR | TJU_CMC_MD2.ID02137.hairpin | YES | NO | NO | YES | NO | NO | NO | NO |
| TJU_CMC_MD2.ID02138.5p-miR | TJU_CMC_MD2.ID02138.hairpin | YES | YES | YES | NO | YES | NO | NO | NO |
| TJU_CMC_MD2.ID02139.3p-miR | TJU_CMC_MD2.ID02139.hairpin | YES | NO | NO | NO | NO | NO | NO | NO |
| TJU_CMC_MD2.ID02140.5p-miR | TJU_CMC_MD2.ID02140.hairpin | YES | YES | YES | YES | YES | YES | NO | NO |
| TJU_CMC_MD2.ID02141.5p-miR | TJU_CMC_MD2.ID02141.hairpin | YES | NO | YES | YES | YES | YES | NO | NO |
| TJU_CMC_MD2.ID02142.3p-miR | TJU_CMC_MD2.ID02142.hairpin | YES | NO | NO | NO | NO | NO | NO | NO |
| TJU_CMC_MD2.ID02143.3p-miR | TJU_CMC_MD2.ID02143.hairpin | YES | YES | YES | YES | YES | NO | NO | NO |
| TJU_CMC_MD2.ID02143.5p-miR | TJU_CMC_MD2.ID02143.hairpin | YES | YES | YES | YES | YES | NO | NO | NO |
| TJU_CMC_MD2.ID02144.5p-miR | TJU_CMC_MD2.ID02144.hairpin | YES | NO | YES | NO | YES | NO | NO | NO |
| TJU_CMC_MD2.ID02145.5p-miR | TJU_CMC_MD2.ID02145.hairpin | YES | YES | NO | NO | NO | NO | NO | NO |
| TJU_CMC_MD2.ID02146.5p-miR | TJU_CMC_MD2.ID02146.hairpin | YES | NO | NO | NO | NO | NO | NO | NO |
| TJU_CMC_MD2.ID02147.5p-miR | TJU_CMC_MD2.ID02147.hairpin | YES | NO | YES | NO | NO | NO | NO | NO |
| TJU_CMC_MD2.ID02148.3p-miR | TJU_CMC_MD2.ID02148.hairpin | YES | NO | NO | NO | NO | NO | NO | NO |
| TJU_CMC_MD2.ID02149.3p-miR | TJU_CMC_MD2.ID02149.hairpin | YES | NO | NO | NO | NO | NO | NO | NO |
| TJU_CMC_MD2.ID02150.5p-miR | TJU_CMC_MD2.ID02150.hairpin | YES | YES | YES | NO | NO | NO | NO | NO |
| TJU_CMC_MD2.ID02151.5p-miR | TJU_CMC_MD2.ID02151.hairpin | YES | YES | YES | NO | NO | NO | NO | NO |
| TJU_CMC_MD2.ID02152.3p-miR | TJU_CMC_MD2.ID02152.hairpin | YES | NO | NO | NO | NO | NO | NO | NO |
| TJU_CMC_MD2.ID02153.5p-miR | TJU_CMC_MD2.ID02153.hairpin | YES | NO | YES | NO | NO | NO | NO | NO |
| TJU_CMC_MD2.ID02154.3p-miR | TJU_CMC_MD2.ID02154.hairpin | YES | NO | NO | NO | NO | NO | NO | NO |
| TJU_CMC_MD2.ID02155.3p-miR | TJU_CMC_MD2.ID02155.hairpin | YES | NO | NO | NO | NO | NO | NO | NO |
| TJU_CMC_MD2.ID02156.3p-miR | TJU_CMC_MD2.ID02156.hairpin | YES | NO | NO | NO | NO | NO | NO | NO |
| TJU_CMC_MD2.ID02157.5p-miR | TJU_CMC_MD2.ID02157.hairpin | YES | YES | YES | NO | NO | NO | NO | NO |
| TJU_CMC_MD2.ID02158.5p-miR | TJU_CMC_MD2.ID02158.hairpin | YES | YES | NO | NO | NO | NO | NO | NO |
| TJU_CMC_MD2.ID02159.3p-miR | TJU_CMC_MD2.ID02159.hairpin | YES | NO | NO | NO | NO | NO | NO | NO |
| TJU_CMC_MD2.ID02160.3p-miR | TJU_CMC_MD2.ID02160.hairpin | YES | NO | NO | NO | NO | NO | NO | NO |
| TJU_CMC_MD2.ID02161.3p-miR | TJU_CMC_MD2.ID02161.hairpin | YES | NO | NO | NO | NO | NO | NO | NO |
| TJU_CMC_MD2.ID02162.5p-miR | TJU_CMC_MD2.ID02162.hairpin | YES | NO | YES | NO | YES | NO | NO | NO |
| TJU_CMC_MD2.ID02163.3p-miR | TJU_CMC_MD2.ID02163.hairpin | YES | NO | NO | NO | NO | NO | NO | NO |
| TJU_CMC_MD2.ID02164.3p-miR | TJU_CMC_MD2.ID02164.hairpin | YES | NO | NO | NO | NO | NO | NO | NO |
| TJU_CMC_MD2.ID02165.3p-miR | TJU_CMC_MD2.ID02165.hairpin | YES | NO | NO | NO | NO | NO | NO | NO |
| TJU_CMC_MD2.ID02165.5p-miR | TJU_CMC_MD2.ID02165.hairpin | YES | YES | YES | NO | YES | NO | NO | NO |
| TJU_CMC_MD2.ID02166.3p-miR | TJU_CMC_MD2.ID02166.hairpin | YES | NO | NO | NO | NO | NO | NO | NO |
| TJU_CMC_MD2.ID02167.3p-miR | TJU_CMC_MD2.ID02167.hairpin | YES | NO | NO | NO | NO | NO | NO | NO |
| TJU_CMC_MD2.ID02168.5p-miR | TJU_CMC_MD2.ID02168.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02169.3p-miR | TJU_CMC_MD2.ID02169.hairpin | YES | NO | NO | NO | NO | NO | NO | NO |
| TJU_CMC_MD2.ID02169.5p-miR | TJU_CMC_MD2.ID02169.hairpin | YES | NO | YES | NO | YES | NO | NO | NO |
| TJU_CMC_MD2.ID02170.3p-miR | TJU_CMC_MD2.ID02170.hairpin | YES | NO | NO | NO | NO | NO | NO | NO |
| TJU_CMC_MD2.ID02171.5p-miR | TJU_CMC_MD2.ID02171.hairpin | YES | YES | YES | YES | NO | YES | NO | NO |
| TJU_CMC_MD2.ID02172.5p-miR | TJU_CMC_MD2.ID02172.hairpin | YES | NO | YES | NO | YES | NO | NO | NO |
| TJU_CMC_MD2.ID02173.3p-miR | TJU_CMC_MD2.ID02173.hairpin | YES | NO | NO | NO | NO | NO | NO | NO |
| TJU_CMC_MD2.ID02174.5p-miR | TJU_CMC_MD2.ID02174.hairpin | YES | YES | YES | NO | NO | NO | NO | NO |
| TJU_CMC_MD2.ID02175.5p-miR | TJU_CMC_MD2.ID02175.hairpin | YES | NO | NO | NO | NO | NO | NO | NO |
| TJU_CMC_MD2.ID02176.3p-miR | TJU_CMC_MD2.ID02176.hairpin | YES | NO | NO | NO | NO | NO | NO | NO |
| TJU_CMC_MD2.ID02176.5p-miR | TJU_CMC_MD2.ID02176.hairpin | YES | YES | YES | YES | NO | NO | NO | NO |
| TJU_CMC_MD2.ID02177.5p-miR | TJU_CMC_MD2.ID02177.hairpin | YES | NO | NO | NO | NO | NO | NO | NO |
| TJU_CMC_MD2.ID02178.5p-miR | TJU_CMC_MD2.ID02178.hairpin | YES | YES | YES | NO | NO | NO | NO | NO |
| TJU_CMC_MD2.ID02179.3p-miR | TJU_CMC_MD2.ID02179.hairpin | YES | NO | NO | NO | NO | NO | NO | NO |
| TJU_CMC_MD2.ID02180.3p-miR | TJU_CMC_MD2.ID02180.hairpin | YES | NO | NO | NO | NO | NO | NO | NO |
| TJU_CMC_MD2.ID02181.3p-miR | TJU_CMC_MD2.ID02181.hairpin | YES | NO | NO | NO | NO | NO | NO | NO |
| TJU_CMC_MD2.ID02182.5p-miR | TJU_CMC_MD2.ID02182.hairpin | YES | NO | NO | NO | YES | NO | NO | NO |
| TJU_CMC_MD2.ID02183.5p-miR | TJU_CMC_MD2.ID02183.hairpin | YES | YES | YES | YES | YES | YES | NO | NO |
| TJU_CMC_MD2.ID02184.3p-miR | TJU_CMC_MD2.ID02184.hairpin | YES | NO | NO | NO | NO | NO | NO | NO |
| TJU_CMC_MD2.ID02185.5p-miR | TJU_CMC_MD2.ID02185.hairpin | YES | NO | YES | NO | YES | NO | NO | NO |
| TJU_CMC_MD2.ID02186.5p-miR | TJU_CMC_MD2.ID02186.hairpin | YES | YES | YES | YES | YES | NO | NO | NO |
| TJU_CMC_MD2.ID02187.5p-miR | TJU_CMC_MD2.ID02187.hairpin | YES | NO | NO | NO | NO | NO | NO | NO |
| TJU_CMC_MD2.ID02188.3p-miR | TJU_CMC_MD2.ID02188.hairpin | YES | NO | NO | NO | NO | NO | NO | NO |
| TJU_CMC_MD2.ID02188.5p-miR | TJU_CMC_MD2.ID02188.hairpin | YES | NO | YES | NO | YES | NO | NO | NO |
| TJU_CMC_MD2.ID02189.5p-miR | TJU_CMC_MD2.ID02189.hairpin | YES | YES | YES | NO | YES | NO | NO | NO |
| TJU_CMC_MD2.ID02190.5p-miR | TJU_CMC_MD2.ID02190.hairpin | YES | NO | NO | NO | NO | NO | NO | NO |
| TJU_CMC_MD2.ID02191.5p-miR | TJU_CMC_MD2.ID02191.hairpin | YES | NO | YES | NO | YES | NO | NO | NO |
| TJU_CMC_MD2.ID02192.5p-miR | TJU_CMC_MD2.ID02192.hairpin | YES | NO | NO | NO | NO | NO | NO | NO |
| TJU_CMC_MD2.ID02193.3p-miR | TJU_CMC_MD2.ID02193.hairpin | YES | NO | NO | NO | NO | NO | NO | NO |
| TJU_CMC_MD2.ID02194.3p-miR | TJU_CMC_MD2.ID02194.hairpin | YES | NO | NO | NO | NO | NO | NO | NO |
| TJU_CMC_MD2.ID02195.3p-miR | TJU_CMC_MD2.ID02195.hairpin | YES | NO | NO | NO | NO | NO | NO | NO |
| TJU_CMC_MD2.ID02196.5p-miR | TJU_CMC_MD2.ID02196.hairpin | YES | NO | NO | NO | YES | NO | NO | NO |
| TJU_CMC_MD2.ID02197.3p-miR | TJU_CMC_MD2.ID02197.hairpin | YES | NO | NO | NO | NO | NO | NO | NO |
| TJU_CMC_MD2.ID02198.3p-miR | TJU_CMC_MD2.ID02198.hairpin | YES | NO | NO | NO | NO | NO | NO | NO |
| TJU_CMC_MD2.ID02199.5p-miR | TJU_CMC_MD2.ID02199.hairpin | YES | YES | YES | YES | YES | NO | NO | NO |
| TJU_CMC_MD2.ID02200.3p-miR | TJU_CMC_MD2.ID02200.hairpin | YES | NO | NO | NO | NO | NO | NO | NO |
| TJU_CMC_MD2.ID02201.3p-miR | TJU_CMC_MD2.ID02201.hairpin | YES | NO | NO | NO | NO | NO | NO | NO |
| TJU_CMC_MD2.ID02202.5p-miR | TJU_CMC_MD2.ID02202.hairpin | YES | NO | YES | NO | NO | NO | NO | NO |
| TJU_CMC_MD2.ID02203.5p-miR | TJU_CMC_MD2.ID02203.hairpin | YES | YES | YES | YES | NO | NO | NO | NO |
| TJU_CMC_MD2.ID02204.5p-miR | TJU_CMC_MD2.ID02204.hairpin | YES | YES | YES | YES | NO | NO | NO | NO |
| TJU_CMC_MD2.ID02205.5p-miR | TJU_CMC_MD2.ID02205.hairpin | YES | YES | YES | YES | YES | NO | NO | NO |
| TJU_CMC_MD2.ID02206.5p-miR | TJU_CMC_MD2.ID02206.hairpin | YES | NO | YES | NO | YES | NO | NO | NO |
| TJU_CMC_MD2.ID02207.5p-miR | TJU_CMC_MD2.ID02207.hairpin | YES | YES | YES | YES | YES | NO | NO | NO |
| TJU_CMC_MD2.ID02208.5p-miR | TJU_CMC_MD2.ID02208.hairpin | YES | YES | YES | NO | NO | NO | NO | NO |
| TJU_CMC_MD2.ID02209.3p-miR | TJU_CMC_MD2.ID02209.hairpin | YES | NO | NO | NO | NO | NO | NO | NO |
| TJU_CMC_MD2.ID02210.5p-miR | TJU_CMC_MD2.ID02210.hairpin | YES | NO | NO | NO | NO | NO | NO | NO |
| TJU_CMC_MD2.ID02211.5p-miR | TJU_CMC_MD2.ID02211.hairpin | YES | YES | YES | YES | YES | NO | NO | NO |
| TJU_CMC_MD2.ID02212.5p-miR | TJU_CMC_MD2.ID02212.hairpin | YES | NO | YES | NO | YES | NO | NO | NO |
| TJU_CMC_MD2.ID02213.3p-miR | TJU_CMC_MD2.ID02213.hairpin | YES | NO | NO | NO | NO | NO | NO | NO |
| TJU_CMC_MD2.ID02214.3p-miR | TJU_CMC_MD2.ID02214.hairpin | YES | NO | NO | NO | NO | NO | NO | NO |
| TJU_CMC_MD2.ID02215.5p-miR | TJU_CMC_MD2.ID02215.hairpin | YES | NO | YES | NO | YES | NO | NO | NO |
| TJU_CMC_MD2.ID02216.3p-miR | TJU_CMC_MD2.ID02216.hairpin | YES | NO | NO | NO | NO | NO | NO | NO |
| TJU_CMC_MD2.ID02217.5p-miR | TJU_CMC_MD2.ID02217.hairpin | YES | NO | YES | NO | NO | NO | NO | NO |
| TJU_CMC_MD2.ID02218.3p-miR | TJU_CMC_MD2.ID02218.hairpin | YES | NO | NO | NO | NO | NO | NO | NO |
| TJU_CMC_MD2.ID02219.3p-miR | TJU_CMC_MD2.ID02219.hairpin | YES | NO | NO | NO | NO | NO | NO | NO |
| TJU_CMC_MD2.ID02220.5p-miR | TJU_CMC_MD2.ID02220.hairpin | YES | YES | YES | YES | YES | NO | NO | NO |
| TJU_CMC_MD2.ID02221.3p-miR | TJU_CMC_MD2.ID02221.hairpin | YES | NO | NO | NO | NO | NO | NO | NO |
| TJU_CMC_MD2.ID02222.3p-miR | TJU_CMC_MD2.ID02222.hairpin | YES | NO | NO | NO | NO | NO | NO | NO |
| TJU_CMC_MD2.ID02223.3p-miR | TJU_CMC_MD2.ID02223.hairpin | YES | NO | NO | NO | NO | NO | NO | NO |
| TJU_CMC_MD2.ID02224.3p-miR | TJU_CMC_MD2.ID02224.hairpin | YES | NO | NO | NO | NO | NO | NO | NO |
| TJU_CMC_MD2.ID02224.5p-miR | TJU_CMC_MD2.ID02224.hairpin | YES | YES | YES | YES | YES | NO | NO | NO |
| TJU_CMC_MD2.ID02225.5p-miR | TJU_CMC_MD2.ID02225.hairpin | YES | YES | YES | YES | NO | NO | NO | NO |
| TJU_CMC_MD2.ID02226.3p-miR | TJU_CMC_MD2.ID02226.hairpin | YES | NO | NO | NO | NO | NO | NO | NO |
| TJU_CMC_MD2.ID02227.3p-miR | TJU_CMC_MD2.ID02227.hairpin | YES | NO | NO | NO | NO | NO | NO | NO |
| TJU_CMC_MD2.ID02228.3p-miR | TJU_CMC_MD2.ID02228.hairpin | YES | NO | NO | NO | NO | NO | NO | NO |
| TJU_CMC_MD2.ID02229.3p-miR | TJU_CMC_MD2.ID02229.hairpin | YES | NO | NO | NO | NO | NO | NO | NO |
| TJU_CMC_MD2.ID02230.3p-miR | TJU_CMC_MD2.ID02230.hairpin | YES | NO | NO | NO | NO | NO | NO | NO |
| TJU_CMC_MD2.ID02231.3p-miR | TJU_CMC_MD2.ID02231.hairpin | YES | NO | NO | NO | NO | NO | NO | NO |
| TJU_CMC_MD2.ID02232.3p-miR | TJU_CMC_MD2.ID02232.hairpin | YES | NO | NO | NO | NO | NO | NO | NO |
| TJU_CMC_MD2.ID02233.3p-miR | TJU_CMC_MD2.ID02233.hairpin | YES | NO | NO | NO | NO | NO | NO | NO |
| TJU_CMC_MD2.ID02234.5p-miR | TJU_CMC_MD2.ID02234.hairpin | YES | NO | YES | NO | YES | NO | NO | NO |
| TJU_CMC_MD2.ID02235.5p-miR | TJU_CMC_MD2.ID02235.hairpin | YES | NO | NO | NO | NO | NO | NO | NO |
| TJU_CMC_MD2.ID02236.3p-miR | TJU_CMC_MD2.ID02236.hairpin | YES | NO | NO | NO | NO | NO | NO | NO |
| TJU_CMC_MD2.ID02236.5p-miR | TJU_CMC_MD2.ID02236.hairpin | YES | YES | YES | YES | YES | NO | NO | NO |
| TJU_CMC_MD2.ID02237.3p-miR | TJU_CMC_MD2.ID02237.hairpin | YES | NO | NO | NO | NO | NO | NO | NO |
| TJU_CMC_MD2.ID02237.5p-miR | TJU_CMC_MD2.ID02237.hairpin | YES | NO | YES | NO | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02238.5p-miR | TJU_CMC_MD2.ID02238.hairpin | YES | NO | YES | NO | NO | NO | NO | NO |
| TJU_CMC_MD2.ID02239.3p-miR | TJU_CMC_MD2.ID02239.hairpin | YES | NO | NO | NO | NO | NO | NO | NO |
| TJU_CMC_MD2.ID02240.3p-miR | TJU_CMC_MD2.ID02240.hairpin | YES | NO | NO | NO | NO | NO | NO | NO |
| TJU_CMC_MD2.ID02241.3p-miR | TJU_CMC_MD2.ID02241.hairpin | YES | NO | NO | NO | NO | NO | NO | NO |
| TJU_CMC_MD2.ID02242.3p-miR | TJU_CMC_MD2.ID02242.hairpin | YES | NO | NO | NO | NO | NO | NO | NO |
| TJU_CMC_MD2.ID02243.5p-miR | TJU_CMC_MD2.ID02243.hairpin | YES | YES | YES | YES | YES | YES | NO | NO |
| TJU_CMC_MD2.ID02244.3p-miR | TJU_CMC_MD2.ID02244.hairpin | YES | NO | NO | NO | NO | NO | NO | NO |
| TJU_CMC_MD2.ID02245.5p-miR | TJU_CMC_MD2.ID02245.hairpin | YES | NO | YES | NO | NO | NO | NO | NO |
| TJU_CMC_MD2.ID02246.3p-miR | TJU_CMC_MD2.ID02246.hairpin | YES | NO | NO | NO | NO | NO | NO | NO |
| TJU_CMC_MD2.ID02247.3p-miR | TJU_CMC_MD2.ID02247.hairpin | YES | NO | NO | NO | NO | NO | NO | NO |
| TJU_CMC_MD2.ID02248.5p-miR | TJU_CMC_MD2.ID02248.hairpin | YES | NO | YES | NO | YES | NO | NO | NO |
| TJU_CMC_MD2.ID02249.3p-miR | TJU_CMC_MD2.ID02249.hairpin | YES | NO | NO | NO | NO | NO | NO | NO |
| TJU_CMC_MD2.ID02250.3p-miR | TJU_CMC_MD2.ID02250.hairpin | YES | NO | NO | NO | NO | NO | NO | NO |
| TJU_CMC_MD2.ID02251.5p-miR | TJU_CMC_MD2.ID02251.hairpin | YES | NO | NO | NO | NO | NO | NO | NO |
| TJU_CMC_MD2.ID02252.3p-miR | TJU_CMC_MD2.ID02252.hairpin | YES | NO | NO | NO | NO | NO | NO | NO |
| TJU_CMC_MD2.ID02253.3p-miR | TJU_CMC_MD2.ID02253.hairpin | YES | NO | NO | NO | NO | NO | NO | NO |
| TJU_CMC_MD2.ID02254.5p-miR | TJU_CMC_MD2.ID02254.hairpin | YES | NO | NO | NO | NO | NO | NO | NO |
| TJU_CMC_MD2.ID02255.5p-miR | TJU_CMC_MD2.ID02255.hairpin | YES | NO | NO | NO | NO | NO | NO | NO |
| TJU_CMC_MD2.ID02256.3p-miR | TJU_CMC_MD2.ID02256.hairpin | YES | NO | NO | NO | NO | NO | NO | NO |
| TJU_CMC_MD2.ID02257.3p-miR | TJU_CMC_MD2.ID02257.hairpin | YES | NO | NO | NO | NO | NO | NO | NO |
| TJU_CMC_MD2.ID02258.3p-miR | TJU_CMC_MD2.ID02258.hairpin | YES | NO | NO | NO | NO | NO | NO | NO |
| TJU_CMC_MD2.ID02259.5p-miR | TJU_CMC_MD2.ID02259.hairpin | YES | NO | YES | NO | NO | NO | NO | NO |
| TJU_CMC_MD2.ID02260.5p-miR | TJU_CMC_MD2.ID02260.hairpin | YES | NO | NO | NO | NO | NO | NO | NO |
| TJU_CMC_MD2.ID02261.5p-miR | TJU_CMC_MD2.ID02261.hairpin | YES | YES | YES | NO | YES | NO | NO | NO |
| TJU_CMC_MD2.ID02262.3p-miR | TJU_CMC_MD2.ID02262.hairpin | YES | NO | NO | NO | NO | NO | NO | NO |
| TJU_CMC_MD2.ID02263.3p-miR | TJU_CMC_MD2.ID02263.hairpin | YES | NO | NO | NO | NO | NO | NO | NO |
| TJU_CMC_MD2.ID02264.3p-miR | TJU_CMC_MD2.ID02264.hairpin | YES | NO | NO | NO | NO | NO | NO | NO |
| TJU_CMC_MD2.ID02264.5p-miR | TJU_CMC_MD2.ID02264.hairpin | YES | NO | YES | NO | YES | NO | NO | NO |
| TJU_CMC_MD2.ID02265.5p-miR | TJU_CMC_MD2.ID02265.hairpin | YES | NO | YES | NO | YES | NO | NO | NO |
| TJU_CMC_MD2.ID02266.5p-miR | TJU_CMC_MD2.ID02266.hairpin | YES | NO | YES | NO | NO | NO | NO | NO |
| TJU_CMC_MD2.ID02267.3p-miR | TJU_CMC_MD2.ID02267.hairpin | YES | NO | NO | NO | NO | NO | NO | NO |
| TJU_CMC_MD2.ID02268.3p-miR | TJU_CMC_MD2.ID02268.hairpin | YES | NO | NO | NO | NO | NO | NO | NO |
| TJU_CMC_MD2.ID02269.3p-miR | TJU_CMC_MD2.ID02269.hairpin | YES | NO | NO | NO | NO | NO | NO | NO |
| TJU_CMC_MD2.ID02270.3p-miR | TJU_CMC_MD2.ID02270.hairpin | YES | NO | NO | NO | NO | NO | NO | NO |
| TJU_CMC_MD2.ID02271.3p-miR | TJU_CMC_MD2.ID02271.hairpin | YES | NO | NO | NO | NO | NO | NO | NO |
| TJU_CMC_MD2.ID02272.5p-miR | TJU_CMC_MD2.ID02272.hairpin | YES | YES | YES | YES | NO | NO | NO | NO |
| TJU_CMC_MD2.ID02273.3p-miR | TJU_CMC_MD2.ID02273.hairpin | YES | NO | NO | NO | NO | NO | NO | NO |
| TJU_CMC_MD2.ID02274.3p-miR | TJU_CMC_MD2.ID02274.hairpin | YES | NO | NO | NO | NO | NO | NO | NO |
| TJU_CMC_MD2.ID02275.5p-miR | TJU_CMC_MD2.ID02275.hairpin | YES | YES | YES | YES | YES | NO | NO | NO |
| TJU_CMC_MD2.ID02276.3p-miR | TJU_CMC_MD2.ID02276.hairpin | YES | NO | NO | NO | NO | NO | NO | NO |
| TJU_CMC_MD2.ID02276.5p-miR | TJU_CMC_MD2.ID02276.hairpin | YES | NO | YES | NO | NO | NO | NO | NO |
| TJU_CMC_MD2.ID02277.3p-miR | TJU_CMC_MD2.ID02277.hairpin | YES | NO | NO | NO | NO | NO | NO | NO |
| TJU_CMC_MD2.ID02277.5p-miR | TJU_CMC_MD2.ID02277.hairpin | YES | YES | YES | YES | NO | NO | NO | NO |
| TJU_CMC_MD2.ID02278.5p-miR | TJU_CMC_MD2.ID02278.hairpin | YES | NO | NO | NO | NO | NO | NO | NO |
| TJU_CMC_MD2.ID02279.3p-miR | TJU_CMC_MD2.ID02279.hairpin | YES | YES | YES | NO | NO | NO | NO | NO |
| TJU_CMC_MD2.ID02280.3p-miR | TJU_CMC_MD2.ID02280.hairpin | YES | NO | NO | NO | NO | NO | NO | NO |
| TJU_CMC_MD2.ID02280.5p-miR | TJU_CMC_MD2.ID02280.hairpin | YES | YES | YES | YES | NO | NO | NO | NO |
| TJU_CMC_MD2.ID02281.5p-miR | TJU_CMC_MD2.ID02281.hairpin | YES | YES | YES | YES | YES | NO | NO | NO |
| TJU_CMC_MD2.ID02282.5p-miR | TJU_CMC_MD2.ID02282.hairpin | YES | YES | NO | YES | NO | NO | NO | NO |
| TJU_CMC_MD2.ID02283.3p-miR | TJU_CMC_MD2.ID02283.hairpin | YES | NO | NO | NO | NO | NO | NO | NO |
| TJU_CMC_MD2.ID02284.3p-miR | TJU_CMC_MD2.ID02284.hairpin | YES | NO | NO | NO | NO | NO | NO | NO |
| TJU_CMC_MD2.ID02285.5p-miR | TJU_CMC_MD2.ID02285.hairpin | YES | NO | YES | NO | NO | NO | NO | NO |
| TJU_CMC_MD2.ID02286.3p-miR | TJU_CMC_MD2.ID02286.hairpin | YES | NO | NO | NO | NO | NO | NO | NO |
| TJU_CMC_MD2.ID02287.5p-miR | TJU_CMC_MD2.ID02287.hairpin | YES | YES | YES | NO | NO | NO | NO | NO |
| TJU_CMC_MD2.ID02288.5p-miR | TJU_CMC_MD2.ID02288.hairpin | YES | YES | YES | YES | YES | NO | NO | NO |
| TJU_CMC_MD2.ID02289.3p-miR | TJU_CMC_MD2.ID02289.hairpin | YES | NO | NO | NO | NO | NO | NO | NO |
| TJU_CMC_MD2.ID02289.5p-miR | TJU_CMC_MD2.ID02289.hairpin | YES | YES | YES | NO | NO | NO | NO | NO |
| TJU_CMC_MD2.ID02290.3p-miR | TJU_CMC_MD2.ID02290.hairpin | YES | YES | YES | NO | YES | NO | NO | NO |
| TJU_CMC_MD2.ID02290.5p-miR | TJU_CMC_MD2.ID02290.hairpin | YES | YES | YES | NO | YES | NO | NO | NO |
| TJU_CMC_MD2.ID02291.3p-miR | TJU_CMC_MD2.ID02291.hairpin | YES | NO | NO | NO | NO | NO | NO | NO |
| TJU_CMC_MD2.ID02291.5p-miR | TJU_CMC_MD2.ID02291.hairpin | YES | YES | YES | YES | YES | NO | NO | NO |
| TJU_CMC_MD2.ID02292.5p-miR | TJU_CMC_MD2.ID02292.hairpin | YES | YES | NO | NO | NO | NO | NO | NO |
| TJU_CMC_MD2.ID02293.3p-miR | TJU_CMC_MD2.ID02293.hairpin | YES | NO | NO | NO | NO | NO | NO | NO |
| TJU_CMC_MD2.ID02294.5p-miR | TJU_CMC_MD2.ID02294.hairpin | YES | NO | NO | NO | NO | NO | NO | NO |
| TJU_CMC_MD2.ID02295.3p-miR | TJU_CMC_MD2.ID02295.hairpin | YES | NO | NO | NO | NO | NO | NO | NO |
| TJU_CMC_MD2.ID02295.5p-miR | TJU_CMC_MD2.ID02295.hairpin | YES | YES | NO | YES | NO | NO | NO | NO |
| TJU_CMC_MD2.ID02296.5p-miR | TJU_CMC_MD2.ID02296.hairpin | YES | YES | NO | YES | NO | NO | NO | NO |
| TJU_CMC_MD2.ID02297.3p-miR | TJU_CMC_MD2.ID02297.hairpin | YES | NO | NO | NO | NO | NO | NO | NO |
| TJU_CMC_MD2.ID02298.3p-miR | TJU_CMC_MD2.ID02298.hairpin | YES | NO | NO | NO | NO | NO | NO | NO |
| TJU_CMC_MD2.ID02299.5p-miR | TJU_CMC_MD2.ID02299.hairpin | YES | NO | YES | NO | NO | NO | NO | NO |
| TJU_CMC_MD2.ID02300.3p-miR | TJU_CMC_MD2.ID02300.hairpin | YES | NO | NO | NO | NO | NO | NO | NO |
| TJU_CMC_MD2.ID02301.5p-miR | TJU_CMC_MD2.ID02301.hairpin | YES | YES | YES | NO | NO | NO | NO | NO |
| TJU_CMC_MD2.ID02302.3p-miR | TJU_CMC_MD2.ID02302.hairpin | YES | NO | NO | NO | NO | NO | NO | NO |
| TJU_CMC_MD2.ID02303.5p-miR | TJU_CMC_MD2.ID02303.hairpin | YES | YES | YES | YES | NO | NO | NO | NO |
| TJU_CMC_MD2.ID02304.5p-miR | TJU_CMC_MD2.ID02304.hairpin | YES | YES | NO | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02305.3p-miR | TJU_CMC_MD2.ID02305.hairpin | YES | NO | NO | NO | NO | NO | NO | NO |
| TJU_CMC_MD2.ID02306.3p-miR | TJU_CMC_MD2.ID02306.hairpin | YES | NO | NO | NO | NO | NO | NO | NO |
| TJU_CMC_MD2.ID02307.3p-miR | TJU_CMC_MD2.ID02307.hairpin | YES | NO | NO | NO | NO | NO | NO | NO |
| TJU_CMC_MD2.ID02308.3p-miR | TJU_CMC_MD2.ID02308.hairpin | YES | NO | NO | NO | NO | NO | NO | NO |
| TJU_CMC_MD2.ID02309.3p-miR | TJU_CMC_MD2.ID02309.hairpin | YES | NO | NO | NO | NO | NO | NO | NO |
| TJU_CMC_MD2.ID02310.3p-miR | TJU_CMC_MD2.ID02310.hairpin | YES | NO | NO | NO | NO | NO | NO | NO |
| TJU_CMC_MD2.ID02311.3p-miR | TJU_CMC_MD2.ID02311.hairpin | YES | NO | NO | NO | NO | NO | NO | NO |
| TJU_CMC_MD2.ID02312.5p-miR | TJU_CMC_MD2.ID02312.hairpin | YES | YES | YES | YES | YES | NO | NO | NO |
| TJU_CMC_MD2.ID02313.3p-miR | TJU_CMC_MD2.ID02313.hairpin | YES | NO | NO | NO | NO | NO | NO | NO |
| TJU_CMC_MD2.ID02314.3p-miR | TJU_CMC_MD2.ID02314.hairpin | YES | NO | NO | NO | NO | NO | NO | NO |
| TJU_CMC_MD2.ID02315.3p-miR | TJU_CMC_MD2.ID02315.hairpin | YES | NO | NO | NO | NO | NO | NO | NO |
| TJU_CMC_MD2.ID02316.3p-miR | TJU_CMC_MD2.ID02316.hairpin | YES | NO | NO | NO | NO | NO | NO | NO |
| TJU_CMC_MD2.ID02317.3p-miR | TJU_CMC_MD2.ID02317.hairpin | YES | NO | NO | NO | NO | NO | NO | NO |
| TJU_CMC_MD2.ID02318.5p-miR | TJU_CMC_MD2.ID02318.hairpin | YES | YES | YES | YES | YES | NO | NO | NO |
| TJU_CMC_MD2.ID02319.3p-miR | TJU_CMC_MD2.ID02319.hairpin | YES | NO | NO | NO | NO | NO | NO | NO |
| TJU_CMC_MD2.ID02320.3p-miR | TJU_CMC_MD2.ID02320.hairpin | YES | NO | NO | NO | NO | NO | NO | NO |
| TJU_CMC_MD2.ID02321.5p-miR | TJU_CMC_MD2.ID02321.hairpin | YES | YES | YES | YES | YES | NO | NO | NO |
| TJU_CMC_MD2.ID02322.5p-miR | TJU_CMC_MD2.ID02322.hairpin | YES | YES | NO | YES | NO | NO | NO | NO |
| TJU_CMC_MD2.ID02323.3p-miR | TJU_CMC_MD2.ID02323.hairpin | YES | NO | NO | NO | NO | NO | NO | NO |
| TJU_CMC_MD2.ID02324.3p-miR | TJU_CMC_MD2.ID02324.hairpin | YES | NO | NO | NO | NO | NO | NO | NO |
| TJU_CMC_MD2.ID02325.3p-miR | TJU_CMC_MD2.ID02325.hairpin | YES | NO | NO | NO | NO | NO | NO | NO |
| TJU_CMC_MD2.ID02325.5p-miR | TJU_CMC_MD2.ID02325.hairpin | YES | YES | YES | YES | YES | NO | NO | NO |
| TJU_CMC_MD2.ID02326.5p-miR | TJU_CMC_MD2.ID02326.hairpin | YES | YES | NO | NO | NO | NO | NO | NO |
| TJU_CMC_MD2.ID02327.5p-miR | TJU_CMC_MD2.ID02327.hairpin | YES | YES | YES | YES | YES | YES | NO | NO |
| TJU_CMC_MD2.ID02328.5p-miR | TJU_CMC_MD2.ID02328.hairpin | YES | YES | YES | NO | YES | NO | NO | NO |
| TJU_CMC_MD2.ID02329.3p-miR | TJU_CMC_MD2.ID02329.hairpin | YES | NO | NO | NO | NO | NO | NO | NO |
| TJU_CMC_MD2.ID02330.3p-miR | TJU_CMC_MD2.ID02330.hairpin | YES | NO | NO | NO | NO | NO | NO | NO |
| TJU_CMC_MD2.ID02331.3p-miR | TJU_CMC_MD2.ID02331.hairpin | YES | NO | NO | NO | NO | NO | NO | NO |
| TJU_CMC_MD2.ID02332.3p-miR | TJU_CMC_MD2.ID02332.hairpin | YES | NO | NO | NO | NO | NO | NO | NO |
| TJU_CMC_MD2.ID02333.3p-miR | TJU_CMC_MD2.ID02333.hairpin | YES | NO | NO | NO | NO | NO | NO | NO |
| TJU_CMC_MD2.ID02334.5p-miR | TJU_CMC_MD2.ID02334.hairpin | YES | YES | YES | YES | NO | NO | NO | NO |
| TJU_CMC_MD2.ID02335.5p-miR | TJU_CMC_MD2.ID02335.hairpin | YES | YES | YES | NO | YES | NO | NO | NO |
| TJU_CMC_MD2.ID02336.3p-miR | TJU_CMC_MD2.ID02336.hairpin | YES | NO | NO | NO | NO | NO | NO | NO |
| TJU_CMC_MD2.ID02337.3p-miR | TJU_CMC_MD2.ID02337.hairpin | YES | NO | NO | NO | NO | NO | NO | NO |
| TJU_CMC_MD2.ID02338.3p-miR | TJU_CMC_MD2.ID02338.hairpin | YES | NO | NO | NO | NO | NO | NO | NO |
| TJU_CMC_MD2.ID02338.5p-miR | TJU_CMC_MD2.ID02338.hairpin | YES | YES | YES | YES | YES | NO | NO | NO |
| TJU_CMC_MD2.ID02339.5p-miR | TJU_CMC_MD2.ID02339.hairpin | YES | NO | YES | YES | YES | NO | NO | NO |
| TJU_CMC_MD2.ID02340.3p-miR | TJU_CMC_MD2.ID02340.hairpin | YES | NO | NO | NO | NO | NO | NO | NO |
| TJU_CMC_MD2.ID02341.3p-miR | TJU_CMC_MD2.ID02341.hairpin | YES | NO | NO | NO | NO | NO | NO | NO |
| TJU_CMC_MD2.ID02342.5p-miR | TJU_CMC_MD2.ID02342.hairpin | YES | NO | NO | YES | NO | NO | NO | NO |
| TJU_CMC_MD2.ID02343.3p-miR | TJU_CMC_MD2.ID02343.hairpin | YES | NO | NO | NO | NO | NO | NO | NO |
| TJU_CMC_MD2.ID02344.3p-miR | TJU_CMC_MD2.ID02344.hairpin | YES | NO | NO | NO | NO | NO | NO | NO |
| TJU_CMC_MD2.ID02345.3p-miR | TJU_CMC_MD2.ID02345.hairpin | YES | NO | NO | NO | NO | NO | NO | NO |
| TJU_CMC_MD2.ID02346.3p-miR | TJU_CMC_MD2.ID02346.hairpin | YES | NO | NO | NO | NO | NO | NO | NO |
| TJU_CMC_MD2.ID02347.5p-miR | TJU_CMC_MD2.ID02347.hairpin | YES | YES | YES | YES | NO | NO | NO | NO |
| TJU_CMC_MD2.ID02348.3p-miR | TJU_CMC_MD2.ID02348.hairpin | YES | NO | NO | NO | NO | NO | NO | NO |
| TJU_CMC_MD2.ID02348.5p-miR | TJU_CMC_MD2.ID02348.hairpin | YES | YES | YES | YES | YES | NO | NO | NO |
| TJU_CMC_MD2.ID02349.3p-miR | TJU_CMC_MD2.ID02349.hairpin | YES | NO | NO | NO | NO | NO | NO | NO |
| TJU_CMC_MD2.ID02350.5p-miR | TJU_CMC_MD2.ID02350.hairpin | YES | YES | YES | YES | NO | NO | NO | NO |
| TJU_CMC_MD2.ID02351.5p-miR | TJU_CMC_MD2.ID02351.hairpin | YES | YES | YES | YES | NO | NO | NO | NO |
| TJU_CMC_MD2.ID02352.5p-miR | TJU_CMC_MD2.ID02352.hairpin | YES | YES | YES | YES | YES | NO | NO | NO |
| TJU_CMC_MD2.ID02353.3p-miR | TJU_CMC_MD2.ID02353.hairpin | YES | NO | NO | NO | NO | NO | NO | NO |
| TJU_CMC_MD2.ID02354.3p-miR | TJU_CMC_MD2.ID02354.hairpin | YES | YES | YES | YES | YES | NO | NO | NO |
| TJU_CMC_MD2.ID02355.3p-miR | TJU_CMC_MD2.ID02355.hairpin | YES | NO | NO | NO | NO | NO | NO | NO |
| TJU_CMC_MD2.ID02355.5p-miR | TJU_CMC_MD2.ID02355.hairpin | YES | YES | YES | YES | NO | NO | NO | NO |
| TJU_CMC_MD2.ID02356.3p-miR | TJU_CMC_MD2.ID02356.hairpin | YES | NO | NO | NO | NO | NO | NO | NO |
| TJU_CMC_MD2.ID02357.3p-miR | TJU_CMC_MD2.ID02357.hairpin | YES | NO | NO | NO | NO | NO | NO | NO |
| TJU_CMC_MD2.ID02358.3p-miR | TJU_CMC_MD2.ID02358.hairpin | YES | NO | NO | NO | NO | NO | NO | NO |
| TJU_CMC_MD2.ID02359.5p-miR | TJU_CMC_MD2.ID02359.hairpin | YES | YES | YES | NO | NO | NO | NO | NO |
| TJU_CMC_MD2.ID02360.5p-miR | TJU_CMC_MD2.ID02360.hairpin | YES | YES | NO | YES | NO | NO | NO | NO |
| TJU_CMC_MD2.ID02361.3p-miR | TJU_CMC_MD2.ID02361.hairpin | YES | NO | NO | NO | NO | NO | NO | NO |
| TJU_CMC_MD2.ID02362.5p-miR | TJU_CMC_MD2.ID02362.hairpin | YES | YES | YES | YES | NO | NO | NO | NO |
| TJU_CMC_MD2.ID02363.5p-miR | TJU_CMC_MD2.ID02363.hairpin | YES | YES | NO | YES | NO | NO | NO | NO |
| TJU_CMC_MD2.ID02364.3p-miR | TJU_CMC_MD2.ID02364.hairpin | YES | NO | NO | NO | NO | NO | NO | NO |
| TJU_CMC_MD2.ID02365.5p-miR | TJU_CMC_MD2.ID02365.hairpin | YES | YES | YES | YES | NO | NO | NO | NO |
| TJU_CMC_MD2.ID02366.3p-miR | TJU_CMC_MD2.ID02366.hairpin | YES | NO | NO | NO | NO | NO | NO | NO |
| TJU_CMC_MD2.ID02367.3p-miR | TJU_CMC_MD2.ID02367.hairpin | YES | NO | NO | NO | NO | NO | NO | NO |
| TJU_CMC_MD2.ID02367.5p-miR | TJU_CMC_MD2.ID02367.hairpin | YES | YES | YES | NO | YES | NO | NO | NO |
| TJU_CMC_MD2.ID02368.3p-miR | TJU_CMC_MD2.ID02368.hairpin | YES | NO | NO | NO | NO | NO | NO | NO |
| TJU_CMC_MD2.ID02369.5p-miR | TJU_CMC_MD2.ID02369.hairpin | YES | YES | YES | YES | YES | NO | NO | NO |
| TJU_CMC_MD2.ID02370.3p-miR | TJU_CMC_MD2.ID02370.hairpin | YES | NO | NO | NO | NO | NO | NO | NO |
| TJU_CMC_MD2.ID02371.5p-miR | TJU_CMC_MD2.ID02371.hairpin | YES | YES | YES | NO | YES | NO | NO | NO |
| TJU_CMC_MD2.ID02372.3p-miR | TJU_CMC_MD2.ID02372.hairpin | YES | NO | NO | NO | NO | NO | NO | NO |
| TJU_CMC_MD2.ID02373.5p-miR | TJU_CMC_MD2.ID02373.hairpin | YES | YES | YES | YES | NO | NO | NO | NO |
| TJU_CMC_MD2.ID02374.3p-miR | TJU_CMC_MD2.ID02374.hairpin | YES | NO | NO | NO | NO | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02375.3p-miR | TJU_CMC_MD2.ID02375.hairpin | YES | NO | NO | NO | NO | NO | NO | NO |
| TJU_CMC_MD2.ID02376.3p-miR | TJU_CMC_MD2.ID02376.hairpin | YES | YES | YES | YES | YES | NO | NO | NO |
| TJU_CMC_MD2.ID02376.5p-miR | TJU_CMC_MD2.ID02376.hairpin | YES | YES | YES | YES | NO | NO | NO | NO |
| TJU_CMC_MD2.ID02377.5p-miR | TJU_CMC_MD2.ID02377.hairpin | YES | NO | YES | YES | YES | NO | NO | NO |
| TJU_CMC_MD2.ID02378.5p-miR | TJU_CMC_MD2.ID02378.hairpin | YES | YES | NO | NO | NO | NO | NO | NO |
| TJU_CMC_MD2.ID02379.3p-miR | TJU_CMC_MD2.ID02379.hairpin | YES | NO | NO | NO | NO | NO | NO | NO |
| TJU_CMC_MD2.ID02380.5p-miR | TJU_CMC_MD2.ID02380.hairpin | YES | YES | YES | YES | NO | NO | NO | NO |
| TJU_CMC_MD2.ID02381.3p-miR | TJU_CMC_MD2.ID02381.hairpin | YES | YES | YES | NO | NO | NO | NO | NO |
| TJU_CMC_MD2.ID02382.3p-miR | TJU_CMC_MD2.ID02382.hairpin | YES | NO | NO | NO | NO | NO | NO | NO |
| TJU_CMC_MD2.ID02383.5p-miR | TJU_CMC_MD2.ID02383.hairpin | YES | YES | YES | NO | NO | NO | NO | NO |
| TJU_CMC_MD2.ID02384.5p-miR | TJU_CMC_MD2.ID02384.hairpin | YES | YES | YES | YES | NO | NO | NO | NO |
| TJU_CMC_MD2.ID02385.3p-miR | TJU_CMC_MD2.ID02385.hairpin | YES | NO | NO | NO | NO | NO | NO | NO |
| TJU_CMC_MD2.ID02386.3p-miR | TJU_CMC_MD2.ID02386.hairpin | YES | NO | NO | NO | NO | NO | NO | NO |
| TJU_CMC_MD2.ID02387.5p-miR | TJU_CMC_MD2.ID02387.hairpin | YES | YES | YES | YES | YES | NO | NO | NO |
| TJU_CMC_MD2.ID02388.3p-miR | TJU_CMC_MD2.ID02388.hairpin | YES | NO | NO | NO | NO | NO | NO | NO |
| TJU_CMC_MD2.ID02389.3p-miR | TJU_CMC_MD2.ID02389.hairpin | YES | NO | NO | NO | NO | NO | NO | NO |
| TJU_CMC_MD2.ID02390.3p-miR | TJU_CMC_MD2.ID02390.hairpin | YES | NO | NO | NO | NO | NO | NO | NO |
| TJU_CMC_MD2.ID02391.3p-miR | TJU_CMC_MD2.ID02391.hairpin | YES | YES | NO | YES | YES | NO | NO | NO |
| TJU_CMC_MD2.ID02392.3p-miR | TJU_CMC_MD2.ID02392.hairpin | YES | NO | NO | NO | NO | NO | NO | NO |
| TJU_CMC_MD2.ID02393.5p-miR | TJU_CMC_MD2.ID02393.hairpin | YES | YES | YES | YES | YES | NO | NO | NO |
| TJU_CMC_MD2.ID02394.5p-miR | TJU_CMC_MD2.ID02394.hairpin | YES | NO | NO | NO | NO | NO | NO | NO |
| TJU_CMC_MD2.ID02395.3p-miR | TJU_CMC_MD2.ID02395.hairpin | YES | NO | NO | NO | NO | NO | NO | NO |
| TJU_CMC_MD2.ID02396.3p-miR | TJU_CMC_MD2.ID02396.hairpin | YES | NO | NO | NO | NO | NO | NO | NO |
| TJU_CMC_MD2.ID02396.5p-miR | TJU_CMC_MD2.ID02396.hairpin | YES | NO | YES | NO | NO | NO | NO | NO |
| TJU_CMC_MD2.ID02397.3p-miR | TJU_CMC_MD2.ID02397.hairpin | YES | NO | NO | NO | NO | NO | NO | NO |
| TJU_CMC_MD2.ID02398.3p-miR | TJU_CMC_MD2.ID02398.hairpin | YES | NO | NO | NO | NO | NO | NO | NO |
| TJU_CMC_MD2.ID02399.3p-miR | TJU_CMC_MD2.ID02399.hairpin | YES | NO | NO | NO | NO | NO | NO | NO |
| TJU_CMC_MD2.ID02400.5p-miR | TJU_CMC_MD2.ID02400.hairpin | YES | YES | YES | YES | YES | NO | NO | NO |
| TJU_CMC_MD2.ID02401.3p-miR | TJU_CMC_MD2.ID02401.hairpin | YES | NO | NO | NO | NO | NO | NO | NO |
| TJU_CMC_MD2.ID02402.3p-miR | TJU_CMC_MD2.ID02402.hairpin | YES | YES | YES | YES | YES | NO | NO | NO |
| TJU_CMC_MD2.ID02403.3p-miR | TJU_CMC_MD2.ID02403.hairpin | YES | NO | NO | NO | NO | NO | NO | NO |
| TJU_CMC_MD2.ID02404.3p-miR | TJU_CMC_MD2.ID02404.hairpin | YES | NO | NO | NO | NO | NO | NO | NO |
| TJU_CMC_MD2.ID02405.5p-miR | TJU_CMC_MD2.ID02405.hairpin | YES | YES | YES | YES | YES | NO | NO | NO |
| TJU_CMC_MD2.ID02406.5p-miR | TJU_CMC_MD2.ID02406.hairpin | YES | YES | YES | YES | YES | NO | NO | NO |
| TJU_CMC_MD2.ID02407.3p-miR | TJU_CMC_MD2.ID02407.hairpin | YES | NO | NO | NO | NO | NO | NO | NO |
| TJU_CMC_MD2.ID02408.3p-miR | TJU_CMC_MD2.ID02408.hairpin | YES | NO | NO | NO | NO | NO | NO | NO |
| TJU_CMC_MD2.ID02409.3p-miR | TJU_CMC_MD2.ID02409.hairpin | YES | NO | NO | NO | NO | NO | NO | NO |
| TJU_CMC_MD2.ID02410.3p-miR | TJU_CMC_MD2.ID02410.hairpin | YES | NO | NO | NO | NO | NO | NO | NO |
| TJU_CMC_MD2.ID02410.5p-miR | TJU_CMC_MD2.ID02410.hairpin | YES | YES | YES | NO | NO | NO | NO | NO |
| TJU_CMC_MD2.ID02411.3p-miR | TJU_CMC_MD2.ID02411.hairpin | YES | YES | YES | YES | YES | NO | NO | NO |
| TJU_CMC_MD2.ID02411.5p-miR | TJU_CMC_MD2.ID02411.hairpin | YES | YES | YES | YES | NO | NO | NO | NO |
| TJU_CMC_MD2.ID02412.3p-miR | TJU_CMC_MD2.ID02412.hairpin | YES | NO | NO | NO | NO | NO | NO | NO |
| TJU_CMC_MD2.ID02413.5p-miR | TJU_CMC_MD2.ID02413.hairpin | YES | NO | NO | NO | NO | NO | NO | NO |
| TJU_CMC_MD2.ID02414.3p-miR | TJU_CMC_MD2.ID02414.hairpin | YES | NO | NO | NO | NO | NO | NO | NO |
| TJU_CMC_MD2.ID02415.3p-miR | TJU_CMC_MD2.ID02415.hairpin | YES | NO | NO | NO | NO | NO | NO | NO |
| TJU_CMC_MD2.ID02416.5p-miR | TJU_CMC_MD2.ID02416.hairpin | YES | YES | YES | YES | NO | NO | NO | NO |
| TJU_CMC_MD2.ID02417.5p-miR | TJU_CMC_MD2.ID02417.hairpin | YES | YES | YES | YES | YES | NO | NO | NO |
| TJU_CMC_MD2.ID02418.3p-miR | TJU_CMC_MD2.ID02418.hairpin | YES | NO | NO | NO | NO | NO | NO | NO |
| TJU_CMC_MD2.ID02419.3p-miR | TJU_CMC_MD2.ID02419.hairpin | YES | NO | NO | NO | NO | NO | NO | NO |
| TJU_CMC_MD2.ID02420.5p-miR | TJU_CMC_MD2.ID02420.hairpin | YES | NO | YES | NO | NO | NO | NO | NO |
| TJU_CMC_MD2.ID02421.5p-miR | TJU_CMC_MD2.ID02421.hairpin | YES | NO | YES | NO | YES | NO | NO | NO |
| TJU_CMC_MD2.ID02422.3p-miR | TJU_CMC_MD2.ID02422.hairpin | YES | NO | NO | NO | NO | NO | NO | NO |
| TJU_CMC_MD2.ID02422.5p-miR | TJU_CMC_MD2.ID02422.hairpin | YES | YES | YES | NO | NO | NO | NO | NO |
| TJU_CMC_MD2.ID02423.5p-miR | TJU_CMC_MD2.ID02423.hairpin | YES | YES | YES | YES | NO | YES | NO | NO |
| TJU_CMC_MD2.ID02424.3p-miR | TJU_CMC_MD2.ID02424.hairpin | YES | NO | NO | NO | NO | NO | NO | NO |
| TJU_CMC_MD2.ID02425.3p-miR | TJU_CMC_MD2.ID02425.hairpin | YES | NO | NO | NO | NO | NO | NO | NO |
| TJU_CMC_MD2.ID02426.5p-miR | TJU_CMC_MD2.ID02426.hairpin | YES | YES | YES | YES | YES | NO | NO | NO |
| TJU_CMC_MD2.ID02427.3p-miR | TJU_CMC_MD2.ID02427.hairpin | YES | YES | NO | YES | NO | NO | NO | NO |
| TJU_CMC_MD2.ID02428.3p-miR | TJU_CMC_MD2.ID02428.hairpin | YES | NO | NO | NO | NO | NO | NO | NO |
| TJU_CMC_MD2.ID02429.3p-miR | TJU_CMC_MD2.ID02429.hairpin | YES | NO | NO | NO | NO | NO | NO | NO |
| TJU_CMC_MD2.ID02430.3p-miR | TJU_CMC_MD2.ID02430.hairpin | YES | NO | NO | NO | NO | NO | NO | NO |
| TJU_CMC_MD2.ID02431.3p-miR | TJU_CMC_MD2.ID02431.hairpin | YES | NO | NO | NO | NO | NO | NO | NO |
| TJU_CMC_MD2.ID02432.3p-miR | TJU_CMC_MD2.ID02432.hairpin | YES | NO | NO | NO | NO | NO | NO | NO |
| TJU_CMC_MD2.ID02433.5p-miR | TJU_CMC_MD2.ID02433.hairpin | YES | YES | NO | YES | NO | NO | NO | NO |
| TJU_CMC_MD2.ID02434.3p-miR | TJU_CMC_MD2.ID02434.hairpin | YES | NO | NO | NO | NO | NO | NO | NO |
| TJU_CMC_MD2.ID02434.5p-miR | TJU_CMC_MD2.ID02434.hairpin | YES | YES | YES | YES | NO | NO | NO | NO |
| TJU_CMC_MD2.ID02435.5p-miR | TJU_CMC_MD2.ID02435.hairpin | YES | YES | YES | YES | YES | NO | NO | NO |
| TJU_CMC_MD2.ID02436.3p-miR | TJU_CMC_MD2.ID02436.hairpin | YES | NO | NO | NO | NO | NO | NO | NO |
| TJU_CMC_MD2.ID02437.3p-miR | TJU_CMC_MD2.ID02437.hairpin | YES | NO | NO | NO | NO | NO | NO | NO |
| TJU_CMC_MD2.ID02438.5p-miR | TJU_CMC_MD2.ID02438.hairpin | YES | YES | YES | YES | YES | YES | NO | NO |
| TJU_CMC_MD2.ID02439.5p-miR | TJU_CMC_MD2.ID02439.hairpin | YES | YES | YES | NO | NO | NO | NO | NO |
| TJU_CMC_MD2.ID02440.3p-miR | TJU_CMC_MD2.ID02440.hairpin | YES | NO | NO | NO | NO | NO | NO | NO |
| TJU_CMC_MD2.ID02441.5p-miR | TJU_CMC_MD2.ID02441.hairpin | YES | YES | YES | NO | NO | NO | NO | NO |
| TJU_CMC_MD2.ID02442.5p-miR | TJU_CMC_MD2.ID02442.hairpin | YES | YES | YES | YES | YES | YES | NO | NO |
| TJU_CMC_MD2.ID02443.3p-miR | TJU_CMC_MD2.ID02443.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02444.5p-miR | TJU_CMC_MD2.ID02444.hairpin | YES | NO | NO | NO | NO | NO | NO | NO |
| TJU_CMC_MD2.ID02445.3p-miR | TJU_CMC_MD2.ID02445.hairpin | YES | NO | NO | NO | NO | NO | NO | NO |
| TJU_CMC_MD2.ID02446.5p-miR | TJU_CMC_MD2.ID02446.hairpin | YES | YES | YES | YES | NO | NO | NO | NO |
| TJU_CMC_MD2.ID02447.5p-miR | TJU_CMC_MD2.ID02447.hairpin | YES | YES | YES | YES | NO | NO | NO | NO |
| TJU_CMC_MD2.ID02448.5p-miR | TJU_CMC_MD2.ID02448.hairpin | YES | YES | YES | NO | NO | NO | NO | NO |
| TJU_CMC_MD2.ID02449.3p-miR | TJU_CMC_MD2.ID02449.hairpin | YES | NO | NO | NO | NO | NO | NO | NO |
| TJU_CMC_MD2.ID02450.3p-miR | TJU_CMC_MD2.ID02450.hairpin | YES | NO | NO | NO | NO | NO | NO | NO |
| TJU_CMC_MD2.ID02451.5p-miR | TJU_CMC_MD2.ID02451.hairpin | YES | NO | YES | YES | NO | NO | NO | NO |
| TJU_CMC_MD2.ID02452.3p-miR | TJU_CMC_MD2.ID02452.hairpin | YES | NO | NO | NO | NO | NO | NO | NO |
| TJU_CMC_MD2.ID02453.3p-miR | TJU_CMC_MD2.ID02453.hairpin | YES | NO | NO | NO | NO | NO | NO | NO |
| TJU_CMC_MD2.ID02453.5p-miR | TJU_CMC_MD2.ID02453.hairpin | YES | YES | YES | YES | NO | NO | NO | NO |
| TJU_CMC_MD2.ID02454.5p-miR | TJU_CMC_MD2.ID02454.hairpin | YES | YES | YES | YES | NO | NO | NO | NO |
| TJU_CMC_MD2.ID02455.3p-miR | TJU_CMC_MD2.ID02455.hairpin | YES | NO | NO | NO | NO | NO | NO | NO |
| TJU_CMC_MD2.ID02456.3p-miR | TJU_CMC_MD2.ID02456.hairpin | YES | NO | NO | NO | NO | NO | NO | NO |
| TJU_CMC_MD2.ID02457.3p-miR | TJU_CMC_MD2.ID02457.hairpin | YES | NO | NO | NO | NO | NO | NO | NO |
| TJU_CMC_MD2.ID02458.3p-miR | TJU_CMC_MD2.ID02458.hairpin | YES | NO | NO | NO | NO | NO | NO | NO |
| TJU_CMC_MD2.ID02459.5p-miR | TJU_CMC_MD2.ID02459.hairpin | YES | NO | YES | YES | YES | NO | NO | NO |
| TJU_CMC_MD2.ID02460.5p-miR | TJU_CMC_MD2.ID02460.hairpin | YES | YES | NO | YES | YES | NO | NO | NO |
| TJU_CMC_MD2.ID02461.5p-miR | TJU_CMC_MD2.ID02461.hairpin | YES | YES | YES | YES | YES | NO | NO | NO |
| TJU_CMC_MD2.ID02462.5p-miR | TJU_CMC_MD2.ID02462.hairpin | YES | YES | YES | YES | YES | NO | NO | NO |
| TJU_CMC_MD2.ID02463.3p-miR | TJU_CMC_MD2.ID02463.hairpin | YES | NO | NO | NO | NO | NO | NO | NO |
| TJU_CMC_MD2.ID02464.5p-miR | TJU_CMC_MD2.ID02464.hairpin | YES | YES | YES | YES | NO | NO | NO | NO |
| TJU_CMC_MD2.ID02465.3p-miR | TJU_CMC_MD2.ID02465.hairpin | YES | NO | NO | NO | NO | NO | NO | NO |
| TJU_CMC_MD2.ID02466.3p-miR | TJU_CMC_MD2.ID02466.hairpin | YES | NO | NO | NO | NO | NO | NO | NO |
| TJU_CMC_MD2.ID02467.3p-miR | TJU_CMC_MD2.ID02467.hairpin | YES | NO | NO | NO | NO | NO | NO | NO |
| TJU_CMC_MD2.ID02468.5p-miR | TJU_CMC_MD2.ID02468.hairpin | YES | NO | YES | NO | YES | NO | NO | NO |
| TJU_CMC_MD2.ID02469.3p-miR | TJU_CMC_MD2.ID02469.hairpin | YES | NO | NO | NO | NO | NO | NO | NO |
| TJU_CMC_MD2.ID02470.3p-miR | TJU_CMC_MD2.ID02470.hairpin | YES | NO | NO | NO | NO | NO | NO | NO |
| TJU_CMC_MD2.ID02471.3p-miR | TJU_CMC_MD2.ID02471.hairpin | YES | NO | NO | NO | NO | NO | NO | NO |
| TJU_CMC_MD2.ID02472.3p-miR | TJU_CMC_MD2.ID02472.hairpin | YES | NO | NO | NO | NO | NO | NO | NO |
| TJU_CMC_MD2.ID02473.3p-miR | TJU_CMC_MD2.ID02473.hairpin | YES | NO | NO | NO | NO | NO | NO | NO |
| TJU_CMC_MD2.ID02474.3p-miR | TJU_CMC_MD2.ID02474.hairpin | YES | NO | NO | NO | NO | NO | NO | NO |
| TJU_CMC_MD2.ID02475.5p-miR | TJU_CMC_MD2.ID02475.hairpin | YES | YES | YES | YES | NO | NO | NO | NO |
| TJU_CMC_MD2.ID02476.3p-miR | TJU_CMC_MD2.ID02476.hairpin | YES | NO | NO | NO | NO | NO | NO | NO |
| TJU_CMC_MD2.ID02477.3p-miR | TJU_CMC_MD2.ID02477.hairpin | YES | NO | NO | NO | NO | NO | NO | NO |
| TJU_CMC_MD2.ID02478.3p-miR | TJU_CMC_MD2.ID02478.hairpin | YES | NO | NO | NO | NO | NO | NO | NO |
| TJU_CMC_MD2.ID02479.3p-miR | TJU_CMC_MD2.ID02479.hairpin | YES | NO | NO | NO | NO | NO | NO | NO |
| TJU_CMC_MD2.ID02480.5p-miR | TJU_CMC_MD2.ID02480.hairpin | YES | YES | YES | YES | NO | NO | NO | NO |
| TJU_CMC_MD2.ID02481.5p-miR | TJU_CMC_MD2.ID02481.hairpin | YES | YES | NO | YES | YES | NO | NO | NO |
| TJU_CMC_MD2.ID02482.3p-miR | TJU_CMC_MD2.ID02482.hairpin | YES | NO | NO | NO | NO | NO | NO | NO |
| TJU_CMC_MD2.ID02483.3p-miR | TJU_CMC_MD2.ID02483.hairpin | YES | NO | NO | NO | NO | NO | NO | NO |
| TJU_CMC_MD2.ID02484.3p-miR | TJU_CMC_MD2.ID02484.hairpin | YES | NO | NO | NO | NO | NO | NO | NO |
| TJU_CMC_MD2.ID02485.5p-miR | TJU_CMC_MD2.ID02485.hairpin | YES | NO | YES | NO | NO | NO | NO | NO |
| TJU_CMC_MD2.ID02486.3p-miR | TJU_CMC_MD2.ID02486.hairpin | YES | NO | NO | NO | NO | NO | NO | NO |
| TJU_CMC_MD2.ID02487.5p-miR | TJU_CMC_MD2.ID02487.hairpin | YES | YES | NO | NO | NO | NO | NO | NO |
| TJU_CMC_MD2.ID02488.3p-miR | TJU_CMC_MD2.ID02488.hairpin | YES | NO | NO | NO | NO | NO | NO | NO |
| TJU_CMC_MD2.ID02488.5p-miR | TJU_CMC_MD2.ID02488.hairpin | YES | YES | YES | NO | NO | NO | NO | NO |
| TJU_CMC_MD2.ID02489.3p-miR | TJU_CMC_MD2.ID02489.hairpin | YES | NO | NO | NO | NO | NO | NO | NO |
| TJU_CMC_MD2.ID02490.5p-miR | TJU_CMC_MD2.ID02490.hairpin | YES | YES | YES | YES | NO | NO | NO | NO |
| TJU_CMC_MD2.ID02491.3p-miR | TJU_CMC_MD2.ID02491.hairpin | YES | NO | NO | NO | NO | NO | NO | NO |
| TJU_CMC_MD2.ID02491.5p-miR | TJU_CMC_MD2.ID02491.hairpin | YES | YES | YES | NO | YES | NO | NO | NO |
| TJU_CMC_MD2.ID02492.3p-miR | TJU_CMC_MD2.ID02492.hairpin | YES | NO | NO | NO | NO | NO | NO | NO |
| TJU_CMC_MD2.ID02493.3p-miR | TJU_CMC_MD2.ID02493.hairpin | YES | NO | NO | NO | NO | NO | NO | NO |
| TJU_CMC_MD2.ID02494.3p-miR | TJU_CMC_MD2.ID02494.hairpin | YES | NO | NO | NO | NO | NO | NO | NO |
| TJU_CMC_MD2.ID02495.3p-miR | TJU_CMC_MD2.ID02495.hairpin | YES | NO | NO | NO | NO | NO | NO | NO |
| TJU_CMC_MD2.ID02496.5p-miR | TJU_CMC_MD2.ID02496.hairpin | YES | YES | YES | NO | NO | NO | NO | NO |
| TJU_CMC_MD2.ID02497.3p-miR | TJU_CMC_MD2.ID02497.hairpin | YES | NO | NO | NO | NO | NO | NO | NO |
| TJU_CMC_MD2.ID02498.5p-miR | TJU_CMC_MD2.ID02498.hairpin | YES | YES | YES | YES | NO | NO | NO | NO |
| TJU_CMC_MD2.ID02499.3p-miR | TJU_CMC_MD2.ID02499.hairpin | YES | NO | NO | NO | NO | NO | NO | NO |
| TJU_CMC_MD2.ID02500.3p-miR | TJU_CMC_MD2.ID02500.hairpin | YES | NO | NO | NO | NO | NO | NO | NO |
| TJU_CMC_MD2.ID02501.3p-miR | TJU_CMC_MD2.ID02501.hairpin | YES | NO | NO | NO | NO | NO | NO | NO |
| TJU_CMC_MD2.ID02502.3p-miR | TJU_CMC_MD2.ID02502.hairpin | YES | NO | NO | NO | NO | NO | NO | NO |
| TJU_CMC_MD2.ID02503.3p-miR | TJU_CMC_MD2.ID02503.hairpin | YES | NO | NO | NO | NO | NO | NO | NO |
| TJU_CMC_MD2.ID02504.5p-miR | TJU_CMC_MD2.ID02504.hairpin | YES | YES | YES | YES | NO | NO | NO | NO |
| TJU_CMC_MD2.ID02505.5p-miR | TJU_CMC_MD2.ID02505.hairpin | YES | NO | NO | NO | NO | NO | NO | NO |
| TJU_CMC_MD2.ID02506.3p-miR | TJU_CMC_MD2.ID02506.hairpin | YES | NO | NO | NO | NO | NO | NO | NO |
| TJU_CMC_MD2.ID02507.3p-miR | TJU_CMC_MD2.ID02507.hairpin | YES | NO | NO | NO | NO | NO | NO | NO |
| TJU_CMC_MD2.ID02508.5p-miR | TJU_CMC_MD2.ID02508.hairpin | YES | YES | YES | YES | YES | NO | NO | NO |
| TJU_CMC_MD2.ID02509.3p-miR | TJU_CMC_MD2.ID02509.hairpin | YES | NO | NO | NO | NO | NO | NO | NO |
| TJU_CMC_MD2.ID02510.3p-miR | TJU_CMC_MD2.ID02510.hairpin | YES | NO | NO | NO | NO | NO | NO | NO |
| TJU_CMC_MD2.ID02510.5p-miR | TJU_CMC_MD2.ID02510.hairpin | YES | YES | NO | NO | NO | NO | NO | NO |
| TJU_CMC_MD2.ID02511.3p-miR | TJU_CMC_MD2.ID02511.hairpin | YES | NO | NO | NO | NO | NO | NO | NO |
| TJU_CMC_MD2.ID02512.3p-miR | TJU_CMC_MD2.ID02512.hairpin | YES | NO | NO | NO | NO | NO | NO | NO |
| TJU_CMC_MD2.ID02513.5p-miR | TJU_CMC_MD2.ID02513.hairpin | YES | NO | NO | NO | NO | NO | NO | NO |
| TJU_CMC_MD2.ID02514.3p-miR | TJU_CMC_MD2.ID02514.hairpin | YES | NO | NO | NO | NO | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02514.5p-miR | TJU_CMC_MD2.ID02514.hairpin | YES | NO | NO | NO | NO | NO | NO | NO |
| TJU_CMC_MD2.ID02515.3p-miR | TJU_CMC_MD2.ID02515.hairpin | YES | NO | NO | NO | NO | NO | NO | NO |
| TJU_CMC_MD2.ID02516.3p-miR | TJU_CMC_MD2.ID02516.hairpin | YES | NO | NO | NO | NO | NO | NO | NO |
| TJU_CMC_MD2.ID02517.3p-miR | TJU_CMC_MD2.ID02517.hairpin | YES | NO | NO | NO | NO | NO | NO | NO |
| TJU_CMC_MD2.ID02518.3p-miR | TJU_CMC_MD2.ID02518.hairpin | YES | NO | NO | NO | NO | NO | NO | NO |
| TJU_CMC_MD2.ID02519.3p-miR | TJU_CMC_MD2.ID02519.hairpin | YES | YES | YES | YES | NO | NO | NO | NO |
| TJU_CMC_MD2.ID02520.5p-miR | TJU_CMC_MD2.ID02520.hairpin | YES | YES | NO | NO | YES | NO | NO | NO |
| TJU_CMC_MD2.ID02521.5p-miR | TJU_CMC_MD2.ID02521.hairpin | YES | YES | YES | NO | NO | NO | NO | NO |
| TJU_CMC_MD2.ID02522.3p-miR | TJU_CMC_MD2.ID02522.hairpin | YES | NO | NO | NO | NO | NO | NO | NO |
| TJU_CMC_MD2.ID02523.3p-miR | TJU_CMC_MD2.ID02523.hairpin | YES | NO | NO | NO | NO | NO | NO | NO |
| TJU_CMC_MD2.ID02524.5p-miR | TJU_CMC_MD2.ID02524.hairpin | YES | YES | YES | YES | NO | NO | NO | NO |
| TJU_CMC_MD2.ID02525.5p-miR | TJU_CMC_MD2.ID02525.hairpin | YES | YES | YES | YES | NO | NO | NO | NO |
| TJU_CMC_MD2.ID02526.3p-miR | TJU_CMC_MD2.ID02526.hairpin | YES | NO | NO | NO | NO | NO | NO | NO |
| TJU_CMC_MD2.ID02527.5p-miR | TJU_CMC_MD2.ID02527.hairpin | YES | YES | NO | NO | NO | NO | NO | NO |
| TJU_CMC_MD2.ID02528.3p-miR | TJU_CMC_MD2.ID02528.hairpin | YES | NO | NO | NO | NO | NO | NO | NO |
| TJU_CMC_MD2.ID02528.5p-miR | TJU_CMC_MD2.ID02528.hairpin | YES | YES | YES | YES | YES | NO | NO | NO |
| TJU_CMC_MD2.ID02529.5p-miR | TJU_CMC_MD2.ID02529.hairpin | YES | YES | NO | NO | NO | NO | NO | NO |
| TJU_CMC_MD2.ID02530.5p-miR | TJU_CMC_MD2.ID02530.hairpin | YES | NO | NO | YES | NO | NO | NO | NO |
| TJU_CMC_MD2.ID02531.3p-miR | TJU_CMC_MD2.ID02531.hairpin | YES | NO | NO | NO | NO | NO | NO | NO |
| TJU_CMC_MD2.ID02532.3p-miR | TJU_CMC_MD2.ID02532.hairpin | YES | NO | NO | NO | NO | NO | NO | NO |
| TJU_CMC_MD2.ID02533.3p-miR | TJU_CMC_MD2.ID02533.hairpin | YES | NO | NO | NO | NO | NO | NO | NO |
| TJU_CMC_MD2.ID02534.5p-miR | TJU_CMC_MD2.ID02534.hairpin | YES | NO | YES | NO | NO | NO | NO | NO |
| TJU_CMC_MD2.ID02535.3p-miR | TJU_CMC_MD2.ID02535.hairpin | YES | NO | NO | NO | NO | NO | NO | NO |
| TJU_CMC_MD2.ID02536.5p-miR | TJU_CMC_MD2.ID02536.hairpin | YES | YES | YES | YES | NO | YES | NO | NO |
| TJU_CMC_MD2.ID02537.5p-miR | TJU_CMC_MD2.ID02537.hairpin | YES | YES | NO | NO | NO | NO | NO | NO |
| TJU_CMC_MD2.ID02538.3p-miR | TJU_CMC_MD2.ID02538.hairpin | YES | NO | NO | NO | NO | NO | NO | NO |
| TJU_CMC_MD2.ID02539.3p-miR | TJU_CMC_MD2.ID02539.hairpin | YES | NO | NO | NO | NO | NO | NO | NO |
| TJU_CMC_MD2.ID02540.3p-miR | TJU_CMC_MD2.ID02540.hairpin | YES | NO | NO | NO | NO | NO | NO | NO |
| TJU_CMC_MD2.ID02541.5p-miR | TJU_CMC_MD2.ID02541.hairpin | YES | YES | YES | YES | YES | NO | NO | NO |
| TJU_CMC_MD2.ID02542.5p-miR | TJU_CMC_MD2.ID02542.hairpin | YES | YES | YES | YES | YES | NO | NO | NO |
| TJU_CMC_MD2.ID02543.3p-miR | TJU_CMC_MD2.ID02543.hairpin | YES | NO | NO | NO | NO | NO | NO | NO |
| TJU_CMC_MD2.ID02544.5p-miR | TJU_CMC_MD2.ID02544.hairpin | YES | YES | YES | YES | NO | NO | NO | NO |
| TJU_CMC_MD2.ID02545.3p-miR | TJU_CMC_MD2.ID02545.hairpin | YES | NO | NO | NO | NO | NO | NO | NO |
| TJU_CMC_MD2.ID02545.5p-miR | TJU_CMC_MD2.ID02545.hairpin | YES | NO | NO | NO | NO | NO | NO | NO |
| TJU_CMC_MD2.ID02546.5p-miR | TJU_CMC_MD2.ID02546.hairpin | YES | NO | YES | NO | NO | NO | NO | NO |
| TJU_CMC_MD2.ID02547.5p-miR | TJU_CMC_MD2.ID02547.hairpin | YES | YES | YES | NO | NO | NO | NO | NO |
| TJU_CMC_MD2.ID02548.5p-miR | TJU_CMC_MD2.ID02548.hairpin | YES | NO | NO | NO | NO | NO | NO | NO |
| TJU_CMC_MD2.ID02549.3p-miR | TJU_CMC_MD2.ID02549.hairpin | YES | NO | NO | NO | NO | NO | NO | NO |
| TJU_CMC_MD2.ID02550.3p-miR | TJU_CMC_MD2.ID02550.hairpin | YES | NO | NO | NO | NO | NO | NO | NO |
| TJU_CMC_MD2.ID02551.3p-miR | TJU_CMC_MD2.ID02551.hairpin | YES | YES | YES | YES | NO | NO | NO | NO |
| TJU_CMC_MD2.ID02552.3p-miR | TJU_CMC_MD2.ID02552.hairpin | YES | NO | NO | NO | NO | NO | NO | NO |
| TJU_CMC_MD2.ID02553.3p-miR | TJU_CMC_MD2.ID02553.hairpin | YES | NO | NO | NO | NO | NO | NO | NO |
| TJU_CMC_MD2.ID02554.3p-miR | TJU_CMC_MD2.ID02554.hairpin | YES | NO | NO | NO | NO | NO | NO | NO |
| TJU_CMC_MD2.ID02555.5p-miR | TJU_CMC_MD2.ID02555.hairpin | YES | NO | NO | NO | NO | NO | NO | NO |
| TJU_CMC_MD2.ID02556.3p-miR | TJU_CMC_MD2.ID02556.hairpin | YES | NO | NO | NO | NO | NO | NO | NO |
| TJU_CMC_MD2.ID02556.5p-miR | TJU_CMC_MD2.ID02556.hairpin | YES | NO | YES | YES | NO | NO | NO | NO |
| TJU_CMC_MD2.ID02557.3p-miR | TJU_CMC_MD2.ID02557.hairpin | YES | NO | NO | NO | NO | NO | NO | NO |
| TJU_CMC_MD2.ID02558.3p-miR | TJU_CMC_MD2.ID02558.hairpin | YES | NO | NO | NO | NO | NO | NO | NO |
| TJU_CMC_MD2.ID02559.5p-miR | TJU_CMC_MD2.ID02559.hairpin | YES | NO | NO | NO | NO | NO | NO | NO |
| TJU_CMC_MD2.ID02560.3p-miR | TJU_CMC_MD2.ID02560.hairpin | YES | YES | YES | YES | YES | NO | NO | NO |
| TJU_CMC_MD2.ID02561.5p-miR | TJU_CMC_MD2.ID02561.hairpin | YES | YES | YES | YES | YES | NO | NO | NO |
| TJU_CMC_MD2.ID02562.3p-miR | TJU_CMC_MD2.ID02562.hairpin | YES | NO | NO | NO | NO | NO | NO | NO |
| TJU_CMC_MD2.ID02563.3p-miR | TJU_CMC_MD2.ID02563.hairpin | YES | NO | NO | NO | NO | NO | NO | NO |
| TJU_CMC_MD2.ID02564.3p-miR | TJU_CMC_MD2.ID02564.hairpin | YES | NO | NO | NO | NO | NO | NO | NO |
| TJU_CMC_MD2.ID02565.3p-miR | TJU_CMC_MD2.ID02565.hairpin | YES | NO | NO | NO | NO | NO | NO | NO |
| TJU_CMC_MD2.ID02565.5p-miR | TJU_CMC_MD2.ID02565.hairpin | YES | NO | YES | YES | YES | NO | NO | NO |
| TJU_CMC_MD2.ID02566.3p-miR | TJU_CMC_MD2.ID02566.hairpin | YES | NO | NO | NO | NO | NO | NO | NO |
| TJU_CMC_MD2.ID02567.3p-miR | TJU_CMC_MD2.ID02567.hairpin | YES | NO | NO | NO | NO | NO | NO | NO |
| TJU_CMC_MD2.ID02568.3p-miR | TJU_CMC_MD2.ID02568.hairpin | YES | NO | NO | NO | NO | NO | NO | NO |
| TJU_CMC_MD2.ID02569.3p-miR | TJU_CMC_MD2.ID02569.hairpin | YES | NO | NO | NO | NO | NO | NO | NO |
| TJU_CMC_MD2.ID02570.3p-miR | TJU_CMC_MD2.ID02570.hairpin | YES | NO | NO | NO | NO | NO | NO | NO |
| TJU_CMC_MD2.ID02571.5p-miR | TJU_CMC_MD2.ID02571.hairpin | YES | YES | YES | YES | NO | NO | NO | NO |
| TJU_CMC_MD2.ID02572.5p-miR | TJU_CMC_MD2.ID02572.hairpin | YES | YES | NO | NO | NO | NO | NO | NO |
| TJU_CMC_MD2.ID02573.5p-miR | TJU_CMC_MD2.ID02573.hairpin | YES | NO | NO | NO | NO | NO | NO | NO |
| TJU_CMC_MD2.ID02574.3p-miR | TJU_CMC_MD2.ID02574.hairpin | YES | NO | NO | NO | NO | NO | NO | NO |
| TJU_CMC_MD2.ID02575.3p-miR | TJU_CMC_MD2.ID02575.hairpin | YES | NO | NO | NO | NO | NO | NO | NO |
| TJU_CMC_MD2.ID02576.5p-miR | TJU_CMC_MD2.ID02576.hairpin | YES | YES | YES | YES | YES | NO | NO | NO |
| TJU_CMC_MD2.ID02577.3p-miR | TJU_CMC_MD2.ID02577.hairpin | YES | NO | NO | NO | NO | NO | NO | NO |
| TJU_CMC_MD2.ID02578.3p-miR | TJU_CMC_MD2.ID02578.hairpin | YES | NO | NO | NO | NO | NO | NO | NO |
| TJU_CMC_MD2.ID02579.3p-miR | TJU_CMC_MD2.ID02579.hairpin | YES | NO | NO | NO | NO | NO | NO | NO |
| TJU_CMC_MD2.ID02579.5p-miR | TJU_CMC_MD2.ID02579.hairpin | YES | NO | YES | NO | YES | NO | NO | NO |
| TJU_CMC_MD2.ID02580.3p-miR | TJU_CMC_MD2.ID02580.hairpin | YES | NO | NO | NO | NO | NO | NO | NO |
| TJU_CMC_MD2.ID02581.5p-miR | TJU_CMC_MD2.ID02581.hairpin | YES | YES | YES | YES | NO | NO | NO | NO |
| TJU_CMC_MD2.ID02582.3p-miR | TJU_CMC_MD2.ID02582.hairpin | YES | NO | NO | NO | NO | NO | NO | NO |
| TJU_CMC_MD2.ID02583.5p-miR | TJU_CMC_MD2.ID02583.hairpin | YES | YES | YES | YES | YES | NO | NO | NO |

TABLE 7-continued

Conservation properties across the examined model organisms for the novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02584.3p-miR | TJU_CMC_MD2.ID02584.hairpin | YES | NO | NO | NO | NO | NO | NO | NO |
| TJU_CMC_MD2.ID02585.5p-miR | TJU_CMC_MD2.ID02585.hairpin | YES | NO | NO | NO | NO | NO | NO | NO |
| TJU_CMC_MD2.ID02586.3p-miR | TJU_CMC_MD2.ID02586.hairpin | YES | NO | NO | NO | NO | NO | NO | NO |
| TJU_CMC_MD2.ID02587.3p-miR | TJU_CMC_MD2.ID02587.hairpin | YES | NO | NO | NO | NO | NO | NO | NO |
| TJU_CMC_MD2.ID02588.3p-miR | TJU_CMC_MD2.ID02588.hairpin | YES | NO | NO | NO | NO | NO | NO | NO |
| TJU_CMC_MD2.ID02589.5p-miR | TJU_CMC_MD2.ID02589.hairpin | YES | YES | YES | YES | NO | NO | NO | NO |
| TJU_CMC_MD2.ID02590.3p-miR | TJU_CMC_MD2.ID02590.hairpin | YES | NO | NO | NO | NO | NO | NO | NO |
| TJU_CMC_MD2.ID02591.5p-miR | TJU_CMC_MD2.ID02591.hairpin | YES | NO | YES | YES | NO | NO | NO | NO |
| TJU_CMC_MD2.ID02592.5p-miR | TJU_CMC_MD2.ID02592.hairpin | YES | NO | NO | NO | NO | NO | NO | NO |
| TJU_CMC_MD2.ID02593.5p-miR | TJU_CMC_MD2.ID02593.hairpin | YES | YES | NO | YES | NO | NO | NO | NO |
| TJU_CMC_MD2.ID02594.3p-miR | TJU_CMC_MD2.ID02594.hairpin | YES | NO | NO | NO | NO | NO | NO | NO |
| TJU_CMC_MD2.ID02595.5p-miR | TJU_CMC_MD2.ID02595.hairpin | YES | NO | YES | NO | NO | NO | NO | NO |
| TJU_CMC_MD2.ID02596.5p-miR | TJU_CMC_MD2.ID02596.hairpin | YES | YES | YES | YES | NO | NO | NO | NO |
| TJU_CMC_MD2.ID02597.3p-miR | TJU_CMC_MD2.ID02597.hairpin | YES | NO | NO | NO | NO | NO | NO | NO |
| TJU_CMC_MD2.ID02598.3p-miR | TJU_CMC_MD2.ID02598.hairpin | YES | NO | NO | NO | NO | NO | NO | NO |
| TJU_CMC_MD2.ID02599.3p-miR | TJU_CMC_MD2.ID02599.hairpin | YES | NO | NO | NO | NO | NO | NO | NO |
| TJU_CMC_MD2.ID02600.3p-miR | TJU_CMC_MD2.ID02600.hairpin | YES | NO | NO | NO | NO | NO | NO | NO |
| TJU_CMC_MD2.ID02601.5p-miR | TJU_CMC_MD2.ID02601.hairpin | YES | NO | YES | NO | NO | NO | NO | NO |
| TJU_CMC_MD2.ID02602.5p-miR | TJU_CMC_MD2.ID02602.hairpin | YES | YES | NO | YES | NO | NO | NO | NO |
| TJU_CMC_MD2.ID02603.3p-miR | TJU_CMC_MD2.ID02603.hairpin | YES | NO | NO | NO | NO | NO | NO | NO |
| TJU_CMC_MD2.ID02604.3p-miR | TJU_CMC_MD2.ID02604.hairpin | YES | YES | NO | YES | YES | NO | NO | NO |
| TJU_CMC_MD2.ID02604.5p-miR | TJU_CMC_MD2.ID02604.hairpin | YES | YES | YES | YES | YES | NO | NO | NO |
| TJU_CMC_MD2.ID02605.3p-miR | TJU_CMC_MD2.ID02605.hairpin | YES | YES | YES | YES | YES | NO | NO | NO |
| TJU_CMC_MD2.ID02606.5p-miR | TJU_CMC_MD2.ID02606.hairpin | YES | YES | YES | YES | YES | NO | NO | NO |
| TJU_CMC_MD2.ID02607.3p-miR | TJU_CMC_MD2.ID02607.hairpin | YES | NO | NO | NO | NO | NO | NO | NO |
| TJU_CMC_MD2.ID02608.5p-miR | TJU_CMC_MD2.ID02608.hairpin | YES | YES | YES | YES | NO | NO | NO | NO |
| TJU_CMC_MD2.ID02609.3p-miR | TJU_CMC_MD2.ID02609.hairpin | YES | NO | NO | NO | NO | NO | NO | NO |
| TJU_CMC_MD2.ID02610.3p-miR | TJU_CMC_MD2.ID02610.hairpin | YES | NO | NO | NO | NO | NO | NO | NO |
| TJU_CMC_MD2.ID02611.3p-miR | TJU_CMC_MD2.ID02611.hairpin | YES | NO | NO | NO | NO | NO | NO | NO |
| TJU_CMC_MD2.ID02612.5p-miR | TJU_CMC_MD2.ID02612.hairpin | YES | NO | NO | NO | NO | NO | NO | NO |
| TJU_CMC_MD2.ID02613.3p-miR | TJU_CMC_MD2.ID02613.hairpin | YES | NO | NO | NO | NO | NO | NO | NO |
| TJU_CMC_MD2.ID02614.3p-miR | TJU_CMC_MD2.ID02614.hairpin | YES | NO | NO | NO | NO | NO | NO | NO |
| TJU_CMC_MD2.ID02615.5p-miR | TJU_CMC_MD2.ID02615.hairpin | YES | NO | YES | YES | NO | NO | NO | NO |
| TJU_CMC_MD2.ID02616.5p-miR | TJU_CMC_MD2.ID02616.hairpin | YES | YES | YES | YES | YES | NO | NO | NO |
| TJU_CMC_MD2.ID02617.5p-miR | TJU_CMC_MD2.ID02617.hairpin | YES | NO | NO | NO | NO | NO | NO | NO |
| TJU_CMC_MD2.ID02618.3p-miR | TJU_CMC_MD2.ID02618.hairpin | YES | NO | NO | NO | NO | NO | NO | NO |
| TJU_CMC_MD2.ID02619.5p-miR | TJU_CMC_MD2.ID02619.hairpin | YES | YES | YES | YES | NO | NO | NO | NO |
| TJU_CMC_MD2.ID02620.5p-miR | TJU_CMC_MD2.ID02620.hairpin | YES | YES | YES | YES | NO | NO | NO | NO |
| TJU_CMC_MD2.ID02621.3p-miR | TJU_CMC_MD2.ID02621.hairpin | YES | NO | NO | NO | NO | NO | NO | NO |
| TJU_CMC_MD2.ID02622.3p-miR | TJU_CMC_MD2.ID02622.hairpin | YES | NO | NO | NO | NO | NO | NO | NO |
| TJU_CMC_MD2.ID02623.3p-miR | TJU_CMC_MD2.ID02623.hairpin | YES | NO | NO | NO | NO | NO | NO | NO |
| TJU_CMC_MD2.ID02624.3p-miR | TJU_CMC_MD2.ID02624.hairpin | YES | NO | NO | NO | NO | NO | NO | NO |
| TJU_CMC_MD2.ID02625.5p-miR | TJU_CMC_MD2.ID02625.hairpin | YES | YES | YES | NO | NO | NO | NO | NO |
| TJU_CMC_MD2.ID02626.5p-miR | TJU_CMC_MD2.ID02626.hairpin | YES | YES | YES | YES | NO | YES | NO | NO |
| TJU_CMC_MD2.ID02627.5p-miR | TJU_CMC_MD2.ID02627.hairpin | YES | YES | YES | YES | YES | NO | NO | NO |
| TJU_CMC_MD2.ID02628.5p-miR | TJU_CMC_MD2.ID02628.hairpin | YES | YES | YES | YES | NO | NO | NO | NO |
| TJU_CMC_MD2.ID02629.3p-miR | TJU_CMC_MD2.ID02629.hairpin | YES | YES | YES | YES | NO | NO | NO | NO |
| TJU_CMC_MD2.ID02629.5p-miR | TJU_CMC_MD2.ID02629.hairpin | YES | YES | YES | YES | NO | NO | NO | NO |
| TJU_CMC_MD2.ID02630.3p-miR | TJU_CMC_MD2.ID02630.hairpin | YES | NO | NO | NO | NO | NO | NO | NO |
| TJU_CMC_MD2.ID02631.5p-miR | TJU_CMC_MD2.ID02631.hairpin | YES | NO | YES | NO | NO | NO | NO | NO |
| TJU_CMC_MD2.ID02632.5p-miR | TJU_CMC_MD2.ID02632.hairpin | YES | YES | YES | NO | NO | NO | NO | NO |
| TJU_CMC_MD2.ID02633.3p-miR | TJU_CMC_MD2.ID02633.hairpin | YES | YES | YES | YES | NO | NO | NO | NO |
| TJU_CMC_MD2.ID02634.3p-miR | TJU_CMC_MD2.ID02634.hairpin | YES | NO | NO | NO | NO | NO | NO | NO |
| TJU_CMC_MD2.ID02635.5p-miR | TJU_CMC_MD2.ID02635.hairpin | YES | YES | YES | YES | NO | NO | NO | NO |
| TJU_CMC_MD2.ID02636.5p-miR | TJU_CMC_MD2.ID02636.hairpin | YES | YES | YES | YES | YES | NO | NO | NO |
| TJU_CMC_MD2.ID02637.3p-miR | TJU_CMC_MD2.ID02637.hairpin | YES | NO | NO | NO | NO | NO | NO | NO |
| TJU_CMC_MD2.ID02638.3p-miR | TJU_CMC_MD2.ID02638.hairpin | YES | NO | NO | NO | NO | NO | NO | NO |
| TJU_CMC_MD2.ID02638.5p-miR | TJU_CMC_MD2.ID02638.hairpin | YES | YES | YES | NO | NO | NO | NO | NO |
| TJU_CMC_MD2.ID02639.5p-miR | TJU_CMC_MD2.ID02639.hairpin | YES | YES | YES | YES | NO | NO | NO | NO |
| TJU_CMC_MD2.ID02640.3p-miR | TJU_CMC_MD2.ID02640.hairpin | YES | NO | NO | NO | NO | NO | NO | NO |
| TJU_CMC_MD2.ID02641.5p-miR | TJU_CMC_MD2.ID02641.hairpin | YES | YES | YES | YES | YES | NO | NO | NO |
| TJU_CMC_MD2.ID02642.3p-miR | TJU_CMC_MD2.ID02642.hairpin | YES | NO | NO | NO | NO | NO | NO | NO |
| TJU_CMC_MD2.ID02642.5p-miR | TJU_CMC_MD2.ID02642.hairpin | YES | YES | YES | YES | YES | NO | NO | NO |
| TJU_CMC_MD2.ID02643.3p-miR | TJU_CMC_MD2.ID02643.hairpin | YES | NO | NO | NO | NO | NO | NO | NO |
| TJU_CMC_MD2.ID02644.3p-miR | TJU_CMC_MD2.ID02644.hairpin | YES | NO | NO | NO | NO | NO | NO | NO |
| TJU_CMC_MD2.ID02645.5p-miR | TJU_CMC_MD2.ID02645.hairpin | YES | YES | NO | YES | YES | NO | NO | NO |
| TJU_CMC_MD2.ID02646.3p-miR | TJU_CMC_MD2.ID02646.hairpin | YES | NO | NO | NO | NO | NO | NO | NO |
| TJU_CMC_MD2.ID02647.3p-miR | TJU_CMC_MD2.ID02647.hairpin | YES | NO | NO | NO | NO | NO | NO | NO |
| TJU_CMC_MD2.ID02648.5p-miR | TJU_CMC_MD2.ID02648.hairpin | YES | YES | YES | NO | NO | NO | NO | NO |
| TJU_CMC_MD2.ID02649.5p-miR | TJU_CMC_MD2.ID02649.hairpin | YES | NO | YES | YES | NO | NO | NO | NO |
| TJU_CMC_MD2.ID02650.3p-miR | TJU_CMC_MD2.ID02650.hairpin | YES | YES | YES | YES | NO | NO | NO | NO |
| TJU_CMC_MD2.ID02651.5p-miR | TJU_CMC_MD2.ID02651.hairpin | YES | YES | NO | NO | NO | NO | NO | NO |
| TJU_CMC_MD2.ID02652.5p-miR | TJU_CMC_MD2.ID02652.hairpin | YES | YES | YES | NO | NO | NO | NO | NO |
| TJU_CMC_MD2.ID02653.3p-miR | TJU_CMC_MD2.ID02653.hairpin | YES | NO | NO | NO | NO | NO | NO | NO |
| TJU_CMC_MD2.ID02654.3p-miR | TJU_CMC_MD2.ID02654.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02655.3p-miR | TJU_CMC_MD2.ID02655.hairpin | YES | NO | NO | NO | NO | NO | NO | NO |
| TJU_CMC_MD2.ID02656.5p-miR | TJU_CMC_MD2.ID02656.hairpin | YES | YES | YES | YES | YES | NO | NO | NO |
| TJU_CMC_MD2.ID02657.5p-miR | TJU_CMC_MD2.ID02657.hairpin | YES | YES | NO | NO | NO | NO | NO | NO |
| TJU_CMC_MD2.ID02658.5p-miR | TJU_CMC_MD2.ID02658.hairpin | YES | YES | YES | YES | YES | NO | NO | NO |
| TJU_CMC_MD2.ID02659.3p-miR | TJU_CMC_MD2.ID02659.hairpin | YES | NO | NO | NO | NO | NO | NO | NO |
| TJU_CMC_MD2.ID02660.3p-miR | TJU_CMC_MD2.ID02660.hairpin | YES | NO | NO | NO | NO | NO | NO | NO |
| TJU_CMC_MD2.ID02661.5p-miR | TJU_CMC_MD2.ID02661.hairpin | YES | NO | NO | YES | NO | NO | NO | NO |
| TJU_CMC_MD2.ID02662.5p-miR | TJU_CMC_MD2.ID02662.hairpin | YES | YES | YES | YES | YES | NO | NO | NO |
| TJU_CMC_MD2.ID02663.5p-miR | TJU_CMC_MD2.ID02663.hairpin | YES | YES | YES | YES | YES | NO | NO | NO |
| TJU_CMC_MD2.ID02664.5p-miR | TJU_CMC_MD2.ID02664.hairpin | YES | YES | YES | YES | YES | NO | NO | NO |
| TJU_CMC_MD2.ID02665.3p-miR | TJU_CMC_MD2.ID02665.hairpin | YES | NO | NO | NO | NO | NO | NO | NO |
| TJU_CMC_MD2.ID02666.5p-miR | TJU_CMC_MD2.ID02666.hairpin | YES | YES | YES | YES | YES | NO | NO | NO |
| TJU_CMC_MD2.ID02667.5p-miR | TJU_CMC_MD2.ID02667.hairpin | YES | YES | YES | YES | YES | NO | NO | NO |
| TJU_CMC_MD2.ID02668.5p-miR | TJU_CMC_MD2.ID02668.hairpin | YES | YES | YES | NO | NO | NO | NO | NO |
| TJU_CMC_MD2.ID02669.5p-miR | TJU_CMC_MD2.ID02669.hairpin | YES | YES | YES | YES | NO | NO | NO | NO |
| TJU_CMC_MD2.ID02670.3p-miR | TJU_CMC_MD2.ID02670.hairpin | YES | NO | NO | NO | NO | NO | NO | NO |
| TJU_CMC_MD2.ID02670.5p-miR | TJU_CMC_MD2.ID02670.hairpin | YES | NO | YES | NO | YES | NO | NO | NO |
| TJU_CMC_MD2.ID02671.5p-miR | TJU_CMC_MD2.ID02671.hairpin | YES | NO | NO | NO | NO | NO | NO | NO |
| TJU_CMC_MD2.ID02672.5p-miR | TJU_CMC_MD2.ID02672.hairpin | YES | YES | YES | NO | NO | NO | NO | NO |
| TJU_CMC_MD2.ID02673.5p-miR | TJU_CMC_MD2.ID02673.hairpin | YES | YES | YES | YES | YES | NO | NO | NO |
| TJU_CMC_MD2.ID02674.3p-miR | TJU_CMC_MD2.ID02674.hairpin | YES | NO | NO | NO | NO | NO | NO | NO |
| TJU_CMC_MD2.ID02675.3p-miR | TJU_CMC_MD2.ID02675.hairpin | YES | NO | NO | NO | NO | NO | NO | NO |
| TJU_CMC_MD2.ID02676.5p-miR | TJU_CMC_MD2.ID02676.hairpin | YES | NO | NO | NO | NO | NO | NO | NO |
| TJU_CMC_MD2.ID02677.5p-miR | TJU_CMC_MD2.ID02677.hairpin | YES | YES | YES | YES | YES | NO | NO | NO |
| TJU_CMC_MD2.ID02678.3p-miR | TJU_CMC_MD2.ID02678.hairpin | YES | NO | NO | NO | NO | NO | NO | NO |
| TJU_CMC_MD2.ID02679.3p-miR | TJU_CMC_MD2.ID02679.hairpin | YES | NO | NO | NO | NO | NO | NO | NO |
| TJU_CMC_MD2.ID02680.3p-miR | TJU_CMC_MD2.ID02680.hairpin | YES | NO | NO | NO | NO | NO | NO | NO |
| TJU_CMC_MD2.ID02681.3p-miR | TJU_CMC_MD2.ID02681.hairpin | YES | NO | NO | NO | NO | NO | NO | NO |
| TJU_CMC_MD2.ID02682.5p-miR | TJU_CMC_MD2.ID02682.hairpin | YES | YES | YES | NO | YES | NO | NO | NO |
| TJU_CMC_MD2.ID02683.3p-miR | TJU_CMC_MD2.ID02683.hairpin | YES | NO | NO | NO | NO | NO | NO | NO |
| TJU_CMC_MD2.ID02683.5p-miR | TJU_CMC_MD2.ID02683.hairpin | YES | YES | YES | NO | NO | NO | NO | NO |
| TJU_CMC_MD2.ID02684.5p-miR | TJU_CMC_MD2.ID02684.hairpin | YES | YES | YES | NO | NO | NO | NO | NO |
| TJU_CMC_MD2.ID02685.3p-miR | TJU_CMC_MD2.ID02685.hairpin | YES | NO | NO | NO | NO | NO | NO | NO |
| TJU_CMC_MD2.ID02686.5p-miR | TJU_CMC_MD2.ID02686.hairpin | YES | NO | NO | YES | NO | YES | NO | NO |
| TJU_CMC_MD2.ID02687.3p-miR | TJU_CMC_MD2.ID02687.hairpin | YES | NO | NO | NO | NO | NO | NO | NO |
| TJU_CMC_MD2.ID02687.5p-miR | TJU_CMC_MD2.ID02687.hairpin | YES | YES | YES | YES | NO | NO | NO | NO |
| TJU_CMC_MD2.ID02688.5p-miR | TJU_CMC_MD2.ID02688.hairpin | YES | YES | YES | YES | YES | NO | NO | NO |
| TJU_CMC_MD2.ID02689.3p-miR | TJU_CMC_MD2.ID02689.hairpin | YES | NO | NO | NO | NO | NO | NO | NO |
| TJU_CMC_MD2.ID02690.3p-miR | TJU_CMC_MD2.ID02690.hairpin | YES | NO | NO | NO | NO | NO | NO | NO |
| TJU_CMC_MD2.ID02690.5p-miR | TJU_CMC_MD2.ID02690.hairpin | YES | YES | YES | YES | NO | NO | NO | NO |
| TJU_CMC_MD2.ID02691.5p-miR | TJU_CMC_MD2.ID02691.hairpin | YES | YES | YES | YES | YES | YES | NO | NO |
| TJU_CMC_MD2.ID02692.3p-miR | TJU_CMC_MD2.ID02692.hairpin | YES | NO | NO | NO | NO | NO | NO | NO |
| TJU_CMC_MD2.ID02692.5p-miR | TJU_CMC_MD2.ID02692.hairpin | YES | YES | YES | YES | YES | NO | NO | NO |
| TJU_CMC_MD2.ID02693.3p-miR | TJU_CMC_MD2.ID02693.hairpin | YES | NO | NO | NO | NO | NO | NO | NO |
| TJU_CMC_MD2.ID02694.3p-miR | TJU_CMC_MD2.ID02694.hairpin | YES | NO | NO | NO | NO | NO | NO | NO |
| TJU_CMC_MD2.ID02695.3p-miR | TJU_CMC_MD2.ID02695.hairpin | YES | NO | NO | NO | NO | NO | NO | NO |
| TJU_CMC_MD2.ID02696.5p-miR | TJU_CMC_MD2.ID02696.hairpin | YES | YES | YES | YES | YES | NO | NO | NO |
| TJU_CMC_MD2.ID02697.3p-miR | TJU_CMC_MD2.ID02697.hairpin | YES | NO | NO | NO | NO | NO | NO | NO |
| TJU_CMC_MD2.ID02698.3p-miR | TJU_CMC_MD2.ID02698.hairpin | YES | NO | NO | NO | NO | NO | NO | NO |
| TJU_CMC_MD2.ID02699.5p-miR | TJU_CMC_MD2.ID02699.hairpin | YES | YES | NO | NO | NO | NO | NO | NO |
| TJU_CMC_MD2.ID02700.3p-miR | TJU_CMC_MD2.ID02700.hairpin | YES | NO | NO | NO | NO | NO | NO | NO |
| TJU_CMC_MD2.ID02700.5p-miR | TJU_CMC_MD2.ID02700.hairpin | YES | YES | YES | YES | YES | YES | NO | NO |
| TJU_CMC_MD2.ID02701.5p-miR | TJU_CMC_MD2.ID02701.hairpin | YES | YES | YES | YES | NO | NO | NO | NO |
| TJU_CMC_MD2.ID02702.3p-miR | TJU_CMC_MD2.ID02702.hairpin | YES | NO | NO | NO | NO | NO | NO | NO |
| TJU_CMC_MD2.ID02703.3p-miR | TJU_CMC_MD2.ID02703.hairpin | YES | NO | NO | NO | NO | NO | NO | NO |
| TJU_CMC_MD2.ID02704.3p-miR | TJU_CMC_MD2.ID02704.hairpin | YES | NO | NO | NO | NO | NO | NO | NO |
| TJU_CMC_MD2.ID02704.5p-miR | TJU_CMC_MD2.ID02704.hairpin | YES | YES | YES | YES | NO | NO | NO | NO |
| TJU_CMC_MD2.ID02705.3p-miR | TJU_CMC_MD2.ID02705.hairpin | YES | NO | NO | NO | NO | NO | NO | NO |
| TJU_CMC_MD2.ID02706.5p-miR | TJU_CMC_MD2.ID02706.hairpin | YES | YES | YES | NO | YES | NO | NO | NO |
| TJU_CMC_MD2.ID02707.3p-miR | TJU_CMC_MD2.ID02707.hairpin | YES | NO | NO | NO | NO | NO | NO | NO |
| TJU_CMC_MD2.ID02708.5p-miR | TJU_CMC_MD2.ID02708.hairpin | YES | YES | YES | YES | YES | NO | NO | NO |
| TJU_CMC_MD2.ID02709.3p-miR | TJU_CMC_MD2.ID02709.hairpin | YES | NO | NO | NO | NO | NO | NO | NO |
| TJU_CMC_MD2.ID02710.3p-miR | TJU_CMC_MD2.ID02710.hairpin | YES | NO | NO | NO | NO | NO | NO | NO |
| TJU_CMC_MD2.ID02711.3p-miR | TJU_CMC_MD2.ID02711.hairpin | YES | YES | NO | NO | NO | NO | NO | NO |
| TJU_CMC_MD2.ID02712.3p-miR | TJU_CMC_MD2.ID02712.hairpin | YES | YES | YES | YES | YES | NO | NO | NO |
| TJU_CMC_MD2.ID02712.5p-miR | TJU_CMC_MD2.ID02712.hairpin | YES | YES | YES | YES | NO | NO | NO | NO |
| TJU_CMC_MD2.ID02713.3p-miR | TJU_CMC_MD2.ID02713.hairpin | YES | NO | NO | NO | NO | NO | NO | NO |
| TJU_CMC_MD2.ID02713.5p-miR | TJU_CMC_MD2.ID02713.hairpin | YES | YES | YES | YES | NO | NO | NO | NO |
| TJU_CMC_MD2.ID02714.5p-miR | TJU_CMC_MD2.ID02714.hairpin | YES | YES | YES | YES | YES | NO | NO | NO |
| TJU_CMC_MD2.ID02715.3p-miR | TJU_CMC_MD2.ID02715.hairpin | YES | NO | NO | NO | NO | NO | NO | NO |
| TJU_CMC_MD2.ID02716.5p-miR | TJU_CMC_MD2.ID02716.hairpin | YES | YES | YES | YES | YES | NO | NO | NO |
| TJU_CMC_MD2.ID02717.5p-miR | TJU_CMC_MD2.ID02717.hairpin | YES | YES | YES | YES | YES | NO | NO | NO |
| TJU_CMC_MD2.ID02718.3p-miR | TJU_CMC_MD2.ID02718.hairpin | YES | NO | NO | NO | NO | NO | NO | NO |
| TJU_CMC_MD2.ID02719.3p-miR | TJU_CMC_MD2.ID02719.hairpin | YES | YES | YES | NO | YES | NO | NO | NO |
| TJU_CMC_MD2.ID02720.3p-miR | TJU_CMC_MD2.ID02720.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02721.5p-miR | TJU_CMC_MD2.ID02721.hairpin | YES | YES | YES | YES | NO | NO | NO | NO |
| TJU_CMC_MD2.ID02722.3p-miR | TJU_CMC_MD2.ID02722.hairpin | YES | NO | NO | NO | NO | NO | NO | NO |
| TJU_CMC_MD2.ID02723.3p-miR | TJU_CMC_MD2.ID02723.hairpin | YES | NO | NO | NO | NO | NO | NO | NO |
| TJU_CMC_MD2.ID02724.5p-miR | TJU_CMC_MD2.ID02724.hairpin | YES | NO | YES | YES | NO | NO | NO | NO |
| TJU_CMC_MD2.ID02725.3p-miR | TJU_CMC_MD2.ID02725.hairpin | YES | NO | NO | NO | NO | NO | NO | NO |
| TJU_CMC_MD2.ID02726.3p-miR | TJU_CMC_MD2.ID02726.hairpin | YES | NO | NO | NO | NO | NO | NO | NO |
| TJU_CMC_MD2.ID02727.5p-miR | TJU_CMC_MD2.ID02727.hairpin | YES | YES | NO | YES | NO | NO | NO | NO |
| TJU_CMC_MD2.ID02728.5p-miR | TJU_CMC_MD2.ID02728.hairpin | YES | NO | YES | YES | NO | NO | NO | NO |
| TJU_CMC_MD2.ID02729.5p-miR | TJU_CMC_MD2.ID02729.hairpin | YES | YES | YES | YES | NO | NO | NO | NO |
| TJU_CMC_MD2.ID02730.5p-miR | TJU_CMC_MD2.ID02730.hairpin | YES | YES | YES | NO | YES | NO | NO | NO |
| TJU_CMC_MD2.ID02731.3p-miR | TJU_CMC_MD2.ID02731.hairpin | YES | NO | NO | NO | NO | NO | NO | NO |
| TJU_CMC_MD2.ID02732.3p-miR | TJU_CMC_MD2.ID02732.hairpin | YES | NO | NO | NO | NO | NO | NO | NO |
| TJU_CMC_MD2.ID02733.5p-miR | TJU_CMC_MD2.ID02733.hairpin | YES | YES | YES | YES | YES | YES | NO | NO |
| TJU_CMC_MD2.ID02734.3p-miR | TJU_CMC_MD2.ID02734.hairpin | YES | NO | NO | NO | NO | NO | NO | NO |
| TJU_CMC_MD2.ID02735.3p-miR | TJU_CMC_MD2.ID02735.hairpin | YES | NO | NO | NO | NO | NO | NO | NO |
| TJU_CMC_MD2.ID02736.5p-miR | TJU_CMC_MD2.ID02736.hairpin | YES | YES | YES | YES | YES | YES | NO | NO |
| TJU_CMC_MD2.ID02737.3p-miR | TJU_CMC_MD2.ID02737.hairpin | YES | NO | NO | NO | NO | NO | NO | NO |
| TJU_CMC_MD2.ID02738.3p-miR | TJU_CMC_MD2.ID02738.hairpin | YES | NO | NO | NO | NO | NO | NO | NO |
| TJU_CMC_MD2.ID02739.5p-miR | TJU_CMC_MD2.ID02739.hairpin | YES | YES | YES | YES | YES | NO | NO | NO |
| TJU_CMC_MD2.ID02740.3p-miR | TJU_CMC_MD2.ID02740.hairpin | YES | NO | NO | NO | NO | NO | NO | NO |
| TJU_CMC_MD2.ID02741.3p-miR | TJU_CMC_MD2.ID02741.hairpin | YES | NO | NO | NO | NO | NO | NO | NO |
| TJU_CMC_MD2.ID02742.5p-miR | TJU_CMC_MD2.ID02742.hairpin | YES | NO | NO | NO | YES | NO | NO | NO |
| TJU_CMC_MD2.ID02743.5p-miR | TJU_CMC_MD2.ID02743.hairpin | YES | YES | YES | NO | NO | NO | NO | NO |
| TJU_CMC_MD2.ID02744.3p-miR | TJU_CMC_MD2.ID02744.hairpin | YES | NO | NO | NO | NO | NO | NO | NO |
| TJU_CMC_MD2.ID02745.3p-miR | TJU_CMC_MD2.ID02745.hairpin | YES | NO | NO | NO | NO | NO | NO | NO |
| TJU_CMC_MD2.ID02746.5p-miR | TJU_CMC_MD2.ID02746.hairpin | YES | YES | YES | YES | NO | NO | NO | NO |
| TJU_CMC_MD2.ID02747.5p-miR | TJU_CMC_MD2.ID02747.hairpin | YES | YES | YES | YES | NO | NO | NO | NO |
| TJU_CMC_MD2.ID02748.3p-miR | TJU_CMC_MD2.ID02748.hairpin | YES | NO | NO | NO | NO | NO | NO | NO |
| TJU_CMC_MD2.ID02749.5p-miR | TJU_CMC_MD2.ID02749.hairpin | YES | YES | YES | YES | NO | NO | NO | NO |
| TJU_CMC_MD2.ID02750.3p-miR | TJU_CMC_MD2.ID02750.hairpin | YES | NO | NO | NO | NO | NO | NO | NO |
| TJU_CMC_MD2.ID02751.3p-miR | TJU_CMC_MD2.ID02751.hairpin | YES | NO | NO | NO | NO | NO | NO | NO |
| TJU_CMC_MD2.ID02752.3p-miR | TJU_CMC_MD2.ID02752.hairpin | YES | NO | NO | NO | NO | NO | NO | NO |
| TJU_CMC_MD2.ID02753.3p-miR | TJU_CMC_MD2.ID02753.hairpin | YES | YES | YES | NO | YES | NO | NO | NO |
| TJU_CMC_MD2.ID02753.5p-miR | TJU_CMC_MD2.ID02753.hairpin | YES | YES | YES | YES | NO | NO | NO | NO |
| TJU_CMC_MD2.ID02754.5p-miR | TJU_CMC_MD2.ID02754.hairpin | YES | YES | YES | YES | YES | NO | NO | NO |
| TJU_CMC_MD2.ID02755.3p-miR | TJU_CMC_MD2.ID02755.hairpin | YES | NO | NO | NO | NO | NO | NO | NO |
| TJU_CMC_MD2.ID02756.3p-miR | TJU_CMC_MD2.ID02756.hairpin | YES | NO | NO | NO | NO | NO | NO | NO |
| TJU_CMC_MD2.ID02757.3p-miR | TJU_CMC_MD2.ID02757.hairpin | YES | NO | NO | NO | NO | NO | NO | NO |
| TJU_CMC_MD2.ID02758.3p-miR | TJU_CMC_MD2.ID02758.hairpin | YES | NO | NO | NO | NO | NO | NO | NO |
| TJU_CMC_MD2.ID02759.3p-miR | TJU_CMC_MD2.ID02759.hairpin | YES | NO | NO | NO | NO | NO | NO | NO |
| TJU_CMC_MD2.ID02759.5p-miR | TJU_CMC_MD2.ID02759.hairpin | YES | YES | NO | NO | NO | NO | NO | NO |
| TJU_CMC_MD2.ID02760.3p-miR | TJU_CMC_MD2.ID02760.hairpin | YES | NO | NO | NO | NO | NO | NO | NO |
| TJU_CMC_MD2.ID02761.3p-miR | TJU_CMC_MD2.ID02761.hairpin | YES | NO | NO | NO | NO | NO | NO | NO |
| TJU_CMC_MD2.ID02762.5p-miR | TJU_CMC_MD2.ID02762.hairpin | YES | YES | NO | NO | NO | NO | NO | NO |
| TJU_CMC_MD2.ID02763.3p-miR | TJU_CMC_MD2.ID02763.hairpin | YES | NO | NO | NO | NO | NO | NO | NO |
| TJU_CMC_MD2.ID02764.5p-miR | TJU_CMC_MD2.ID02764.hairpin | YES | NO | NO | NO | NO | NO | NO | NO |
| TJU_CMC_MD2.ID02765.3p-miR | TJU_CMC_MD2.ID02765.hairpin | YES | NO | NO | NO | NO | NO | NO | NO |
| TJU_CMC_MD2.ID02766.3p-miR | TJU_CMC_MD2.ID02766.hairpin | YES | NO | NO | NO | NO | NO | NO | NO |
| TJU_CMC_MD2.ID02767.3p-miR | TJU_CMC_MD2.ID02767.hairpin | YES | NO | NO | NO | NO | NO | NO | NO |
| TJU_CMC_MD2.ID02768.3p-miR | TJU_CMC_MD2.ID02768.hairpin | YES | NO | NO | NO | NO | NO | NO | NO |
| TJU_CMC_MD2.ID02769.5p-miR | TJU_CMC_MD2.ID02769.hairpin | YES | YES | YES | NO | NO | NO | NO | NO |
| TJU_CMC_MD2.ID02770.5p-miR | TJU_CMC_MD2.ID02770.hairpin | YES | YES | NO | NO | NO | YES | NO | NO |
| TJU_CMC_MD2.ID02771.3p-miR | TJU_CMC_MD2.ID02771.hairpin | YES | NO | NO | NO | NO | NO | NO | NO |
| TJU_CMC_MD2.ID02772.3p-miR | TJU_CMC_MD2.ID02772.hairpin | YES | NO | NO | NO | NO | NO | NO | NO |
| TJU_CMC_MD2.ID02773.3p-miR | TJU_CMC_MD2.ID02773.hairpin | YES | NO | NO | NO | NO | NO | NO | NO |
| TJU_CMC_MD2.ID02774.5p-miR | TJU_CMC_MD2.ID02774.hairpin | YES | YES | YES | YES | YES | NO | NO | NO |
| TJU_CMC_MD2.ID02775.5p-miR | TJU_CMC_MD2.ID02775.hairpin | YES | YES | YES | YES | YES | NO | NO | NO |
| TJU_CMC_MD2.ID02776.5p-miR | TJU_CMC_MD2.ID02776.hairpin | YES | YES | YES | YES | NO | NO | NO | NO |
| TJU_CMC_MD2.ID02777.3p-miR | TJU_CMC_MD2.ID02777.hairpin | YES | NO | NO | NO | NO | NO | NO | NO |
| TJU_CMC_MD2.ID02778.3p-miR | TJU_CMC_MD2.ID02778.hairpin | YES | NO | NO | NO | NO | NO | NO | NO |
| TJU_CMC_MD2.ID02779.3p-miR | TJU_CMC_MD2.ID02779.hairpin | YES | NO | NO | NO | NO | NO | NO | NO |
| TJU_CMC_MD2.ID02780.3p-miR | TJU_CMC_MD2.ID02780.hairpin | YES | NO | NO | NO | NO | NO | NO | NO |
| TJU_CMC_MD2.ID02781.3p-miR | TJU_CMC_MD2.ID02781.hairpin | YES | NO | NO | NO | NO | NO | NO | NO |
| TJU_CMC_MD2.ID02782.5p-miR | TJU_CMC_MD2.ID02782.hairpin | YES | YES | YES | YES | YES | NO | NO | NO |
| TJU_CMC_MD2.ID02783.5p-miR | TJU_CMC_MD2.ID02783.hairpin | YES | YES | YES | YES | YES | NO | NO | NO |
| TJU_CMC_MD2.ID02784.3p-miR | TJU_CMC_MD2.ID02784.hairpin | YES | NO | NO | NO | NO | NO | NO | NO |
| TJU_CMC_MD2.ID02785.3p-miR | TJU_CMC_MD2.ID02785.hairpin | YES | NO | NO | NO | NO | NO | NO | NO |
| TJU_CMC_MD2.ID02786.5p-miR | TJU_CMC_MD2.ID02786.hairpin | YES | YES | NO | YES | NO | NO | NO | NO |
| TJU_CMC_MD2.ID02787.5p-miR | TJU_CMC_MD2.ID02787.hairpin | YES | YES | YES | NO | YES | NO | NO | NO |
| TJU_CMC_MD2.ID02788.3p-miR | TJU_CMC_MD2.ID02788.hairpin | YES | NO | NO | NO | NO | NO | NO | NO |
| TJU_CMC_MD2.ID02789.5p-miR | TJU_CMC_MD2.ID02789.hairpin | YES | YES | NO | YES | NO | NO | NO | NO |
| TJU_CMC_MD2.ID02790.5p-miR | TJU_CMC_MD2.ID02790.hairpin | YES | YES | YES | YES | YES | NO | NO | NO |
| TJU_CMC_MD2.ID02791.5p-miR | TJU_CMC_MD2.ID02791.hairpin | YES | YES | YES | NO | NO | NO | NO | NO |
| TJU_CMC_MD2.ID02792.3p-miR | TJU_CMC_MD2.ID02792.hairpin | YES | NO | NO | NO | NO | NO | NO | NO |
| TJU_CMC_MD2.ID02793.3p-miR | TJU_CMC_MD2.ID02793.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02794.3p-miR | TJU_CMC_MD2.ID02794.hairpin | YES | NO | NO | NO | NO | NO | NO | NO |
| TJU_CMC_MD2.ID02795.3p-miR | TJU_CMC_MD2.ID02795.hairpin | YES | NO | NO | NO | NO | NO | NO | NO |
| TJU_CMC_MD2.ID02795.5p-miR | TJU_CMC_MD2.ID02795.hairpin | YES | YES | YES | NO | NO | NO | NO | NO |
| TJU_CMC_MD2.ID02796.3p-miR | TJU_CMC_MD2.ID02796.hairpin | YES | YES | YES | YES | NO | NO | NO | NO |
| TJU_CMC_MD2.ID02797.3p-miR | TJU_CMC_MD2.ID02797.hairpin | YES | NO | NO | NO | NO | NO | NO | NO |
| TJU_CMC_MD2.ID02798.3p-miR | TJU_CMC_MD2.ID02798.hairpin | YES | NO | NO | NO | NO | NO | NO | NO |
| TJU_CMC_MD2.ID02799.5p-miR | TJU_CMC_MD2.ID02799.hairpin | YES | NO | YES | YES | NO | YES | NO | NO |
| TJU_CMC_MD2.ID02800.3p-miR | TJU_CMC_MD2.ID02800.hairpin | YES | NO | NO | NO | NO | NO | NO | NO |
| TJU_CMC_MD2.ID02801.3p-miR | TJU_CMC_MD2.ID02801.hairpin | YES | NO | NO | NO | NO | NO | NO | NO |
| TJU_CMC_MD2.ID02802.3p-miR | TJU_CMC_MD2.ID02802.hairpin | YES | NO | NO | NO | NO | NO | NO | NO |
| TJU_CMC_MD2.ID02803.5p-miR | TJU_CMC_MD2.ID02803.hairpin | YES | YES | NO | NO | NO | NO | NO | NO |
| TJU_CMC_MD2.ID02804.5p-miR | TJU_CMC_MD2.ID02804.hairpin | YES | YES | YES | YES | YES | NO | NO | NO |
| TJU_CMC_MD2.ID02805.5p-miR | TJU_CMC_MD2.ID02805.hairpin | YES | YES | YES | NO | NO | YES | NO | NO |
| TJU_CMC_MD2.ID02806.3p-miR | TJU_CMC_MD2.ID02806.hairpin | YES | NO | NO | NO | NO | NO | NO | NO |
| TJU_CMC_MD2.ID02807.3p-miR | TJU_CMC_MD2.ID02807.hairpin | YES | NO | NO | NO | NO | NO | NO | NO |
| TJU_CMC_MD2.ID02808.3p-miR | TJU_CMC_MD2.ID02808.hairpin | YES | NO | NO | NO | NO | NO | NO | NO |
| TJU_CMC_MD2.ID02808.5p-miR | TJU_CMC_MD2.ID02808.hairpin | YES | YES | YES | YES | YES | NO | NO | NO |
| TJU_CMC_MD2.ID02809.3p-miR | TJU_CMC_MD2.ID02809.hairpin | YES | NO | NO | NO | NO | NO | NO | NO |
| TJU_CMC_MD2.ID02810.5p-miR | TJU_CMC_MD2.ID02810.hairpin | YES | YES | YES | YES | YES | NO | NO | NO |
| TJU_CMC_MD2.ID02811.5p-miR | TJU_CMC_MD2.ID02811.hairpin | YES | NO | YES | NO | NO | NO | NO | NO |
| TJU_CMC_MD2.ID02812.3p-miR | TJU_CMC_MD2.ID02812.hairpin | YES | NO | NO | NO | NO | NO | NO | NO |
| TJU_CMC_MD2.ID02813.3p-miR | TJU_CMC_MD2.ID02813.hairpin | YES | NO | NO | NO | NO | NO | NO | NO |
| TJU_CMC_MD2.ID02814.5p-miR | TJU_CMC_MD2.ID02814.hairpin | YES | YES | YES | NO | YES | NO | NO | NO |
| TJU_CMC_MD2.ID02815.3p-miR | TJU_CMC_MD2.ID02815.hairpin | YES | NO | NO | NO | NO | NO | NO | NO |
| TJU_CMC_MD2.ID02816.3p-miR | TJU_CMC_MD2.ID02816.hairpin | YES | NO | NO | NO | NO | NO | NO | NO |
| TJU_CMC_MD2.ID02817.3p-miR | TJU_CMC_MD2.ID02817.hairpin | YES | YES | YES | NO | YES | YES | NO | NO |
| TJU_CMC_MD2.ID02817.5p-miR | TJU_CMC_MD2.ID02817.hairpin | YES | YES | YES | NO | YES | YES | NO | NO |
| TJU_CMC_MD2.ID02818.5p-miR | TJU_CMC_MD2.ID02818.hairpin | YES | YES | NO | YES | NO | NO | NO | NO |
| TJU_CMC_MD2.ID02819.5p-miR | TJU_CMC_MD2.ID02819.hairpin | YES | NO | YES | NO | YES | NO | NO | NO |
| TJU_CMC_MD2.ID02820.3p-miR | TJU_CMC_MD2.ID02820.hairpin | YES | NO | NO | NO | NO | NO | NO | NO |
| TJU_CMC_MD2.ID02821.3p-miR | TJU_CMC_MD2.ID02821.hairpin | YES | NO | NO | NO | NO | NO | NO | NO |
| TJU_CMC_MD2.ID02821.5p-miR | TJU_CMC_MD2.ID02821.hairpin | YES | YES | YES | NO | NO | NO | NO | NO |
| TJU_CMC_MD2.ID02822.5p-miR | TJU_CMC_MD2.ID02822.hairpin | YES | YES | YES | YES | NO | NO | NO | NO |
| TJU_CMC_MD2.ID02823.3p-miR | TJU_CMC_MD2.ID02823.hairpin | YES | NO | NO | NO | NO | NO | NO | NO |
| TJU_CMC_MD2.ID02824.3p-miR | TJU_CMC_MD2.ID02824.hairpin | YES | NO | NO | NO | NO | NO | NO | NO |
| TJU_CMC_MD2.ID02825.3p-miR | TJU_CMC_MD2.ID02825.hairpin | YES | NO | NO | NO | NO | NO | NO | NO |
| TJU_CMC_MD2.ID02826.3p-miR | TJU_CMC_MD2.ID02826.hairpin | YES | NO | NO | NO | NO | NO | NO | NO |
| TJU_CMC_MD2.ID02827.3p-miR | TJU_CMC_MD2.ID02827.hairpin | YES | NO | NO | NO | NO | NO | NO | NO |
| TJU_CMC_MD2.ID02828.3p-miR | TJU_CMC_MD2.ID02828.hairpin | YES | NO | NO | NO | NO | NO | NO | NO |
| TJU_CMC_MD2.ID02829.5p-miR | TJU_CMC_MD2.ID02829.hairpin | YES | YES | NO | YES | YES | NO | NO | NO |
| TJU_CMC_MD2.ID02830.3p-miR | TJU_CMC_MD2.ID02830.hairpin | YES | NO | NO | NO | NO | NO | NO | NO |
| TJU_CMC_MD2.ID02831.3p-miR | TJU_CMC_MD2.ID02831.hairpin | YES | NO | NO | NO | NO | NO | NO | NO |
| TJU_CMC_MD2.ID02831.5p-miR | TJU_CMC_MD2.ID02831.hairpin | YES | YES | NO | NO | NO | NO | NO | NO |
| TJU_CMC_MD2.ID02832.3p-miR | TJU_CMC_MD2.ID02832.hairpin | YES | NO | NO | NO | NO | NO | NO | NO |
| TJU_CMC_MD2.ID02833.5p-miR | TJU_CMC_MD2.ID02833.hairpin | YES | YES | YES | YES | YES | NO | NO | NO |
| TJU_CMC_MD2.ID02834.3p-miR | TJU_CMC_MD2.ID02834.hairpin | YES | NO | NO | NO | NO | NO | NO | NO |
| TJU_CMC_MD2.ID02835.3p-miR | TJU_CMC_MD2.ID02835.hairpin | YES | YES | YES | YES | YES | NO | NO | NO |
| TJU_CMC_MD2.ID02835.5p-miR | TJU_CMC_MD2.ID02835.hairpin | YES | NO | YES | YES | YES | NO | NO | NO |
| TJU_CMC_MD2.ID02836.3p-miR | TJU_CMC_MD2.ID02836.hairpin | YES | NO | NO | NO | NO | NO | NO | NO |
| TJU_CMC_MD2.ID02837.5p-miR | TJU_CMC_MD2.ID02837.hairpin | YES | YES | NO | YES | NO | NO | NO | NO |
| TJU_CMC_MD2.ID02838.5p-miR | TJU_CMC_MD2.ID02838.hairpin | YES | YES | YES | NO | YES | NO | NO | NO |
| TJU_CMC_MD2.ID02839.3p-miR | TJU_CMC_MD2.ID02839.hairpin | YES | NO | NO | NO | NO | NO | NO | NO |
| TJU_CMC_MD2.ID02840.3p-miR | TJU_CMC_MD2.ID02840.hairpin | YES | NO | NO | NO | NO | NO | NO | NO |
| TJU_CMC_MD2.ID02841.5p-miR | TJU_CMC_MD2.ID02841.hairpin | YES | NO | NO | NO | NO | NO | NO | NO |
| TJU_CMC_MD2.ID02842.5p-miR | TJU_CMC_MD2.ID02842.hairpin | YES | YES | NO | YES | NO | NO | NO | NO |
| TJU_CMC_MD2.ID02843.5p-miR | TJU_CMC_MD2.ID02843.hairpin | YES | YES | YES | YES | NO | NO | NO | NO |
| TJU_CMC_MD2.ID02844.5p-miR | TJU_CMC_MD2.ID02844.hairpin | YES | YES | YES | YES | YES | NO | NO | NO |
| TJU_CMC_MD2.ID02845.5p-miR | TJU_CMC_MD2.ID02845.hairpin | YES | YES | YES | YES | YES | NO | NO | NO |
| TJU_CMC_MD2.ID02846.3p-miR | TJU_CMC_MD2.ID02846.hairpin | YES | NO | NO | NO | NO | NO | NO | NO |
| TJU_CMC_MD2.ID02847.5p-miR | TJU_CMC_MD2.ID02847.hairpin | YES | NO | NO | NO | NO | NO | NO | NO |
| TJU_CMC_MD2.ID02848.3p-miR | TJU_CMC_MD2.ID02848.hairpin | YES | NO | NO | NO | NO | NO | NO | NO |
| TJU_CMC_MD2.ID02849.5p-miR | TJU_CMC_MD2.ID02849.hairpin | YES | YES | NO | NO | NO | NO | NO | NO |
| TJU_CMC_MD2.ID02850.3p-miR | TJU_CMC_MD2.ID02850.hairpin | YES | NO | NO | NO | NO | NO | NO | NO |
| TJU_CMC_MD2.ID02851.5p-miR | TJU_CMC_MD2.ID02851.hairpin | YES | NO | YES | NO | NO | NO | NO | NO |
| TJU_CMC_MD2.ID02852.5p-miR | TJU_CMC_MD2.ID02852.hairpin | YES | NO | YES | NO | NO | NO | NO | NO |
| TJU_CMC_MD2.ID02853.3p-miR | TJU_CMC_MD2.ID02853.hairpin | YES | NO | NO | NO | NO | NO | NO | NO |
| TJU_CMC_MD2.ID02854.5p-miR | TJU_CMC_MD2.ID02854.hairpin | YES | YES | YES | YES | NO | NO | NO | NO |
| TJU_CMC_MD2.ID02855.5p-miR | TJU_CMC_MD2.ID02855.hairpin | YES | YES | YES | NO | YES | NO | NO | NO |
| TJU_CMC_MD2.ID02856.5p-miR | TJU_CMC_MD2.ID02856.hairpin | YES | YES | YES | YES | YES | NO | NO | NO |
| TJU_CMC_MD2.ID02857.3p-miR | TJU_CMC_MD2.ID02857.hairpin | YES | NO | NO | NO | NO | NO | NO | NO |
| TJU_CMC_MD2.ID02858.3p-miR | TJU_CMC_MD2.ID02858.hairpin | YES | NO | NO | NO | NO | NO | NO | NO |
| TJU_CMC_MD2.ID02859.3p-miR | TJU_CMC_MD2.ID02859.hairpin | YES | NO | NO | NO | NO | NO | NO | NO |
| TJU_CMC_MD2.ID02860.5p-miR | TJU_CMC_MD2.ID02860.hairpin | YES | NO | NO | YES | NO | NO | NO | NO |
| TJU_CMC_MD2.ID02861.3p-miR | TJU_CMC_MD2.ID02861.hairpin | YES | NO | NO | NO | NO | NO | NO | NO |
| TJU_CMC_MD2.ID02862.3p-miR | TJU_CMC_MD2.ID02862.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02863.3p-miR | TJU_CMC_MD2.ID02863.hairpin | YES | YES | YES | NO | NO | NO | NO | NO |
| TJU_CMC_MD2.ID02864.5p-miR | TJU_CMC_MD2.ID02864.hairpin | YES | YES | YES | YES | YES | NO | NO | NO |
| TJU_CMC_MD2.ID02865.5p-miR | TJU_CMC_MD2.ID02865.hairpin | YES | YES | YES | YES | YES | NO | NO | NO |
| TJU_CMC_MD2.ID02866.5p-miR | TJU_CMC_MD2.ID02866.hairpin | YES | YES | NO | NO | NO | NO | NO | NO |
| TJU_CMC_MD2.ID02867.3p-miR | TJU_CMC_MD2.ID02867.hairpin | YES | NO | NO | NO | NO | NO | NO | NO |
| TJU_CMC_MD2.ID02868.3p-miR | TJU_CMC_MD2.ID02868.hairpin | YES | NO | NO | NO | NO | NO | NO | NO |
| TJU_CMC_MD2.ID02869.3p-miR | TJU_CMC_MD2.ID02869.hairpin | YES | NO | NO | NO | NO | NO | NO | NO |
| TJU_CMC_MD2.ID02870.3p-miR | TJU_CMC_MD2.ID02870.hairpin | YES | YES | YES | YES | NO | NO | NO | NO |
| TJU_CMC_MD2.ID02871.5p-miR | TJU_CMC_MD2.ID02871.hairpin | YES | YES | YES | NO | NO | NO | NO | NO |
| TJU_CMC_MD2.ID02872.3p-miR | TJU_CMC_MD2.ID02872.hairpin | YES | NO | NO | NO | NO | NO | NO | NO |
| TJU_CMC_MD2.ID02873.3p-miR | TJU_CMC_MD2.ID02873.hairpin | YES | NO | NO | NO | NO | NO | NO | NO |
| TJU_CMC_MD2.ID02874.5p-miR | TJU_CMC_MD2.ID02874.hairpin | YES | YES | YES | NO | YES | NO | NO | NO |
| TJU_CMC_MD2.ID02875.5p-miR | TJU_CMC_MD2.ID02875.hairpin | YES | YES | YES | YES | YES | NO | NO | NO |
| TJU_CMC_MD2.ID02876.3p-miR | TJU_CMC_MD2.ID02876.hairpin | YES | NO | YES | NO | YES | NO | NO | NO |
| TJU_CMC_MD2.ID02876.5p-miR | TJU_CMC_MD2.ID02876.hairpin | YES | NO | YES | NO | YES | NO | NO | NO |
| TJU_CMC_MD2.ID02877.5p-miR | TJU_CMC_MD2.ID02877.hairpin | YES | YES | YES | YES | NO | NO | NO | NO |
| TJU_CMC_MD2.ID02878.3p-miR | TJU_CMC_MD2.ID02878.hairpin | YES | YES | YES | YES | YES | NO | NO | NO |
| TJU_CMC_MD2.ID02878.5p-miR | TJU_CMC_MD2.ID02878.hairpin | YES | YES | YES | YES | YES | NO | NO | NO |
| TJU_CMC_MD2.ID02879.3p-miR | TJU_CMC_MD2.ID02879.hairpin | YES | NO | NO | NO | NO | NO | NO | NO |
| TJU_CMC_MD2.ID02880.3p-miR | TJU_CMC_MD2.ID02880.hairpin | YES | NO | NO | NO | NO | NO | NO | NO |
| TJU_CMC_MD2.ID02881.3p-miR | TJU_CMC_MD2.ID02881.hairpin | YES | NO | NO | NO | NO | NO | NO | NO |
| TJU_CMC_MD2.ID02882.3p-miR | TJU_CMC_MD2.ID02882.hairpin | YES | NO | NO | NO | NO | NO | NO | NO |
| TJU_CMC_MD2.ID02883.3p-miR | TJU_CMC_MD2.ID02883.hairpin | YES | NO | NO | NO | NO | NO | NO | NO |
| TJU_CMC_MD2.ID02884.3p-miR | TJU_CMC_MD2.ID02884.hairpin | YES | NO | NO | NO | NO | NO | NO | NO |
| TJU_CMC_MD2.ID02885.3p-miR | TJU_CMC_MD2.ID02885.hairpin | YES | NO | NO | NO | NO | NO | NO | NO |
| TJU_CMC_MD2.ID02886.5p-miR | TJU_CMC_MD2.ID02886.hairpin | YES | YES | YES | YES | YES | NO | NO | NO |
| TJU_CMC_MD2.ID02887.3p-miR | TJU_CMC_MD2.ID02887.hairpin | YES | NO | NO | NO | NO | NO | NO | NO |
| TJU_CMC_MD2.ID02888.5p-miR | TJU_CMC_MD2.ID02888.hairpin | YES | YES | YES | YES | YES | NO | NO | NO |
| TJU_CMC_MD2.ID02889.3p-miR | TJU_CMC_MD2.ID02889.hairpin | YES | NO | NO | NO | NO | NO | NO | NO |
| TJU_CMC_MD2.ID02890.3p-miR | TJU_CMC_MD2.ID02890.hairpin | YES | NO | NO | NO | NO | NO | NO | NO |
| TJU_CMC_MD2.ID02890.5p-miR | TJU_CMC_MD2.ID02890.hairpin | YES | YES | YES | NO | NO | NO | NO | NO |
| TJU_CMC_MD2.ID02891.3p-miR | TJU_CMC_MD2.ID02891.hairpin | YES | NO | NO | NO | NO | NO | NO | NO |
| TJU_CMC_MD2.ID02892.3p-miR | TJU_CMC_MD2.ID02892.hairpin | YES | NO | NO | NO | NO | NO | NO | NO |
| TJU_CMC_MD2.ID02893.5p-miR | TJU_CMC_MD2.ID02893.hairpin | YES | YES | YES | NO | NO | NO | NO | NO |
| TJU_CMC_MD2.ID02894.3p-miR | TJU_CMC_MD2.ID02894.hairpin | YES | NO | NO | NO | NO | NO | NO | NO |
| TJU_CMC_MD2.ID02895.3p-miR | TJU_CMC_MD2.ID02895.hairpin | YES | NO | NO | NO | NO | NO | NO | NO |
| TJU_CMC_MD2.ID02896.5p-miR | TJU_CMC_MD2.ID02896.hairpin | YES | YES | NO | NO | NO | NO | NO | NO |
| TJU_CMC_MD2.ID02897.3p-miR | TJU_CMC_MD2.ID02897.hairpin | YES | NO | NO | NO | NO | NO | NO | NO |
| TJU_CMC_MD2.ID02898.3p-miR | TJU_CMC_MD2.ID02898.hairpin | YES | NO | NO | NO | NO | NO | NO | NO |
| TJU_CMC_MD2.ID02899.3p-miR | TJU_CMC_MD2.ID02899.hairpin | YES | NO | NO | NO | NO | NO | NO | NO |
| TJU_CMC_MD2.ID02900.5p-miR | TJU_CMC_MD2.ID02900.hairpin | YES | YES | YES | NO | YES | NO | NO | NO |
| TJU_CMC_MD2.ID02901.3p-miR | TJU_CMC_MD2.ID02901.hairpin | YES | NO | NO | NO | NO | NO | NO | NO |
| TJU_CMC_MD2.ID02902.5p-miR | TJU_CMC_MD2.ID02902.hairpin | YES | YES | NO | NO | NO | NO | NO | NO |
| TJU_CMC_MD2.ID02903.3p-miR | TJU_CMC_MD2.ID02903.hairpin | YES | NO | NO | NO | NO | NO | NO | NO |
| TJU_CMC_MD2.ID02904.5p-miR | TJU_CMC_MD2.ID02904.hairpin | YES | YES | YES | NO | NO | NO | NO | NO |
| TJU_CMC_MD2.ID02905.3p-miR | TJU_CMC_MD2.ID02905.hairpin | YES | NO | NO | NO | NO | NO | NO | NO |
| TJU_CMC_MD2.ID02906.3p-miR | TJU_CMC_MD2.ID02906.hairpin | YES | NO | NO | NO | NO | NO | NO | NO |
| TJU_CMC_MD2.ID02907.3p-miR | TJU_CMC_MD2.ID02907.hairpin | YES | NO | NO | NO | NO | NO | NO | NO |
| TJU_CMC_MD2.ID02908.3p-miR | TJU_CMC_MD2.ID02908.hairpin | YES | NO | NO | NO | NO | NO | NO | NO |
| TJU_CMC_MD2.ID02909.5p-miR | TJU_CMC_MD2.ID02909.hairpin | YES | YES | YES | YES | YES | NO | NO | NO |
| TJU_CMC_MD2.ID02910.5p-miR | TJU_CMC_MD2.ID02910.hairpin | YES | YES | YES | YES | NO | NO | NO | NO |
| TJU_CMC_MD2.ID02911.5p-miR | TJU_CMC_MD2.ID02911.hairpin | YES | YES | YES | YES | NO | NO | NO | NO |
| TJU_CMC_MD2.ID02912.3p-miR | TJU_CMC_MD2.ID02912.hairpin | YES | NO | NO | NO | NO | NO | NO | NO |
| TJU_CMC_MD2.ID02912.5p-miR | TJU_CMC_MD2.ID02912.hairpin | YES | YES | YES | YES | NO | NO | NO | NO |
| TJU_CMC_MD2.ID02913.5p-miR | TJU_CMC_MD2.ID02913.hairpin | YES | NO | NO | NO | NO | NO | NO | NO |
| TJU_CMC_MD2.ID02914.3p-miR | TJU_CMC_MD2.ID02914.hairpin | YES | NO | NO | NO | NO | NO | NO | NO |
| TJU_CMC_MD2.ID02915.3p-miR | TJU_CMC_MD2.ID02915.hairpin | YES | NO | NO | NO | NO | NO | NO | NO |
| TJU_CMC_MD2.ID02916.5p-miR | TJU_CMC_MD2.ID02916.hairpin | YES | YES | YES | YES | YES | NO | NO | NO |
| TJU_CMC_MD2.ID02917.3p-miR | TJU_CMC_MD2.ID02917.hairpin | YES | NO | NO | NO | NO | NO | NO | NO |
| TJU_CMC_MD2.ID02918.5p-miR | TJU_CMC_MD2.ID02918.hairpin | YES | YES | NO | NO | NO | NO | NO | NO |
| TJU_CMC_MD2.ID02919.5p-miR | TJU_CMC_MD2.ID02919.hairpin | YES | YES | NO | NO | YES | NO | NO | NO |
| TJU_CMC_MD2.ID02920.3p-miR | TJU_CMC_MD2.ID02920.hairpin | YES | NO | NO | NO | NO | NO | NO | NO |
| TJU_CMC_MD2.ID02921.3p-miR | TJU_CMC_MD2.ID02921.hairpin | YES | NO | NO | NO | NO | NO | NO | NO |
| TJU_CMC_MD2.ID02921.5p-miR | TJU_CMC_MD2.ID02921.hairpin | YES | YES | YES | YES | YES | NO | NO | NO |
| TJU_CMC_MD2.ID02922.3p-miR | TJU_CMC_MD2.ID02922.hairpin | YES | NO | NO | NO | NO | NO | NO | NO |
| TJU_CMC_MD2.ID02923.5p-miR | TJU_CMC_MD2.ID02923.hairpin | YES | YES | YES | YES | YES | NO | NO | NO |
| TJU_CMC_MD2.ID02924.3p-miR | TJU_CMC_MD2.ID02924.hairpin | YES | NO | NO | NO | NO | NO | NO | NO |
| TJU_CMC_MD2.ID02925.3p-miR | TJU_CMC_MD2.ID02925.hairpin | YES | NO | NO | NO | NO | NO | NO | NO |
| TJU_CMC_MD2.ID02926.5p-miR | TJU_CMC_MD2.ID02926.hairpin | YES | YES | NO | NO | NO | NO | NO | NO |
| TJU_CMC_MD2.ID02927.5p-miR | TJU_CMC_MD2.ID02927.hairpin | YES | NO | YES | NO | NO | NO | NO | NO |
| TJU_CMC_MD2.ID02928.3p-miR | TJU_CMC_MD2.ID02928.hairpin | YES | NO | NO | NO | NO | NO | NO | NO |
| TJU_CMC_MD2.ID02929.3p-miR | TJU_CMC_MD2.ID02929.hairpin | YES | NO | NO | NO | NO | NO | NO | NO |
| TJU_CMC_MD2.ID02930.3p-miR | TJU_CMC_MD2.ID02930.hairpin | YES | NO | NO | NO | NO | NO | NO | NO |
| TJU_CMC_MD2.ID02931.3p-miR | TJU_CMC_MD2.ID02931.hairpin | YES | NO | NO | NO | NO | NO | NO | NO |
| TJU_CMC_MD2.ID02931.5p-miR | TJU_CMC_MD2.ID02931.hairpin | YES | YES | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID02932.5p-miR | TJU_CMC_MD2.ID02932.hairpin | YES | YES | NO | NO | NO | NO | NO | NO |
| TJU_CMC_MD2.ID02933.5p-miR | TJU_CMC_MD2.ID02933.hairpin | YES | NO | NO | NO | NO | NO | NO | NO |
| TJU_CMC_MD2.ID02934.5p-miR | TJU_CMC_MD2.ID02934.hairpin | YES | YES | YES | NO | YES | NO | NO | NO |
| TJU_CMC_MD2.ID02935.3p-miR | TJU_CMC_MD2.ID02935.hairpin | YES | NO | NO | NO | NO | NO | NO | NO |
| TJU_CMC_MD2.ID02936.5p-miR | TJU_CMC_MD2.ID02936.hairpin | YES | NO | YES | NO | NO | NO | NO | NO |
| TJU_CMC_MD2.ID02937.5p-miR | TJU_CMC_MD2.ID02937.hairpin | YES | YES | YES | YES | NO | NO | NO | NO |
| TJU_CMC_MD2.ID02938.3p-miR | TJU_CMC_MD2.ID02938.hairpin | YES | NO | NO | NO | NO | NO | NO | NO |
| TJU_CMC_MD2.ID02939.5p-miR | TJU_CMC_MD2.ID02939.hairpin | YES | YES | YES | YES | YES | NO | NO | NO |
| TJU_CMC_MD2.ID02940.3p-miR | TJU_CMC_MD2.ID02940.hairpin | YES | NO | NO | NO | NO | NO | NO | NO |
| TJU_CMC_MD2.ID02941.3p-miR | TJU_CMC_MD2.ID02941.hairpin | YES | NO | NO | NO | NO | NO | NO | NO |
| TJU_CMC_MD2.ID02942.5p-miR | TJU_CMC_MD2.ID02942.hairpin | YES | YES | NO | NO | NO | NO | NO | NO |
| TJU_CMC_MD2.ID02943.5p-miR | TJU_CMC_MD2.ID02943.hairpin | YES | YES | YES | YES | NO | NO | NO | NO |
| TJU_CMC_MD2.ID02944.5p-miR | TJU_CMC_MD2.ID02944.hairpin | YES | NO | YES | YES | YES | NO | NO | NO |
| TJU_CMC_MD2.ID02945.3p-miR | TJU_CMC_MD2.ID02945.hairpin | YES | NO | NO | NO | NO | NO | NO | NO |
| TJU_CMC_MD2.ID02945.5p-miR | TJU_CMC_MD2.ID02945.hairpin | YES | YES | YES | NO | NO | NO | NO | NO |
| TJU_CMC_MD2.ID02946.5p-miR | TJU_CMC_MD2.ID02946.hairpin | YES | YES | YES | NO | NO | NO | NO | NO |
| TJU_CMC_MD2.ID02947.3p-miR | TJU_CMC_MD2.ID02947.hairpin | YES | NO | NO | NO | NO | NO | NO | NO |
| TJU_CMC_MD2.ID02948.5p-miR | TJU_CMC_MD2.ID02948.hairpin | YES | YES | NO | NO | NO | YES | NO | NO |
| TJU_CMC_MD2.ID02949.3p-miR | TJU_CMC_MD2.ID02949.hairpin | YES | NO | NO | NO | NO | NO | NO | NO |
| TJU_CMC_MD2.ID02950.3p-miR | TJU_CMC_MD2.ID02950.hairpin | YES | NO | NO | NO | NO | NO | NO | NO |
| TJU_CMC_MD2.ID02951.3p-miR | TJU_CMC_MD2.ID02951.hairpin | YES | NO | NO | NO | NO | NO | NO | NO |
| TJU_CMC_MD2.ID02952.3p-miR | TJU_CMC_MD2.ID02952.hairpin | YES | NO | NO | NO | NO | NO | NO | NO |
| TJU_CMC_MD2.ID02953.5p-miR | TJU_CMC_MD2.ID02953.hairpin | YES | YES | YES | YES | YES | NO | NO | NO |
| TJU_CMC_MD2.ID02954.3p-miR | TJU_CMC_MD2.ID02954.hairpin | YES | NO | NO | NO | NO | NO | NO | NO |
| TJU_CMC_MD2.ID02955.3p-miR | TJU_CMC_MD2.ID02955.hairpin | YES | NO | NO | NO | NO | NO | NO | NO |
| TJU_CMC_MD2.ID02956.5p-miR | TJU_CMC_MD2.ID02956.hairpin | YES | NO | NO | NO | NO | NO | NO | NO |
| TJU_CMC_MD2.ID02957.5p-miR | TJU_CMC_MD2.ID02957.hairpin | YES | YES | YES | YES | NO | NO | NO | NO |
| TJU_CMC_MD2.ID02958.3p-miR | TJU_CMC_MD2.ID02958.hairpin | YES | NO | NO | NO | NO | NO | NO | NO |
| TJU_CMC_MD2.ID02959.3p-miR | TJU_CMC_MD2.ID02959.hairpin | YES | NO | NO | NO | NO | NO | NO | NO |
| TJU_CMC_MD2.ID02960.3p-miR | TJU_CMC_MD2.ID02960.hairpin | YES | NO | NO | NO | NO | NO | NO | NO |
| TJU_CMC_MD2.ID02961.5p-miR | TJU_CMC_MD2.ID02961.hairpin | YES | YES | YES | YES | NO | NO | NO | NO |
| TJU_CMC_MD2.ID02962.3p-miR | TJU_CMC_MD2.ID02962.hairpin | YES | NO | NO | NO | NO | NO | NO | NO |
| TJU_CMC_MD2.ID02963.5p-miR | TJU_CMC_MD2.ID02963.hairpin | YES | YES | YES | NO | NO | NO | NO | NO |
| TJU_CMC_MD2.ID02964.3p-miR | TJU_CMC_MD2.ID02964.hairpin | YES | NO | NO | NO | NO | NO | NO | NO |
| TJU_CMC_MD2.ID02965.5p-miR | TJU_CMC_MD2.ID02965.hairpin | YES | NO | NO | NO | NO | NO | NO | NO |
| TJU_CMC_MD2.ID02966.5p-miR | TJU_CMC_MD2.ID02966.hairpin | YES | YES | YES | YES | YES | NO | NO | NO |
| TJU_CMC_MD2.ID02967.3p-miR | TJU_CMC_MD2.ID02967.hairpin | YES | NO | NO | NO | NO | NO | NO | NO |
| TJU_CMC_MD2.ID02968.3p-miR | TJU_CMC_MD2.ID02968.hairpin | YES | NO | NO | NO | NO | NO | NO | NO |
| TJU_CMC_MD2.ID02969.3p-miR | TJU_CMC_MD2.ID02969.hairpin | YES | NO | NO | NO | NO | NO | NO | NO |
| TJU_CMC_MD2.ID02970.5p-miR | TJU_CMC_MD2.ID02970.hairpin | YES | YES | YES | YES | YES | NO | NO | NO |
| TJU_CMC_MD2.ID02971.3p-miR | TJU_CMC_MD2.ID02971.hairpin | YES | NO | NO | NO | NO | NO | NO | NO |
| TJU_CMC_MD2.ID02972.5p-miR | TJU_CMC_MD2.ID02972.hairpin | YES | YES | YES | YES | NO | NO | NO | NO |
| TJU_CMC_MD2.ID02973.3p-miR | TJU_CMC_MD2.ID02973.hairpin | YES | NO | NO | NO | NO | NO | NO | NO |
| TJU_CMC_MD2.ID02974.3p-miR | TJU_CMC_MD2.ID02974.hairpin | YES | NO | NO | NO | NO | NO | NO | NO |
| TJU_CMC_MD2.ID02975.3p-miR | TJU_CMC_MD2.ID02975.hairpin | YES | NO | NO | NO | NO | NO | NO | NO |
| TJU_CMC_MD2.ID02976.5p-miR | TJU_CMC_MD2.ID02976.hairpin | YES | YES | NO | YES | NO | NO | NO | NO |
| TJU_CMC_MD2.ID02977.3p-miR | TJU_CMC_MD2.ID02977.hairpin | YES | NO | NO | NO | NO | NO | NO | NO |
| TJU_CMC_MD2.ID02978.3p-miR | TJU_CMC_MD2.ID02978.hairpin | YES | NO | NO | NO | NO | NO | NO | NO |
| TJU_CMC_MD2.ID02979.5p-miR | TJU_CMC_MD2.ID02979.hairpin | YES | YES | NO | NO | NO | NO | NO | NO |
| TJU_CMC_MD2.ID02980.3p-miR | TJU_CMC_MD2.ID02980.hairpin | YES | NO | NO | NO | NO | NO | NO | NO |
| TJU_CMC_MD2.ID02981.3p-miR | TJU_CMC_MD2.ID02981.hairpin | YES | NO | NO | NO | NO | NO | NO | NO |
| TJU_CMC_MD2.ID02982.3p-miR | TJU_CMC_MD2.ID02982.hairpin | YES | NO | NO | NO | NO | NO | NO | NO |
| TJU_CMC_MD2.ID02983.3p-miR | TJU_CMC_MD2.ID02983.hairpin | YES | NO | NO | NO | NO | NO | NO | NO |
| TJU_CMC_MD2.ID02984.3p-miR | TJU_CMC_MD2.ID02984.hairpin | YES | NO | NO | NO | NO | NO | NO | NO |
| TJU_CMC_MD2.ID02985.3p-miR | TJU_CMC_MD2.ID02985.hairpin | YES | NO | NO | NO | NO | NO | NO | NO |
| TJU_CMC_MD2.ID02986.5p-miR | TJU_CMC_MD2.ID02986.hairpin | YES | YES | YES | YES | NO | NO | NO | NO |
| TJU_CMC_MD2.ID02987.5p-miR | TJU_CMC_MD2.ID02987.hairpin | YES | YES | YES | YES | YES | NO | NO | NO |
| TJU_CMC_MD2.ID02988.5p-miR | TJU_CMC_MD2.ID02988.hairpin | YES | YES | YES | NO | NO | NO | NO | NO |
| TJU_CMC_MD2.ID02989.3p-miR | TJU_CMC_MD2.ID02989.hairpin | YES | NO | NO | NO | NO | NO | NO | NO |
| TJU_CMC_MD2.ID02990.3p-miR | TJU_CMC_MD2.ID02990.hairpin | YES | NO | NO | NO | NO | NO | NO | NO |
| TJU_CMC_MD2.ID02991.3p-miR | TJU_CMC_MD2.ID02991.hairpin | YES | NO | NO | NO | NO | NO | NO | NO |
| TJU_CMC_MD2.ID02992.5p-miR | TJU_CMC_MD2.ID02992.hairpin | YES | YES | NO | YES | NO | NO | NO | NO |
| TJU_CMC_MD2.ID02993.5p-miR | TJU_CMC_MD2.ID02993.hairpin | YES | YES | YES | YES | YES | NO | NO | NO |
| TJU_CMC_MD2.ID02994.3p-miR | TJU_CMC_MD2.ID02994.hairpin | YES | NO | NO | NO | NO | NO | NO | NO |
| TJU_CMC_MD2.ID02995.3p-miR | TJU_CMC_MD2.ID02995.hairpin | YES | NO | NO | NO | NO | NO | NO | NO |
| TJU_CMC_MD2.ID02996.5p-miR | TJU_CMC_MD2.ID02996.hairpin | YES | YES | YES | YES | NO | NO | NO | NO |
| TJU_CMC_MD2.ID02997.5p-miR | TJU_CMC_MD2.ID02997.hairpin | YES | YES | NO | NO | NO | NO | NO | NO |
| TJU_CMC_MD2.ID02998.3p-miR | TJU_CMC_MD2.ID02998.hairpin | YES | NO | NO | NO | NO | NO | NO | NO |
| TJU_CMC_MD2.ID02999.5p-miR | TJU_CMC_MD2.ID02999.hairpin | YES | YES | NO | YES | NO | NO | NO | NO |
| TJU_CMC_MD2.ID03000.5p-miR | TJU_CMC_MD2.ID03000.hairpin | YES | YES | YES | YES | NO | NO | NO | NO |
| TJU_CMC_MD2.ID03001.3p-miR | TJU_CMC_MD2.ID03001.hairpin | YES | NO | NO | NO | NO | NO | NO | NO |
| TJU_CMC_MD2.ID03002.5p-miR | TJU_CMC_MD2.ID03002.hairpin | YES | YES | YES | YES | YES | NO | NO | NO |
| TJU_CMC_MD2.ID03003.5p-miR | TJU_CMC_MD2.ID03003.hairpin | YES | YES | YES | NO | YES | NO | NO | NO |
| TJU_CMC_MD2.ID03004.3p-miR | TJU_CMC_MD2.ID03004.hairpin | YES | NO | NO | NO | NO | NO | NO | NO |
| TJU_CMC_MD2.ID03005.3p-miR | TJU_CMC_MD2.ID03005.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03006.5p-miR | TJU_CMC_MD2.ID03006.hairpin | YES | YES | YES | YES | NO | NO | NO | NO |
| TJU_CMC_MD2.ID03007.5p-miR | TJU_CMC_MD2.ID03007.hairpin | YES | YES | YES | YES | NO | NO | NO | NO |
| TJU_CMC_MD2.ID03008.5p-miR | TJU_CMC_MD2.ID03008.hairpin | YES | YES | YES | NO | NO | YES | NO | NO |
| TJU_CMC_MD2.ID03009.3p-miR | TJU_CMC_MD2.ID03009.hairpin | YES | NO | NO | NO | NO | NO | NO | NO |
| TJU_CMC_MD2.ID03010.5p-miR | TJU_CMC_MD2.ID03010.hairpin | YES | NO | NO | NO | NO | NO | NO | NO |
| TJU_CMC_MD2.ID03011.5p-miR | TJU_CMC_MD2.ID03011.hairpin | YES | NO | NO | NO | NO | NO | NO | NO |
| TJU_CMC_MD2.ID03012.3p-miR | TJU_CMC_MD2.ID03012.hairpin | YES | NO | NO | NO | NO | NO | NO | NO |
| TJU_CMC_MD2.ID03013.5p-miR | TJU_CMC_MD2.ID03013.hairpin | YES | NO | YES | NO | NO | NO | NO | NO |
| TJU_CMC_MD2.ID03014.3p-miR | TJU_CMC_MD2.ID03014.hairpin | YES | NO | NO | NO | NO | NO | NO | NO |
| TJU_CMC_MD2.ID03015.3p-miR | TJU_CMC_MD2.ID03015.hairpin | YES | NO | NO | NO | NO | NO | NO | NO |
| TJU_CMC_MD2.ID03016.3p-miR | TJU_CMC_MD2.ID03016.hairpin | YES | NO | NO | NO | NO | NO | NO | NO |
| TJU_CMC_MD2.ID03017.5p-miR | TJU_CMC_MD2.ID03017.hairpin | YES | YES | NO | NO | NO | NO | NO | NO |
| TJU_CMC_MD2.ID03018.3p-miR | TJU_CMC_MD2.ID03018.hairpin | YES | NO | NO | NO | NO | NO | NO | NO |
| TJU_CMC_MD2.ID03019.5p-miR | TJU_CMC_MD2.ID03019.hairpin | YES | YES | YES | YES | NO | NO | NO | NO |
| TJU_CMC_MD2.ID03020.3p-miR | TJU_CMC_MD2.ID03020.hairpin | YES | YES | YES | YES | NO | NO | NO | NO |
| TJU_CMC_MD2.ID03021.5p-miR | TJU_CMC_MD2.ID03021.hairpin | YES | NO | YES | YES | NO | NO | NO | NO |
| TJU_CMC_MD2.ID03022.3p-miR | TJU_CMC_MD2.ID03022.hairpin | YES | NO | NO | NO | NO | NO | NO | NO |
| TJU_CMC_MD2.ID03023.3p-miR | TJU_CMC_MD2.ID03023.hairpin | YES | NO | NO | NO | NO | NO | NO | NO |
| TJU_CMC_MD2.ID03024.5p-miR | TJU_CMC_MD2.ID03024.hairpin | YES | NO | YES | NO | NO | NO | NO | NO |
| TJU_CMC_MD2.ID03025.5p-miR | TJU_CMC_MD2.ID03025.hairpin | YES | YES | YES | YES | NO | NO | NO | NO |
| TJU_CMC_MD2.ID03026.5p-miR | TJU_CMC_MD2.ID03026.hairpin | YES | YES | YES | YES | YES | YES | NO | NO |
| TJU_CMC_MD2.ID03027.3p-miR | TJU_CMC_MD2.ID03027.hairpin | YES | NO | NO | NO | NO | NO | NO | NO |
| TJU_CMC_MD2.ID03028.3p-miR | TJU_CMC_MD2.ID03028.hairpin | YES | NO | NO | NO | NO | NO | NO | NO |
| TJU_CMC_MD2.ID03029.3p-miR | TJU_CMC_MD2.ID03029.hairpin | YES | NO | NO | NO | NO | NO | NO | NO |
| TJU_CMC_MD2.ID03030.3p-miR | TJU_CMC_MD2.ID03030.hairpin | YES | NO | NO | NO | NO | NO | NO | NO |
| TJU_CMC_MD2.ID03031.5p-miR | TJU_CMC_MD2.ID03031.hairpin | YES | YES | YES | YES | YES | NO | NO | NO |
| TJU_CMC_MD2.ID03032.3p-miR | TJU_CMC_MD2.ID03032.hairpin | YES | NO | NO | NO | NO | NO | NO | NO |
| TJU_CMC_MD2.ID03033.3p-miR | TJU_CMC_MD2.ID03033.hairpin | YES | NO | NO | NO | NO | NO | NO | NO |
| TJU_CMC_MD2.ID03034.5p-miR | TJU_CMC_MD2.ID03034.hairpin | YES | NO | NO | NO | NO | NO | NO | NO |
| TJU_CMC_MD2.ID03035.3p-miR | TJU_CMC_MD2.ID03035.hairpin | YES | NO | NO | NO | NO | NO | NO | NO |
| TJU_CMC_MD2.ID03036.3p-miR | TJU_CMC_MD2.ID03036.hairpin | YES | YES | YES | YES | YES | NO | NO | NO |
| TJU_CMC_MD2.ID03037.3p-miR | TJU_CMC_MD2.ID03037.hairpin | YES | YES | YES | YES | YES | NO | NO | NO |
| TJU_CMC_MD2.ID03038.3p-miR | TJU_CMC_MD2.ID03038.hairpin | YES | NO | NO | NO | NO | NO | NO | NO |
| TJU_CMC_MD2.ID03039.3p-miR | TJU_CMC_MD2.ID03039.hairpin | YES | NO | NO | NO | NO | NO | NO | NO |
| TJU_CMC_MD2.ID03040.3p-miR | TJU_CMC_MD2.ID03040.hairpin | YES | NO | NO | NO | NO | NO | NO | NO |
| TJU_CMC_MD2.ID03041.3p-miR | TJU_CMC_MD2.ID03041.hairpin | YES | NO | NO | NO | NO | NO | NO | NO |
| TJU_CMC_MD2.ID03042.5p-miR | TJU_CMC_MD2.ID03042.hairpin | YES | NO | NO | NO | NO | NO | NO | NO |
| TJU_CMC_MD2.ID03043.5p-miR | TJU_CMC_MD2.ID03043.hairpin | YES | YES | NO | NO | NO | NO | NO | NO |
| TJU_CMC_MD2.ID03044.3p-miR | TJU_CMC_MD2.ID03044.hairpin | YES | NO | NO | NO | NO | NO | NO | NO |
| TJU_CMC_MD2.ID03045.3p-miR | TJU_CMC_MD2.ID03045.hairpin | YES | NO | NO | NO | NO | NO | NO | NO |
| TJU_CMC_MD2.ID03046.5p-miR | TJU_CMC_MD2.ID03046.hairpin | YES | YES | YES | YES | NO | NO | NO | NO |
| TJU_CMC_MD2.ID03047.3p-miR | TJU_CMC_MD2.ID03047.hairpin | YES | NO | NO | NO | NO | NO | NO | NO |
| TJU_CMC_MD2.ID03048.3p-miR | TJU_CMC_MD2.ID03048.hairpin | YES | NO | NO | NO | NO | NO | NO | NO |
| TJU_CMC_MD2.ID03049.5p-miR | TJU_CMC_MD2.ID03049.hairpin | YES | YES | YES | YES | YES | NO | NO | NO |
| TJU_CMC_MD2.ID03050.3p-miR | TJU_CMC_MD2.ID03050.hairpin | YES | YES | YES | YES | YES | YES | NO | NO |
| TJU_CMC_MD2.ID03051.3p-miR | TJU_CMC_MD2.ID03051.hairpin | YES | NO | NO | NO | NO | NO | NO | NO |
| TJU_CMC_MD2.ID03052.5p-miR | TJU_CMC_MD2.ID03052.hairpin | YES | NO | NO | NO | NO | NO | NO | NO |
| TJU_CMC_MD2.ID03053.3p-miR | TJU_CMC_MD2.ID03053.hairpin | YES | NO | NO | NO | NO | NO | NO | NO |
| TJU_CMC_MD2.ID03054.3p-miR | TJU_CMC_MD2.ID03054.hairpin | YES | NO | NO | NO | NO | NO | NO | NO |
| TJU_CMC_MD2.ID03055.5p-miR | TJU_CMC_MD2.ID03055.hairpin | YES | YES | YES | YES | NO | NO | NO | NO |
| TJU_CMC_MD2.ID03056.3p-miR | TJU_CMC_MD2.ID03056.hairpin | YES | NO | NO | NO | NO | NO | NO | NO |
| TJU_CMC_MD2.ID03057.3p-miR | TJU_CMC_MD2.ID03057.hairpin | YES | NO | NO | NO | NO | NO | NO | NO |
| TJU_CMC_MD2.ID03058.3p-miR | TJU_CMC_MD2.ID03058.hairpin | YES | NO | NO | NO | NO | NO | NO | NO |
| TJU_CMC_MD2.ID03059.3p-miR | TJU_CMC_MD2.ID03059.hairpin | YES | NO | NO | NO | NO | NO | NO | NO |
| TJU_CMC_MD2.ID03060.3p-miR | TJU_CMC_MD2.ID03060.hairpin | YES | NO | NO | NO | NO | NO | NO | NO |
| TJU_CMC_MD2.ID03061.3p-miR | TJU_CMC_MD2.ID03061.hairpin | YES | YES | YES | YES | YES | NO | NO | NO |
| TJU_CMC_MD2.ID03061.5p-miR | TJU_CMC_MD2.ID03061.hairpin | YES | YES | YES | YES | YES | NO | NO | NO |
| TJU_CMC_MD2.ID03062.3p-miR | TJU_CMC_MD2.ID03062.hairpin | YES | NO | NO | NO | NO | NO | NO | NO |
| TJU_CMC_MD2.ID03063.3p-miR | TJU_CMC_MD2.ID03063.hairpin | YES | NO | NO | NO | NO | NO | NO | NO |
| TJU_CMC_MD2.ID03063.5p-miR | TJU_CMC_MD2.ID03063.hairpin | YES | YES | YES | YES | YES | NO | NO | NO |
| TJU_CMC_MD2.ID03064.3p-miR | TJU_CMC_MD2.ID03064.hairpin | YES | NO | NO | NO | NO | NO | NO | NO |
| TJU_CMC_MD2.ID03065.3p-miR | TJU_CMC_MD2.ID03065.hairpin | YES | NO | NO | NO | NO | NO | NO | NO |
| TJU_CMC_MD2.ID03066.3p-miR | TJU_CMC_MD2.ID03066.hairpin | YES | YES | NO | NO | NO | NO | NO | NO |
| TJU_CMC_MD2.ID03066.5p-miR | TJU_CMC_MD2.ID03066.hairpin | YES | YES | YES | YES | NO | NO | NO | NO |
| TJU_CMC_MD2.ID03067.5p-miR | TJU_CMC_MD2.ID03067.hairpin | YES | YES | YES | YES | NO | NO | NO | NO |
| TJU_CMC_MD2.ID03068.3p-miR | TJU_CMC_MD2.ID03068.hairpin | YES | NO | NO | NO | NO | NO | NO | NO |
| TJU_CMC_MD2.ID03069.5p-miR | TJU_CMC_MD2.ID03069.hairpin | YES | NO | YES | YES | NO | YES | NO | NO |
| TJU_CMC_MD2.ID03070.3p-miR | TJU_CMC_MD2.ID03070.hairpin | YES | NO | NO | NO | NO | NO | NO | NO |
| TJU_CMC_MD2.ID03071.3p-miR | TJU_CMC_MD2.ID03071.hairpin | YES | NO | NO | NO | NO | NO | NO | NO |
| TJU_CMC_MD2.ID03072.5p-miR | TJU_CMC_MD2.ID03072.hairpin | YES | YES | YES | YES | NO | NO | NO | NO |
| TJU_CMC_MD2.ID03073.3p-miR | TJU_CMC_MD2.ID03073.hairpin | YES | YES | NO | YES | NO | NO | NO | NO |
| TJU_CMC_MD2.ID03074.5p-miR | TJU_CMC_MD2.ID03074.hairpin | YES | YES | YES | YES | YES | NO | NO | NO |
| TJU_CMC_MD2.ID03075.5p-miR | TJU_CMC_MD2.ID03075.hairpin | YES | YES | YES | YES | YES | NO | NO | NO |
| TJU_CMC_MD2.ID03076.5p-miR | TJU_CMC_MD2.ID03076.hairpin | YES | NO | NO | YES | NO | NO | NO | NO |
| TJU_CMC_MD2.ID03077.3p-miR | TJU_CMC_MD2.ID03077.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03078.3p-miR | TJU_CMC_MD2.ID03078.hairpin | YES | NO | NO | NO | NO | NO | NO | NO |
| TJU_CMC_MD2.ID03079.5p-miR | TJU_CMC_MD2.ID03079.hairpin | YES | YES | YES | YES | YES | NO | NO | NO |
| TJU_CMC_MD2.ID03080.5p-miR | TJU_CMC_MD2.ID03080.hairpin | YES | YES | YES | NO | NO | YES | NO | NO |
| TJU_CMC_MD2.ID03081.5p-miR | TJU_CMC_MD2.ID03081.hairpin | YES | YES | YES | YES | YES | NO | NO | NO |
| TJU_CMC_MD2.ID03082.3p-miR | TJU_CMC_MD2.ID03082.hairpin | YES | NO | NO | NO | NO | NO | NO | NO |
| TJU_CMC_MD2.ID03083.5p-miR | TJU_CMC_MD2.ID03083.hairpin | YES | YES | YES | YES | YES | NO | NO | NO |
| TJU_CMC_MD2.ID03084.3p-miR | TJU_CMC_MD2.ID03084.hairpin | YES | NO | NO | NO | NO | NO | NO | NO |
| TJU_CMC_MD2.ID03085.3p-miR | TJU_CMC_MD2.ID03085.hairpin | YES | YES | YES | NO | NO | NO | NO | NO |
| TJU_CMC_MD2.ID03086.5p-miR | TJU_CMC_MD2.ID03086.hairpin | YES | YES | YES | YES | NO | NO | NO | NO |
| TJU_CMC_MD2.ID03087.3p-miR | TJU_CMC_MD2.ID03087.hairpin | YES | NO | NO | NO | NO | NO | NO | NO |
| TJU_CMC_MD2.ID03088.3p-miR | TJU_CMC_MD2.ID03088.hairpin | YES | NO | NO | NO | NO | NO | NO | NO |
| TJU_CMC_MD2.ID03089.5p-miR | TJU_CMC_MD2.ID03089.hairpin | YES | YES | YES | YES | NO | NO | NO | NO |
| TJU_CMC_MD2.ID03090.3p-miR | TJU_CMC_MD2.ID03090.hairpin | YES | NO | NO | NO | NO | NO | NO | NO |
| TJU_CMC_MD2.ID03091.5p-miR | TJU_CMC_MD2.ID03091.hairpin | YES | YES | NO | NO | NO | NO | NO | NO |
| TJU_CMC_MD2.ID03092.3p-miR | TJU_CMC_MD2.ID03092.hairpin | YES | NO | NO | NO | NO | NO | NO | NO |
| TJU_CMC_MD2.ID03093.3p-miR | TJU_CMC_MD2.ID03093.hairpin | YES | NO | NO | NO | NO | NO | NO | NO |
| TJU_CMC_MD2.ID03093.5p-miR | TJU_CMC_MD2.ID03093.hairpin | YES | YES | YES | YES | NO | NO | NO | NO |
| TJU_CMC_MD2.ID03094.3p-miR | TJU_CMC_MD2.ID03094.hairpin | YES | NO | NO | NO | NO | NO | NO | NO |
| TJU_CMC_MD2.ID03094.5p-miR | TJU_CMC_MD2.ID03094.hairpin | YES | YES | YES | YES | YES | NO | NO | NO |
| TJU_CMC_MD2.ID03095.3p-miR | TJU_CMC_MD2.ID03095.hairpin | YES | YES | YES | YES | YES | NO | NO | NO |
| TJU_CMC_MD2.ID03095.5p-miR | TJU_CMC_MD2.ID03095.hairpin | YES | NO | NO | NO | NO | NO | NO | NO |
| TJU_CMC_MD2.ID03096.5p-miR | TJU_CMC_MD2.ID03096.hairpin | YES | YES | YES | NO | NO | NO | NO | NO |
| TJU_CMC_MD2.ID03097.3p-miR | TJU_CMC_MD2.ID03097.hairpin | YES | NO | NO | NO | NO | NO | NO | NO |
| TJU_CMC_MD2.ID03098.3p-miR | TJU_CMC_MD2.ID03098.hairpin | YES | NO | NO | NO | NO | NO | NO | NO |
| TJU_CMC_MD2.ID03099.3p-miR | TJU_CMC_MD2.ID03099.hairpin | YES | NO | NO | NO | NO | NO | NO | NO |
| TJU_CMC_MD2.ID03100.3p-miR | TJU_CMC_MD2.ID03100.hairpin | YES | NO | NO | NO | NO | NO | NO | NO |
| TJU_CMC_MD2.ID03101.3p-miR | TJU_CMC_MD2.ID03101.hairpin | YES | NO | NO | NO | NO | NO | NO | NO |
| TJU_CMC_MD2.ID03102.5p-miR | TJU_CMC_MD2.ID03102.hairpin | YES | NO | NO | NO | NO | NO | NO | NO |
| TJU_CMC_MD2.ID03103.3p-miR | TJU_CMC_MD2.ID03103.hairpin | YES | NO | NO | NO | NO | NO | NO | NO |
| TJU_CMC_MD2.ID03104.3p-miR | TJU_CMC_MD2.ID03104.hairpin | YES | NO | NO | NO | NO | NO | NO | NO |
| TJU_CMC_MD2.ID03105.3p-miR | TJU_CMC_MD2.ID03105.hairpin | YES | NO | NO | NO | NO | NO | NO | NO |
| TJU_CMC_MD2.ID03106.3p-miR | TJU_CMC_MD2.ID03106.hairpin | YES | NO | NO | NO | NO | NO | NO | NO |
| TJU_CMC_MD2.ID03107.3p-miR | TJU_CMC_MD2.ID03107.hairpin | YES | NO | NO | NO | NO | NO | NO | NO |
| TJU_CMC_MD2.ID03108.5p-miR | TJU_CMC_MD2.ID03108.hairpin | YES | YES | YES | NO | NO | YES | NO | NO |
| TJU_CMC_MD2.ID03109.3p-miR | TJU_CMC_MD2.ID03109.hairpin | YES | YES | YES | YES | YES | NO | NO | NO |
| TJU_CMC_MD2.ID03109.5p-miR | TJU_CMC_MD2.ID03109.hairpin | YES | YES | YES | YES | YES | NO | NO | NO |
| TJU_CMC_MD2.ID03110.3p-miR | TJU_CMC_MD2.ID03110.hairpin | YES | NO | NO | NO | NO | NO | NO | NO |
| TJU_CMC_MD2.ID03111.5p-miR | TJU_CMC_MD2.ID03111.hairpin | YES | YES | NO | NO | NO | NO | NO | NO |
| TJU_CMC_MD2.ID03112.5p-miR | TJU_CMC_MD2.ID03112.hairpin | YES | YES | YES | NO | NO | NO | NO | NO |
| TJU_CMC_MD2.ID03113.3p-miR | TJU_CMC_MD2.ID03113.hairpin | YES | NO | NO | NO | NO | NO | NO | NO |
| TJU_CMC_MD2.ID03114.3p-miR | TJU_CMC_MD2.ID03114.hairpin | YES | YES | YES | NO | YES | NO | NO | NO |
| TJU_CMC_MD2.ID03115.5p-miR | TJU_CMC_MD2.ID03115.hairpin | YES | YES | YES | YES | YES | YES | NO | NO |
| TJU_CMC_MD2.ID03116.3p-miR | TJU_CMC_MD2.ID03116.hairpin | YES | NO | NO | NO | NO | NO | NO | NO |
| TJU_CMC_MD2.ID03117.3p-miR | TJU_CMC_MD2.ID03117.hairpin | YES | NO | NO | NO | NO | NO | NO | NO |
| TJU_CMC_MD2.ID03118.3p-miR | TJU_CMC_MD2.ID03118.hairpin | YES | NO | NO | NO | NO | NO | NO | NO |
| TJU_CMC_MD2.ID03119.5p-miR | TJU_CMC_MD2.ID03119.hairpin | YES | YES | YES | YES | YES | NO | NO | NO |
| TJU_CMC_MD2.ID03120.3p-miR | TJU_CMC_MD2.ID03120.hairpin | YES | NO | NO | NO | NO | NO | NO | NO |
| TJU_CMC_MD2.ID03121.3p-miR | TJU_CMC_MD2.ID03121.hairpin | YES | NO | NO | NO | NO | NO | NO | NO |
| TJU_CMC_MD2.ID03122.3p-miR | TJU_CMC_MD2.ID03122.hairpin | YES | NO | NO | NO | NO | NO | NO | NO |
| TJU_CMC_MD2.ID03123.5p-miR | TJU_CMC_MD2.ID03123.hairpin | YES | YES | YES | YES | YES | NO | NO | NO |
| TJU_CMC_MD2.ID03124.3p-miR | TJU_CMC_MD2.ID03124.hairpin | YES | NO | NO | NO | NO | NO | NO | NO |
| TJU_CMC_MD2.ID03125.3p-miR | TJU_CMC_MD2.ID03125.hairpin | YES | NO | NO | NO | NO | NO | NO | NO |
| TJU_CMC_MD2.ID03126.5p-miR | TJU_CMC_MD2.ID03126.hairpin | YES | YES | YES | YES | YES | NO | NO | NO |
| TJU_CMC_MD2.ID03127.5p-miR | TJU_CMC_MD2.ID03127.hairpin | YES | YES | YES | YES | YES | NO | NO | NO |
| TJU_CMC_MD2.ID03128.5p-miR | TJU_CMC_MD2.ID03128.hairpin | YES | YES | YES | YES | YES | NO | NO | NO |
| TJU_CMC_MD2.ID03129.3p-miR | TJU_CMC_MD2.ID03129.hairpin | YES | NO | NO | NO | NO | NO | NO | NO |
| TJU_CMC_MD2.ID03130.5p-miR | TJU_CMC_MD2.ID03130.hairpin | YES | YES | YES | YES | NO | NO | NO | NO |
| TJU_CMC_MD2.ID03131.3p-miR | TJU_CMC_MD2.ID03131.hairpin | YES | NO | NO | NO | NO | NO | NO | NO |
| TJU_CMC_MD2.ID03132.5p-miR | TJU_CMC_MD2.ID03132.hairpin | YES | YES | YES | NO | YES | NO | NO | NO |
| TJU_CMC_MD2.ID03133.3p-miR | TJU_CMC_MD2.ID03133.hairpin | YES | NO | NO | NO | NO | NO | NO | NO |
| TJU_CMC_MD2.ID03134.3p-miR | TJU_CMC_MD2.ID03134.hairpin | YES | NO | NO | NO | NO | NO | NO | NO |
| TJU_CMC_MD2.ID03135.5p-miR | TJU_CMC_MD2.ID03135.hairpin | YES | YES | YES | YES | NO | NO | NO | NO |
| TJU_CMC_MD2.ID03136.3p-miR | TJU_CMC_MD2.ID03136.hairpin | YES | NO | NO | NO | NO | NO | NO | NO |
| TJU_CMC_MD2.ID03137.5p-miR | TJU_CMC_MD2.ID03137.hairpin | YES | NO | YES | NO | NO | NO | NO | NO |
| TJU_CMC_MD2.ID03138.3p-miR | TJU_CMC_MD2.ID03138.hairpin | YES | NO | NO | NO | NO | NO | NO | NO |
| TJU_CMC_MD2.ID03138.5p-miR | TJU_CMC_MD2.ID03138.hairpin | YES | YES | YES | YES | YES | YES | NO | NO |
| TJU_CMC_MD2.ID03139.5p-miR | TJU_CMC_MD2.ID03139.hairpin | YES | YES | YES | YES | NO | NO | NO | NO |
| TJU_CMC_MD2.ID03140.3p-miR | TJU_CMC_MD2.ID03140.hairpin | YES | NO | NO | NO | NO | NO | NO | NO |
| TJU_CMC_MD2.ID03141.3p-miR | TJU_CMC_MD2.ID03141.hairpin | YES | NO | NO | NO | NO | NO | NO | NO |
| TJU_CMC_MD2.ID03141.5p-miR | TJU_CMC_MD2.ID03141.hairpin | YES | NO | NO | YES | NO | NO | NO | NO |
| TJU_CMC_MD2.ID03142.5p-miR | TJU_CMC_MD2.ID03142.hairpin | YES | NO | NO | NO | NO | NO | NO | NO |
| TJU_CMC_MD2.ID03143.3p-miR | TJU_CMC_MD2.ID03143.hairpin | YES | NO | NO | NO | NO | NO | NO | NO |
| TJU_CMC_MD2.ID03144.5p-miR | TJU_CMC_MD2.ID03144.hairpin | YES | NO | NO | NO | NO | NO | NO | NO |
| TJU_CMC_MD2.ID03145.5p-miR | TJU_CMC_MD2.ID03145.hairpin | YES | YES | NO | YES | NO | NO | NO | NO |
| TJU_CMC_MD2.ID03146.5p-miR | TJU_CMC_MD2.ID03146.hairpin | YES | YES | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03147.5p-miR | TJU_CMC_MD2.ID03147.hairpin | YES | YES | YES | YES | NO | NO | NO | NO |
| TJU_CMC_MD2.ID03148.3p-miR | TJU_CMC_MD2.ID03148.hairpin | YES | NO | NO | NO | NO | NO | NO | NO |
| TJU_CMC_MD2.ID03149.5p-miR | TJU_CMC_MD2.ID03149.hairpin | YES | YES | YES | NO | NO | NO | NO | NO |
| TJU_CMC_MD2.ID03150.3p-miR | TJU_CMC_MD2.ID03150.hairpin | YES | NO | NO | NO | NO | NO | NO | NO |
| TJU_CMC_MD2.ID03151.3p-miR | TJU_CMC_MD2.ID03151.hairpin | YES | NO | NO | NO | NO | NO | NO | NO |
| TJU_CMC_MD2.ID03152.3p-miR | TJU_CMC_MD2.ID03152.hairpin | YES | NO | NO | NO | NO | NO | NO | NO |
| TJU_CMC_MD2.ID03153.3p-miR | TJU_CMC_MD2.ID03153.hairpin | YES | NO | NO | NO | NO | NO | NO | NO |
| TJU_CMC_MD2.ID03154.3p-miR | TJU_CMC_MD2.ID03154.hairpin | YES | NO | NO | NO | NO | NO | NO | NO |
| TJU_CMC_MD2.ID03155.3p-miR | TJU_CMC_MD2.ID03155.hairpin | YES | NO | NO | NO | NO | NO | NO | NO |
| TJU_CMC_MD2.ID03156.5p-miR | TJU_CMC_MD2.ID03156.hairpin | YES | YES | YES | YES | NO | NO | NO | NO |
| TJU_CMC_MD2.ID03157.5p-miR | TJU_CMC_MD2.ID03157.hairpin | YES | NO | YES | YES | NO | NO | NO | NO |
| TJU_CMC_MD2.ID03158.5p-miR | TJU_CMC_MD2.ID03158.hairpin | YES | YES | YES | YES | YES | NO | NO | NO |
| TJU_CMC_MD2.ID03159.3p-miR | TJU_CMC_MD2.ID03159.hairpin | YES | NO | NO | NO | NO | NO | NO | NO |
| TJU_CMC_MD2.ID03159.5p-miR | TJU_CMC_MD2.ID03159.hairpin | YES | YES | NO | NO | NO | NO | NO | NO |
| TJU_CMC_MD2.ID03160.5p-miR | TJU_CMC_MD2.ID03160.hairpin | YES | YES | YES | YES | YES | NO | NO | NO |
| TJU_CMC_MD2.ID03161.3p-miR | TJU_CMC_MD2.ID03161.hairpin | YES | NO | NO | NO | NO | NO | NO | NO |
| TJU_CMC_MD2.ID03162.3p-miR | TJU_CMC_MD2.ID03162.hairpin | YES | YES | YES | YES | YES | NO | NO | NO |
| TJU_CMC_MD2.ID03163.3p-miR | TJU_CMC_MD2.ID03163.hairpin | YES | NO | NO | NO | NO | NO | NO | NO |
| TJU_CMC_MD2.ID03164.3p-miR | TJU_CMC_MD2.ID03164.hairpin | YES | NO | NO | NO | NO | NO | NO | NO |
| TJU_CMC_MD2.ID03165.5p-miR | TJU_CMC_MD2.ID03165.hairpin | YES | YES | NO | YES | NO | NO | NO | NO |
| TJU_CMC_MD2.ID03166.5p-miR | TJU_CMC_MD2.ID03166.hairpin | YES | YES | NO | YES | NO | NO | NO | NO |
| TJU_CMC_MD2.ID03167.3p-miR | TJU_CMC_MD2.ID03167.hairpin | YES | NO | NO | NO | NO | NO | NO | NO |
| TJU_CMC_MD2.ID03168.3p-miR | TJU_CMC_MD2.ID03168.hairpin | YES | NO | NO | NO | NO | NO | NO | NO |
| TJU_CMC_MD2.ID03169.5p-miR | TJU_CMC_MD2.ID03169.hairpin | YES | YES | YES | YES | YES | NO | NO | NO |
| TJU_CMC_MD2.ID03170.3p-miR | TJU_CMC_MD2.ID03170.hairpin | YES | YES | YES | YES | YES | NO | NO | NO |
| TJU_CMC_MD2.ID03170.5p-miR | TJU_CMC_MD2.ID03170.hairpin | YES | YES | YES | YES | YES | NO | NO | NO |
| TJU_CMC_MD2.ID03171.5p-miR | TJU_CMC_MD2.ID03171.hairpin | YES | YES | YES | NO | NO | NO | NO | NO |
| TJU_CMC_MD2.ID03172.3p-miR | TJU_CMC_MD2.ID03172.hairpin | YES | NO | NO | NO | NO | NO | NO | NO |
| TJU_CMC_MD2.ID03173.3p-miR | TJU_CMC_MD2.ID03173.hairpin | YES | NO | NO | NO | NO | NO | NO | NO |
| TJU_CMC_MD2.ID03174.5p-miR | TJU_CMC_MD2.ID03174.hairpin | YES | YES | NO | NO | NO | NO | NO | NO |
| TJU_CMC_MD2.ID03175.3p-miR | TJU_CMC_MD2.ID03175.hairpin | YES | NO | NO | NO | NO | NO | NO | NO |
| TJU_CMC_MD2.ID03176.5p-miR | TJU_CMC_MD2.ID03176.hairpin | YES | YES | YES | YES | NO | NO | NO | NO |
| TJU_CMC_MD2.ID03177.5p-miR | TJU_CMC_MD2.ID03177.hairpin | YES | YES | NO | YES | NO | NO | NO | NO |
| TJU_CMC_MD2.ID03178.5p-miR | TJU_CMC_MD2.ID03178.hairpin | YES | NO | YES | YES | YES | NO | NO | NO |
| TJU_CMC_MD2.ID03179.5p-miR | TJU_CMC_MD2.ID03179.hairpin | YES | YES | YES | YES | NO | NO | NO | NO |
| TJU_CMC_MD2.ID03180.5p-miR | TJU_CMC_MD2.ID03180.hairpin | YES | YES | YES | YES | NO | NO | NO | NO |
| TJU_CMC_MD2.ID03181.3p-miR | TJU_CMC_MD2.ID03181.hairpin | YES | NO | NO | NO | NO | NO | NO | NO |
| TJU_CMC_MD2.ID03182.3p-miR | TJU_CMC_MD2.ID03182.hairpin | YES | NO | NO | NO | NO | NO | NO | NO |
| TJU_CMC_MD2.ID03183.3p-miR | TJU_CMC_MD2.ID03183.hairpin | YES | NO | NO | NO | NO | NO | NO | NO |
| TJU_CMC_MD2.ID03184.3p-miR | TJU_CMC_MD2.ID03184.hairpin | YES | NO | NO | NO | NO | NO | NO | NO |
| TJU_CMC_MD2.ID03185.5p-miR | TJU_CMC_MD2.ID03185.hairpin | YES | YES | YES | YES | YES | NO | NO | NO |
| TJU_CMC_MD2.ID03186.3p-miR | TJU_CMC_MD2.ID03186.hairpin | YES | NO | NO | NO | NO | NO | NO | NO |
| TJU_CMC_MD2.ID03187.3p-miR | TJU_CMC_MD2.ID03187.hairpin | YES | NO | NO | NO | NO | NO | NO | NO |
| TJU_CMC_MD2.ID03188.3p-miR | TJU_CMC_MD2.ID03188.hairpin | YES | NO | NO | NO | NO | NO | NO | NO |
| TJU_CMC_MD2.ID03188.5p-miR | TJU_CMC_MD2.ID03188.hairpin | YES | YES | YES | YES | NO | NO | NO | NO |
| TJU_CMC_MD2.ID03189.3p-miR | TJU_CMC_MD2.ID03189.hairpin | YES | NO | NO | NO | NO | NO | NO | NO |
| TJU_CMC_MD2.ID03190.5p-miR | TJU_CMC_MD2.ID03190.hairpin | YES | NO | YES | YES | NO | NO | NO | NO |
| TJU_CMC_MD2.ID03191.3p-miR | TJU_CMC_MD2.ID03191.hairpin | YES | NO | NO | NO | NO | NO | NO | NO |
| TJU_CMC_MD2.ID03192.5p-miR | TJU_CMC_MD2.ID03192.hairpin | YES | NO | YES | YES | NO | NO | NO | NO |
| TJU_CMC_MD2.ID03193.3p-miR | TJU_CMC_MD2.ID03193.hairpin | YES | NO | NO | NO | NO | NO | NO | NO |
| TJU_CMC_MD2.ID03194.3p-miR | TJU_CMC_MD2.ID03194.hairpin | YES | NO | NO | NO | NO | NO | NO | NO |
| TJU_CMC_MD2.ID03195.3p-miR | TJU_CMC_MD2.ID03195.hairpin | YES | NO | NO | NO | NO | NO | NO | NO |
| TJU_CMC_MD2.ID03196.3p-miR | TJU_CMC_MD2.ID03196.hairpin | YES | NO | NO | NO | NO | NO | NO | NO |
| TJU_CMC_MD2.ID03197.5p-miR | TJU_CMC_MD2.ID03197.hairpin | YES | YES | YES | NO | YES | NO | NO | NO |
| TJU_CMC_MD2.ID03198.3p-miR | TJU_CMC_MD2.ID03198.hairpin | YES | NO | NO | NO | NO | NO | NO | NO |
| TJU_CMC_MD2.ID03199.5p-miR | TJU_CMC_MD2.ID03199.hairpin | YES | YES | YES | YES | NO | NO | NO | NO |
| TJU_CMC_MD2.ID03200.3p-miR | TJU_CMC_MD2.ID03200.hairpin | YES | NO | NO | NO | NO | NO | NO | NO |
| TJU_CMC_MD2.ID03201.3p-miR | TJU_CMC_MD2.ID03201.hairpin | YES | NO | NO | NO | NO | NO | NO | NO |
| TJU_CMC_MD2.ID03202.3p-miR | TJU_CMC_MD2.ID03202.hairpin | YES | NO | NO | NO | NO | NO | NO | NO |
| TJU_CMC_MD2.ID03203.3p-miR | TJU_CMC_MD2.ID03203.hairpin | YES | NO | NO | NO | NO | NO | NO | NO |
| TJU_CMC_MD2.ID03204.3p-miR | TJU_CMC_MD2.ID03204.hairpin | YES | NO | NO | NO | NO | NO | NO | NO |
| TJU_CMC_MD2.ID03205.3p-miR | TJU_CMC_MD2.ID03205.hairpin | YES | NO | NO | NO | NO | NO | NO | NO |
| TJU_CMC_MD2.ID03206.5p-miR | TJU_CMC_MD2.ID03206.hairpin | YES | YES | NO | YES | NO | NO | NO | NO |
| TJU_CMC_MD2.ID03207.3p-miR | TJU_CMC_MD2.ID03207.hairpin | YES | NO | NO | NO | NO | NO | NO | NO |
| TJU_CMC_MD2.ID03208.5p-miR | TJU_CMC_MD2.ID03208.hairpin | YES | YES | YES | NO | YES | NO | NO | NO |
| TJU_CMC_MD2.ID03209.5p-miR | TJU_CMC_MD2.ID03209.hairpin | YES | YES | NO | YES | NO | NO | NO | NO |
| TJU_CMC_MD2.ID03210.5p-miR | TJU_CMC_MD2.ID03210.hairpin | YES | NO | YES | NO | YES | NO | NO | NO |
| TJU_CMC_MD2.ID03211.3p-miR | TJU_CMC_MD2.ID03211.hairpin | YES | NO | NO | NO | NO | NO | NO | NO |
| TJU_CMC_MD2.ID03212.5p-miR | TJU_CMC_MD2.ID03212.hairpin | YES | NO | NO | NO | NO | NO | NO | NO |
| TJU_CMC_MD2.ID03213.5p-miR | TJU_CMC_MD2.ID03213.hairpin | YES | YES | YES | YES | NO | NO | NO | NO |
| TJU_CMC_MD2.ID03214.3p-miR | TJU_CMC_MD2.ID03214.hairpin | YES | NO | NO | NO | NO | NO | NO | NO |
| TJU_CMC_MD2.ID03215.3p-miR | TJU_CMC_MD2.ID03215.hairpin | YES | NO | NO | NO | NO | NO | NO | NO |
| TJU_CMC_MD2.ID03216.3p-miR | TJU_CMC_MD2.ID03216.hairpin | YES | NO | NO | NO | NO | NO | NO | NO |
| TJU_CMC_MD2.ID03217.5p-miR | TJU_CMC_MD2.ID03217.hairpin | YES | YES | YES | YES | YES | NO | NO | NO |
| TJU_CMC_MD2.ID03218.3p-miR | TJU_CMC_MD2.ID03218.hairpin | YES | NO | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03219.3p-miR | TJU_CMC_MD2.ID03219.hairpin | YES | NO | NO | NO | NO | NO | NO | NO |
| TJU_CMC_MD2.ID03220.3p-miR | TJU_CMC_MD2.ID03220.hairpin | YES | NO | NO | NO | NO | NO | NO | NO |
| TJU_CMC_MD2.ID03221.5p-miR | TJU_CMC_MD2.ID03221.hairpin | YES | NO | NO | NO | NO | NO | NO | NO |
| TJU_CMC_MD2.ID03222.5p-miR | TJU_CMC_MD2.ID03222.hairpin | YES | YES | NO | YES | NO | NO | NO | NO |
| TJU_CMC_MD2.ID03223.5p-miR | TJU_CMC_MD2.ID03223.hairpin | YES | YES | YES | YES | NO | NO | NO | NO |
| TJU_CMC_MD2.ID03224.5p-miR | TJU_CMC_MD2.ID03224.hairpin | YES | YES | NO | NO | NO | NO | NO | NO |
| TJU_CMC_MD2.ID03225.3p-miR | TJU_CMC_MD2.ID03225.hairpin | YES | NO | NO | NO | NO | NO | NO | NO |
| TJU_CMC_MD2.ID03226.3p-miR | TJU_CMC_MD2.ID03226.hairpin | YES | NO | NO | NO | NO | NO | NO | NO |
| TJU_CMC_MD2.ID03227.3p-miR | TJU_CMC_MD2.ID03227.hairpin | YES | NO | NO | NO | NO | NO | NO | NO |
| TJU_CMC_MD2.ID03228.5p-miR | TJU_CMC_MD2.ID03228.hairpin | YES | NO | YES | NO | YES | NO | NO | NO |
| TJU_CMC_MD2.ID03229.5p-miR | TJU_CMC_MD2.ID03229.hairpin | YES | NO | YES | YES | NO | NO | NO | NO |
| TJU_CMC_MD2.ID03230.5p-miR | TJU_CMC_MD2.ID03230.hairpin | YES | YES | YES | YES | YES | NO | NO | NO |
| TJU_CMC_MD2.ID03231.5p-miR | TJU_CMC_MD2.ID03231.hairpin | YES | YES | YES | YES | YES | NO | NO | NO |
| TJU_CMC_MD2.ID03232.3p-miR | TJU_CMC_MD2.ID03232.hairpin | YES | NO | NO | NO | NO | NO | NO | NO |
| TJU_CMC_MD2.ID03233.5p-miR | TJU_CMC_MD2.ID03233.hairpin | YES | YES | NO | NO | NO | NO | NO | NO |
| TJU_CMC_MD2.ID03234.5p-miR | TJU_CMC_MD2.ID03234.hairpin | YES | YES | YES | YES | YES | YES | NO | NO |
| TJU_CMC_MD2.ID03235.3p-miR | TJU_CMC_MD2.ID03235.hairpin | YES | NO | NO | NO | NO | NO | NO | NO |
| TJU_CMC_MD2.ID03236.3p-miR | TJU_CMC_MD2.ID03236.hairpin | YES | YES | YES | YES | YES | NO | NO | NO |
| TJU_CMC_MD2.ID03236.5p-miR | TJU_CMC_MD2.ID03236.hairpin | YES | YES | YES | NO | NO | NO | NO | NO |
| TJU_CMC_MD2.ID03237.3p-miR | TJU_CMC_MD2.ID03237.hairpin | YES | NO | NO | NO | NO | NO | NO | NO |
| TJU_CMC_MD2.ID03238.3p-miR | TJU_CMC_MD2.ID03238.hairpin | YES | NO | NO | NO | NO | NO | NO | NO |
| TJU_CMC_MD2.ID03239.5p-miR | TJU_CMC_MD2.ID03239.hairpin | YES | NO | YES | NO | NO | NO | NO | NO |
| TJU_CMC_MD2.ID03240.3p-miR | TJU_CMC_MD2.ID03240.hairpin | YES | NO | NO | NO | NO | NO | NO | NO |
| TJU_CMC_MD2.ID03241.5p-miR | TJU_CMC_MD2.ID03241.hairpin | YES | YES | YES | YES | NO | NO | NO | NO |
| TJU_CMC_MD2.ID03242.5p-miR | TJU_CMC_MD2.ID03242.hairpin | YES | YES | YES | YES | YES | NO | NO | NO |
| TJU_CMC_MD2.ID03243.3p-miR | TJU_CMC_MD2.ID03243.hairpin | YES | NO | NO | NO | NO | NO | NO | NO |
| TJU_CMC_MD2.ID03244.3p-miR | TJU_CMC_MD2.ID03244.hairpin | YES | NO | NO | NO | NO | NO | NO | NO |
| TJU_CMC_MD2.ID03244.5p-miR | TJU_CMC_MD2.ID03244.hairpin | YES | NO | NO | NO | NO | NO | NO | NO |
| TJU_CMC_MD2.ID03245.5p-miR | TJU_CMC_MD2.ID03245.hairpin | YES | NO | NO | NO | NO | NO | NO | NO |
| TJU_CMC_MD2.ID03246.3p-miR | TJU_CMC_MD2.ID03246.hairpin | YES | NO | NO | NO | NO | NO | NO | NO |
| TJU_CMC_MD2.ID03247.3p-miR | TJU_CMC_MD2.ID03247.hairpin | YES | NO | NO | NO | NO | NO | NO | NO |
| TJU_CMC_MD2.ID03248.3p-miR | TJU_CMC_MD2.ID03248.hairpin | YES | NO | NO | NO | NO | NO | NO | NO |
| TJU_CMC_MD2.ID03249.3p-miR | TJU_CMC_MD2.ID03249.hairpin | YES | NO | NO | NO | NO | NO | NO | NO |
| TJU_CMC_MD2.ID03250.5p-miR | TJU_CMC_MD2.ID03250.hairpin | YES | YES | YES | NO | YES | NO | NO | NO |
| TJU_CMC_MD2.ID03251.5p-miR | TJU_CMC_MD2.ID03251.hairpin | YES | YES | YES | YES | NO | NO | NO | NO |
| TJU_CMC_MD2.ID03252.5p-miR | TJU_CMC_MD2.ID03252.hairpin | YES | YES | YES | NO | YES | NO | NO | NO |
| TJU_CMC_MD2.ID03253.3p-miR | TJU_CMC_MD2.ID03253.hairpin | YES | NO | NO | NO | NO | NO | NO | NO |
| TJU_CMC_MD2.ID03254.5p-miR | TJU_CMC_MD2.ID03254.hairpin | YES | YES | YES | YES | YES | NO | NO | NO |
| TJU_CMC_MD2.ID03255.5p-miR | TJU_CMC_MD2.ID03255.hairpin | YES | YES | YES | NO | YES | NO | NO | NO |
| TJU_CMC_MD2.ID03256.3p-miR | TJU_CMC_MD2.ID03256.hairpin | YES | NO | NO | NO | NO | NO | NO | NO |
| TJU_CMC_MD2.ID03257.3p-miR | TJU_CMC_MD2.ID03257.hairpin | YES | NO | NO | NO | NO | NO | NO | NO |
| TJU_CMC_MD2.ID03258.5p-miR | TJU_CMC_MD2.ID03258.hairpin | YES | YES | YES | YES | YES | YES | NO | NO |
| TJU_CMC_MD2.ID03259.3p-miR | TJU_CMC_MD2.ID03259.hairpin | YES | NO | NO | NO | NO | NO | NO | NO |
| TJU_CMC_MD2.ID03260.3p-miR | TJU_CMC_MD2.ID03260.hairpin | YES | NO | NO | NO | NO | NO | NO | NO |
| TJU_CMC_MD2.ID03261.5p-miR | TJU_CMC_MD2.ID03261.hairpin | YES | YES | NO | YES | NO | NO | NO | NO |
| TJU_CMC_MD2.ID03262.5p-miR | TJU_CMC_MD2.ID03262.hairpin | YES | YES | YES | YES | YES | NO | NO | NO |
| TJU_CMC_MD2.ID03263.3p-miR | TJU_CMC_MD2.ID03263.hairpin | YES | NO | NO | NO | NO | NO | NO | NO |
| TJU_CMC_MD2.ID03263.5p-miR | TJU_CMC_MD2.ID03263.hairpin | YES | YES | NO | NO | NO | NO | NO | NO |
| TJU_CMC_MD2.ID03264.3p-miR | TJU_CMC_MD2.ID03264.hairpin | YES | NO | NO | NO | NO | NO | NO | NO |
| TJU_CMC_MD2.ID03265.3p-miR | TJU_CMC_MD2.ID03265.hairpin | YES | NO | NO | NO | NO | NO | NO | NO |
| TJU_CMC_MD2.ID03266.5p-miR | TJU_CMC_MD2.ID03266.hairpin | YES | YES | YES | NO | NO | NO | NO | NO |
| TJU_CMC_MD2.ID03267.3p-miR | TJU_CMC_MD2.ID03267.hairpin | YES | NO | NO | NO | NO | NO | NO | NO |
| TJU_CMC_MD2.ID03268.3p-miR | TJU_CMC_MD2.ID03268.hairpin | YES | NO | NO | NO | NO | NO | NO | NO |
| TJU_CMC_MD2.ID03269.3p-miR | TJU_CMC_MD2.ID03269.hairpin | YES | NO | YES | NO | NO | NO | NO | NO |
| TJU_CMC_MD2.ID03270.3p-miR | TJU_CMC_MD2.ID03270.hairpin | YES | NO | NO | NO | NO | NO | NO | NO |
| TJU_CMC_MD2.ID03271.5p-miR | TJU_CMC_MD2.ID03271.hairpin | YES | NO | NO | NO | NO | NO | NO | NO |
| TJU_CMC_MD2.ID03272.5p-miR | TJU_CMC_MD2.ID03272.hairpin | YES | YES | YES | NO | NO | NO | NO | NO |
| TJU_CMC_MD2.ID03273.3p-miR | TJU_CMC_MD2.ID03273.hairpin | YES | NO | NO | NO | NO | NO | NO | NO |
| TJU_CMC_MD2.ID03274.3p-miR | TJU_CMC_MD2.ID03274.hairpin | YES | NO | NO | NO | NO | NO | NO | NO |
| TJU_CMC_MD2.ID03275.5p-miR | TJU_CMC_MD2.ID03275.hairpin | YES | YES | NO | YES | NO | NO | NO | NO |
| TJU_CMC_MD2.ID03276.5p-miR | TJU_CMC_MD2.ID03276.hairpin | YES | YES | NO | NO | NO | NO | NO | NO |
| TJU_CMC_MD2.ID03277.5p-miR | TJU_CMC_MD2.ID03277.hairpin | YES | YES | YES | YES | NO | NO | NO | NO |
| TJU_CMC_MD2.ID03278.3p-miR | TJU_CMC_MD2.ID03278.hairpin | YES | NO | NO | NO | NO | NO | NO | NO |
| TJU_CMC_MD2.ID03279.3p-miR | TJU_CMC_MD2.ID03279.hairpin | YES | NO | NO | NO | NO | NO | NO | NO |
| TJU_CMC_MD2.ID03279.5p-miR | TJU_CMC_MD2.ID03279.hairpin | YES | YES | NO | YES | NO | NO | NO | NO |
| TJU_CMC_MD2.ID03280.3p-miR | TJU_CMC_MD2.ID03280.hairpin | YES | NO | NO | NO | NO | NO | NO | NO |
| TJU_CMC_MD2.ID03281.3p-miR | TJU_CMC_MD2.ID03281.hairpin | YES | NO | NO | NO | NO | NO | NO | NO |
| TJU_CMC_MD2.ID03282.3p-miR | TJU_CMC_MD2.ID03282.hairpin | YES | NO | NO | NO | NO | NO | NO | NO |
| TJU_CMC_MD2.ID03283.5p-miR | TJU_CMC_MD2.ID03283.hairpin | YES | YES | NO | NO | NO | NO | NO | NO |
| TJU_CMC_MD2.ID03284.3p-miR | TJU_CMC_MD2.ID03284.hairpin | YES | NO | NO | NO | NO | NO | NO | NO |
| TJU_CMC_MD2.ID03285.3p-miR | TJU_CMC_MD2.ID03285.hairpin | YES | NO | NO | NO | NO | NO | NO | NO |
| TJU_CMC_MD2.ID03286.5p-miR | TJU_CMC_MD2.ID03286.hairpin | YES | YES | YES | NO | YES | YES | NO | NO |
| TJU_CMC_MD2.ID03287.3p-miR | TJU_CMC_MD2.ID03287.hairpin | YES | NO | NO | NO | NO | NO | NO | NO |
| TJU_CMC_MD2.ID03288.5p-miR | TJU_CMC_MD2.ID03288.hairpin | YES | NO | YES | NO | NO | NO | NO | NO |
| TJU_CMC_MD2.ID03289.5p-miR | TJU_CMC_MD2.ID03289.hairpin | YES | YES | YES | YES | YES | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03290.3p-miR | TJU_CMC_MD2.ID03290.hairpin | YES | NO | NO | NO | NO | NO | NO | NO |
| TJU_CMC_MD2.ID03291.3p-miR | TJU_CMC_MD2.ID03291.hairpin | YES | NO | NO | NO | NO | NO | NO | NO |
| TJU_CMC_MD2.ID03292.3p-miR | TJU_CMC_MD2.ID03292.hairpin | YES | NO | NO | NO | NO | NO | NO | NO |
| TJU_CMC_MD2.ID03293.3p-miR | TJU_CMC_MD2.ID03293.hairpin | YES | NO | NO | NO | NO | NO | NO | NO |
| TJU_CMC_MD2.ID03294.5p-miR | TJU_CMC_MD2.ID03294.hairpin | YES | YES | YES | NO | YES | NO | NO | NO |
| TJU_CMC_MD2.ID03295.3p-miR | TJU_CMC_MD2.ID03295.hairpin | YES | NO | NO | NO | NO | NO | NO | NO |
| TJU_CMC_MD2.ID03296.3p-miR | TJU_CMC_MD2.ID03296.hairpin | YES | YES | YES | NO | YES | NO | NO | NO |
| TJU_CMC_MD2.ID03296.5p-miR | TJU_CMC_MD2.ID03296.hairpin | YES | YES | YES | NO | NO | NO | NO | NO |
| TJU_CMC_MD2.ID03297.3p-miR | TJU_CMC_MD2.ID03297.hairpin | YES | NO | NO | NO | NO | NO | NO | NO |
| TJU_CMC_MD2.ID03298.3p-miR | TJU_CMC_MD2.ID03298.hairpin | YES | NO | NO | NO | NO | NO | NO | NO |
| TJU_CMC_MD2.ID03299.5p-miR | TJU_CMC_MD2.ID03299.hairpin | YES | YES | YES | YES | YES | YES | NO | NO |
| TJU_CMC_MD2.ID03300.5p-miR | TJU_CMC_MD2.ID03300.hairpin | YES | YES | YES | YES | YES | YES | NO | NO |
| TJU_CMC_MD2.ID03301.3p-miR | TJU_CMC_MD2.ID03301.hairpin | YES | NO | NO | NO | NO | NO | NO | NO |
| TJU_CMC_MD2.ID03302.3p-miR | TJU_CMC_MD2.ID03302.hairpin | YES | NO | NO | NO | NO | NO | NO | NO |
| TJU_CMC_MD2.ID03303.3p-miR | TJU_CMC_MD2.ID03303.hairpin | YES | NO | NO | NO | NO | NO | NO | NO |
| TJU_CMC_MD2.ID03304.3p-miR | TJU_CMC_MD2.ID03304.hairpin | YES | YES | YES | NO | NO | NO | NO | NO |
| TJU_CMC_MD2.ID03305.5p-miR | TJU_CMC_MD2.ID03305.hairpin | YES | YES | YES | YES | NO | NO | NO | NO |
| TJU_CMC_MD2.ID03306.3p-miR | TJU_CMC_MD2.ID03306.hairpin | YES | NO | NO | NO | NO | NO | NO | NO |
| TJU_CMC_MD2.ID03307.3p-miR | TJU_CMC_MD2.ID03307.hairpin | YES | NO | NO | NO | NO | NO | NO | NO |
| TJU_CMC_MD2.ID03308.3p-miR | TJU_CMC_MD2.ID03308.hairpin | YES | NO | NO | NO | NO | NO | NO | NO |
| TJU_CMC_MD2.ID03309.5p-miR | TJU_CMC_MD2.ID03309.hairpin | YES | YES | YES | YES | NO | NO | NO | NO |
| TJU_CMC_MD2.ID03310.5p-miR | TJU_CMC_MD2.ID03310.hairpin | YES | NO | YES | NO | NO | NO | NO | NO |
| TJU_CMC_MD2.ID03311.5p-miR | TJU_CMC_MD2.ID03311.hairpin | YES | YES | NO | NO | NO | NO | NO | NO |
| TJU_CMC_MD2.ID03312.5p-miR | TJU_CMC_MD2.ID03312.hairpin | YES | NO | NO | YES | YES | NO | NO | NO |
| TJU_CMC_MD2.ID03313.3p-miR | TJU_CMC_MD2.ID03313.hairpin | YES | NO | NO | NO | NO | NO | NO | NO |
| TJU_CMC_MD2.ID03314.5p-miR | TJU_CMC_MD2.ID03314.hairpin | YES | YES | YES | YES | YES | NO | NO | NO |
| TJU_CMC_MD2.ID03315.3p-miR | TJU_CMC_MD2.ID03315.hairpin | YES | NO | NO | NO | NO | NO | NO | NO |
| TJU_CMC_MD2.ID03316.3p-miR | TJU_CMC_MD2.ID03316.hairpin | YES | NO | NO | NO | NO | NO | NO | NO |
| TJU_CMC_MD2.ID03317.3p-miR | TJU_CMC_MD2.ID03317.hairpin | YES | NO | NO | NO | NO | NO | NO | NO |
| TJU_CMC_MD2.ID03318.3p-miR | TJU_CMC_MD2.ID03318.hairpin | YES | NO | NO | NO | NO | NO | NO | NO |
| TJU_CMC_MD2.ID03319.3p-miR | TJU_CMC_MD2.ID03319.hairpin | YES | NO | NO | NO | NO | NO | NO | NO |
| TJU_CMC_MD2.ID03320.3p-miR | TJU_CMC_MD2.ID03320.hairpin | YES | NO | NO | NO | NO | NO | NO | NO |
| TJU_CMC_MD2.ID03321.3p-miR | TJU_CMC_MD2.ID03321.hairpin | YES | NO | NO | NO | NO | NO | NO | NO |
| TJU_CMC_MD2.ID03322.3p-miR | TJU_CMC_MD2.ID03322.hairpin | YES | NO | NO | NO | NO | NO | NO | NO |
| TJU_CMC_MD2.ID03323.5p-miR | TJU_CMC_MD2.ID03323.hairpin | YES | YES | YES | YES | NO | NO | NO | NO |
| TJU_CMC_MD2.ID03324.3p-miR | TJU_CMC_MD2.ID03324.hairpin | YES | NO | NO | NO | NO | NO | NO | NO |
| TJU_CMC_MD2.ID03325.5p-miR | TJU_CMC_MD2.ID03325.hairpin | YES | YES | YES | YES | NO | NO | NO | NO |
| TJU_CMC_MD2.ID03326.3p-miR | TJU_CMC_MD2.ID03326.hairpin | YES | NO | NO | NO | NO | NO | NO | NO |
| TJU_CMC_MD2.ID03327.3p-miR | TJU_CMC_MD2.ID03327.hairpin | YES | YES | YES | YES | YES | YES | NO | NO |
| TJU_CMC_MD2.ID03328.5p-miR | TJU_CMC_MD2.ID03328.hairpin | YES | YES | YES | YES | YES | NO | NO | NO |
| TJU_CMC_MD2.ID03329.3p-miR | TJU_CMC_MD2.ID03329.hairpin | YES | NO | NO | NO | NO | NO | NO | NO |
| TJU_CMC_MD2.ID03330.3p-miR | TJU_CMC_MD2.ID03330.hairpin | YES | NO | NO | NO | NO | NO | NO | NO |
| TJU_CMC_MD2.ID03331.3p-miR | TJU_CMC_MD2.ID03331.hairpin | YES | NO | NO | NO | NO | NO | NO | NO |
| TJU_CMC_MD2.ID03332.3p-miR | TJU_CMC_MD2.ID03332.hairpin | YES | NO | NO | NO | NO | NO | NO | NO |
| TJU_CMC_MD2.ID03333.3p-miR | TJU_CMC_MD2.ID03333.hairpin | YES | NO | NO | NO | NO | NO | NO | NO |
| TJU_CMC_MD2.ID03334.5p-miR | TJU_CMC_MD2.ID03334.hairpin | YES | YES | YES | NO | YES | NO | NO | NO |
| TJU_CMC_MD2.ID03335.3p-miR | TJU_CMC_MD2.ID03335.hairpin | YES | NO | NO | NO | NO | NO | NO | NO |
| TJU_CMC_MD2.ID03336.5p-miR | TJU_CMC_MD2.ID03336.hairpin | YES | YES | NO | YES | NO | NO | NO | NO |
| TJU_CMC_MD2.ID03337.3p-miR | TJU_CMC_MD2.ID03337.hairpin | YES | NO | NO | NO | NO | NO | NO | NO |
| TJU_CMC_MD2.ID03338.5p-miR | TJU_CMC_MD2.ID03338.hairpin | YES | YES | NO | YES | NO | NO | NO | NO |
| TJU_CMC_MD2.ID03339.5p-miR | TJU_CMC_MD2.ID03339.hairpin | YES | YES | NO | NO | NO | NO | NO | NO |
| TJU_CMC_MD2.ID03340.3p-miR | TJU_CMC_MD2.ID03340.hairpin | YES | NO | NO | NO | NO | NO | NO | NO |
| TJU_CMC_MD2.ID03340.5p-miR | TJU_CMC_MD2.ID03340.hairpin | YES | YES | YES | NO | NO | NO | NO | NO |
| TJU_CMC_MD2.ID03341.5p-miR | TJU_CMC_MD2.ID03341.hairpin | YES | YES | YES | YES | YES | NO | NO | NO |
| TJU_CMC_MD2.ID03342.3p-miR | TJU_CMC_MD2.ID03342.hairpin | YES | NO | NO | NO | NO | NO | NO | NO |
| TJU_CMC_MD2.ID03343.3p-miR | TJU_CMC_MD2.ID03343.hairpin | YES | NO | NO | NO | NO | NO | NO | NO |
| TJU_CMC_MD2.ID03344.3p-miR | TJU_CMC_MD2.ID03344.hairpin | YES | NO | NO | NO | NO | NO | NO | NO |
| TJU_CMC_MD2.ID03345.5p-miR | TJU_CMC_MD2.ID03345.hairpin | YES | NO | YES | NO | NO | NO | NO | NO |
| TJU_CMC_MD2.ID03346.3p-miR | TJU_CMC_MD2.ID03346.hairpin | YES | NO | NO | NO | NO | NO | NO | NO |
| TJU_CMC_MD2.ID03347.5p-miR | TJU_CMC_MD2.ID03347.hairpin | YES | YES | NO | NO | NO | NO | NO | NO |
| TJU_CMC_MD2.ID03348.3p-miR | TJU_CMC_MD2.ID03348.hairpin | YES | NO | NO | NO | NO | NO | NO | NO |
| TJU_CMC_MD2.ID03349.3p-miR | TJU_CMC_MD2.ID03349.hairpin | YES | NO | NO | NO | NO | NO | NO | NO |
| TJU_CMC_MD2.ID03350.5p-miR | TJU_CMC_MD2.ID03350.hairpin | YES | YES | YES | NO | NO | NO | NO | NO |
| TJU_CMC_MD2.ID03351.5p-miR | TJU_CMC_MD2.ID03351.hairpin | YES | YES | YES | YES | YES | NO | NO | NO |
| TJU_CMC_MD2.ID03352.3p-miR | TJU_CMC_MD2.ID03352.hairpin | YES | NO | YES | NO | YES | NO | NO | NO |
| TJU_CMC_MD2.ID03353.5p-miR | TJU_CMC_MD2.ID03353.hairpin | YES | YES | YES | YES | YES | NO | NO | NO |
| TJU_CMC_MD2.ID03354.5p-miR | TJU_CMC_MD2.ID03354.hairpin | YES | NO | NO | NO | NO | NO | NO | NO |
| TJU_CMC_MD2.ID03355.5p-miR | TJU_CMC_MD2.ID03355.hairpin | YES | YES | NO | YES | YES | NO | NO | NO |
| TJU_CMC_MD2.ID03356.5p-miR | TJU_CMC_MD2.ID03356.hairpin | YES | NO | YES | NO | YES | NO | NO | NO |
| TJU_CMC_MD2.ID03357.3p-miR | TJU_CMC_MD2.ID03357.hairpin | YES | NO | NO | NO | NO | NO | NO | NO |
| TJU_CMC_MD2.ID03358.3p-miR | TJU_CMC_MD2.ID03358.hairpin | YES | NO | NO | NO | NO | NO | NO | NO |
| TJU_CMC_MD2.ID03359.5p-miR | TJU_CMC_MD2.ID03359.hairpin | YES | NO | NO | NO | NO | NO | NO | NO |
| TJU_CMC_MD2.ID03360.3p-miR | TJU_CMC_MD2.ID03360.hairpin | YES | NO | NO | NO | NO | NO | NO | NO |
| TJU_CMC_MD2.ID03361.5p-miR | TJU_CMC_MD2.ID03361.hairpin | YES | YES | YES | YES | NO | NO | NO | NO |
| TJU_CMC_MD2.ID03362.5p-miR | TJU_CMC_MD2.ID03362.hairpin | YES | YES | NO | NO | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03363.5p-miR | TJU_CMC_MD2.ID03363.hairpin | YES | NO | YES | YES | NO | NO | NO | NO |
| TJU_CMC_MD2.ID03364.3p-miR | TJU_CMC_MD2.ID03364.hairpin | YES | NO | NO | NO | NO | NO | NO | NO |
| TJU_CMC_MD2.ID03365.5p-miR | TJU_CMC_MD2.ID03365.hairpin | YES | YES | YES | NO | NO | NO | NO | NO |
| TJU_CMC_MD2.ID03366.3p-miR | TJU_CMC_MD2.ID03366.hairpin | YES | NO | NO | NO | NO | NO | NO | NO |
| TJU_CMC_MD2.ID03367.5p-miR | TJU_CMC_MD2.ID03367.hairpin | YES | NO | NO | NO | NO | NO | NO | NO |
| TJU_CMC_MD2.ID03368.3p-miR | TJU_CMC_MD2.ID03368.hairpin | YES | NO | NO | NO | NO | NO | NO | NO |
| TJU_CMC_MD2.ID03369.3p-miR | TJU_CMC_MD2.ID03369.hairpin | YES | NO | NO | NO | NO | NO | NO | NO |
| TJU_CMC_MD2.ID03370.5p-miR | TJU_CMC_MD2.ID03370.hairpin | YES | YES | NO | YES | NO | NO | NO | NO |
| TJU_CMC_MD2.ID03371.3p-miR | TJU_CMC_MD2.ID03371.hairpin | YES | NO | NO | NO | NO | NO | NO | NO |
| TJU_CMC_MD2.ID03372.3p-miR | TJU_CMC_MD2.ID03372.hairpin | YES | NO | NO | NO | NO | NO | NO | NO |
| TJU_CMC_MD2.ID03373.3p-miR | TJU_CMC_MD2.ID03373.hairpin | YES | NO | NO | NO | NO | NO | NO | NO |
| TJU_CMC_MD2.ID03374.3p-miR | TJU_CMC_MD2.ID03374.hairpin | YES | NO | NO | NO | NO | NO | NO | NO |
| TJU_CMC_MD2.ID03375.5p-miR | TJU_CMC_MD2.ID03375.hairpin | YES | YES | YES | NO | YES | NO | NO | NO |
| TJU_CMC_MD2.ID03376.3p-miR | TJU_CMC_MD2.ID03376.hairpin | YES | NO | NO | NO | NO | NO | NO | NO |
| TJU_CMC_MD2.ID03377.3p-miR | TJU_CMC_MD2.ID03377.hairpin | YES | NO | NO | NO | NO | NO | NO | NO |
| TJU_CMC_MD2.ID03378.3p-miR | TJU_CMC_MD2.ID03378.hairpin | YES | NO | NO | NO | NO | NO | NO | NO |
| TJU_CMC_MD2.ID03379.3p-miR | TJU_CMC_MD2.ID03379.hairpin | YES | NO | NO | NO | NO | NO | NO | NO |
| TJU_CMC_MD2.ID03380.3p-miR | TJU_CMC_MD2.ID03380.hairpin | YES | NO | NO | NO | NO | NO | NO | NO |
| TJU_CMC_MD2.ID03381.3p-miR | TJU_CMC_MD2.ID03381.hairpin | YES | NO | NO | NO | NO | NO | NO | NO |
| TJU_CMC_MD2.ID03381.5p-miR | TJU_CMC_MD2.ID03381.hairpin | YES | YES | YES | NO | YES | NO | NO | NO |
| TJU_CMC_MD2.ID03382.3p-miR | TJU_CMC_MD2.ID03382.hairpin | YES | NO | NO | NO | NO | NO | NO | NO |
| TJU_CMC_MD2.ID03383.3p-miR | TJU_CMC_MD2.ID03383.hairpin | YES | NO | NO | NO | NO | NO | NO | NO |
| TJU_CMC_MD2.ID03384.3p-miR | TJU_CMC_MD2.ID03384.hairpin | YES | NO | NO | NO | NO | NO | NO | NO |
| TJU_CMC_MD2.ID03385.3p-miR | TJU_CMC_MD2.ID03385.hairpin | YES | NO | NO | NO | NO | NO | NO | NO |
| TJU_CMC_MD2.ID03386.5p-miR | TJU_CMC_MD2.ID03386.hairpin | YES | YES | YES | YES | NO | NO | NO | NO |
| TJU_CMC_MD2.ID03387.3p-miR | TJU_CMC_MD2.ID03387.hairpin | YES | NO | NO | NO | NO | NO | NO | NO |
| TJU_CMC_MD2.ID03388.5p-miR | TJU_CMC_MD2.ID03388.hairpin | YES | YES | NO | NO | NO | NO | NO | NO |
| TJU_CMC_MD2.ID03389.3p-miR | TJU_CMC_MD2.ID03389.hairpin | YES | NO | NO | NO | NO | NO | NO | NO |
| TJU_CMC_MD2.ID03390.3p-miR | TJU_CMC_MD2.ID03390.hairpin | YES | NO | NO | NO | NO | NO | NO | NO |
| TJU_CMC_MD2.ID03391.5p-miR | TJU_CMC_MD2.ID03391.hairpin | YES | YES | NO | NO | NO | NO | NO | NO |
| TJU_CMC_MD2.ID03392.3p-miR | TJU_CMC_MD2.ID03392.hairpin | YES | NO | NO | NO | NO | NO | NO | NO |
| TJU_CMC_MD2.ID03393.3p-miR | TJU_CMC_MD2.ID03393.hairpin | YES | NO | NO | NO | NO | NO | NO | NO |
| TJU_CMC_MD2.ID03394.3p-miR | TJU_CMC_MD2.ID03394.hairpin | YES | NO | NO | NO | NO | NO | NO | NO |
| TJU_CMC_MD2.ID03395.3p-miR | TJU_CMC_MD2.ID03395.hairpin | YES | NO | NO | NO | NO | NO | NO | NO |
| TJU_CMC_MD2.ID03396.5p-miR | TJU_CMC_MD2.ID03396.hairpin | YES | NO | YES | NO | NO | NO | NO | NO |
| TJU_CMC_MD2.ID03397.3p-miR | TJU_CMC_MD2.ID03397.hairpin | YES | NO | NO | NO | NO | NO | NO | NO |
| TJU_CMC_MD2.ID03398.5p-miR | TJU_CMC_MD2.ID03398.hairpin | YES | YES | YES | YES | NO | NO | NO | NO |
| TJU_CMC_MD2.ID03399.5p-miR | TJU_CMC_MD2.ID03399.hairpin | YES | NO | NO | YES | NO | NO | NO | NO |
| TJU_CMC_MD2.ID03400.3p-miR | TJU_CMC_MD2.ID03400.hairpin | YES | NO | NO | NO | NO | NO | NO | NO |
| TJU_CMC_MD2.ID03402.5p-miR | TJU_CMC_MD2.ID03402.hairpin | YES | YES | YES | NO | NO | NO | NO | NO |
| TJU_CMC_MD2.ID03403.5p-miR | TJU_CMC_MD2.ID03403.hairpin | YES | NO | YES | NO | NO | NO | NO | NO |
| TJU_CMC_MD2.ID03404.5p-miR | TJU_CMC_MD2.ID03404.hairpin | YES | NO | YES | YES | NO | NO | NO | NO |
| TJU_CMC_MD2.ID03405.3p-miR | TJU_CMC_MD2.ID03405.hairpin | YES | NO | NO | NO | NO | NO | NO | NO |
| TJU_CMC_MD2.ID03406.5p-miR | TJU_CMC_MD2.ID03406.hairpin | YES | YES | NO | NO | NO | NO | NO | NO |
| TJU_CMC_MD2.ID03407.3p-miR | TJU_CMC_MD2.ID03407.hairpin | YES | NO | NO | NO | NO | NO | NO | NO |
| TJU_CMC_MD2.ID03408.3p-miR | TJU_CMC_MD2.ID03408.hairpin | YES | NO | NO | NO | NO | NO | NO | NO |
| TJU_CMC_MD2.ID03409.3p-miR | TJU_CMC_MD2.ID03409.hairpin | YES | NO | NO | NO | NO | NO | NO | NO |
| TJU_CMC_MD2.ID03409.5p-miR | TJU_CMC_MD2.ID03409.hairpin | YES | NO | NO | NO | NO | NO | NO | NO |
| TJU_CMC_MD2.ID03410.5p-miR | TJU_CMC_MD2.ID03410.hairpin | YES | YES | YES | YES | YES | NO | NO | NO |
| TJU_CMC_MD2.ID03411.3p-miR | TJU_CMC_MD2.ID03411.hairpin | YES | NO | NO | NO | NO | NO | NO | NO |
| TJU_CMC_MD2.ID03412.5p-miR | TJU_CMC_MD2.ID03412.hairpin | YES | YES | YES | YES | YES | NO | NO | NO |
| TJU_CMC_MD2.ID03413.5p-miR | TJU_CMC_MD2.ID03413.hairpin | YES | YES | YES | YES | YES | NO | NO | NO |
| TJU_CMC_MD2.ID03414.3p-miR | TJU_CMC_MD2.ID03414.hairpin | YES | NO | NO | NO | NO | NO | NO | NO |
| TJU_CMC_MD2.ID03415.5p-miR | TJU_CMC_MD2.ID03415.hairpin | YES | YES | YES | YES | YES | NO | NO | NO |
| TJU_CMC_MD2.ID03416.5p-miR | TJU_CMC_MD2.ID03416.hairpin | YES | YES | YES | YES | NO | NO | NO | NO |
| TJU_CMC_MD2.ID03417.5p-miR | TJU_CMC_MD2.ID03417.hairpin | YES | YES | YES | YES | YES | NO | NO | NO |
| TJU_CMC_MD2.ID03418.3p-miR | TJU_CMC_MD2.ID03418.hairpin | YES | NO | NO | NO | NO | NO | NO | NO |
| TJU_CMC_MD2.ID03419.5p-miR | TJU_CMC_MD2.ID03419.hairpin | YES | YES | NO | YES | NO | NO | NO | NO |
| TJU_CMC_MD2.ID03420.3p-miR | TJU_CMC_MD2.ID03420.hairpin | YES | NO | NO | NO | NO | NO | NO | NO |
| TJU_CMC_MD2.ID03421.5p-miR | TJU_CMC_MD2.ID03421.hairpin | YES | YES | YES | YES | NO | NO | NO | NO |
| TJU_CMC_MD2.ID03422.3p-miR | TJU_CMC_MD2.ID03422.hairpin | YES | NO | NO | NO | NO | NO | NO | NO |
| TJU_CMC_MD2.ID03423.5p-miR | TJU_CMC_MD2.ID03423.hairpin | YES | NO | NO | NO | NO | NO | NO | NO |
| TJU_CMC_MD2.ID03424.3p-miR | TJU_CMC_MD2.ID03424.hairpin | YES | NO | YES | NO | NO | NO | NO | NO |
| TJU_CMC_MD2.ID03425.5p-miR | TJU_CMC_MD2.ID03425.hairpin | YES | NO | YES | YES | NO | NO | NO | NO |
| TJU_CMC_MD2.ID03426.5p-miR | TJU_CMC_MD2.ID03426.hairpin | YES | YES | NO | NO | NO | NO | NO | NO |
| TJU_CMC_MD2.ID03427.3p-miR | TJU_CMC_MD2.ID03427.hairpin | YES | NO | NO | NO | NO | NO | NO | NO |
| TJU_CMC_MD2.ID03428.5p-miR | TJU_CMC_MD2.ID03428.hairpin | YES | NO | YES | YES | YES | NO | NO | NO |
| TJU_CMC_MD2.ID03429.3p-miR | TJU_CMC_MD2.ID03429.hairpin | YES | NO | NO | NO | NO | NO | NO | NO |
| TJU_CMC_MD2.ID03430.3p-miR | TJU_CMC_MD2.ID03430.hairpin | YES | NO | NO | NO | NO | NO | NO | NO |
| TJU_CMC_MD2.ID03431.5p-miR | TJU_CMC_MD2.ID03431.hairpin | YES | YES | YES | YES | YES | NO | NO | NO |
| TJU_CMC_MD2.ID03432.3p-miR | TJU_CMC_MD2.ID03432.hairpin | YES | NO | NO | NO | NO | NO | NO | NO |
| TJU_CMC_MD2.ID03433.3p-miR | TJU_CMC_MD2.ID03433.hairpin | YES | NO | NO | NO | NO | NO | NO | NO |
| TJU_CMC_MD2.ID03434.5p-miR | TJU_CMC_MD2.ID03434.hairpin | YES | YES | YES | YES | YES | YES | NO | NO |
| TJU_CMC_MD2.ID03435.3p-miR | TJU_CMC_MD2.ID03435.hairpin | YES | NO | NO | NO | NO | NO | NO | NO |
| TJU_CMC_MD2.ID03436.5p-miR | TJU_CMC_MD2.ID03436.hairpin | YES | NO | YES | YES | NO | NO | NO | NO |

TABLE 7-continued

Conservation properties across the examined model organisms for the
novel miRNA:hairpin combinations identified using the miRDeep2 method

| Novel miRNA ID | Hairpin ID | Hu | Ch | Go | Or | Ma | Mo | Dr | Wo |
|---|---|---|---|---|---|---|---|---|---|
| TJU_CMC_MD2.ID03437.5p-miR | TJU_CMC_MD2.ID03437.hairpin | YES | YES | YES | YES | YES | NO | NO | NO |
| TJU_CMC_MD2.ID03438.5p-miR | TJU_CMC_MD2.ID03438.hairpin | YES | YES | YES | YES | YES | NO | NO | NO |
| TJU_CMC_MD2.ID03439.5p-miR | TJU_CMC_MD2.ID03439.hairpin | YES | YES | YES | YES | YES | NO | NO | NO |
| TJU_CMC_MD2.ID03440.5p-miR | TJU_CMC_MD2.ID03440.hairpin | YES | YES | NO | YES | NO | NO | NO | NO |
| TJU_CMC_MD2.ID03441.3p-miR | TJU_CMC_MD2.ID03441.hairpin | YES | NO | NO | NO | NO | NO | NO | NO |
| TJU_CMC_MD2.ID03442.3p-miR | TJU_CMC_MD2.ID03442.hairpin | YES | NO | NO | NO | NO | NO | NO | NO |
| TJU_CMC_MD2.ID03443.3p-miR | TJU_CMC_MD2.ID03443.hairpin | YES | YES | YES | YES | YES | NO | NO | NO |
| TJU_CMC_MD2.ID03444.3p-miR | TJU_CMC_MD2.ID03444.hairpin | YES | NO | NO | NO | NO | NO | NO | NO |
| TJU_CMC_MD2.ID03444.5p-miR | TJU_CMC_MD2.ID03444.hairpin | YES | YES | NO | YES | NO | NO | NO | NO |
| TJU_CMC_MD2.ID03445.3p-miR | TJU_CMC_MD2.ID03445.hairpin | YES | YES | YES | YES | NO | NO | NO | NO |
| TJU_CMC_MD2.ID03446.3p-miR | TJU_CMC_MD2.ID03446.hairpin | YES | NO | NO | NO | NO | NO | NO | NO |
| TJU_CMC_MD2.ID03447.3p-miR | TJU_CMC_MD2.ID03447.hairpin | YES | NO | NO | NO | NO | NO | NO | NO |
| TJU_CMC_MD2.ID03448.3p-miR | TJU_CMC_MD2.ID03448.hairpin | YES | NO | NO | NO | NO | NO | NO | NO |
| TJU_CMC_MD2.ID03449.3p-miR | TJU_CMC_MD2.ID03449.hairpin | YES | NO | NO | NO | NO | NO | NO | NO |
| TJU_CMC_MD2.ID03450.5p-miR | TJU_CMC_MD2.ID03450.hairpin | YES | YES | YES | NO | YES | NO | NO | NO |
| TJU_CMC_MD2.ID03451.3p-miR | TJU_CMC_MD2.ID03451.hairpin | YES | NO | NO | NO | NO | NO | NO | NO |
| TJU_CMC_MD2.ID03452.5p-miR | TJU_CMC_MD2.ID03452.hairpin | YES | NO | YES | YES | YES | NO | NO | NO |
| TJU_CMC_MD2.ID03453.3p-miR | TJU_CMC_MD2.ID03453.hairpin | YES | NO | NO | NO | NO | NO | NO | NO |
| TJU_CMC_MD2.ID03454.3p-miR | TJU_CMC_MD2.ID03454.hairpin | YES | YES | YES | YES | NO | YES | NO | NO |
| TJU_CMC_MD2.ID03455.5p-miR | TJU_CMC_MD2.ID03455.hairpin | YES | YES | YES | YES | YES | YES | NO | NO |
| TJU_CMC_MD2.ID03456.5p-miR | TJU_CMC_MD2.ID03456.hairpin | YES | YES | YES | YES | YES | YES | NO | NO |
| TJU_CMC_MD2.ID03457.3p-miR | TJU_CMC_MD2.ID03457.hairpin | YES | NO | NO | NO | NO | NO | NO | NO |
| TJU_CMC_MD2.ID03458.5p-miR | TJU_CMC_MD2.ID03458.hairpin | YES | YES | YES | YES | NO | NO | NO | NO |
| TJU_CMC_MD2.ID03459.3p-miR | TJU_CMC_MD2.ID03459.hairpin | YES | NO | NO | NO | NO | NO | NO | NO |
| TJU_CMC_MD2.ID03459.5p-miR | TJU_CMC_MD2.ID03459.hairpin | YES | NO | YES | NO | NO | NO | NO | NO |
| TJU_CMC_MD2.ID03460.3p-miR | TJU_CMC_MD2.ID03460.hairpin | YES | NO | NO | NO | NO | NO | NO | NO |
| TJU_CMC_MD2.ID03461.3p-miR | TJU_CMC_MD2.ID03461.hairpin | YES | NO | NO | NO | NO | NO | NO | NO |
| TJU_CMC_MD2.ID03462.5p-miR | TJU_CMC_MD2.ID03462.hairpin | YES | NO | NO | YES | NO | NO | NO | NO |
| TJU_CMC_MD2.ID03463.3p-miR | TJU_CMC_MD2.ID03463.hairpin | YES | NO | NO | NO | NO | NO | NO | NO |
| TJU_CMC_MD2.ID03464.3p-miR | TJU_CMC_MD2.ID03464.hairpin | YES | NO | NO | NO | NO | NO | NO | NO |
| TJU_CMC_MD2.ID03465.3p-miR | TJU_CMC_MD2.ID03465.hairpin | YES | NO | NO | NO | NO | NO | NO | NO |
| TJU_CMC_MD2.ID03466.3p-miR | TJU_CMC_MD2.ID03466.hairpin | YES | YES | YES | YES | YES | YES | NO | NO |
| TJU_CMC_MD2.ID03467.5p-miR | TJU_CMC_MD2.ID03467.hairpin | YES | NO | YES | YES | YES | NO | NO | NO |
| TJU_CMC_MD2.ID03468.3p-miR | TJU_CMC_MD2.ID03468.hairpin | YES | NO | NO | NO | NO | NO | NO | NO |
| TJU_CMC_MD2.ID03469.5p-miR | TJU_CMC_MD2.ID03469.hairpin | YES | NO | NO | YES | YES | NO | NO | NO |
| TJU_CMC_MD2.ID03470.5p-miR | TJU_CMC_MD2.ID03470.hairpin | YES | YES | YES | YES | YES | NO | NO | NO |
| TJU_CMC_MD2.ID03471.3p-miR | TJU_CMC_MD2.ID03471.hairpin | YES | NO | NO | NO | NO | NO | NO | NO |
| TJU_CMC_MD2.ID03472.3p-miR | TJU_CMC_MD2.ID03472.hairpin | YES | YES | YES | YES | NO | NO | NO | NO |
| TJU_CMC_MD2.ID03473.3p-miR | TJU_CMC_MD2.ID03473.hairpin | YES | YES | YES | YES | YES | NO | NO | NO |
| TJU_CMC_MD2.ID03474.3p-miR | TJU_CMC_MD2.ID03474.hairpin | YES | NO | NO | NO | NO | NO | NO | NO |
| TJU_CMC_MD2.ID03475.5p-miR | TJU_CMC_MD2.ID03475.hairpin | YES | YES | YES | YES | YES | NO | NO | NO |
| TJU_CMC_MD2.ID03476.3p-miR | TJU_CMC_MD2.ID03476.hairpin | YES | NO | NO | NO | NO | NO | NO | NO |
| TJU_CMC_MD2.ID03477.3p-miR | TJU_CMC_MD2.ID03477.hairpin | YES | NO | NO | NO | NO | NO | NO | NO |
| TJU_CMC_MD2.ID03478.3p-miR | TJU_CMC_MD2.ID03478.hairpin | YES | NO | NO | NO | NO | NO | NO | NO |
| TJU_CMC_MD2.ID03479.3p-miR | TJU_CMC_MD2.ID03479.hairpin | YES | NO | NO | NO | NO | NO | NO | NO |
| TJU_CMC_MD2.ID03480.3p-miR | TJU_CMC_MD2.ID03480.hairpin | YES | NO | NO | NO | NO | NO | NO | NO |
| TJU_CMC_MD2.ID03481.3p-miR | TJU_CMC_MD2.ID03481.hairpin | YES | NO | NO | NO | NO | NO | NO | NO |
| TJU_CMC_MD2.ID03481.5p-miR | TJU_CMC_MD2.ID03481.hairpin | YES | NO | YES | NO | NO | NO | NO | NO |
| TJU_CMC_MD2.ID03482.3p-miR | TJU_CMC_MD2.ID03482.hairpin | YES | NO | NO | NO | NO | NO | NO | NO |
| TJU_CMC_MD2.ID03483.3p-miR | TJU_CMC_MD2.ID03483.hairpin | YES | NO | NO | NO | NO | NO | NO | NO |
| TJU_CMC_MD2.ID03484.3p-miR | TJU_CMC_MD2.ID03484.hairpin | YES | NO | NO | NO | NO | NO | NO | NO |
| TJU_CMC_MD2.ID03485.5p-miR | TJU_CMC_MD2.ID03485.hairpin | YES | YES | YES | YES | NO | NO | NO | NO |
| TJU_CMC_MD2.ID03486.3p-miR | TJU_CMC_MD2.ID03486.hairpin | YES | NO | NO | NO | NO | NO | NO | NO |
| TJU_CMC_MD2.ID03487.3p-miR | TJU_CMC_MD2.ID03487.hairpin | YES | NO | NO | NO | NO | NO | NO | NO |
| TJU_CMC_MD2.ID03488.3p-miR | TJU_CMC_MD2.ID03488.hairpin | YES | NO | NO | NO | NO | NO | NO | NO |
| TJU_CMC_MD2.ID03489.3p-miR | TJU_CMC_MD2.ID03489.hairpin | YES | NO | NO | NO | NO | NO | NO | NO |
| TJU_CMC_MD2.ID03489.5p-miR | TJU_CMC_MD2.ID03489.hairpin | YES | NO | YES | NO | YES | NO | NO | NO |
| TJU_CMC_MD2.ID03490.3p-miR | TJU_CMC_MD2.ID03490.hairpin | YES | NO | NO | NO | NO | NO | NO | NO |
| TJU_CMC_MD2.ID03491.3p-miR | TJU_CMC_MD2.ID03491.hairpin | YES | NO | NO | NO | NO | NO | NO | NO |
| TJU_CMC_MD2.ID03492.5p-miR | TJU_CMC_MD2.ID03492.hairpin | YES | NO | NO | NO | YES | NO | NO | NO |
| TJU_CMC_MD2.ID03493.3p-miR | TJU_CMC_MD2.ID03493.hairpin | YES | NO | NO | NO | NO | NO | NO | NO |
| TJU_CMC_MD2.ID03494.5p-miR | TJU_CMC_MD2.ID03494.hairpin | YES | YES | NO | NO | NO | NO | NO | NO |
| TJU_CMC_MD2.ID03495.5p-miR | TJU_CMC_MD2.ID03495.hairpin | YES | YES | NO | NO | NO | NO | NO | NO |

Example 3. Tissue Specificity of the Novel miRNAs Described Herein

An additional property of the novel miRNAs described herein is that they are for the most part specific to the tissue in which they were discovered. This finding indicates that these novel miRNAs can be used to form distinguishing "signatures" with application to diagnostic and/or prognostic activities. Their participation in such distinguishing signatures directly implicates these sequences in molecular mechanisms that are currently either unknown or poorly understood: as such, some of these sequences can be eventually used to design appropriate therapeutics that are relevant for the corresponding tissue and tissue-state.

As an example, the inventors focused on the 3,707 novel miRNAs listed in Table 2 that they discovered using the miRDeep2 method and for each pair of tissues they computed the number of novel miRNAs that are in common. The following Table 8 shows the results of this computation:

sequences can be used to design appropriate therapeutics that are relevant for the corresponding tissue and tissue-state.

TABLE 8

Number of novel miRNAs described herein that are in common for each pair of tissues

| Number of Samples | | B-cells | Brain | Breast | CD3+ Lympho-cytes | Fibro-blasts | Gastric Tissue | Lymphoblastoid cell lines (LCLs) | Pancreas | Platelets | Peripheral Blood Mononuclear Cells (PBMC) | Prostate | Serum | Skin |
|---|---|---|---|---|---|---|---|---|---|---|---|---|---|---|
| 37 | B-cells | 317 | 100 | 116 | 15 | 91 | 57 | 118 | 149 | 176 | 88 | 94 | 166 | 30 |
| 24 | Brain | 100 | 455 | 104 | 14 | 115 | 59 | 98 | 160 | 204 | 210 | 146 | 166 | 25 |
| 604 | Breast | 116 | 104 | 432 | 12 | 91 | 56 | 122 | 125 | 115 | 95 | 87 | 142 | 34 |
| 1 | CD3+ Lymphocytes | 15 | 14 | 12 | 18 | 12 | 13 | 14 | 14 | 18 | 12 | 15 | 17 | 7 |
| 4 | Fibroblasts | 91 | 115 | 91 | 12 | 260 | 61 | 75 | 150 | 149 | 96 | 117 | 116 | 22 |
| 25 | Gastric Tissue | 57 | 59 | 56 | 13 | 61 | 136 | 47 | 79 | 70 | 57 | 66 | 62 | 16 |
| 488 | LCLs | 118 | 98 | 122 | 14 | 75 | 47 | 268 | 99 | 127 | 86 | 75 | 122 | 32 |
| 12 | Pancreas | 149 | 160 | 125 | 14 | 150 | 79 | 99 | 527 | 199 | 152 | 151 | 178 | 26 |
| 15 | Platelets | 176 | 204 | 115 | 18 | 149 | 70 | 127 | 199 | 633 | 377 | 155 | 354 | 21 |
| 18 | PBMC | 88 | 210 | 95 | 12 | 96 | 57 | 86 | 152 | 377 | 881 | 123 | 288 | 12 |
| 10 | Prostate | 94 | 146 | 87 | 15 | 117 | 66 | 75 | 151 | 155 | 123 | 273 | 134 | 20 |
| 24 | Serum | 166 | 166 | 142 | 17 | 116 | 62 | 122 | 178 | 354 | 288 | 134 | 698 | 21 |
| 63 | Skin | 30 | 25 | 34 | 7 | 22 | 16 | 32 | 26 | 21 | 12 | 20 | 21 | 48 |

The Jaccard coefficients are also computed for each pair above and shown in Table 9. The lower the Jaccard coefficient is when comparing the novel miRNAs discovered in two tissues types, the higher the number of novel miRNAs that are present in one of the two tissue types but not the other tissue type.

This Example shows that differentially expressed isomiRs listed in Table 3 can be used to separate individuals with platelet antigen hyper-reactivity vs. hypo-reactivity. Platelets derived from 10 healthy male individuals were tested for their aggregation properties in response to the PAR1-AP, PAR4-AP, anti-CD9, ADP, and CRP antigens. The individu-

TABLE 9

Jaccard coefficients for each pair of tissues based on the number of novel miRNAs described herein that are in common shown in Table 8 above

| | B-cells | Brain | Breast | CD3+ Lymphocytes | Fibro-blasts | Gastric Tissue | LCLs | Pancreas | Platelets | PBMC | Prostate | Serum | Skin |
|---|---|---|---|---|---|---|---|---|---|---|---|---|---|
| B-cells | 1 | 0.1488 | 0.1833 | 0.0469 | 0.1872 | 0.1439 | 0.2527 | 0.2144 | 0.2274 | 0.0793 | 0.1895 | 0.1955 | 0.0896 |
| Brain | 0.1488 | 1 | 0.1328 | 0.0305 | 0.1917 | 0.1109 | 0.1568 | 0.1946 | 0.2308 | 0.1865 | 0.2509 | 0.1682 | 0.0523 |
| Breast | 0.1833 | 0.1328 | 1 | 0.0274 | 0.1514 | 0.1094 | 0.2111 | 0.1499 | 0.1211 | 0.078 | 0.1408 | 0.1437 | 0.0762 |
| CD3+ Lymphocytes | 0.0469 | 0.0305 | 0.0274 | 1 | 0.0451 | 0.0922 | 0.0515 | 0.0264 | 0.0284 | 0.0135 | 0.0543 | 0.0243 | 0.1186 |
| Fibroblasts | 0.1872 | 0.1917 | 0.1514 | 0.0451 | 1 | 0.1821 | 0.1656 | 0.2355 | 0.2003 | 0.0919 | 0.2812 | 0.1378 | 0.0769 |
| Gastric Tissue | 0.1439 | 0.1109 | 0.1094 | 0.0922 | 0.1821 | 1 | 0.1317 | 0.1353 | 0.1001 | 0.0594 | 0.1924 | 0.0803 | 0.0952 |
| LCLs | 0.2527 | 0.1568 | 0.2111 | 0.0515 | 0.1656 | 0.1317 | 1 | 0.1422 | 0.1641 | 0.0809 | 0.1609 | 0.1445 | 0.1127 |
| Pancreas | 0.2144 | 0.1946 | 0.1499 | 0.0264 | 0.2355 | 0.1353 | 0.1422 | 1 | 0.2071 | 0.121 | 0.2327 | 0.17 | 0.0474 |
| Platelets | 0.2274 | 0.2308 | 0.1211 | 0.0284 | 0.2003 | 0.1001 | 0.1641 | 0.2071 | 1 | 0.3316 | 0.2064 | 0.3623 | 0.0318 |
| PBMC | 0.0793 | 0.1865 | 0.078 | 0.0135 | 0.0919 | 0.0594 | 0.0809 | 0.121 | 0.3316 | 1 | 0.1193 | 0.2231 | 0.0131 |
| Prostate | 0.1895 | 0.2509 | 0.1408 | 0.0543 | 0.2812 | 0.1924 | 0.1609 | 0.2327 | 0.2064 | 0.1193 | 1 | 0.1601 | 0.0664 |
| Serum | 0.1955 | 0.1682 | 0.1437 | 0.0243 | 0.1378 | 0.0803 | 0.1445 | 0.17 | 0.3623 | 0.2231 | 0.1601 | 1 | 0.029 |
| Skin | 0.0896 | 0.0523 | 0.0762 | 0.1186 | 0.0769 | 0.0952 | 0.1127 | 0.0474 | 0.0318 | 0.0131 | 0.0664 | 0.029 | 1 |

Figure 3:
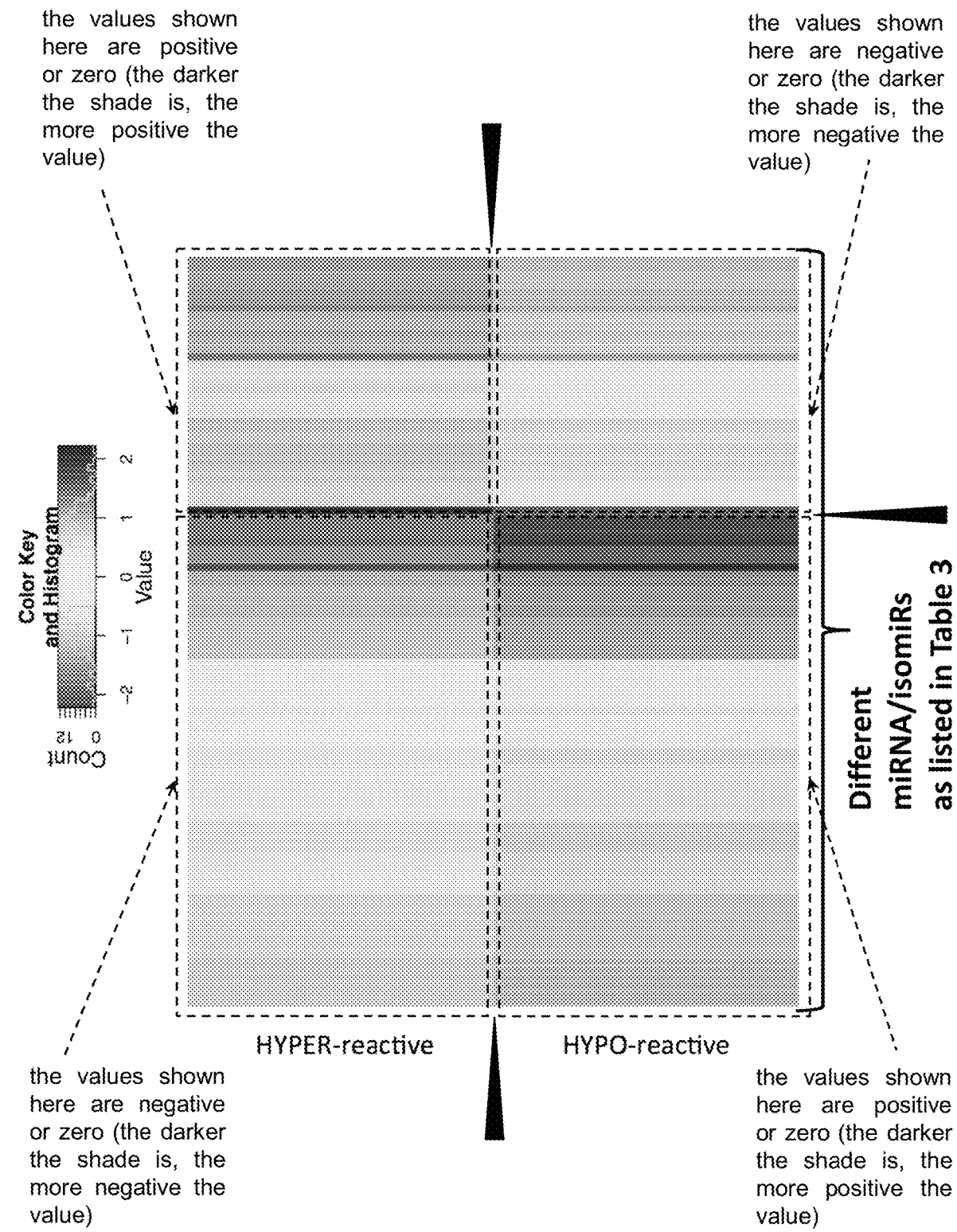
FIG. 3 is a heatmap showing that the two groups of individuals with platelet antigen hyper-reactivity or hypo-reactivity have distinct miRNA/isomiR expression profiles.

Example 4. Exemplary Applications of the isomiRs in Patient Segmentation or Diagnosis In Examples 4-7 below, the isomiRs as listed in Table 3 are found to exhibit different expression behavior between two states of the same tissue, between same-gender members of two different human populations, etc. These examples show that isomiRs, just like miRNAs, can be used to form distinguishing "signatures" with application to diagnostic and/or prognostic activities. Their participation in such distinguishing signatures directly implicates these sequences in molecular mechanisms that are currently either unknown or poorly understood: as such, some of these als were split into two groups ("hyper-reactive" and "hypo-reactive") based on their response to the antigens and time to clot. Short RNA sequencing was used to profile the short RNA populations of the platelets from all 10 individuals and isomiR expression was examined across the hyper-reactive and hypo-reactive group. Differential expression of isomiRs was calculated using the DESeq2 algorithm. An isomiR is considered to be differentially expressed if it had a mean expression of at least 50 sequenced reads, a log 2-change in expression of ≥0.58 or ≤−0.58, and a p-Value ≤0.05. FIG. 3 shows a heatmap that summarizes the results of Table 10 shown below: each row in the heatmap corresponds to a different isomiR as listed in Table 3. FIG. 3 shows that the two groups of individuals with platelet antigen hyper-reactivity or hypo-reactivity have distinct isomiR expression profiles. Since this is a gray-scale image, a two dashed lines was used to separate the drawing in quadrants. The upper left quadrant includes miRNAs/isomiRs that are more abundant in hyper-reactive than in hypo-reactive individuals. The upper right quadrant includes miRNAs/isomiRs that are less abundant in hypo-reactive than in hyper-reactive individuals. The lower left quadrant includes miRNAs/isomiRs that are less abundant in hyper-reactive than in hypo-reactive individuals. The lower right quadrant includes miRNAs/isomiRs that are more abundant in hypo-reactive than in hyper-reactive individuals.

Table 10 below shows the fold-change of the miRNAs and isomiRs in the two groups of individuals with platelet antigen hyper-reactivity or hypo-reactivity that are depicted in the heatmap of FIG. 3. The actual miRNA and corresponding SEQ ID NOs. can be identified in Table 3 according to the "miRNA ID" listed in Table 10.

TABLE 10

Differential expression of isomiR or miRNA in individuals with platelet antigen hyper-reactivity vs. hypo-reactivity

| miRNA ID | Is it a miRNA or an isomiR? | Chromo-some | Strand | IsomiR Start | IsomiR End | log2FoldChange of HYPO-reactive / HYPER-reactive |
|---|---|---|---|---|---|---|
| ID = MIMAT0016844; hsa-miR-4295 | isomiR | 10 | + | 114393939 | 114393960 | 1.693050804 |
| ID = MIMAT0000098; hsa-miR-100-5p | isomiR | 11 | − | 122022982 | 122023004 | 1.823802128 |
| ID = MIMAT0000098; hsa-miR-100-5p | mirBase | 11 | − | 122022983 | 122023004 | 1.814040075 |
| ID = MIMAT0019774; hsa-miR-4687-5p | isomiR | 11 | + | 3877303 | 3877322 | −1.208797144 |
| ID = MIMAT0000267; hsa-miR-210-3p | isomiR | 11 | − | 568113 | 568133 | −1.050732203 |
| ID = MIMAT0014982; hsa-miR-3120-3p | isomiR | 1 | + | 172107998 | 172108019 | 0.975239935 |
| ID = MIMAT0000256; hsa-miR-181a-5p | mirBase | 1 | − | 198828237 | 198828259 | 1.174507982 |
| ID = MIMAT0000681; hsa-miR-29c-3p | isomiR | 1 | − | 207975209 | 207975231 | 0.536818398 |
| ID = MIMAT0017991; hsa-miR-3613-3p | isomiR | 13 | − | 50570564 | 50570585 | 1.608621193 |
| ID = MIMAT0000772; hsa-miR-345-5p | isomiR | 14 | + | 100774213 | 100774232 | −0.840570448 |
| ID = MIMAT0000772; hsa-miR-345-5p | isomiR | 14 | + | 100774213 | 100774233 | −0.614388579 |
| ID = MIMAT0004604; hsa-miR-127-5p | isomiR | 14 | + | 101349338 | 101349358 | −1.307212535 |
| ID = MIMAT0000722; hsa-miR-370-3p | isomiR | 14 | + | 101377523 | 101377543 | −0.973765428 |
| ID = MIMAT0002178; hsa-miR-487a-3p | mirBase | 14 | + | 101518831 | 101518852 | 1.069025151 |
| ID = MIMAT0000447; hsa-miR-134-5p | mirBase | 14 | + | 101521031 | 101521052 | 0.709528735 |
| ID = MIMAT0000447; hsa-miR-134-5p | isomiR | 14 | + | 101521031 | 101521053 | 0.860800629 |
| ID = MIMAT0002176; hsa-miR-485-3p | isomiR | 14 | + | 101521800 | 101521822 | 1.844384975 |
| ID = MIMAT0015050; hsa-miR-323b-3p | isomiR | 14 | + | 101522605 | 101522626 | −1.480187879 |
| ID = MIMAT0000452; hsa-miR-154-5p | mirBase | 14 | + | 101526106 | 101526127 | 0.750616377 |
| ID = MIMAT0000453; hsa-miR-154-3p | mirBase | 14 | + | 101526142 | 101526163 | 1.920772298 |
| ID = MIMAT0000730; hsa-miR-377-3p | isomiR | 14 | + | 101528431 | 101528451 | 2.220079064 |
| ID = MIMAT0000730; hsa-miR-377-3p | mirBase | 14 | + | 101528431 | 101528452 | 1.234206271 |
| ID = MIMAT0001639; hsa-miR-409-3p | isomiR | 14 | + | 101531684 | 101531705 | 1.008026114 |
| ID = MIMAT0015054; hsa-miR-3177-3p | isomiR | 16 | + | 1785039 | 1785060 | −1.070825052 |
| ID = MIMAT0003301; hsa-miR-33b-5p | mirBase | 17 | − | 17717211 | 17717230 | −0.8778958 |
| ID = MIMAT0000433; hsa-miR-142-5p | isomiR | 17 | − | 56408647 | 56408666 | −0.679403276 |
| ID = MIMAT0002820; hsa-miR-497-5p | isomiR | 17 | − | 6921297 | 6921318 | −1.022619012 |
| ID = MIMAT0002820; hsa-miR-497-5p | mirBase | 17 | − | 6921298 | 6921318 | −1.103842786 |
| ID = MIMAT0000763; hsa-miR-338-3p | isomiR | 17 | − | 79099686 | 79099707 | 0.755685679 |
| ID = MIMAT0000763; hsa-miR-338-3p | isomiR | 17 | − | 79099686 | 79099708 | 0.585798504 |
| ID = MIMAT0000763; hsa-miR-R-338-3p | mirBase | 17 | − | 79099687 | 79099708 | 0.637201072 |
| ID = MIMAT0000078; hsa-miR-23a-3p | isomiR | 19 | − | 13947406 | 13947427 | 0.92049045 |
| ID = MIMAT0000078; hsa-miR-23a-3p | isomiR | 19 | − | 13947407 | 13947427 | 1.139296411 |
| ID = MIMAT0000078; hsa-miR-23a-3p | isomiR | 19 | − | 13947407 | 13947429 | 0.605379042 |
| ID = MIMAT0000078; hsa-miR-23a-3p | isomiR | 19 | − | 13947408 | 13947429 | 0.545064371 |
| ID = MIMAT0000258; hsa-miR-181c-5p | isomiR | 19 | + | 13985539 | 13985561 | 0.599867208 |
| ID = MIMAT0000258; hsa-miR-181c-5p | isomiR | 19 | + | 13985539 | 13985562 | 0.643018885 |
| ID = MIMAT0000255; hsa-miR-34a-5p | isomiR | 1 | − | 9211793 | 9211815 | −1.144365962 |
| ID = MIMAT0000255; hsa-miR-34a-5p | mirBase | 1 | − | 9211794 | 9211815 | −0.940567745 |
| ID = MIMAT0003311; hsa-miR-641 | isomiR | 19 | − | 40788511 | 40788534 | 1.173498381 |
| ID = MIMAT0019880; hsa-miR-4746-5p | mirBase | 19 | + | 4445984 | 4446006 | −1.081673049 |
| ID = MIMAT0000689; hsa-miR-99b-5p | isomiR | 19 | + | 52195871 | 52195890 | 1.288028476 |
| ID = MIMAT0000689; hsa-miR-99b-5p | isomiR | 19 | + | 52195871 | 52195891 | 0.942329444 |
| ID = MIMAT0000689; hsa-miR-99b-5p | mirBase | 19 | + | 52195871 | 52195892 | 1.168595698 |
| ID = MIMAT0000689; hsa-miR-99b-5p | isomiR | 19 | + | 52195871 | 52195893 | 1.273940998 |
| ID = MIMAT0004935; hsa-miR-935 | isomiR | 19 | + | 54485618 | 54485638 | −1.290340375 |
| ID = MIMAT0016888; hsa-miR-4326 | isomiR | 20 | + | 61918170 | 61918192 | −2.189171494 |
| ID = MIMAT0000424; hsa-miR-128-3p | isomiR | 2 | + | 136423017 | 136423037 | 1.008351354 |
| ID = MIMAT0022726; hsa-miR-1306-5p | isomiR | 22 | + | 20073595 | 20073615 | −0.687810261 |
| ID = MIMAT0004502; hsa-miR-28-3p | mirBase | 3 | + | 188406622 | 188406643 | 0.805567557 |
| ID = MIMAT0004502; hsa-miR-28-3p | isomiR | 3 | + | 188406622 | 188406644 | 0.98178236 |
| ID = MIMAT0003241; hsa-miR-576-5p | mirBase | 4 | + | 110409869 | 110409890 | 0.702664876 |
| ID = MIMAT0003241; hsa-miR-576-5p | isomiR | 4 | + | 110409869 | 110409892 | 0.918510564 |
| ID = MIMAT0003239; hsa-miR-574-3p | isomiR | 4 | + | 38869714 | 38869734 | −0.905946749 |
| ID = MIMAT0003239; hsa-miR-574-3p | isomiR | 4 | + | 38869714 | 38869735 | −0.716936715 |
| ID = MIMAT0003239; hsa-miR-574-3p | isomiR | 4 | + | 38869714 | 38869736 | −0.907113522 |
| ID = MIMAT0003239; hsa-miR-574-3p | isomiR | 4 | + | 38869715 | 38869734 | −1.143751103 |

TABLE 10-continued

Differential expression of isomiR or miRNA in individuals with platelet antigen hyper-reactivity vs. hypo-reactivity

| miRNA ID | Is it a miRNA or an isomiR? | Chromo-some | Strand | IsomiR Start | IsomiR End | log2FoldChange of HYPO-reactive / HYPER-reactive |
|---|---|---|---|---|---|---|
| ID = MIMAT0003239; hsa-miR-574-3p | isomiR | 4 | + | 38869715 | 38869735 | −0.800015321 |
| ID = MIMAT0003239; hsa-miR-574-3p | isomiR | 4 | + | 38869715 | 38869736 | −0.684840113 |
| ID = MIMAT0004601; hsa-miR-145-3p | mirBase | 5 | + | 148810262 | 148810283 | 0.903088739 |
| ID = MIMAT0000449; hsa-miR-146a-5p | isomiR | 5 | + | 159912380 | 159912401 | 0.787529544 |
| ID = MIMAT0000449; hsa-miR-146a-5p | isomiR | 5 | + | 159912380 | 159912402 | 0.77307406 |
| ID = MIMAT0000449; hsa-miR-146a-5p | isomiR | 5 | + | 159912381 | 159912401 | 0.657010583 |
| ID = MIMAT0004702; hsa-miR-339-3p | isomiR | 7 | − | 1062592 | 1062611 | −0.777037637 |
| ID = MIMAT0000764; hsa-miR-339-5p | isomiR | 7 | − | 1062625 | 1062647 | −0.781301482 |
| ID = MIMAT0000765; hsa-miR-335-5p | isomiR | 7 | + | 130135967 | 130135988 | 0.53296691 |
| ID = MIMAT0000765; hsa-miR-335-5p | mirBase | 7 | + | 130135967 | 130135989 | 0.582659429 |
| ID = MIMAT0000086; hsa-miR-29a-3p | isomiR | 7 | − | 130561506 | 130561528 | 0.563158034 |
| ID = MIMAT0004672; hsa-miR-106b-3p | mirBase | 7 | − | 99691625 | 99691646 | −0.774615259 |
| ID = MIMAT0004672; hsa-miR-106b-3p | isomiR | 7 | − | 99691625 | 99691647 | −1.206525491 |
| ID = MIMAT0000420; hsa-miR-30b-5p | isomiR | 8 | − | 135812811 | 135812834 | 0.656327955 |
| ID = MIMAT0000420; hsa-miR-30b-5p | isomiR | 8 | − | 135812812 | 135812834 | 0.59271139 |
| ID = MIMAT0027604; hsa-miR-6852-5p | isomiR | 9 | − | 35710711 | 35710733 | −0.978676086 |
| ID = MIMAT0027604; hsa-miR-6852-5p | isomiR | 9 | − | 35710712 | 35710733 | −0.623346064 |
| ID = MIMAT0027604; hsa-miR-6852-5p | mirBase | 9 | − | 35710713 | 35710733 | −0.608678796 |
| ID = MIMAT0000099_1; hsa-miR-101-3p | isomiR | 9 | + | 4850347 | 4850368 | 1.057868333 |
| ID = MIMAT0000418; hsa-miR-23b-3p | isomiR | 9 | + | 97847547 | 97847568 | 0.759475648 |
| ID = MIMAT0000418; hsa-miR-23b-3p | isomiR | 9 | + | 97847547 | 97847569 | 0.596830114 |
| ID = MIMAT0000418; hsa-miR-23b-3p | isomiR | 9 | + | 97847547 | 97847570 | 0.670886728 |
| ID = MIMAT0000418; hsa-miR-23b-3p | isomiR | 9 | + | 97847549 | 97847568 | 1.160734587 |
| ID = MIMAT0000418; hsa-miR-23b-3p | isomiR | 9 | + | 97847549 | 97847569 | 1.014775501 |
| ID = MIMAT0000418; hsa-miR-2313-3p | isomiR | 9 | + | 97847549 | 97847570 | 1.28609021 |
| ID = MIMAT0022709; hsa-miR-652-5p | isomiR | X | + | 109298576 | 109298595 | 0.967684929 |
| ID = MIMAT0000707; hsa-miR-363-3p | isomiR | X | − | 133303411 | 133303433 | 0.631364682 |
| ID = MIMAT0003389; hsa-miR-542-3p | isomiR | X | − | 133675393 | 133675415 | 1.304170278 |
| ID = MIMAT0000096; hsa-miR-98-5p | isomiR | X | − | 53583259 | 53583281 | 0.693686608 |
| ID = MIMAT0019919; hsa-miR-4767 | isomiR | X | + | 7065909 | 7065931 | −1.260816811 |
| ID = MIMAT0000727; hsa-miR-374a-5p | isomiR | X | − | 73507158 | 73507181 | 1.387909088 |
| ID = MIMAT0000727; hsa-miR-374a-5p | isomiR | X | − | 73507159 | 73507180 | 0.80294068 |
| ID = MIMAT0000727; hsa-miR-374a-5p | isomiR | X | − | 73507159 | 73507181 | 0.58382585 |

Example 5. Differential Expression of isomiRs Across Populations by Ethnicity

This Example is drawn from the analysis of the deep sequencing data of 482 lymphoblastoid cell line (LCL) samples from the Geuvadis RNA deep-sequencing project, where its information is accessible online at http://www.geuvadis.org/web/geuvadis/RNAseq-project. In particular, the inventors focused and analyzed the 452 unique samples among the collection of 482 datasets (the remaining samples are technical replicates). The 452 samples represent five human populations: Utah Residents with Northern and Western European ancestry (CEU, 87 subjects), Finnish from Finland (FIN, 93 subjects), British in England and Scotland (GBR, 94 subjects), Toscani Italians (TSI, 89 subjects), and Yoruban Africans from the city of Ibadan (YRI, 89 subjects).

Figure 4:
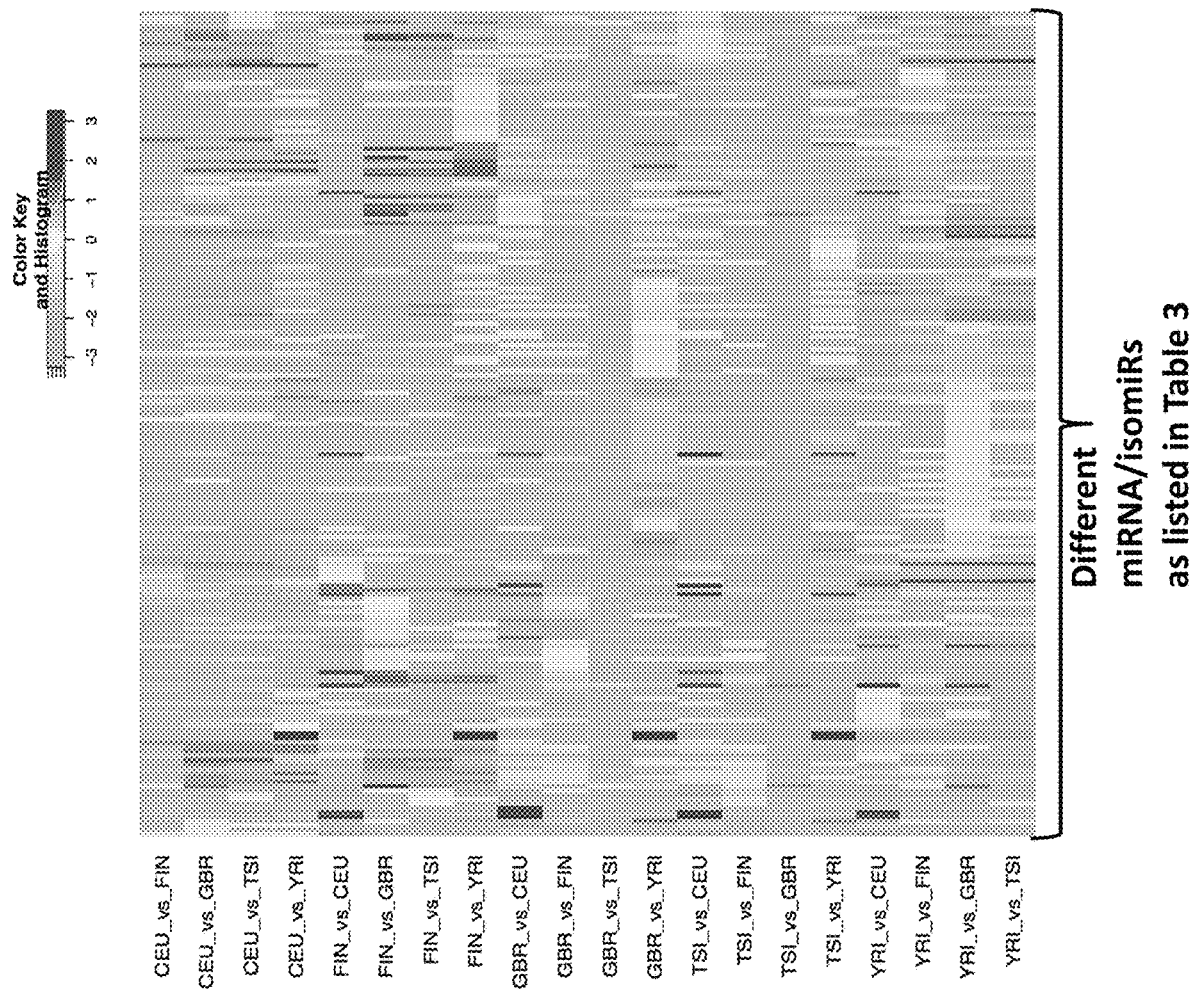
FIG. 4 is a heatmap showing differential expression of novel isomiRs across human populations by ethnicities.

Using samples from both genders, the inventors identified differentially expressed isomiRs separately for each pair of populations. FIG. 4 shows the resulting heatmap for the identified isomiRs listed in Table 3. Cells shown as white correspond to cases that did not reach statistical significance for the corresponding combination of miRNA/isomiR and population-pair. The color intensity scale is logarithmic (log 2 base). For all statistically significant combinations the associated FDR value is ≤0.05. This example shows that miRNAs and isomiRs can be used in principle to distinguish among human populations. Thus, combinations of isomiRs and miRNAs can be used to form distinguishing "signatures" with application to diagnostic and/or prognostic activities. Their participation in such distinguishing signatures directly implicates these sequences in molecular mechanisms that are currently either unknown or poorly understood: as such, some of these sequences can be eventually used to design appropriate therapeutics that are relevant for the corresponding tissue and tissue-state.

Example 6. Differential Expression of isomiRs Across Populations by Gender

Like in Example 5, this Example is drawn from the analysis of the deep sequencing data of 482 LCL samples from the Geuvadis RNA deep-sequencing project, where its information is accessible online at http://www.geuvadis.org/web/geuvadis/RNAseq-project. In particular, the inventors focused and analyzed the 452 unique samples among the collection of 482 datasets (the remaining samples are technical replicates). The 452 samples represent five human populations: Utah Residents with Northern and Western European ancestry (CEU, 87 subjects), Finnish from Finland (FIN, 93 subjects), British in England and Scotland (GBR, 94 subjects), Toscani Italians (TSI, 89 subjects), and Yoruban Africans from the city of Ibadan (YRI, 89 subjects).

Figure 5A:
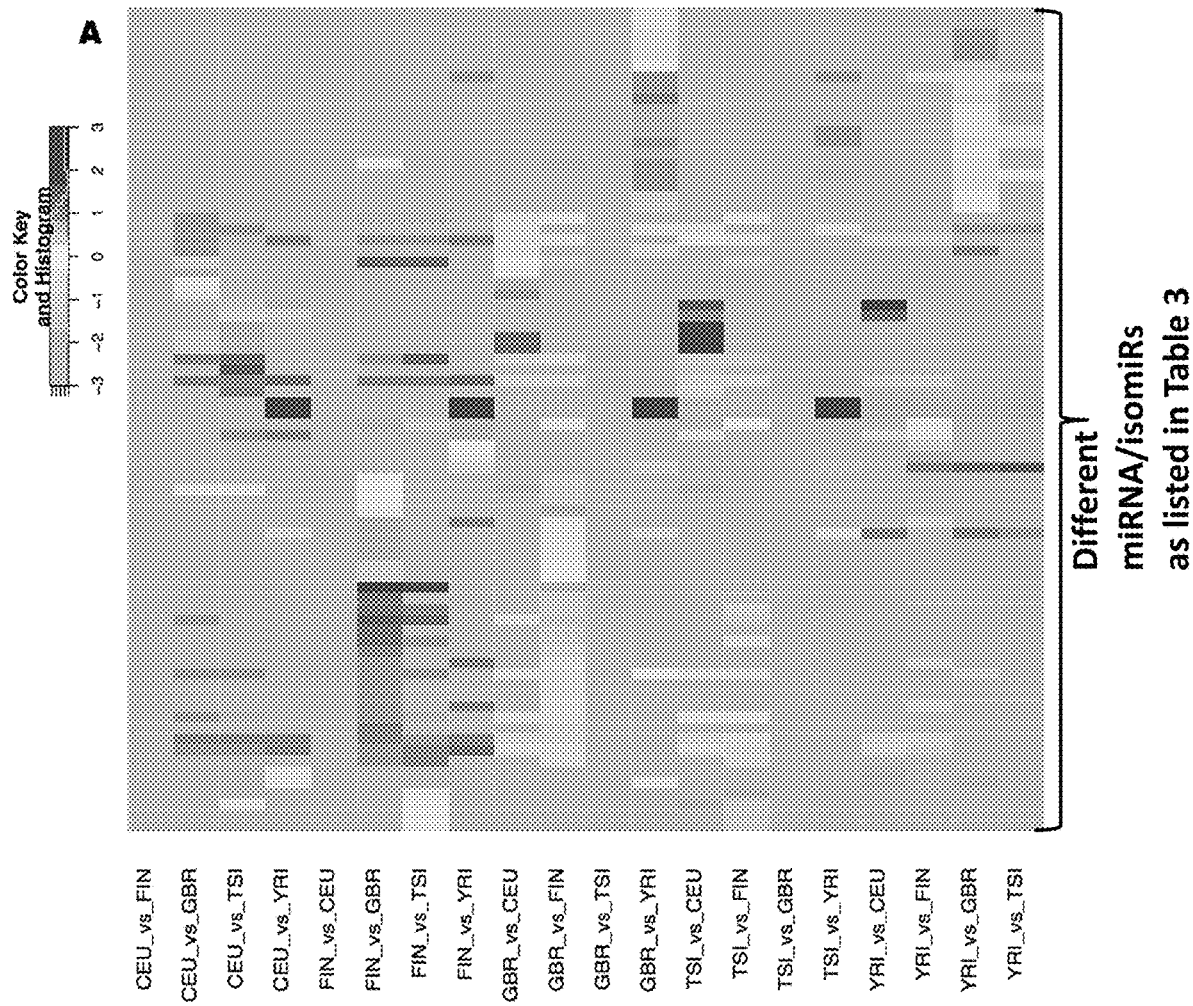
FIGS. 5A-5B is a heatmap showing differential expression of novel isomiRs across human populations by ethnicities and gender.
Figure 5B:
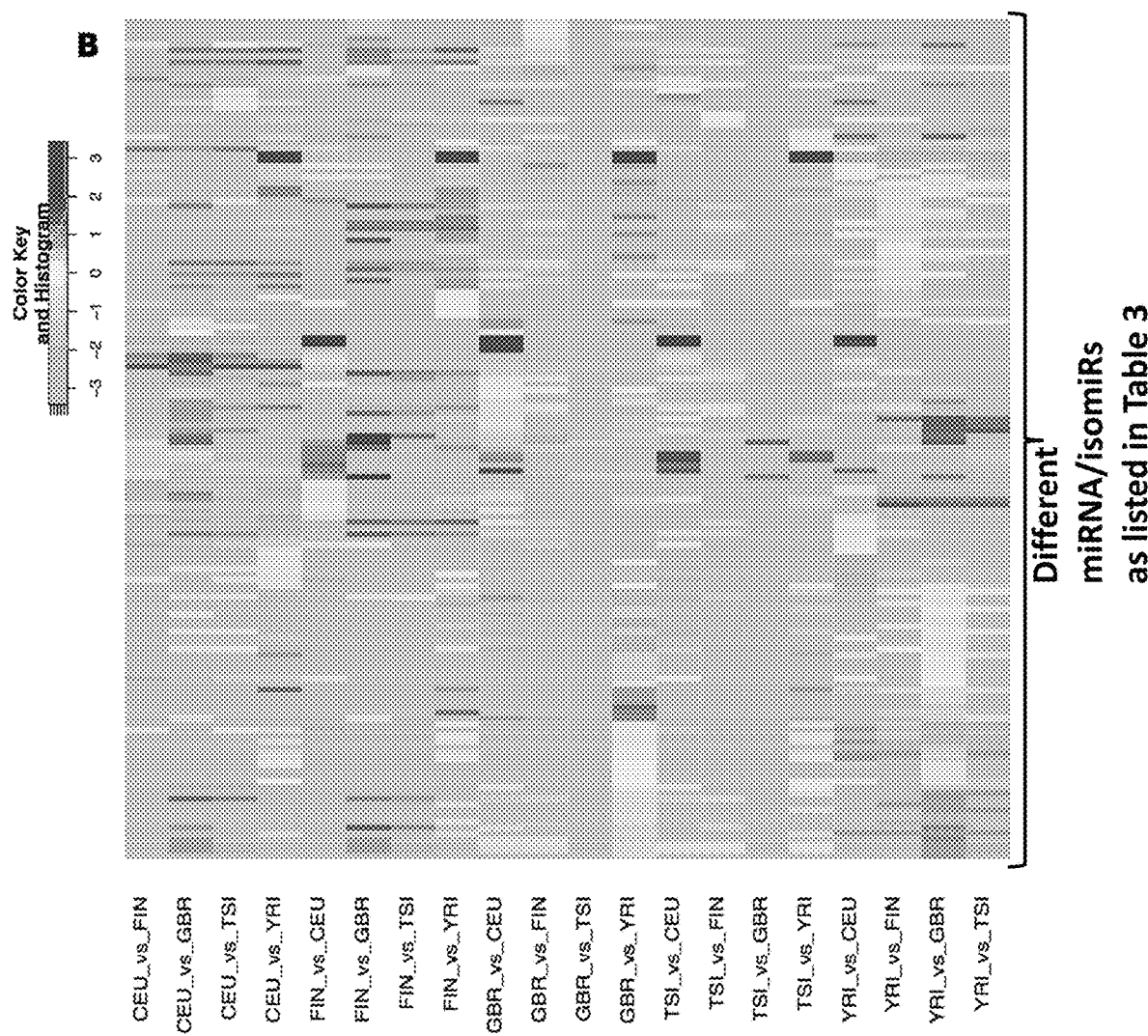

Using samples of the same gender, the inventors identified differentially expressed isomiRs separately for each pair of populations. FIGS. 5A-5B show the resulting heatmap for the isomiRs (identified in Table 3) in male samples and female samples, respectively. Cells shown as white correspond to cases that did not reach statistical significance for the corresponding combination of miRNA/isomiR and population-pair. The color intensity scale is logarithmic (log 2 base). For all statistically significant combinations the associated FDR value is ≤0.05. This example shows that miRNAs and isomiRs have different expression profiles among populations when only males are considered vs. when only females are considered. This shows the presence of different miRNAs/isomiRs and/or different expression patterns between females and males and thus the potential presence of differences in the underlying molecular mechanisms for the corresponding tissue and tissue-state.

Example 7. Differential Expression of Novel miRNAs by Disease States

There are three collections of novel miRNA sequences: (1) novel miRNAs that were discovered using the inventors' developed method as described in Example 1 (as listed in Table 11 below, they are prefixed by "TJU_CMC" only, e.g. TJU_CMC.ID02768.5p-miR); (2) novel miRNAs that were discovered using the miRDeep2 method and listed in Table 11 below, they are prefixed by "TJU_CMC.MD2" i.e. TJU_CMC_MD2.ID01023.3p-miR); and (3) isomiRs from miRNA loci that are in Rel. 20 of the miRBase repository and listed in Table 12 below, they are prefixed by "NovelMiR_KnownLoci" e.g. NovelMiR_KnownLoci_ID0001566).

The inventors processed numerous samples from different tissues and tissue states and sought to determine instances of miRNAs from each of these categories that were differentially expressed between pairs of states of the same tissue. A novel miRNA/isomiR is considered to be differentially expressed if it has a mean expression of at least 50 sequenced reads, a log 2-change in expression between the compared states of ≥0.58 or ≤−0.58, and a p-Value ≤0.05.

Using samples from different disease states, the inventors identified differentially expressed novel miRNAs that were either discovered using their own developed method (prefixed by "TJU_CMC" only, e.g. TJU_CMC.ID02768.5p-miR) or discovered using the miRDeep2 method (prefixed by "TJU_CMC.MD2" i.e. TJU_CMC_MD2.ID01023.3p-miR). As stated above, a miRNA is considered to be differentially expressed if it had a mean expression of at least 50 sequenced reads, a log 2-change in expression between the compared states of ≥0.58 or ≤−0.58, and a p-Value ≤0.05.

Examples 7-8 show that these novel sequences (either novel miRNAs or novel isomiRs from previously reported loci) can be used to form distinguishing "signatures" with application to diagnostic and/or prognostic activities. Again, their very participation in such distinguishing signatures directly implicates these sequences in molecular mechanisms that currently are either unknown or poorly understood: as such, some of these sequences could be eventually used to design appropriate therapeutics that are relevant for the corresponding tissue and tissue-state.

Table 11 below shows the fold-change of the miRNAs in pairs of the same tissue of different states. Abbreviations: TCGA=The Cancer Genome Atlas; PBMC=Peripheral Blood Mononuclear Cells; GEO=Gene Expression Omnibus. The actual miRNA or isomiR sequences and corresponding SEQ ID NOs. can be identified in Tables 1-2 according to the "Name" listed in Table 11.

TABLE 11

Differential expression of miRNAs in tissues of various disease states

| Name | Log2 fold change of Set A/Set B | p-Val | Sets Compared (A/B) |
| --- | --- | --- | --- |
| TJU_CMC.ID06653.3p-miR | −5.350055999 | 1.82E−11 | Chronic Lymphocytic Leukemia/Normal B cells |
| TJU_CMC.ID09612.5p-miR | −6.143612864 | 1.62E−09 | Chronic Lymphocytic Leukemia/Normal B cells |
| TJU_CMC.ID02842.5p-miR | 10.61146501 | 1.24E−08 | Chronic Lymphocytic Leukemia/Normal B cells |
| TJU_CMC_MD2.ID02528.3p-miR | −999999 | 1.79E−08 | Chronic Lymphocytic Leukemia/Normal B cells |
| TJU_CMC.ID09305.5p-miR | −6.666005566 | 6.04E−08 | Chronic Lymphocytic Leukemia/Normal B cells |
| TJU_CMC.ID02503.5p-miR | 10.87508867 | 9.50E−08 | Chronic Lymphocytic Leukemia/Normal B cells |
| TJU_CMC_MD2.ID02528.5p-miR | −999999 | 1.07E−07 | Chronic Lymphocytic Leukemia/Normal B cells |
| TJU_CMC.ID03278.3p-miR | 5.641662569 | 1.40E−07 | Chronic Lymphocytic Leukemia/Normal B cells |
| TJU_CMC.ID04657.3p-miR | −9.866230829 | 1.86E−07 | Chronic Lymphocytic Leukemia/Normal B cells |
| TJU_CMC.ID06600.5p-miR | −8.103688639 | 1.93E−07 | Chronic Lymphocytic Leukemia/Normal B cells |
| TJU_CMC_MD2.ID01860.5p-miR | −999999 | 1.94E−07 | Chronic Lymphocytic Leukemia/Normal B cells |
| TJU_CMC.ID02768.5p-miR | 8.369781246 | 2.13E−07 | Chronic Lymphocytic Leukemia/Normal B cells |
| TJU_CMC_MD2.ID01023.3p-miR | 999999 | 3.16E−07 | Chronic Lymphocytic Leukemia/Normal B cells |
| TJU_CMC.ID03256.3p-miR | −3.917708041 | 2.39E−08 | Hypo-reactive/Hyper-reactive (Platelets) |
| TJU_CMC.ID09799.3p-miR | −4.887841727 | 2.14E−07 | HER2− Breast Cancer/HER2+ Breast Cancer (TCGA) |
| TJU_CMC_MD2.ID00953.5p-miR | −999999 | 8.82E−07 | Chronic Lymphocytic Leukemia/Normal B cells |
| TJU_CMC_MD2.ID01023.5p-miR | 999999 | 8.97E−07 | Chronic Lymphocytic Leukemia/Normal B cells |
| TJU_CMC_MD2.ID00558.3p-miR | −999999 | 1.01E−06 | Chronic Lymphocytic Leukemia/Normal B cells |
| TJU_CMC_MD2.ID02912.5p-miR | 999999 | 1.24E−06 | Chronic Lymphocytic Leukemia/Normal B cells |
| TJU_CMC.ID04299.5p-miR | −5.000995116 | 1.22E−06 | Chronic Lymphocytic Leukemia/Normal B cells |
| TJU_CMC_MD2.ID00258.5p-miR | 8.714626517 | 1.36E−06 | Chronic Lymphocytic Leukemia/Normal B cells |
| TJU_CMC_MD2.ID02465.3p-miR | −8.206164944 | 1.99E−06 | Chronic Lymphocytic Leukemia/Normal B cells |
| TJU_CMC.ID08100.5p-miR | 10.78227313 | 5.45E−07 | Breast Cancer (adenoid/apocrine/atypical/DCIS/IDC/metaplastic)/Normal Breast Tissue (GEO: GSE28884) |
| TJU_CMC_MD2.ID00964.5p-miR | −999999 | 3.18E−06 | Chronic Lymphocytic Leukemia/Normal B cells |
| TJU_CMC.ID05256.5p-miR | −9.115766175 | 3.58E−06 | Chronic Lymphocytic Leukemia/Normal B cells |
| TJU_CMC.ID03524.5p-miR | 7.056227807 | 4.18E−06 | Chronic Lymphocytic Leukemia/Normal B cells |
| TJU_CMC.ID03856.5p-miR | −8.692614532 | 4.12E−06 | Chronic Lymphocytic Leukemia/Normal B cells |
| TJU_CMC.ID03519.3p-miR | 8.82432173 | 4.31E−06 | Chronic Lymphocytic Leukemia/Normal B cells |
| TJU_CMC.ID00299.5p-miR | 4.167117002 | 7.05E−07 | Stage 1 Gastric Cancer/Normal Gastric Tissue |
| TJU_CMC.ID09200.5p-miR | 4.147086478 | 8.81E−07 | Stage 1 Gastric Cancer/Normal Gastric Tissue |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID03504.3p-miR | 6.413198125 | 6.21E−06 | Chronic Lymphocytic Leukemia/Normal B cells |
| TJU_CMC.ID00744.3p-miR | 7.100628383 | 6.80E−06 | Chronic Lymphocytic Leukemia/Normal B cells |
| TJU_CMC.ID00225.3p-miR | 4.242952027 | 1.68E−06 | Stage 1 Gastric Cancer/Normal Gastric Tissue |
| TJU_CMC.ID08731.3p-miR | −5.94141269 | 2.10E−06 | Stage 1 Gastric Cancer/Normal Gastric Tissue |
| TJU_CMC.ID01316.3p-miR | −6.870251682 | 1.52E−05 | Chronic Lymphocytic Leukemia/Normal B cells |
| TJU_CMC.ID03300.5p-miR | 6.702083272 | 1.49E−05 | Chronic Lymphocytic Leukemia/Normal B cells |
| TJU_CMC.ID01494.3p-miR | 5.289938285 | 1.83E−05 | Chronic Lymphocytic Leukemia/Normal B cells |
| TJU_CMC.ID07022.5p-miR | 7.623615595 | 1.58E−05 | Breast Cancer (adenoid/apocrine/atypical/DCIS/IDC/metaplastic)/Normal Breast Tissue (GEO: GSE28884) |
| TJU_CMC.ID03454.5p-miR | 6.77674742 | 2.31E−05 | Chronic Lymphocytic Leukemia/Normal B cells |
| TJU_CMC.ID05541.3p-miR | 5.718371954 | 2.29E−05 | Chronic Lymphocytic Leukemia/Normal B cells |
| TJU_CMC.ID06289.5p-miR | −6.055179931 | 2.34E−05 | Chronic Lymphocytic Leukemia/Normal B cells |
| TJU_CMC.ID08042.5p-miR | −4.371634744 | 2.74E−05 | Chronic Lymphocytic Leukemia/Normal B cells |
| TJU_CMC.ID02508.5p-miR | 5.957071622 | 2.89E−05 | Chronic Lymphocytic Leukemia/Normal B cells |
| TJU_CMC.ID05571.3p-miR | 4.87676621 | 2.94E−05 | Chronic Lymphocytic Leukemia/Normal B cells |
| TJU_CMC.ID02844.3p-miR | 6.131098482 | 3.07E−05 | Chronic Lymphocytic Leukemia/Normal B cells |
| TJU_CMC.ID07466.3p-miR | 5.998317527 | 3.03E−05 | Chronic Lymphocytic Leukemia/Normal B cells |
| TJU_CMC.ID01558.5p-miR | −6.679700391 | 3.49E−05 | Chronic Lymphocytic Leukemia/Normal B cells |
| TJU_CMC.ID01152.5p-miR | 7.246723864 | 3.58E−05 | Chronic Lymphocytic Leukemia/Normal B cells |
| TJU_CMC.ID00581.3p-miR | 5.112712713 | 5.53E−05 | Breast Cancer (adenoid/apocrine/atypical/DCIS/IDC/metaplastic)/Normal Breast Tissue (GEO: GSE28884) |
| TJU_CMC.ID09045.5p-miR | 5.996981054 | 5.01E−05 | Breast Cancer (adenoid/apocrine/atypical/DCIS/IDC/metaplastic)/Normal Breast Tissue (GEO: GSE28884) |
| TJU_CMC.ID08817.5p-miR | −7.040237443 | 4.01E−05 | Chronic Lymphocytic Leukemia/Normal B cells |
| TJU_CMC.ID01743.5p-miR | 5.687787729 | 4.52E−05 | Chronic Lymphocytic Leukemia/Normal B cells |
| TJU_CMC.ID06261.5p-miR | 3.978728907 | 4.80E−05 | Chronic Lymphocytic Leukemia/Normal B cells |
| TJU_CMC.ID06075.5p-miR | 5.198810713 | 5.11E−05 | Chronic Lymphocytic Leukemia/Normal B cells |
| TJU_CMC.ID03003.3p-miR | −5.282487816 | 9.27E−06 | Stage 1 Gastric Cancer/Normal Gastric Tissue |
| TJU_CMC.ID08644.5p-miR | 3.698764073 | 1.02E−05 | Stage 1 Gastric Cancer/Normal Gastric Tissue |
| TJU_CMC.ID09315.5p-miR | 4.202589537 | 9.98E−06 | Stage 1 Gastric Cancer/Normal Gastric Tissue |
| TJU_CMC.ID04909.5p-miR | −5.426714465 | 5.61E−05 | Chronic Lymphocytic Leukemia/Normal B cells |
| TJU_CMC_MD2.ID02721.5p-miR | −6.028345639 | 5.92E−05 | Chronic Lymphocytic Leukemia/Normal B cells |
| TJU_CMC.ID02172.3p-miR | 4.17893251 | 6.33E−05 | Chronic Lymphocytic Leukemia/Normal B cells |
| TJU_CMC.ID03495.5p-miR | −4.565082803 | 6.28E−05 | Chronic Lymphocytic Leukemia/Normal B cells |
| TJU_CMC.ID06967.3p-miR | −6.51771449 | 7.17E−05 | Chronic Lymphocytic Leukemia/Normal B cells |
| TJU_CMC.ID04559.5p-miR | 5.435199575 | 7.57E−05 | Chronic Lymphocytic Leukemia/Normal B cells |
| TJU_CMC.ID01232.3p-miR | 6.558455622 | 0.000110459 | Breast Cancer (adenoid/apocrine/atypical/DCIS/IDC/metaplastic)/Normal Breast Tissue (GEO: GSE28884) |
| TJU_CMC.ID09362.5p-miR | 8.068986534 | 0.000122719 | Breast Cancer (adenoid/apocrine/atypical/DCIS/IDC/metaplastic)/Normal Breast Tissue (GEO: GSE28884) |
| TJU_CMC.ID05136.3p-miR | −6.462794459 | 7.96E−05 | Chronic Lymphocytic Leukemia/Normal B cells |
| TJU_CMC.ID09211.5p-miR | −6.096317714 | 8.22E−05 | Chronic Lymphocytic Leukemia/Normal B cells |
| TJU_CMC_MD2.ID01436.3p-miR | −6.844516944 | 9.18E−05 | Chronic Lymphocytic Leukemia/Normal B cells |
| TJU_CMC.ID05232.3p-miR | 5.269136783 | 9.66E−05 | Chronic Lymphocytic Leukemia/Normal B cells |
| TJU_CMC.ID08857.5p-miR | −5.185841009 | 0.000101318 | Chronic Lymphocytic Leukemia/Normal B cells |
| TJU_CMC.ID04776.3p-miR | −5.968840199 | 0.000108755 | Chronic Lymphocytic Leukemia/Normal B cells |
| TJU_CMC.ID03322.5p-miR | 3.62089628 | 1.74E−05 | Stage 1 Gastric Cancer/Normal Gastric Tissue |
| TJU_CMC.ID05498.3p-miR | −5.923985039 | 0.00012389 | Chronic Lymphocytic Leukemia/Normal B cells |
| TJU_CMC.ID09556.5p-miR | 4.358490643 | 0.000128181 | Chronic Lymphocytic Leukemia/Normal B cells |
| TJU_CMC.ID05794.5p-miR | −7.275302525 | 0.000129705 | Chronic Lymphocytic Leukemia/Normal B cells |
| TJU_CMC.ID01160.3p-miR | 9.981234895 | 0.000134237 | Chronic Lymphocytic Leukemia/Normal B cells |
| TJU_CMC.ID09464.5p-miR | 6.954848435 | 0.000193258 | Breast Cancer (adenoid/apocrine/atypical/DCIS/IDC/metaplastic)/Normal Breast Tissue (GEO: GSE28884) |
| TJU_CMC.ID06420.5p-miR | 999999 | 0.000146696 | Chronic Lymphocytic Leukemia/Normal B cells |
| TJU_CMC.ID00602.3p-miR | −5.398215307 | 1.51E−04 | Chronic Lymphocytic Leukemia/Normal B cells |
| TJU_CMC.ID05591.5p-miR | −5.202141235 | 0.000150691 | Chronic Lymphocytic Leukemia/Normal B cells |
| TJU_CMC.ID03158.5p-miR | −5.18709673 | 0.000154642 | Chronic Lymphocytic Leukemia/Normal B cells |
| TJU_CMC_MD2.ID00326.5p-miR | 7.22768428 | 0.000249828 | Breast Cancer (adenoid/apocrine/atypical/DCIS/IDC/metaplastic)/Normal Breast Tissue (GEO: GSE28884) |
| TJU_CMC.ID03778.3p-miR | −3.575821691 | 2.81E−05 | Stage 1 Gastric Cancer/Normal Gastric Tissue |
| TJU_CMC.ID08027.5p-miR | −4.38644661 | 0.0001772 | Chronic Lymphocytic Leukemia/Normal B cells |
| TJU_CMC.ID08731.3p-miR | −5.399172552 | 5.44E−06 | Gastric Cancer (All Stages)/Normal Gastric Tissue |
| TJU_CMC.ID01135.3p-miR | 2.930131702 | 3.31E−05 | Stage 1 Gastric Cancer/Normal Gastric Tissue |
| TJU_CMC.ID08946.3p-miR | 5.279650918 | 0.000208462 | Chronic Lymphocytic Leukemia/Normal B cells |
| TJU_CMC.ID09118.5p-miR | 6.714196096 | 0.000218512 | Chronic Lymphocytic Leukemia/Normal B cells |
| TJU_CMC_MD2.ID03494.5p-miR | 4.14958141 | 0.000220218 | Chronic Lymphocytic Leukemia/Normal B cells |
| TJU_CMC.ID06656.5p-miR | 3.336125897 | 5.06E−05 | Stage 1 Gastric Cancer/Normal Gastric Tissue |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID05992.3p-miR | 5.78174404 | 5.26E−05 | Stage 1 Gastric Cancer/Normal Gastric Tissue |
| TJU_CMC.ID07790.5p-miR | −3.836018874 | 5.10E−05 | Stage 1 Gastric Cancer/Normal Gastric Tissue |
| TJU_CMC.ID08272.3p-miR | 4.113667399 | 4.77E−05 | Stage 1 Gastric Cancer/Normal Gastric Tissue |
| TJU_CMC.ID06876.5p-miR | 4.690963487 | 0.000271606 | Chronic Lymphocytic Leukemia/Normal B cells |
| TJU_CMC.ID08177.5p-miR | 5.155337948 | 0.000289999 | Chronic Lymphocytic Leukemia/Normal B cells |
| TJU_CMC.ID08261.5p-miR | 4.640781533 | 0.000296545 | Chronic Lymphocytic Leukemia/Normal B cells |
| TJU_CMC.ID04632.3p-miR | 7.838923587 | 0.00029972 | Chronic Lymphocytic Leukemia/Normal B cells |
| TJU_CMC.ID01563.5p-miR | 4.858443966 | 0.000303636 | Chronic Lymphocytic Leukemia/Normal B cells |
| TJU_CMC.ID04558.3p-miR | −5.709826486 | 0.00030917 | Chronic Lymphocytic Leukemia/Normal B cells |
| TJU_CMC.ID04581.5p-miR | −6.24534738 | 0.000309428 | Chronic Lymphocytic Leukemia/Normal B cells |
| TJU_CMC.ID01077.5p-miR | −5.111571124 | 0.000317661 | Chronic Lymphocytic Leukemia/Normal B cells |
| TJU_CMC.ID06657.3p-miR | 4.787416739 | 0.000325 | Chronic Lymphocytic Leukemia/Normal B cells |
| TJU_CMC.ID05096.5p-miR | 6.230029943 | 0.000341974 | Chronic Lymphocytic Leukemia/Normal B cells |
| TJU_CMC.ID06065.3p-miR | −5.558341447 | 0.000343083 | Chronic Lymphocytic Leukemia/Normal B cells |
| TJU_CMC.ID09115.5p-miR | 4.779747152 | 7.19E−05 | Stage 1 Gastric Cancer/Normal Gastric Tissue |
| TJU_CMC.ID05175.5p-miR | −1.378776682 | 0.000201196 | PR− Breast Cancer/PR+ Breast Cancer (TCGA) |
| TJU_CMC.ID02914.3p-miR | 4.169060369 | 8.69E−05 | Stage 1 Gastric Cancer/Normal Gastric Tissue |
| TJU_CMC.ID02650.5p-miR | 4.66315875 | 0.000449771 | Chronic Lymphocytic Leukemia/Normal B cells |
| TJU_CMC.ID09493.5p-miR | −5.34762686 | 0.000456447 | Chronic Lymphocytic Leukemia/Normal B cells |
| TJU_CMC.ID05918.3p-miR | 5.145167112 | 0.000511849 | Chronic Lymphocytic Leukemia/Normal B cells |
| TJU_CMC.ID07047.3p-miR | −5.580371457 | 0.000524814 | Chronic Lymphocytic Leukemia/Normal B cells |
| TJU_CMC.ID01631.5p-miR | 4.195376808 | 0.000545762 | Chronic Lymphocytic Leukemia/Normal B cells |
| TJU_CMC.ID02628.3p-miR | 5.277749364 | 0.000543955 | Chronic Lymphocytic Leukemia/Normal B cells |
| TJU_CMC.ID07634.3p-miR | 5.49736396 | 0.000602502 | Chronic Lymphocytic Leukemia/Normal B cells |
| TJU_CMC.ID02766.3p-miR | −3.543069652 | 0.00062563 | Chronic Lymphocytic Leukemia/Normal B cells |
| TJU_CMC.ID00395.3p-miR | 5.213282626 | 0.000646725 | Chronic Lymphocytic Leukemia/Normal B cells |
| TJU_CMC.ID03304.3p-miR | −5.166631344 | 0.000651137 | Chronic Lymphocytic Leukemia/Normal B cells |
| TJU_CMC.ID01362.5p-miR | 4.410814146 | 0.000668225 | Chronic Lymphocytic Leukemia/Normal B cells |
| TJU_CMC.ID05001.3p-miR | 4.203854064 | 0.00068091 | Chronic Lymphocytic Leukemia/Normal B cells |
| TJU_CMC.ID01606.3p-miR | 6.338522361 | 0.000124339 | Stage 1 Gastric Cancer/Normal Gastric Tissue |
| TJU_CMC.ID04661.5p-miR | 3.449210388 | 0.000146579 | Stage 1 Gastric Cancer/Normal Gastric Tissue |
| TJU_CMC.ID09327.3p-miR | −5.04132634 | 0.000774951 | Chronic Lymphocytic Leukemia/Normal B cells |
| TJU_CMC.ID05693.5p-miR | −3.875915893 | 0.000798401 | Chronic Lymphocytic Leukemia/Normal B cells |
| TJU_CMC.ID06834.3p-miR | −2.587635697 | 0.000835388 | Chronic Lymphocytic Leukemia/Normal B cells |
| TJU_CMC.ID00711.5p-miR | 6.255640602 | 0.0008649 | Chronic Lymphocytic Leukemia/Normal B cells |
| TJU_CMC.ID04683.5p-miR | 2.781068193 | 0.000178069 | Stage 1 Gastric Cancer/Normal Gastric Tissue |
| TJU_CMC.ID08301.3p-miR | 4.376235733 | 0.000886208 | Chronic Lymphocytic Leukemia/Normal B cells |
| TJU_CMC.ID05046.5p-miR | −4.905172311 | 0.000896889 | Chronic Lymphocytic Leukemia/Normal B cells |
| TJU_CMC.ID06865.5p-miR | −3.999286886 | 0.000926659 | Chronic Lymphocytic Leukemia/Normal B cells |
| TJU_CMC.ID08236.3p-miR | 4.960820226 | 0.000937113 | Chronic Lymphocytic Leukemia/Normal B cells |
| TJU_CMC.ID03885.3p-miR | 4.25503448 | 0.000950814 | Chronic Lymphocytic Leukemia/Normal B cells |
| TJU_CMC.ID04994.5p-miR | −4.640194729 | 0.000954192 | Chronic Lymphocytic Leukemia/Normal B cells |
| TJU_CMC.ID00522.5p-miR | −4.153838602 | 0.000967384 | Chronic Lymphocytic Leukemia/Normal B cells |
| TJU_CMC.ID01739.3p-miR | 4.398158234 | 0.000987773 | Chronic Lymphocytic Leukemia/Normal B cells |
| TJU_CMC.ID08957.5p-miR | −4.550746438 | 0.00105123 | Chronic Lymphocytic Leukemia/Normal B cells |
| TJU_CMC.ID02282.3p-miR | −4.167884941 | 0.001077348 | Chronic Lymphocytic Leukemia/Normal B cells |
| TJU_CMC.ID06539.3p-miR | 3.25231861 | 0.000215381 | Stage 1 Gastric Cancer/Normal Gastric Tissue |
| TJU_CMC.ID01852.5p-miR | 4.280188721 | 0.001138706 | Chronic Lymphocytic Leukemia/Normal B cells |
| TJU_CMC.ID03898.3p-miR | 6.209813253 | 0.001142411 | Chronic Lymphocytic Leukemia/Normal B cells |
| TJU_CMC.ID08652.5p-miR | −3.632869643 | 0.001147199 | Chronic Lymphocytic Leukemia/Normal B cells |
| TJU_CMC.ID08763.5p-miR | 3.130267045 | 0.000234446 | Stage 1 Gastric Cancer/Normal Gastric Tissue |
| TJU_CMC.ID08292.3p-miR | −4.550226948 | 0.001253063 | Chronic Lymphocytic Leukemia/Normal B cells |
| TJU_CMC.ID08520.5p-miR | 6.374585156 | 0.001261675 | Chronic Lymphocytic Leukemia/Normal B cells |
| TJU_CMC.ID00107.3p-miR | −3.863162301 | 0.000271664 | Stage 1 Gastric Cancer/Normal Gastric Tissue |
| TJU_CMC.ID04757.3p-miR | 5.379247431 | 5.82E−06 | PBMC Scleroderma Patients/PBMC Control Individuals |
| TJU_CMC.ID06916.5p-miR | −4.342335935 | 0.001362215 | Chronic Lymphocytic Leukemia/Normal B cells |
| TJU_CMC.ID07737.3p-miR | 3.089872089 | 0.000285267 | Stage 1 Gastric Cancer/Normal Gastric Tissue |
| TJU_CMC.ID09230.3p-miR | −3.135381546 | 0.000292281 | Stage 1 Gastric Cancer/Normal Gastric Tissue |
| TJU_CMC.ID06765.5p-miR | 4.568486219 | 0.000301392 | Stage 1 Gastric Cancer/Normal Gastric Tissue |
| TJU_CMC.ID09799.3p-miR | 3.785717025 | 0.000309793 | Stage 1 Gastric Cancer/Normal Gastric Tissue |
| TJU_CMC.ID00020.3p-miR | 4.687645247 | 0.001406275 | Chronic Lymphocytic Leukemia/Normal B cells |
| TJU_CMC.ID01975.3p-miR | 3.961680472 | 0.001446071 | Chronic Lymphocytic Leukemia/Normal B cells |
| TJU_CMC.ID09306.3p-miR | −5.136399176 | 0.001488952 | Chronic Lymphocytic Leukemia/Normal B cells |
| TJU_CMC.ID06325.3p-miR | 3.524257076 | 0.000356331 | Stage 1 Gastric Cancer/Normal Gastric Tissue |
| TJU_CMC.ID06673.3p-miR | −3.813753745 | 0.000352979 | Stage 1 Gastric Cancer/Normal Gastric Tissue |
| TJU_CMC.ID01131.5p-miR | −4.519895228 | 0.001519536 | Chronic Lymphocytic Leukemia/Normal B cells |
| TJU_CMC.ID06092.3p-miR | 3.862574726 | 0.001518102 | Chronic Lymphocytic Leukemia/Normal B cells |
| TJU_CMC.ID03353.3p-miR | −4.160245232 | 0.001573503 | Chronic Lymphocytic Leukemia/Normal B cells |
| TJU_CMC.ID07866.3p-miR | 5.214946608 | 0.001576663 | Chronic Lymphocytic Leukemia/Normal B cells |
| TJU_CMC.ID03982.5p-miR | −4.102714902 | 0.001635801 | Chronic Lymphocytic Leukemia/Normal B cells |
| TJU_CMC.ID00141.3p-miR | 3.825644909 | 0.001653643 | Chronic Lymphocytic Leukemia/Normal B cells |
| TJU_CMC.ID00055.3p-miR | 6.007583643 | 0.001698155 | Chronic Lymphocytic Leukemia/Normal B cells |
| TJU_CMC.ID02091.5p-miR | −4.262258924 | 0.001695972 | Chronic Lymphocytic Leukemia/Normal B cells |
| TJU_CMC.ID00442.3p-miR | 4.627278196 | 0.001815043 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID04345.3p-miR | 3.993726787 | 0.001845504 | Chronic Lymphocytic Leukemia/Normal B cells |
| TJU_CMC.ID04197.5p-miR | 4.026699918 | 0.001925506 | Chronic Lymphocytic Leukemia/Normal B cells |
| TJU_CMC.ID07695.3p-miR | 3.844254186 | 0.001942029 | Chronic Lymphocytic Leukemia/Normal B cells |
| TJU_CMC_MD2.ID01416.3p-miR | −4.356600708 | 0.00195735 | Chronic Lymphocytic Leukemia/Normal B cells |
| TJU_CMC.ID05727.5p-miR | 4.587677454 | 0.002022729 | Chronic Lymphocytic Leukemia/Normal B cells |
| TJU_CMC.ID03098.3p-miR | 5.656770601 | 0.002044575 | Chronic Lymphocytic Leukemia/Normal B cells |
| TJU_CMC.ID02066.3p-miR | 3.561817067 | 0.00213419 | Chronic Lymphocytic Leukemia/Normal B cells |
| TJU_CMC.ID05175.5p-miR | −1.185922549 | 0.001482037 | ER− Breast Cancer/ER+ Breast Cancer (TCGA) |
| TJU_CMC.ID00403.3p-miR | 3.756954798 | 0.002198099 | Chronic Lymphocytic Leukemia/Normal B cells |
| TJU_CMC.ID08111.5p-miR | −3.807724286 | 0.002214865 | Chronic Lymphocytic Leukemia/Normal B cells |
| TJU_CMC.ID00506.3p-miR | 5.164155584 | 0.002253642 | Chronic Lymphocytic Leukemia/Normal B cells |
| TJU_CMC.ID00730.5p-miR | 5.330307488 | 0.002250791 | Chronic Lymphocytic Leukemia/Normal B cells |
| TJU_CMC.ID05115.5p-miR | −4.453529341 | 0.002252647 | Chronic Lymphocytic Leukemia/Normal B cells |
| TJU_CMC.ID06844.3p-miR | 3.978840637 | 0.002267126 | Chronic Lymphocytic Leukemia/Normal B cells |
| TJU_CMC.ID01478.3p-miR | 3.972503878 | 0.002290871 | Chronic Lymphocytic Leukemia/Normal B cells |
| TJU_CMC.ID02970.3p-miR | 2.931980044 | 0.000514428 | Stage 1 Gastric Cancer/Normal Gastric Tissue |
| TJU_CMC.ID07009.3p-miR | 3.839672259 | 0.002356424 | Chronic Lymphocytic Leukemia/Normal B cells |
| TJU_CMC.ID02773.3p-miR | 4.518529043 | 0.002394422 | Chronic Lymphocytic Leukemia/Normal B cells |
| TJU_CMC.ID02905.3p-miR | −3.68657312 | 0.002434754 | Chronic Lymphocytic Leukemia/Normal B cells |
| TJU_CMC.ID08831.3p-miR | 4.054510317 | 0.002463378 | Chronic Lymphocytic Leukemia/Normal B cells |
| TJU_CMC.ID05841.5p-miR | −3.957415667 | 0.002498411 | Chronic Lymphocytic Leukemia/Normal B cells |
| TJU_CMC_MD2.ID02050.5p-miR | −5.234003958 | 0.002482054 | Chronic Lymphocytic Leukemia/Normal B cells |
| TJU_CMC.ID07824.5p-miR | 4.60201983 | 2.45E−05 | PBMC Scleroderma Patients/PBMC Control Individuals |
| TJU_CMC.ID02554.5p-miR | 4.555190677 | 0.00252341 | Chronic Lymphocytic Leukemia/Normal B cells |
| TJU_CMC.ID03893.3p-miR | 3.593847173 | 0.004045668 | Breast Cancer (adenoid/apocrine/atypical/DCIS/IDC/metaplastic)/Normal Breast Tissue (GEO: GSE28884) |
| TJU_CMC_MD2.ID02126.3p-miR | 1.451827053 | 0.001782406 | ER− Breast Cancer/ER+ Breast Cancer (TCGA) |
| TJU_CMC.ID06433.3p-miR | 4.295307413 | 0.00273945 | Chronic Lymphocytic Leukemia/Normal B cells |
| TJU_CMC.ID06390.5p-miR | 3.991012698 | 0.002755294 | Chronic Lymphocytic Leukemia/Normal B cells |
| TJU_CMC.ID03823.5p-miR | 3.879328689 | 0.002812429 | Chronic Lymphocytic Leukemia/Normal B cells |
| TJU_CMC.ID06009.3p-miR | −3.989755274 | 0.002830427 | Chronic Lymphocytic Leukemia/Normal B cells |
| TJU_CMC.ID03653.5p-miR | 4.883752181 | 0.002923736 | Chronic Lymphocytic Leukemia/Normal B cells |
| TJU_CMC.ID07934.5p-miR | −4.078319656 | 0.002929015 | Chronic Lymphocytic Leukemia/Normal B cells |
| TJU_CMC.ID03131.3p-miR | 3.751722034 | 0.00300768 | Chronic Lymphocytic Leukemia/Normal B cells |
| TJU_CMC.ID03972.3p-miR | 3.784569846 | 0.003032851 | Chronic Lymphocytic Leukemia/Normal B cells |
| TJU_CMC.ID02000.5p-miR | 5.392634372 | 0.003143169 | Chronic Lymphocytic Leukemia/Normal B cells |
| TJU_CMC.ID02154.3p-miR | −4.396251781 | 0.003146609 | Chronic Lymphocytic Leukemia/Normal B cells |
| TJU_CMC.ID06554.3p-miR | 4.387798596 | 0.003139251 | Chronic Lymphocytic Leukemia/Normal B cells |
| TJU_CMC.ID07572.3p-miR | −3.915312372 | 0.00320242 | Chronic Lymphocytic Leukemia/Normal B cells |
| TJU_CMC.ID08486.5p-miR | −3.887475153 | 0.003232179 | Chronic Lymphocytic Leukemia/Normal B cells |
| TJU_CMC.ID09605.3p-miR | −4.158036816 | 0.003226871 | Chronic Lymphocytic Leukemia/Normal B cells |
| TJU_CMC.ID03066.3p-miR | −1.599224259 | 0.001625123 | PR− Breast Cancer/PR+ Breast Cancer (TCGA) |
| TJU_CMC_MD2.ID00088.5p-miR | −4.093459824 | 0.003338064 | Chronic Lymphocytic Leukemia/Normal B cells |
| TJU_CMC.ID01339.5p-miR | 3.170500627 | 0.000694131 | Stage 1 Gastric Cancer/Normal Gastric Tissue |
| TJU_CMC.ID02355.3p-miR | −4.222175444 | 0.003602964 | Chronic Lymphocytic Leukemia/Normal B cells |
| TJU_CMC.ID07153.5p-miR | 3.740413618 | 0.003588639 | Chronic Lymphocytic Leukemia/Normal B cells |
| TJU_CMC.ID08371.3p-miR | −3.873087387 | 0.003590353 | Chronic Lymphocytic Leukemia/Normal B cells |
| TJU_CMC.ID06215.3p-miR | 3.702159521 | 0.003651192 | Chronic Lymphocytic Leukemia/Normal B cells |
| TJU_CMC.ID03548.3p-miR | 5.023324428 | 0.003714428 | Chronic Lymphocytic Leukemia/Normal B cells |
| TJU_CMC.ID08211.3p-miR | −4.705342525 | 0.003717942 | Chronic Lymphocytic Leukemia/Normal B cells |
| TJU_CMC.ID04133.5p-miR | −1.657029037 | 0.00248944 | ER− Breast Cancer/ER+ Breast Cancer (TCGA) |
| TJU_CMC.ID02903.5p-miR | −4.144824332 | 0.003739725 | Chronic Lymphocytic Leukemia/Normal B cells |
| TJU_CMC.ID05770.3p-miR | 6.865129325 | 0.003793287 | Chronic Lymphocytic Leukemia/Normal B cells |
| TJU_CMC.ID08135.3p-miR | 4.153903665 | 0.003946667 | Chronic Lymphocytic Leukemia/Normal B cells |
| TJU_CMC.ID00684.3p-miR | 6.195031347 | 0.004034179 | Chronic Lymphocytic Leukemia/Normal B cells |
| TJU_CMC.ID08434.5p-miR | −3.741904172 | 0.004018306 | Chronic Lymphocytic Leukemia/Normal B cells |
| TJU_CMC.ID01093.3p-miR | −3.207971266 | 0.000808878 | Stage 1 Gastric Cancer/Normal Gastric Tissue |
| TJU_CMC.ID01019.3p-miR | −3.947784983 | 0.00414436 | Chronic Lymphocytic Leukemia/Normal B cells |
| TJU_CMC.ID04387.5p-miR | −3.518005909 | 0.004170622 | Chronic Lymphocytic Leukemia/Normal B cells |
| TJU_CMC.ID02329.5p-miR | 3.875903033 | 0.004198355 | Chronic Lymphocytic Leukemia/Normal B cells |
| TJU_CMC.ID00051.5p-miR | 3.736006102 | 0.004367628 | Chronic Lymphocytic Leukemia/Normal B cells |
| TJU_CMC.ID01767.3p-miR | 5.538641135 | 0.004377749 | Chronic Lymphocytic Leukemia/Normal B cells |
| TJU_CMC.ID05633.3p-miR | 5.02784088 | 0.004264183 | Chronic Lymphocytic Leukemia/Normal B cells |
| TJU_CMC.ID05673.5p-miR | −3.764399583 | 0.004329739 | Chronic Lymphocytic Leukemia/Normal B cells |
| TJU_CMC.ID06451.5p-miR | 3.771384312 | 0.00427519 | Chronic Lymphocytic Leukemia/Normal B cells |
| TJU_CMC.ID06926.3p-miR | −4.135406749 | 0.004289928 | Chronic Lymphocytic Leukemia/Normal B cells |
| TJU_CMC_MD2.ID02125.3p-miR | −3.886256183 | 0.004382399 | Chronic Lymphocytic Leukemia/Normal B cells |
| TJU_CMC.ID02796.5p-miR | 4.182424269 | 0.004407616 | Chronic Lymphocytic Leukemia/Normal B cells |
| TJU_CMC.ID02785.3p-miR | 4.324652154 | 0.004614631 | Chronic Lymphocytic Leukemia/Normal B cells |
| TJU_CMC.ID07294.3p-miR | −3.510999533 | 0.004639479 | Chronic Lymphocytic Leukemia/Normal B cells |
| TJU_CMC.ID07864.5p-miR | −3.662633681 | 5.35E−05 | Gastric Cancer (All Stages)/Normal Gastric Tissue |
| TJU_CMC.ID08927.5p-miR | −3.731813089 | 0.000868055 | Stage 1 Gastric Cancer/Normal Gastric Tissue |
| TJU_CMC.ID02027.3p-miR | −5.340729298 | 0.004736291 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
| --- | --- | --- | --- |
| TJU_CMC.ID08389.5p-miR | 3.373648505 | 0.000893978 | Stage 1 Gastric Cancer/Normal Gastric Tissue |
| TJU_CMC.ID09745.3p-miR | −3.76806725 | 0.00476875 | Chronic Lymphocytic Leukemia/Normal B cells |
| TJU_CMC.ID04996.5p-miR | −5.907575247 | 0.004992966 | Chronic Lymphocytic Leukemia/Normal B cells |
| TJU_CMC.ID03448.5p-miR | 3.305828171 | 0.001003754 | Stage 1 Gastric Cancer/Normal Gastric Tissue |
| TJU_CMC.ID06731.3p-miR | −2.627421791 | 0.001010748 | Stage 1 Gastric Cancer/Normal Gastric Tissue |
| TJU_CMC.ID09120.3p-miR | −2.799361236 | 0.001005158 | Stage 1 Gastric Cancer/Normal Gastric Tissue |
| TJU_CMC.ID09799.3p-miR | 4.988057257 | 0.000156714 | HER2-type Breast Cancer/Basal-like Breast Cancer (TCGA) |
| TJU_CMC.ID03066.3p-miR | −1.525246872 | 0.003710768 | ER− Breast Cancer/ER+ Breast Cancer (TCGA) |
| TJU_CMC.ID00808.5p-miR | 4.45455467 | 0.005359437 | Chronic Lymphocytic Leukemia/Normal B cells |
| TJU_CMC.ID04999.3p-miR | 4.55163693 | 0.005443038 | Chronic Lymphocytic Leukemia/Normal B cells |
| TJU_CMC.ID04293.5p-miR | −3.975913396 | 0.005473644 | Chronic Lymphocytic Leukemia/Normal B cells |
| TJU_CMC.ID07897.3p-miR | 3.262292955 | 0.005460879 | Chronic Lymphocytic Leukemia/Normal B cells |
| TJU_CMC.ID04734.3p-miR | 3.31390565 | 0.005513998 | Chronic Lymphocytic Leukemia/Normal B cells |
| TJU_CMC.ID09827.5p-miR | −2.428009406 | 0.005517439 | Chronic Lymphocytic Leukemia/Normal B cells |
| TJU_CMC.ID09669.3p-miR | −3.458782703 | 0.005677504 | Chronic Lymphocytic Leukemia/Normal B cells |
| TJU_CMC.ID03560.3p-miR | 999999 | 0.005760813 | Chronic Lymphocytic Leukemia/Normal B cells |
| TJU_CMC_MD2.ID01860.3p-miR | −999999 | 0.005819237 | Chronic Lymphocytic Leukemia/Normal B cells |
| TJU_CMC.ID08066.3p-miR | 4.287744017 | 0.005869927 | Chronic Lymphocytic Leukemia/Normal B cells |
| TJU_CMC.ID06825.3p-miR | −3.522675208 | 0.001127059 | Stage 1 Gastric Cancer/Normal Gastric Tissue |
| TJU_CMC.ID02186.3p-miR | 3.721624573 | 0.006069033 | Chronic Lymphocytic Leukemia/Normal B cells |
| TJU_CMC.ID05680.3p-miR | −3.487688128 | 0.006066361 | Chronic Lymphocytic Leukemia/Normal B cells |
| TJU_CMC.ID03810.3p-miR | 3.615932991 | 0.006213076 | Chronic Lymphocytic Leukemia/Normal B cells |
| TJU_CMC.ID09849.5p-miR | −3.493578587 | 0.006186266 | Chronic Lymphocytic Leukemia/Normal B cells |
| TJU_CMC.ID08219.3p-miR | 4.875280596 | 0.006322887 | Chronic Lymphocytic Leukemia/Normal B cells |
| TJU_CMC.ID01848.5p-miR | −3.750885689 | 0.006378115 | Chronic Lymphocytic Leukemia/Normal B cells |
| TJU_CMC.ID04261.3p-miR | 4.129878547 | 0.006400059 | Chronic Lymphocytic Leukemia/Normal B cells |
| TJU_CMC_MD2.ID01104.3p-miR | −3.925384235 | 0.006412455 | Chronic Lymphocytic Leukemia/Normal B cells |
| TJU_CMC.ID03499.3p-miR | 3.397485958 | 0.006456307 | Chronic Lymphocytic Leukemia/Normal B cells |
| TJU_CMC.ID08877.5p-miR | 4.015540666 | 5.83E−05 | PBMC Scleroderma Patients/PBMC Control Individuals |
| TJU_CMC.ID05581.5p-miR | 4.983456978 | 0.006763951 | Chronic Lymphocytic Leukemia/Normal B cells |
| TJU_CMC.ID06430.5p-miR | −3.425154896 | 0.006796496 | Chronic Lymphocytic Leukemia/Normal B cells |
| TJU_CMC.ID09687.3p-miR | −3.605372058 | 0.006791673 | Chronic Lymphocytic Leukemia/Normal B cells |
| TJU_CMC_MD2.ID02946.5p-miR | −4.006709967 | 0.00669263 | Chronic Lymphocytic Leukemia/Normal B cells |
| TJU_CMC.ID03249.5p-miR | 3.736002726 | 0.006864919 | Chronic Lymphocytic Leukemia/Normal B cells |
| TJU_CMC.ID03497.5p-miR | −2.826827067 | 0.006934821 | Chronic Lymphocytic Leukemia/Normal B cells |
| TJU_CMC.ID01429.5p-miR | 3.845168153 | 0.001272276 | Stage 1 Gastric Cancer/Normal Gastric Tissue |
| TJU_CMC.ID04813.5p-miR | −2.734683848 | 0.001279186 | Stage 1 Gastric Cancer/Normal Gastric Tissue |
| TJU_CMC.ID02519.3p-miR | 6.626008984 | 0.007071927 | Chronic Lymphocytic Leukemia/Normal B cells |
| TJU_CMC.ID07881.5p-miR | −4.645626441 | 0.007132922 | Chronic Lymphocytic Leukemia/Normal B cells |
| TJU_CMC.ID09682.5p-miR | −3.694229362 | 0.007468685 | Chronic Lymphocytic Leukemia/Normal B cells |
| TJU_CMC.ID00644.5p-miR | −3.975809646 | 0.007567406 | Chronic Lymphocytic Leukemia/Normal B cells |
| TJU_CMC.ID07033.5p-miR | 3.38977647 | 0.007574289 | Chronic Lymphocytic Leukemia/Normal B cells |
| TJU_CMC.ID09781.3p-miR | −3.952929903 | 0.007576322 | Chronic Lymphocytic Leukemia/Normal B cells |
| TJU_CMC.ID09464.5p-miR | −1.268418493 | 0.003556504 | PR− Breast Cancer/PR+ Breast Cancer (TCGA) |
| TJU_CMC.ID05902.3p-miR | 3.520306132 | 0.007741627 | Chronic Lymphocytic Leukemia/Normal B cells |
| TJU_CMC.ID00419.3p-miR | −3.22974304 | 0.00777046 | Chronic Lymphocytic Leukemia/Normal B cells |
| TJU_CMC.ID07864.5p-miR | −2.782784628 | 0.00145645 | Stage 1 Gastric Cancer/Normal Gastric Tissue |
| TJU_CMC.ID02392.3p-miR | −3.395999263 | 0.007852482 | Chronic Lymphocytic Leukemia/Normal B cells |
| TJU_CMC.ID08744.3p-miR | 3.823547998 | 0.007842493 | Chronic Lymphocytic Leukemia/Normal B cells |
| TJU_CMC_MD2.ID00802.5p-miR | −3.761374318 | 0.007825048 | Chronic Lymphocytic Leukemia/Normal B cells |
| TJU_CMC.ID05451.5p-miR | −3.601834058 | 0.007958604 | Chronic Lymphocytic Leukemia/Normal B cells |
| TJU_CMC.ID05889.3p-miR | 3.767260997 | 0.00794515 | Chronic Lymphocytic Leukemia/Normal B cells |
| TJU_CMC.ID07409.3p-miR | 3.713000924 | 0.007961062 | Chronic Lymphocytic Leukemia/Normal B cells |
| TJU_CMC.ID07851.5p-miR | −0.848685228 | 0.003847746 | PR− Breast Cancer/PR+ Breast Cancer (TCGA) |
| TJU_CMC.ID05259.5p-miR | 3.238887474 | 0.008207578 | Chronic Lymphocytic Leukemia/Normal B cells |
| TJU_CMC.ID08501.5p-miR | −3.68015595 | 0.008378015 | Chronic Lymphocytic Leukemia/Normal B cells |
| TJU_CMC.ID03695.5p-miR | −3.629989137 | 0.008416202 | Chronic Lymphocytic Leukemia/Normal B cells |
| TJU_CMC_MD2.ID01679.5p-miR | −2.72629129 | 0.001586112 | Stage 1 Gastric Cancer/Normal Gastric Tissue |
| TJU_CMC.ID04861.3p-miR | −3.49968115 | 0.008701215 | Chronic Lymphocytic Leukemia/Normal B cells |
| TJU_CMC.ID04105.5p-miR | 3.465260213 | 0.008745639 | Chronic Lymphocytic Leukemia/Normal B cells |
| TJU_CMC.ID01675.3p-miR | 3.424525025 | 0.008770798 | Chronic Lymphocytic Leukemia/Normal B cells |
| TJU_CMC.ID00858.5p-miR | −2.738680205 | 0.008834193 | Chronic Lymphocytic Leukemia/Normal B cells |
| TJU_CMC.ID00538.3p-miR | −3.58189314 | 0.008891839 | Chronic Lymphocytic Leukemia/Normal B cells |
| TJU_CMC.ID06335.5p-miR | −8.56605621 | 0.008900687 | Chronic Lymphocytic Leukemia/Normal B cells |
| TJU_CMC.ID09270.3p-miR | 3.076343437 | 0.001696361 | Stage 1 Gastric Cancer/Normal Gastric Tissue |
| TJU_CMC.ID01817.3p-miR | −5.905477213 | 0.009056318 | Chronic Lymphocytic Leukemia/Normal B cells |
| TJU_CMC.ID09441.5p-miR | −3.474391593 | 0.009067118 | Chronic Lymphocytic Leukemia/Normal B cells |
| TJU_CMC.ID03485.5p-miR | −3.449134377 | 0.009097675 | Chronic Lymphocytic Leukemia/Normal B cells |
| TJU_CMC.ID09034.5p-miR | 3.336180378 | 0.009309824 | Chronic Lymphocytic Leukemia/Normal B cells |
| TJU_CMC.ID06503.5p-miR | 3.649753645 | 0.009412983 | Chronic Lymphocytic Leukemia/Normal B cells |
| TJU_CMC.ID03683.3p-miR | −3.033501491 | 0.009501326 | Chronic Lymphocytic Leukemia/Normal B cells |
| TJU_CMC_MD2.ID02126.3p-miR | 1.329339479 | 0.004688008 | PR− Breast Cancer/PR+ Breast Cancer (TCGA) |
| TJU_CMC.ID04846.5p-miR | 2.507408703 | 0.009784292 | Chronic Lymphocytic Leukemia/Normal B cells |
| TJU_CMC.ID03615.3p-miR | 4.380853312 | 0.009830812 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID05919.3p-miR | 3.25341944 | 0.009927145 | Chronic Lymphocytic Leukemia/Normal B cells |
| TJU_CMC.ID05362.5p-miR | −3.481303728 | 0.010097837 | Chronic Lymphocytic Leukemia/Normal B cells |
| TJU_CMC.ID08830.3p-miR | 4.348247017 | 0.010090991 | Chronic Lymphocytic Leukemia/Normal B cells |
| TJU_CMC.ID06942.5p-miR | 4.752723586 | 0.010149942 | Chronic Lymphocytic Leukemia/Normal B cells |
| TJU_CMC.ID08906.5p-miR | −7.174478753 | 0.000452493 | MIA PaCa-2 cells/HPNE cells (Pancreas cell lines) |
| TJU_CMC.ID01532.5p-miR | −3.38421841 | 0.010349591 | Chronic Lymphocytic Leukemia/Normal B cells |
| TJU_CMC.ID00590.5p-miR | 2.594449484 | 0.01047864 | Chronic Lymphocytic Leukemia/Normal B cells |
| TJU_CMC.ID04494.5p-miR | −2.928055747 | 0.010485439 | Chronic Lymphocytic Leukemia/Normal B cells |
| TJU_CMC.ID02447.3p-miR | −3.049395422 | 0.002016216 | Stage 1 Gastric Cancer/Normal Gastric Tissue |
| TJU_CMC.ID03129.3p-miR | 3.721639697 | 0.001947997 | Stage 1 Gastric Cancer/Normal Gastric Tissue |
| TJU_CMC.ID04431.3p-miR | 2.421432866 | 0.001984674 | Stage 1 Gastric Cancer/Normal Gastric Tissue |
| TJU_CMC.ID01967.5p-miR | −4.82691252 | 0.010622482 | Chronic Lymphocytic Leukemia/Normal B cells |
| TJU_CMC.ID05791.3p-miR | 4.041554977 | 0.000123848 | PBMC Scleroderma Patients/PBMC Control Individuals |
| TJU_CMC.ID08760.5p-miR | 3.213735394 | 0.010692497 | Chronic Lymphocytic Leukemia/Normal B cells |
| TJU_CMC.ID07726.5p-miR | −3.275093222 | 0.01078539 | Chronic Lymphocytic Leukemia/Normal B cells |
| TJU_CMC.ID06201.5p-miR | 3.243655826 | 0.010829525 | Chronic Lymphocytic Leukemia/Normal B cells |
| TJU_CMC.ID08567.3p-miR | 3.441135965 | 0.010931409 | Chronic Lymphocytic Leukemia/Normal B cells |
| TJU_CMC.ID04355.3p-miR | −7.774051135 | 0.011020162 | Chronic Lymphocytic Leukemia/Normal B cells |
| TJU_CMC.ID04470.5p-miR | −999999 | 0.002097664 | Stage 1 Gastric Cancer/Normal Gastric Tissue |
| TJU_CMC.ID05510.3p-miR | 3.762851965 | 0.002131497 | Stage 1 Gastric Cancer/Normal Gastric Tissue |
| TJU_CMC.ID08188.3p-miR | 3.632361015 | 0.011095653 | Chronic Lymphocytic Leukemia/Normal B cells |
| TJU_CMC.ID05198.3p-miR | 3.606212091 | 0.011215348 | Chronic Lymphocytic Leukemia/Normal B cells |
| TJU_CMC.ID01964.3p-miR | 3.485799512 | 0.011320868 | Chronic Lymphocytic Leukemia/Normal B cells |
| TJU_CMC.ID01548.3p-miR | 4.06463058 | 0.00016661 | PBMC Scleroderma Patients/PBMC Control Individuals |
| TJU_CMC.ID02965.5p-miR | 4.073358618 | 0.000182467 | PBMC Scleroderma Patients/PBMC Control Individuals |
| TJU_CMC.ID04119.3p-miR | 6.354604426 | 0.000151789 | PBMC Scleroderma Patients/PBMC Control Individuals |
| TJU_CMC.ID06401.3p-miR | 2.937429039 | 0.011418415 | Chronic Lymphocytic Leukemia/Normal B cells |
| TJU_CMC.ID00897.3p-miR | 3.242235398 | 0.011701414 | Chronic Lymphocytic Leukemia/Normal B cells |
| TJU_CMC.ID04312.3p-miR | −2.839092601 | 0.002316521 | Stage 1 Gastric Cancer/Normal Gastric Tissue |
| TJU_CMC.ID00367.5p-miR | 3.612335212 | 0.012015975 | Chronic Lymphocytic Leukemia/Normal B cells |
| TJU_CMC.ID03089.5p-miR | 3.871229705 | 0.011982943 | Chronic Lymphocytic Leukemia/Normal B cells |
| TJU_CMC.ID06918.3p-miR | 3.277969503 | 0.012019111 | Chronic Lymphocytic Leukemia/Normal B cells |
| TJU_CMC.ID07026.3p-miR | 3.21069785 | 0.011993843 | Chronic Lymphocytic Leukemia/Normal B cells |
| TJU_CMC.ID08755.5p-miR | −3.474241921 | 0.012057449 | Chronic Lymphocytic Leukemia/Normal B cells |
| TJU_CMC.ID01584.3p-miR | 2.538363808 | 0.012227387 | Chronic Lymphocytic Leukemia/Normal B cells |
| TJU_CMC.ID06706.3p-miR | 3.229974177 | 0.012225456 | Chronic Lymphocytic Leukemia/Normal B cells |
| TJU_CMC_MD2.ID00546.5p-miR | −2.930199773 | 0.012196577 | Chronic Lymphocytic Leukemia/Normal B cells |
| TJU_CMC.ID03479.5p-miR | 5.138235153 | 0.012283946 | Chronic Lymphocytic Leukemia/Normal B cells |
| TJU_CMC.ID05652.3p-miR | −3.801193157 | 0.012410555 | Chronic Lymphocytic Leukemia/Normal B cells |
| TJU_CMC.ID04133.5p-miR | −1.395446103 | 0.006247856 | PR− Breast Cancer/PR+ Breast Cancer (TCGA) |
| TJU_CMC.ID02661.3p-miR | −3.416158149 | 0.012498757 | Chronic Lymphocytic Leukemia/Normal B cells |
| TJU_CMC.ID07851.5p-miR | −0.746966944 | 0.008090463 | ER− Breast Cancer/ER+ Breast Cancer (TCGA) |
| TJU_CMC.ID08923.3p-miR | −3.354714759 | 0.012687656 | Chronic Lymphocytic Leukemia/Normal B cells |
| TJU_CMC.ID00084.5p-miR | 3.251317323 | 0.002568033 | Stage 1 Gastric Cancer/Normal Gastric Tissue |
| TJU_CMC.ID00409.5p-miR | −2.355643659 | 0.002594432 | Stage 1 Gastric Cancer/Normal Gastric Tissue |
| TJU_CMC.ID02895.5p-miR | 3.067023182 | 0.002518555 | Stage 1 Gastric Cancer/Normal Gastric Tissue |
| TJU_CMC.ID03038.3p-miR | −2.406007669 | 0.002497207 | Stage 1 Gastric Cancer/Normal Gastric Tissue |
| TJU_CMC.ID06178.3p-miR | 3.30228222 | 0.012921953 | Chronic Lymphocytic Leukemia/Normal B cells |
| TJU_CMC.ID00712.3p-miR | −2.583984196 | 0.002706236 | Stage 1 Gastric Cancer/Normal Gastric Tissue |
| TJU_CMC.ID00535.5p-miR | 3.272381812 | 0.013317849 | Chronic Lymphocytic Leukemia/Normal B cells |
| TJU_CMC.ID02225.3p-miR | 3.135280669 | 0.013300742 | Chronic Lymphocytic Leukemia/Normal B cells |
| TJU_CMC_MD2.ID02802.3p-miR | −3.361521606 | 0.013277157 | Chronic Lymphocytic Leukemia/Normal B cells |
| TJU_CMC_MD2.ID03407.3p-miR | 5.253149789 | 0.01340197 | Chronic Lymphocytic Leukemia/Normal B cells |
| TJU_CMC.ID06787.5p-miR | 3.365836898 | 0.013537796 | Chronic Lymphocytic Leukemia/Normal B cells |
| TJU_CMC.ID09586.3p-miR | −4.303430541 | 0.013592915 | Chronic Lymphocytic Leukemia/Normal B cells |
| TJU_CMC.ID07029.5p-miR | 2.549642485 | 0.013794616 | Chronic Lymphocytic Leukemia/Normal B cells |
| TJU_CMC.ID03316.5p-miR | −5.594060316 | 0.014229027 | Chronic Lymphocytic Leukemia/Normal B cells |
| TJU_CMC.ID07174.5p-miR | 3.108044351 | 0.014262938 | Chronic Lymphocytic Leukemia/Normal B cells |
| TJU_CMC.ID01826.5p-miR | 4.009674068 | 0.014512746 | Chronic Lymphocytic Leukemia/Normal B cells |
| TJU_CMC.ID03381.5p-miR | −2.022944804 | 0.014523235 | Chronic Lymphocytic Leukemia/Normal B cells |
| TJU_CMC.ID04092.3p-miR | −3.067669024 | 0.014458501 | Chronic Lymphocytic Leukemia/Normal B cells |
| TJU_CMC.ID06103.3p-miR | −3.017564221 | 0.014477798 | Chronic Lymphocytic Leukemia/Normal B cells |
| TJU_CMC.ID09253.3p-miR | −5.174658694 | 0.014509172 | Chronic Lymphocytic Leukemia/Normal B cells |
| TJU_CMC.ID06029.5p-miR | 2.146941799 | 0.002907061 | Stage 1 Gastric Cancer/Normal Gastric Tissue |
| TJU_CMC.ID01099.3p-miR | −2.904791212 | 0.002996927 | Stage 1 Gastric Cancer/Normal Gastric Tissue |
| TJU_CMC.ID03444.5p-miR | 2.306240096 | 0.003077447 | Stage 1 Gastric Cancer/Normal Gastric Tissue |
| TJU_CMC.ID08716.5p-miR | 2.830640101 | 0.003016562 | Stage 1 Gastric Cancer/Normal Gastric Tissue |
| TJU_CMC.ID06167.3p-miR | 5.117000177 | 0.014670432 | Chronic Lymphocytic Leukemia/Normal B cells |
| TJU_CMC.ID03541.5p-miR | 3.480171069 | 0.014845228 | Chronic Lymphocytic Leukemia/Normal B cells |
| TJU_CMC.ID09776.5p-miR | 2.605647153 | 0.015609005 | Breast Cancer (adenoid/apocrine/atypical/DCIS/IDC/metaplastic)/Normal Breast Tissue (GEO: GSE28884) |
| TJU_CMC_MD2.ID00492.5p-miR | −1.885086231 | 0.007448445 | PR− Breast Cancer/PR+ Breast Cancer (TCGA) |
| TJU_CMC.ID06948.3p-miR | 3.09443663 | 0.014984398 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
| --- | --- | --- | --- |
| TJU_CMC.ID06610.5p-miR | 2.508138788 | 0.003182417 | Stage 1 Gastric Cancer/Normal Gastric Tissue |
| TJU_CMC.ID02254.5p-miR | 1.037361726 | 0.00965459 | ER− Breast Cancer/ER+ Breast Cancer (TCGA) |
| TJU_CMC.ID04304.5p-miR | −3.034487907 | 0.015176374 | Chronic Lymphocytic Leukemia/Normal B cells |
| TJU_CMC.ID05336.5p-miR | −3.326587969 | 0.015295193 | Chronic Lymphocytic Leukemia/Normal B cells |
| TJU_CMC.ID06510.3p-miR | −2.961506778 | 0.015296259 | Chronic Lymphocytic Leukemia/Normal B cells |
| TJU_CMC.ID03515.3p-miR | 3.113144145 | 0.015407568 | Chronic Lymphocytic Leukemia/Normal B cells |
| TJU_CMC.ID08821.5p-miR | −8.212551762 | 0.015353105 | Chronic Lymphocytic Leukemia/Normal B cells |
| TJU_CMC.ID09722.3p-miR | −1.147397694 | 0.007755472 | PR− Breast Cancer/PR+ Breast Cancer (TCGA) |
| TJU_CMC.ID07521.3p-miR | 4.000690248 | 0.015505981 | Chronic Lymphocytic Leukemia/Normal B cells |
| TJU_CMC.ID04182.3p-miR | −9.074339415 | 0.015816824 | Chronic Lymphocytic Leukemia/Normal B cells |
| TJU_CMC_MD2.ID00706.5p-miR | −2.872784647 | 0.015913657 | Chronic Lymphocytic Leukemia/Normal B cells |
| TJU_CMC.ID06339.3p-miR | 2.569368917 | 0.003366898 | Stage 1 Gastric Cancer/Normal Gastric Tissue |
| TJU_CMC.ID02375.5p-miR | −3.243638159 | 0.01623186 | Chronic Lymphocytic Leukemia/Normal B cells |
| TJU_CMC.ID04862.5p-miR | 4.27159012 | 0.016239499 | Chronic Lymphocytic Leukemia/Normal B cells |
| TJU_CMC.ID08840.3p-miR | −2.941710453 | 0.016148847 | Chronic Lymphocytic Leukemia/Normal B cells |
| TJU_CMC.ID00700.3p-miR | 2.896017129 | 0.003539638 | Stage 1 Gastric Cancer/Normal Gastric Tissue |
| TJU_CMC.ID08202.5p-miR | 3.891607394 | 0.003500977 | Stage 1 Gastric Cancer/Normal Gastric Tissue |
| TJU_CMC.ID07681.3p-miR | −2.781127573 | 0.016574899 | Chronic Lymphocytic Leukemia/Normal B cells |
| TJU_CMC.ID04643.5p-miR | −2.685076893 | 0.016782143 | Chronic Lymphocytic Leukemia/Normal B cells |
| TJU_CMC.ID02023.5p-miR | 2.749119483 | 0.016983926 | Chronic Lymphocytic Leukemia/Normal B cells |
| TJU_CMC.ID05546.5p-miR | 2.084155351 | 0.003652502 | Stage 1 Gastric Cancer/Normal Gastric Tissue |
| TJU_CMC.ID08362.3p-miR | 2.968005513 | 0.003638234 | Stage 1 Gastric Cancer/Normal Gastric Tissue |
| TJU_CMC.ID07568.5p-miR | 7.428627427 | 0.017073055 | Chronic Lymphocytic Leukemia/Normal B cells |
| TJU_CMC.ID03979.5p-miR | 4.67551264 | 0.017159213 | Chronic Lymphocytic Leukemia/Normal B cells |
| TJU_CMC.ID01151.5p-miR | −3.312262041 | 0.017458394 | Chronic Lymphocytic Leukemia/Normal B cells |
| TJU_CMC.ID03087.3p-miR | 3.038386397 | 0.017407724 | Chronic Lymphocytic Leukemia/Normal B cells |
| TJU_CMC_MD2.ID02715.3p-miR | −3.116026893 | 0.017439889 | Chronic Lymphocytic Leukemia/Normal B cells |
| TJU_CMC.ID01679.3p-miR | −999999 | 0.017623252 | Chronic Lymphocytic Leukemia/Normal B cells |
| TJU_CMC.ID03599.5p-miR | 4.282056224 | 0.017639021 | Chronic Lymphocytic Leukemia/Normal B cells |
| TJU_CMC.ID05141.5p-miR | −2.784882252 | 0.017823221 | Chronic Lymphocytic Leukemia/Normal B cells |
| TJU_CMC.ID06381.5p-miR | −3.383671724 | 0.017801519 | Chronic Lymphocytic Leukemia/Normal B cells |
| TJU_CMC.ID09346.3p-miR | 2.281824718 | 0.01784029 | Chronic Lymphocytic Leukemia/Normal B cells |
| TJU_CMC.ID09080.5p-miR | 3.045680239 | 0.017987293 | Chronic Lymphocytic Leukemia/Normal B cells |
| TJU_CMC.ID01924.5p-miR | 2.622848898 | 0.018307235 | Chronic Lymphocytic Leukemia/Normal B cells |
| TJU_CMC.ID07390.3p-miR | 7.011168408 | 0.018332359 | Chronic Lymphocytic Leukemia/Normal B cells |
| TJU_CMC_MD2.ID02858.3p-miR | −5.832375062 | 0.018415983 | Chronic Lymphocytic Leukemia/Normal B cells |
| TJU_CMC.ID00528.5p-miR | 5.787064141 | 0.01858266 | Chronic Lymphocytic Leukemia/Normal B cells |
| TJU_CMC.ID04082.3p-miR | −2.426940063 | 0.003982178 | Stage 1 Gastric Cancer/Normal Gastric Tissue |
| TJU_CMC.ID04444.3p-miR | 2.741083034 | 0.003953415 | Stage 1 Gastric Cancer/Normal Gastric Tissue |
| TJU_CMC.ID08750.3p-miR | −2.862400301 | 0.00393965 | Stage 1 Gastric Cancer/Normal Gastric Tissue |
| TJU_CMC.ID00637.3p-miR | 6.058184025 | 0.018701103 | Chronic Lymphocytic Leukemia/Normal B cells |
| TJU_CMC.ID02676.5p-miR | −3.39730811 | 0.018730489 | Chronic Lymphocytic Leukemia/Normal B cells |
| TJU_CMC.ID08828.3p-miR | 3.001424354 | 0.018742632 | Chronic Lymphocytic Leukemia/Normal B cells |
| TJU_CMC.ID00970.5p-miR | −4.896585032 | 0.018951843 | Chronic Lymphocytic Leukemia/Normal B cells |
| TJU_CMC.ID05223.5p-miR | 4.613596249 | 0.01898245 | Chronic Lymphocytic Leukemia/Normal B cells |
| TJU_CMC.ID06204.3p-miR | −3.292787893 | 0.01918446 | Chronic Lymphocytic Leukemia/Normal B cells |
| TJU_CMC.ID01953.5p-miR | 6.457921839 | 0.004130506 | Stage 1 Gastric Cancer/Normal Gastric Tissue |
| TJU_CMC.ID08158.3p-miR | 2.719385226 | 0.019780941 | Chronic Lymphocytic Leukemia/Normal B cells |
| TJU_CMC.ID00536.3p-miR | 5.690336637 | 0.019835689 | Chronic Lymphocytic Leukemia/Normal B cells |
| TJU_CMC.ID00672.3p-miR | 3.128585419 | 0.019904416 | Chronic Lymphocytic Leukemia/Normal B cells |
| TJU_CMC.ID00847.3p-miR | 2.327739347 | 0.020065155 | Chronic Lymphocytic Leukemia/Normal B cells |
| TJU_CMC.ID02654.3p-miR | 3.030401524 | 0.020072372 | Chronic Lymphocytic Leukemia/Normal B cells |
| TJU_CMC.ID04467.5p-miR | 3.051362959 | 0.020037318 | Chronic Lymphocytic Leukemia/Normal B cells |
| TJU_CMC.ID07647.3p-miR | −3.261142395 | 0.019998013 | Chronic Lymphocytic Leukemia/Normal B cells |
| TJU_CMC.ID02635.5p-miR | −3.168203988 | 0.020258028 | Chronic Lymphocytic Leukemia/Normal B cells |
| TJU_CMC.ID00862.5p-miR | 2.666454872 | 0.020028583 | Chronic Lymphocytic Leukemia/Normal B cells |
| TJU_CMC.ID06821.5p-miR | −3.105629789 | 0.004269169 | Stage 1 Gastric Cancer/Normal Gastric Tissue |
| TJU_CMC.ID04958.5p-miR | 2.674148083 | 0.020416847 | Chronic Lymphocytic Leukemia/Normal B cells |
| TJU_CMC.ID09041.3p-miR | −6.077795644 | 0.020488339 | Chronic Lymphocytic Leukemia/Normal B cells |
| TJU_CMC.ID07842.5p-miR | 3.255613703 | 0.020621318 | Chronic Lymphocytic Leukemia/Normal B cells |
| TJU_CMC.ID04877.3p-miR | 3.545625034 | 0.020689356 | Chronic Lymphocytic Leukemia/Normal B cells |
| TJU_CMC.ID00795.3p-miR | 2.69704536 | 0.020894454 | Chronic Lymphocytic Leukemia/Normal B cells |
| TJU_CMC.ID08067.3p-miR | −4.163384881 | 0.021285039 | Chronic Lymphocytic Leukemia/Normal B cells |
| TJU_CMC.ID08640.5p-miR | −3.078424476 | 0.021476099 | Chronic Lymphocytic Leukemia/Normal B cells |
| TJU_CMC.ID04299.5p-miR | 2.245847544 | 0.00463289 | Stage 1 Gastric Cancer/Normal Gastric Tissue |
| TJU_CMC.ID04613.3p-miR | 8.376174999 | 0.004594609 | Stage 1 Gastric Cancer/Normal Gastric Tissue |
| TJU_CMC.ID08197.5p-miR | −2.37595939 | 0.004608642 | Stage 1 Gastric Cancer/Normal Gastric Tissue |
| TJU_CMC.ID03014.5p-miR | −3.72049997 | 0.021530771 | Chronic Lymphocytic Leukemia/Normal B cells |
| TJU_CMC.ID01698.5p-miR | −3.897128686 | 0.02165587 | Chronic Lymphocytic Leukemia/Normal B cells |
| TJU_CMC.ID00325.3p-miR | −4.298352365 | 0.021716858 | Chronic Lymphocytic Leukemia/Normal B cells |
| TJU_CMC.ID09179.3p-miR | 3.499124516 | 0.021737413 | Chronic Lymphocytic Leukemia/Normal B cells |
| TJU_CMC.ID05532.5p-miR | −2.800723762 | 0.021866388 | Chronic Lymphocytic Leukemia/Normal B cells |
| TJU_CMC.ID06173.5p-miR | −4.142784796 | 0.021812138 | Chronic Lymphocytic Leukemia/Normal B cells |
| TJU_CMC_MD2.ID02550.3p-miR | 2.839572543 | 0.021923458 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID04190.5p-miR | 4.887393981 | 0.00035747 | PBMC Scleroderma Patients/PBMC Control Individuals |
| TJU_CMC.ID09189.5p-miR | 4.448951859 | 0.022140339 | Chronic Lymphocytic Leukemia/Normal B cells |
| TJU_CMC.ID03233.3p-miR | 2.886399829 | 0.022207984 | Chronic Lymphocytic Leukemia/Normal B cells |
| TJU_CMC.ID01091.3p-miR | 2.682059506 | 0.022422522 | Chronic Lymphocytic Leukemia/Normal B cells |
| TJU_CMC.ID04249.3p-miR | −2.851528998 | 0.022519412 | Chronic Lymphocytic Leukemia/Normal B cells |
| TJU_CMC_MD2.ID02486.3p-miR | 3.565057498 | 0.022456975 | Chronic Lymphocytic Leukemia/Normal B cells |
| TJU_CMC.ID01877.3p-miR | 3.408842979 | 0.022778055 | Chronic Lymphocytic Leukemia/Normal B cells |
| TJU_CMC.ID04106.3p-miR | 2.679758478 | 0.022818898 | Chronic Lymphocytic Leukemia/Normal B cells |
| TJU_CMC.ID00938.5p-miR | −2.537156423 | 0.004921329 | Stage 1 Gastric Cancer/Normal Gastric Tissue |
| TJU_CMC.ID02270.5p-miR | 2.5676745 | 0.023088502 | Chronic Lymphocytic Leukemia/Normal B cells |
| TJU_CMC.ID01138.5p-miR | 2.626576454 | 0.023250686 | Chronic Lymphocytic Leukemia/Normal B cells |
| TJU_CMC.ID05537.5p-miR | −2.279834527 | 0.023422243 | Chronic Lymphocytic Leukemia/Normal B cells |
| TJU_CMC.ID05200.5p-miR | −8.02556359 | 0.00110676 | MIA PaCa-2 cells/HPNE cells (Pancreas cell lines) |
| TJU_CMC.ID01023.5p-miR | 2.395829761 | 0.0050136 | Stage 1 Gastric Cancer/Normal Gastric Tissue |
| TJU_CMC.ID00746.5p-miR | 5.09545691 | 0.023619774 | Chronic Lymphocytic Leukemia/Normal B cells |
| TJU_CMC.ID05806.3p-miR | 2.713678593 | 0.023613813 | Chronic Lymphocytic Leukemia/Normal B cells |
| TJU_CMC_MD2.ID00244.3p-miR | −2.949064286 | 0.023785381 | Chronic Lymphocytic Leukemia/Normal B cells |
| TJU_CMC.ID05479.3p-miR | −2.923242703 | 0.023892528 | Chronic Lymphocytic Leukemia/Normal B cells |
| TJU_CMC.ID01506.3p-miR | −5.501488348 | 0.024039293 | Chronic Lymphocytic Leukemia/Normal B cells |
| TJU_CMC.ID03855.5p-miR | −3.324653343 | 0.024115172 | Chronic Lymphocytic Leukemia/Normal B cells |
| TJU_CMC.ID04136.5p-miR | 2.963836967 | 0.024002725 | Chronic Lymphocytic Leukemia/Normal B cells |
| TJU_CMC.ID06295.3p-miR | −2.621546871 | 0.024139807 | Chronic Lymphocytic Leukemia/Normal B cells |
| TJU_CMC.ID04598.3p-miR | 3.070250447 | 0.024244748 | Chronic Lymphocytic Leukemia/Normal B cells |
| TJU_CMC.ID07317.3p-miR | 5.409734034 | 0.024418766 | Chronic Lymphocytic Leukemia/Normal B cells |
| TJU_CMC.ID00600.3p-miR | −2.957496647 | 0.024937555 | Chronic Lymphocytic Leukemia/Normal B cells |
| TJU_CMC.ID07021.5p-miR | −3.006798222 | 0.024888573 | Chronic Lymphocytic Leukemia/Normal B cells |
| TJU_CMC.ID07249.3p-miR | −2.309085736 | 0.024894649 | Chronic Lymphocytic Leukemia/Normal B cells |
| TJU_CMC.ID08808.5p-miR | −2.876100294 | 0.024654888 | Chronic Lymphocytic Leukemia/Normal B cells |
| TJU_CMC_MD2.ID02793.3p-miR | −2.744299539 | 0.024676699 | Chronic Lymphocytic Leukemia/Normal B cells |
| TJU_CMC.ID03724.3p-miR | 3.168829498 | 0.025598591 | Chronic Lymphocytic Leukemia/Normal B cells |
| TJU_CMC.ID08577.5p-miR | 2.728949814 | 0.025625947 | Chronic Lymphocytic Leukemia/Normal B cells |
| TJU_CMC.ID02213.5p-miR | 4.034035398 | 0.000431332 | PBMC Scleroderma Patients/PBMC Control Individuals |
| TJU_CMC.ID03948.5p-miR | 4.031522549 | 0.00051144 | PBMC Scleroderma Patients/PBMC Control Individuals |
| TJU_CMC.ID05204.5p-miR | 3.534617933 | 0.000461617 | PBMC Scleroderma Patients/PBMC Control Individuals |
| TJU_CMC.ID00474.5p-miR | −3.273098191 | 0.005235566 | Stage 1 Gastric Cancer/Normal Gastric Tissue |
| TJU_CMC.ID03053.3p-miR | 2.264928957 | 0.005317008 | Stage 1 Gastric Cancer/Normal Gastric Tissue |
| TJU_CMC_MD2.ID00590.5p-miR | 3.198726848 | 0.026219482 | Chronic Lymphocytic Leukemia/Normal B cells |
| TJU_CMC.ID03671.3p-miR | 3.335933612 | 0.026339 | Chronic Lymphocytic Leukemia/Normal B cells |
| TJU_CMC.ID01287.3p-miR | 3.090214346 | 0.026553324 | Chronic Lymphocytic Leukemia/Normal B cells |
| TJU_CMC.ID05125.3p-miR | −2.981887028 | 0.026892611 | Chronic Lymphocytic Leukemia/Normal B cells |
| TJU_CMC.ID05191.3p-miR | 2.703208548 | 0.026757187 | Chronic Lymphocytic Leukemia/Normal B cells |
| TJU_CMC_MD2.ID02043.3p-miR | −3.328877283 | 0.026694567 | Chronic Lymphocytic Leukemia/Normal B cells |
| TJU_CMC.ID09116.3p-miR | 2.234253027 | 0.005488804 | Stage 1 Gastric Cancer/Normal Gastric Tissue |
| TJU_CMC.ID05745.5p-miR | 2.793252473 | 0.027209357 | Chronic Lymphocytic Leukemia/Normal B cells |
| TJU_CMC.ID07158.5p-miR | 2.770719295 | 0.027289652 | Chronic Lymphocytic Leukemia/Normal B cells |
| TJU_CMC.ID05776.5p-miR | 2.580231001 | 0.027373375 | Chronic Lymphocytic Leukemia/Normal B cells |
| TJU_CMC.ID04424.5p-miR | 2.049503056 | 0.005607578 | Stage 1 Gastric Cancer/Normal Gastric Tissue |
| TJU_CMC.ID00117.3p-miR | −2.413142856 | 0.005761416 | Stage 1 Gastric Cancer/Normal Gastric Tissue |
| TJU_CMC.ID05823.5p-miR | 4.392611417 | 0.005676082 | Stage 1 Gastric Cancer/Normal Gastric Tissue |
| TJU_CMC.ID03197.3p-miR | 2.924645557 | 0.028182015 | Chronic Lymphocytic Leukemia/Normal B cells |
| TJU_CMC.ID06019.5p-miR | 4.516508691 | 0.000563694 | PBMC Scleroderma Patients/PBMC Control Individuals |
| TJU_CMC_MD2.ID01945.3p-miR | 3.43074861 | 0.028395532 | Chronic Lymphocytic Leukemia/Normal B cells |
| TJU_CMC.ID01483.3p-miR | −4.25712926 | 0.006193215 | Stage 1 Gastric Cancer/Normal Gastric Tissue |
| TJU_CMC.ID06205.3p-miR | −2.958120365 | 0.006137108 | Stage 1 Gastric Cancer/Normal Gastric Tissue |
| TJU_CMC.ID06799.5p-miR | 2.472851563 | 0.028500375 | Chronic Lymphocytic Leukemia/Normal B cells |
| TJU_CMC.ID02016.5p-miR | 3.069788723 | 0.028705269 | Chronic Lymphocytic Leukemia/Normal B cells |
| TJU_CMC.ID02385.3p-miR | 2.522779608 | 0.028683259 | Chronic Lymphocytic Leukemia/Normal B cells |
| TJU_CMC_MD2.ID02695.3p-miR | −5.511362209 | 0.028676056 | Chronic Lymphocytic Leukemia/Normal B cells |
| TJU_CMC.ID00208.3p-miR | 5.264354571 | 0.028857486 | Chronic Lymphocytic Leukemia/Normal B cells |
| TJU_CMC.ID02153.5p-miR | 2.612771596 | 0.029056618 | Chronic Lymphocytic Leukemia/Normal B cells |
| TJU_CMC.ID00531.3p-miR | −2.927976732 | 0.029162333 | Chronic Lymphocytic Leukemia/Normal B cells |
| TJU_CMC.ID04567.3p-miR | 2.430514625 | 0.029164041 | Chronic Lymphocytic Leukemia/Normal B cells |
| TJU_CMC.ID09154.3p-miR | −2.352812441 | 0.029226599 | Chronic Lymphocytic Leukemia/Normal B cells |
| TJU_CMC.ID08726.5p-miR | 2.589983043 | 0.006329591 | Stage 1 Gastric Cancer/Normal Gastric Tissue |
| TJU_CMC.ID00594.3p-miR | 2.698714332 | 0.029666266 | Chronic Lymphocytic Leukemia/Normal B cells |
| TJU_CMC.ID07185.5p-miR | −2.643656815 | 0.029712357 | Chronic Lymphocytic Leukemia/Normal B cells |
| TJU_CMC.ID07652.3p-miR | 2.472825117 | 0.030047125 | Chronic Lymphocytic Leukemia/Normal B cells |
| TJU_CMC.ID02595.3p-miR | −5.860895396 | 0.030268541 | Chronic Lymphocytic Leukemia/Normal B cells |
| TJU_CMC.ID06528.3p-miR | −3.065102364 | 0.030623702 | Chronic Lymphocytic Leukemia/Normal B cells |
| TJU_CMC.ID06108.3p-miR | 2.627764154 | 0.030913846 | Chronic Lymphocytic Leukemia/Normal B cells |
| TJU_CMC.ID09057.5p-miR | 2.493058232 | 0.031093477 | Chronic Lymphocytic Leukemia/Normal B cells |
| TJU_CMC.ID05094.3p-miR | 3.981816007 | 0.031258199 | Chronic Lymphocytic Leukemia/Normal B cells |
| TJU_CMC.ID07930.3p-miR | 2.791865669 | 0.031218091 | Chronic Lymphocytic Leukemia/Normal B cells |
| TJU_CMC.ID07725.3p-miR | 3.11140989 | 0.03151947 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
| --- | --- | --- | --- |
| TJU_CMC.ID01609.3p-miR | 3.034109734 | 0.031724563 | Chronic Lymphocytic Leukemia/Normal B cells |
| TJU_CMC.ID07454.3p-miR | 2.767698905 | 0.031834835 | Chronic Lymphocytic Leukemia/Normal B cells |
| TJU_CMC.ID01683.5p-miR | 2.783748545 | 0.03213857 | Chronic Lymphocytic Leukemia/Normal B cells |
| TJU_CMC.ID02746.3p-miR | 2.740860826 | 0.032318065 | Chronic Lymphocytic Leukemia/Normal B cells |
| TJU_CMC.ID05663.3p-miR | −2.606628114 | 0.032312028 | Chronic Lymphocytic Leukemia/Normal B cells |
| TJU_CMC.ID08849.3p-miR | 2.428322284 | 0.032381642 | Chronic Lymphocytic Leukemia/Normal B cells |
| TJU_CMC.ID03819.3p-miR | −2.959305937 | 0.032487237 | Chronic Lymphocytic Leukemia/Normal B cells |
| TJU_CMC.ID05844.3p-miR | −2.901395389 | 0.032863215 | Chronic Lymphocytic Leukemia/Normal B cells |
| TJU_CMC.ID00123.5p-miR | −2.589222168 | 0.03303298 | Chronic Lymphocytic Leukemia/Normal B cells |
| TJU_CMC.ID05538.5p-miR | −3.518323724 | 0.033311984 | Chronic Lymphocytic Leukemia/Normal B cells |
| TJU_CMC_MD2.ID01155.5p-miR | −4.328614352 | 0.033315366 | Chronic Lymphocytic Leukemia/Normal B cells |
| TJU_CMC.ID05868.3p-miR | 2.381088277 | 0.006854152 | Stage 1 Gastric Cancer/Normal Gastric Tissue |
| TJU_CMC.ID04089.5p-miR | −6.938537055 | 0.033396886 | Chronic Lymphocytic Leukemia/Normal B cells |
| TJU_CMC.ID00604.5p-miR | −2.183178506 | 0.006979761 | Stage 1 Gastric Cancer/Normal Gastric Tissue |
| TJU_CMC.ID05105.3p-miR | −3.748274568 | 0.033879031 | Chronic Lymphocytic Leukemia/Normal B cells |
| TJU_CMC.ID07218.3p-miR | −2.845161695 | 0.03388715 | Chronic Lymphocytic Leukemia/Normal B cells |
| TJU_CMC.ID05399.3p-miR | −5.443303801 | 0.034175132 | Chronic Lymphocytic Leukemia/Normal B cells |
| TJU_CMC_MD2.ID02704.3p-miR | −2.863958791 | 0.034174026 | Chronic Lymphocytic Leukemia/Normal B cells |
| TJU_CMC.ID04691.5p-miR | −2.373867578 | 0.007247164 | Stage 1 Gastric Cancer/Normal Gastric Tissue |
| TJU_CMC.ID08017.3p-miR | −1.960032406 | 0.007208365 | Stage 1 Gastric Cancer/Normal Gastric Tissue |
| TJU_CMC.ID08439.5p-miR | 2.619626927 | 0.028759019 | Breast Cancer (adenoid/apocrine/atypical/DCIS/IDC/metaplastic)/Normal Breast Tissue (GEO: GSE28884) |
| TJU_CMC.ID06040.5p-miR | −2.950733453 | 0.034656982 | Chronic Lymphocytic Leukemia/Normal B cells |
| TJU_CMC.ID06732.5p-miR | −8.486934482 | 0.034845755 | Chronic Lymphocytic Leukemia/Normal B cells |
| TJU_CMC_MD2.ID00235.5p-miR | 2.758952353 | 0.035035243 | Chronic Lymphocytic Leukemia/Normal B cells |
| TJU_CMC.ID01649.3p-miR | 2.2909278 | 0.035157649 | Chronic Lymphocytic Leukemia/Normal B cells |
| TJU_CMC.ID05869.3p-miR | 2.48044966 | 0.035575191 | Chronic Lymphocytic Leukemia/Normal B cells |
| TJU_CMC.ID08031.5p-miR | −3.266960297 | 0.035568557 | Chronic Lymphocytic Leukemia/Normal B cells |
| TJU_CMC.ID09363.5p-miR | 2.109515609 | 0.035580324 | Chronic Lymphocytic Leukemia/Normal B cells |
| TJU_CMC_MD2.ID00891.5p-miR | −3.542326164 | 0.035508611 | Chronic Lymphocytic Leukemia/Normal B cells |
| TJU_CMC.ID00512.3p-miR | −1.585565585 | 0.035922998 | Chronic Lymphocytic Leukemia/Normal B cells |
| TJU_CMC.ID02417.5p-miR | 3.252147992 | 0.03593434 | Chronic Lymphocytic Leukemia/Normal B cells |
| TJU_CMC.ID03110.3p-miR | 3.456131986 | 0.03585254 | Chronic Lymphocytic Leukemia/Normal B cells |
| TJU_CMC.ID09474.5p-miR | −2.926892522 | 0.035840209 | Chronic Lymphocytic Leukemia/Normal B cells |
| TJU_CMC.ID00167.5p-miR | 2.265225917 | 0.036221926 | Chronic Lymphocytic Leukemia/Normal B cells |
| TJU_CMC.ID00269.3p-miR | 3.553813176 | 0.00797452 | Stage 1 Gastric Cancer/Normal Gastric Tissue |
| TJU_CMC.ID01470.5p-miR | −2.412404392 | 0.007746582 | Stage 1 Gastric Cancer/Normal Gastric Tissue |
| TJU_CMC.ID01900.5p-miR | 2.062213287 | 0.007966914 | Stage 1 Gastric Cancer/Normal Gastric Tissue |
| TJU_CMC.ID01910.3p-miR | −2.876806803 | 0.00788604 | Stage 1 Gastric Cancer/Normal Gastric Tissue |
| TJU_CMC.ID02820.5p-miR | 2.137825806 | 0.007948537 | Stage 1 Gastric Cancer/Normal Gastric Tissue |
| TJU_CMC.ID06804.5p-miR | 2.759182496 | 0.007867192 | Stage 1 Gastric Cancer/Normal Gastric Tissue |
| TJU_CMC.ID07941.3p-miR | 3.564568697 | 0.007923931 | Stage 1 Gastric Cancer/Normal Gastric Tissue |
| TJU_CMC.ID08188.3p-miR | −4.859953321 | 0.00780588 | Stage 1 Gastric Cancer/Normal Gastric Tissue |
| TJU_CMC.ID09566.3p-miR | −2.499761469 | 0.007670309 | Stage 1 Gastric Cancer/Normal Gastric Tissue |
| TJU_CMC.ID03020.5p-miR | −2.513997914 | 0.036537429 | Chronic Lymphocytic Leukemia/Normal B cells |
| TJU_CMC.ID02644.5p-miR | 2.924896392 | 0.036574534 | Chronic Lymphocytic Leukemia/Normal B cells |
| TJU_CMC.ID00853.3p-miR | 2.548731231 | 0.008132425 | Stage 1 Gastric Cancer/Normal Gastric Tissue |
| TJU_CMC.ID04896.3p-miR | −2.356304907 | 0.008138933 | Stage 1 Gastric Cancer/Normal Gastric Tissue |
| TJU_CMC.ID04233.3p-miR | 3.02093281 | 0.03676 | Chronic Lymphocytic Leukemia/Normal B cells |
| TJU_CMC.ID00467.3p-miR | 2.471447378 | 0.036877618 | Chronic Lymphocytic Leukemia/Normal B cells |
| TJU_CMC.ID02097.3p-miR | 3.427980707 | 0.008361803 | Stage 1 Gastric Cancer/Normal Gastric Tissue |
| TJU_CMC.ID05571.3p-miR | 2.5736205 | 0.008436838 | Stage 1 Gastric Cancer/Normal Gastric Tissue |
| TJU_CMC.ID09348.3p-miR | −2.540339155 | 0.008667802 | Stage 1 Gastric Cancer/Normal Gastric Tissue |
| TJU_CMC.ID08204.3p-miR | 2.473750463 | 0.038189412 | Chronic Lymphocytic Leukemia/Normal B cells |
| TJU_CMC.ID08793.5p-miR | −2.611932298 | 0.008750634 | Stage 1 Gastric Cancer/Normal Gastric Tissue |
| TJU_CMC.ID01742.3p-miR | −2.456680699 | 0.038466617 | Chronic Lymphocytic Leukemia/Normal B cells |
| TJU_CMC.ID04356.5p-miR | −4.540040887 | 0.03841956 | Chronic Lymphocytic Leukemia/Normal B cells |
| TJU_CMC.ID01789.5p-miR | −1.905920815 | 0.008923227 | Stage 1 Gastric Cancer/Normal Gastric Tissue |
| TJU_CMC.ID04702.3p-miR | 2.428493724 | 0.009016307 | Stage 1 Gastric Cancer/Normal Gastric Tissue |
| TJU_CMC.ID08714.3p-miR | 2.357174319 | 0.008975537 | Stage 1 Gastric Cancer/Normal Gastric Tissue |
| TJU_CMC.ID06000.3p-miR | 2.829086018 | 0.038796939 | Chronic Lymphocytic Leukemia/Normal B cells |
| TJU_CMC.ID03049.3p-miR | 2.690202949 | 0.038943165 | Chronic Lymphocytic Leukemia/Normal B cells |
| TJU_CMC.ID00477.3p-miR | 2.075310793 | 0.009202389 | Stage 1 Gastric Cancer/Normal Gastric Tissue |
| TJU_CMC.ID01538.3p-miR | 1.974172003 | 0.009399986 | Stage 1 Gastric Cancer/Normal Gastric Tissue |
| TJU_CMC.ID08835.3p-miR | −2.678557786 | 0.009422952 | Stage 1 Gastric Cancer/Normal Gastric Tissue |
| TJU_CMC.ID01842.3p-miR | −2.175939651 | 0.009537435 | Stage 1 Gastric Cancer/Normal Gastric Tissue |
| TJU_CMC.ID08812.3p-miR | −2.388382571 | 0.039782219 | Chronic Lymphocytic Leukemia/Normal B cells |
| TJU_CMC.ID07949.5p-miR | 3.302646452 | 0.039894119 | Chronic Lymphocytic Leukemia/Normal B cells |
| TJU_CMC.ID02447.3p-miR | 2.535368209 | 0.040012763 | Chronic Lymphocytic Leukemia/Normal B cells |
| TJU_CMC.ID05372.3p-miR | −3.702075727 | 0.040103443 | Chronic Lymphocytic Leukemia/Normal B cells |
| TJU_CMC_MD2.ID02886.5p-miR | 2.722208909 | 0.040119191 | Chronic Lymphocytic Leukemia/Normal B cells |
| TJU_CMC.ID06513.5p-miR | 2.941490989 | 0.040341719 | Chronic Lymphocytic Leukemia/Normal B cells |
| TJU_CMC.ID02587.3p-miR | −2.853027083 | 0.040483761 | Chronic Lymphocytic Leukemia/Normal B cells |

TABLE 11-continued

Differential expression of miRNAs in tissues of various disease states

| Name | Log2 fold change of Set A/Set B | p-Val | Sets Compared (A/B) |
| --- | --- | --- | --- |
| TJU_CMC.ID05236.5p-miR | 2.255052835 | 0.040457277 | Chronic Lymphocytic Leukemia/Normal B cells |
| TJU_CMC.ID04253.5p-miR | −2.060363535 | 0.009923538 | Stage 1 Gastric Cancer/Normal Gastric Tissue |
| TJU_CMC.ID06838.5p-miR | −1.974424997 | 0.009915512 | Stage 1 Gastric Cancer/Normal Gastric Tissue |
| TJU_CMC.ID09040.5p-miR | 2.89714561 | 0.00981689 | Stage 1 Gastric Cancer/Normal Gastric Tissue |
| TJU_CMC.ID06200.5p-miR | 5.929738732 | 0.041116714 | Chronic Lymphocytic Leukemia/Normal B cells |
| TJU_CMC.ID04313.5p-miR | 2.689009758 | 0.041411831 | Chronic Lymphocytic Leukemia/Normal B cells |
| TJU_CMC.ID07911.3p-miR | −2.762768146 | 0.041579908 | Chronic Lymphocytic Leukemia/Normal B cells |
| TJU_CMC.ID00469.5p-miR | 2.654255133 | 0.041653536 | Chronic Lymphocytic Leukemia/Normal B cells |
| TJU_CMC.ID03307.5p-miR | 2.667635911 | 0.041794598 | Chronic Lymphocytic Leukemia/Normal B cells |
| TJU_CMC.ID03971.5p-miR | −2.331922089 | 0.041708705 | Chronic Lymphocytic Leukemia/Normal B cells |
| TJU_CMC.ID00796.5p-miR | −2.70664484 | 0.010202348 | Stage 1 Gastric Cancer/Normal Gastric Tissue |
| TJU_CMC.ID04948.3p-miR | 2.226044701 | 0.010185066 | Stage 1 Gastric Cancer/Normal Gastric Tissue |
| TJU_CMC.ID03157.3p-miR | −2.674224631 | 0.042826516 | Chronic Lymphocytic Leukemia/Normal B cells |
| TJU_CMC.ID07044.5p-miR | −2.514589588 | 0.042517078 | Chronic Lymphocytic Leukemia/Normal B cells |
| TJU_CMC.ID07513.3p-miR | −2.667481055 | 0.04283258 | Chronic Lymphocytic Leukemia/Normal B cells |
| TJU_CMC.ID09174.5p-miR | −2.073064939 | 0.042602947 | Chronic Lymphocytic Leukemia/Normal B cells |
| TJU_CMC_MD2.ID00448.3p-miR | −2.815676604 | 0.042238491 | Chronic Lymphocytic Leukemia/Normal B cells |
| TJU_CMC_MD2.ID01627.5p-miR | −2.449972503 | 0.042376064 | Chronic Lymphocytic Leukemia/Normal B cells |
| TJU_CMC.ID02925.3p-miR | −2.791352543 | 0.043037206 | Chronic Lymphocytic Leukemia/Normal B cells |
| TJU_CMC.ID08008.3p-miR | 2.552995689 | 0.043247261 | Chronic Lymphocytic Leukemia/Normal B cells |
| TJU_CMC.ID04118.3p-miR | −1.966661969 | 0.010544399 | Stage 1 Gastric Cancer/Normal Gastric Tissue |
| TJU_CMC.ID05018.3p-miR | 1.987601722 | 0.010506792 | Stage 1 Gastric Cancer/Normal Gastric Tissue |
| TJU_CMC.ID05503.5p-miR | 5.113686357 | 0.010521132 | Stage 1 Gastric Cancer/Normal Gastric Tissue |
| TJU_CMC_MD2.ID03086.5p-miR | 2.885461243 | 0.010512505 | Stage 1 Gastric Cancer/Normal Gastric Tissue |
| TJU_CMC.ID01366.5p-miR | −2.560722335 | 0.043676335 | Chronic Lymphocytic Leukemia/Normal B cells |
| TJU_CMC.ID08624.3p-miR | −3.563081204 | 0.043626761 | Chronic Lymphocytic Leukemia/Normal B cells |
| TJU_CMC.ID06421.5p-miR | 2.461360557 | 0.043942278 | Chronic Lymphocytic Leukemia/Normal B cells |
| TJU_CMC.ID05772.5p-miR | 2.493499888 | 0.044083642 | Chronic Lymphocytic Leukemia/Normal B cells |
| TJU_CMC.ID01925.3p-miR | 2.572862146 | 0.044153843 | Chronic Lymphocytic Leukemia/Normal B cells |
| TJU_CMC.ID05711.5p-miR | 2.814087841 | 0.044727116 | Chronic Lymphocytic Leukemia/Normal B cells |
| TJU_CMC.ID01536.3p-miR | −4.105353872 | 0.044982419 | Chronic Lymphocytic Leukemia/Normal B cells |
| TJU_CMC.ID06984.3p-miR | −2.67863973 | 0.045340989 | Chronic Lymphocytic Leukemia/Normal B cells |
| TJU_CMC.ID01926.3p-miR | 5.115238652 | 0.045633062 | Chronic Lymphocytic Leukemia/Normal B cells |
| TJU_CMC.ID04621.5p-miR | 11.43699463 | 0.045793414 | Chronic Lymphocytic Leukemia/Normal B cells |
| TJU_CMC_MD2.ID02236.3p-miR | −2.022691596 | 0.045777842 | Chronic Lymphocytic Leukemia/Normal B cells |
| TJU_CMC.ID00599.3p-miR | 2.745303697 | 0.045982413 | Chronic Lymphocytic Leukemia/Normal B cells |
| TJU_CMC.ID06814.3p-miR | −3.100226571 | 0.046031206 | Chronic Lymphocytic Leukemia/Normal B cells |
| TJU_CMC.ID08511.3p-miR | 2.144631348 | 0.046138461 | Chronic Lymphocytic Leukemia/Normal B cells |
| TJU_CMC.ID05662.5p-miR | 4.003914487 | 0.046965172 | Chronic Lymphocytic Leukemia/Normal B cells |
| TJU_CMC.ID05481.5p-miR | 5.631202084 | 0.047061598 | Chronic Lymphocytic Leukemia/Normal B cells |
| TJU_CMC.ID02239.5p-miR | 1.666720863 | 0.047287595 | Chronic Lymphocytic Leukemia/Normal B cells |
| TJU_CMC.ID03380.5p-miR | 2.74818524 | 0.047370756 | Chronic Lymphocytic Leukemia/Normal B cells |
| TJU_CMC.ID04832.5p-miR | −2.503859524 | 0.047279009 | Chronic Lymphocytic Leukemia/Normal B cells |
| TJU_CMC.ID05861.5p-miR | 2.727277509 | 0.047371096 | Chronic Lymphocytic Leukemia/Normal B cells |
| TJU_CMC.ID02422.3p-miR | 2.133753278 | 0.011528269 | Stage 1 Gastric Cancer/Normal Gastric Tissue |
| TJU_CMC.ID08218.5p-miR | 6.641461595 | 0.047959303 | Chronic Lymphocytic Leukemia/Normal B cells |
| TJU_CMC.ID00473.3p-miR | 1.751557155 | 0.011781402 | Stage 1 Gastric Cancer/Normal Gastric Tissue |
| TJU_CMC.ID04227.5p-miR | 2.545716489 | 0.048385438 | Chronic Lymphocytic Leukemia/Normal B cells |
| TJU_CMC.ID08725.3p-miR | −10.72268832 | 0.048771568 | Chronic Lymphocytic Leukemia/Normal B cells |
| TJU_CMC.ID00431.5p-miR | 2.148214933 | 0.048901953 | Chronic Lymphocytic Leukemia/Normal B cells |
| TJU_CMC.ID01155.3p-miR | −4.671805316 | 0.049206737 | Chronic Lymphocytic Leukemia/Normal B cells |
| TJU_CMC.ID02221.5p-miR | −2.340384796 | 0.049640476 | Chronic Lymphocytic Leukemia/Normal B cells |
| TJU_CMC.ID00234.3p-miR | −3.547988725 | 0.049841816 | Chronic Lymphocytic Leukemia/Normal B cells |
| TJU_CMC.ID06607.3p-miR | 2.424293579 | 0.049864733 | Chronic Lymphocytic Leukemia/Normal B cells |
| TJU_CMC.ID08109.3p-miR | 2.655905187 | 0.049787226 | Chronic Lymphocytic Leukemia/Normal B cells |
| TJU_CMC.ID00215.3p-miR | −1.885337275 | 0.011970371 | Stage 1 Gastric Cancer/Normal Gastric Tissue |
| TJU_CMC.ID05108.3p-miR | 2.582621485 | 0.011935898 | Stage 1 Gastric Cancer/Normal Gastric Tissue |
| TJU_CMC.ID02577.5p-miR | 2.317229523 | 0.012067212 | Stage 1 Gastric Cancer/Normal Gastric Tissue |
| TJU_CMC.ID05561.5p-miR | −1.789531226 | 0.012278689 | Stage 1 Gastric Cancer/Normal Gastric Tissue |
| TJU_CMC.ID07189.5p-miR | 1.716924712 | 0.012380786 | Stage 1 Gastric Cancer/Normal Gastric Tissue |
| TJU_CMC.ID07383.5p-miR | 1.820527264 | 0.012532463 | Stage 1 Gastric Cancer/Normal Gastric Tissue |
| TJU_CMC.ID07957.5p-miR | −1.935121699 | 0.012588246 | Stage 1 Gastric Cancer/Normal Gastric Tissue |
| TJU_CMC.ID07520.3p-miR | −2.783427678 | 0.012704742 | Stage 1 Gastric Cancer/Normal Gastric Tissue |
| TJU_CMC.ID00375.3p-miR | −2.131326172 | 0.013098444 | Stage 1 Gastric Cancer/Normal Gastric Tissue |
| TJU_CMC.ID01864.5p-miR | 1.643025886 | 0.012849988 | Stage 1 Gastric Cancer/Normal Gastric Tissue |
| TJU_CMC.ID04851.3p-miR | 2.241577679 | 0.01310761 | Stage 1 Gastric Cancer/Normal Gastric Tissue |
| TJU_CMC.ID08174.3p-miR | 1.681512554 | 0.013319781 | Stage 1 Gastric Cancer/Normal Gastric Tissue |
| TJU_CMC.ID09722.3p-miR | −0.986418344 | 0.024951349 | ER− Breast Cancer/ER+ Breast Cancer (TCGA) |
| TJU_CMC.ID00579.3p-miR | −3.598339659 | 0.013560547 | Stage 1 Gastric Cancer/Normal Gastric Tissue |
| TJU_CMC.ID02730.5p-miR | −1.818547003 | 0.013562724 | Stage 1 Gastric Cancer/Normal Gastric Tissue |
| TJU_CMC.ID04620.5p-miR | 2.649212636 | 0.013587286 | Stage 1 Gastric Cancer/Normal Gastric Tissue |
| TJU_CMC.ID03538.3p-miR | 2.582017311 | 0.037828562 | Breast Cancer (adenoid/apocrine/atypical/DCIS/IDC/metaplastic)/Normal Breast Tissue (GEO: GSE28884) |

TABLE 11-continued

Differential expression of miRNAs in tissues of various disease states

| Name | Log2 fold change of Set A/Set B | p-Val | Sets Compared (A/B) |
| --- | --- | --- | --- |
| TJU_CMC.ID02628.3p-miR | −2.201026055 | 0.013732821 | Stage 1 Gastric Cancer/Normal Gastric Tissue |
| TJU_CMC.ID07261.5p-miR | 2.189831384 | 0.01389691 | Stage 1 Gastric Cancer/Normal Gastric Tissue |
| TJU_CMC.ID01297.3p-miR | 3.390718513 | 0.000847778 | PBMC Scleroderma Patients/PBMC Control Individuals |
| TJU_CMC.ID00654.5p-miR | 3.454910509 | 0.000915643 | PBMC Scleroderma Patients/PBMC Control Individuals |
| TJU_CMC.ID05313.5p-miR | −3.764364769 | 0.040079878 | Breast Cancer (adenoid/apocrine/atypical/DCIS/IDC/metaplastic)/Normal Breast Tissue (GEO: GSE28884) |
| TJU_CMC.ID00921.3p-miR | −3.350218667 | 0.014497451 | Stage 1 Gastric Cancer/Normal Gastric Tissue |
| TJU_CMC_MD2.ID00492.5p-miR | −1.620933739 | 0.027178806 | ER− Breast Cancer/ER+ Breast Cancer (TCGA) |
| TJU_CMC.ID01025.5p-miR | 2.811768795 | 0.015092124 | Stage 1 Gastric Cancer/Normal Gastric Tissue |
| TJU_CMC.ID05045.3p-miR | 2.405659845 | 0.015056884 | Stage 1 Gastric Cancer/Normal Gastric Tissue |
| TJU_CMC.ID07022.5p-miR | 5.684162776 | 0.015055519 | Stage 1 Gastric Cancer/Normal Gastric Tissue |
| TJU_CMC.ID08442.5p-miR | 2.725006334 | 0.014965452 | Stage 1 Gastric Cancer/Normal Gastric Tissue |
| TJU_CMC.ID04423.3p-miR | −1.725831913 | 0.015145701 | Stage 1 Gastric Cancer/Normal Gastric Tissue |
| TJU_CMC.ID05148.5p-miR | −2.235695907 | 0.015232917 | Stage 1 Gastric Cancer/Normal Gastric Tissue |
| TJU_CMC.ID07709.5p-miR | −2.024192806 | 0.015314902 | Stage 1 Gastric Cancer/Normal Gastric Tissue |
| TJU_CMC_MD2.ID00121.5p-miR | −0.715200567 | 0.028326407 | ER− Breast Cancer/ER+ Breast Cancer (TCGA) |
| TJU_CMC.ID05312.5p-miR | −2.171325441 | 0.016199312 | Stage 1 Gastric Cancer/Normal Gastric Tissue |
| TJU_CMC.ID06773.3p-miR | 2.47772879 | 0.016239106 | Stage 1 Gastric Cancer/Normal Gastric Tissue |
| TJU_CMC.ID08458.3p-miR | −2.453214057 | 0.016075598 | Stage 1 Gastric Cancer/Normal Gastric Tissue |
| TJU_CMC.ID01174.5p-miR | 4.539765114 | 0.016909714 | Stage 1 Gastric Cancer/Normal Gastric Tissue |
| TJU_CMC.ID00909.5p-miR | −2.266728504 | 0.01735875 | Stage 1 Gastric Cancer/Normal Gastric Tissue |
| TJU_CMC.ID03916.3p-miR | 2.045002013 | 0.017418935 | Stage 1 Gastric Cancer/Normal Gastric Tissue |
| TJU_CMC.ID08289.5p-miR | −2.161273244 | 0.017696904 | Stage 1 Gastric Cancer/Normal Gastric Tissue |
| TJU_CMC.ID01819.5p-miR | 2.295373401 | 0.01783452 | Stage 1 Gastric Cancer/Normal Gastric Tissue |
| TJU_CMC.ID08998.3p-miR | −2.005443142 | 0.017866735 | Stage 1 Gastric Cancer/Normal Gastric Tissue |
| TJU_CMC.ID00512.3p-miR | 2.252872227 | 0.018141777 | Stage 1 Gastric Cancer/Normal Gastric Tissue |
| TJU_CMC.ID02102.3p-miR | 2.36718115 | 0.018321663 | Stage 1 Gastric Cancer/Normal Gastric Tissue |
| TJU_CMC.ID04681.3p-miR | −2.176188804 | 0.018286169 | Stage 1 Gastric Cancer/Normal Gastric Tissue |
| TJU_CMC.ID05039.5p-miR | −1.953170666 | 0.018285911 | Stage 1 Gastric Cancer/Normal Gastric Tissue |
| TJU_CMC.ID07345.5p-miR | 1.837615276 | 0.018278214 | Stage 1 Gastric Cancer/Normal Gastric Tissue |
| TJU_CMC.ID07698.3p-miR | 2.310253622 | 0.018146438 | Stage 1 Gastric Cancer/Normal Gastric Tissue |
| TJU_CMC.ID06033.5p-miR | 2.492889092 | 0.018503478 | Stage 1 Gastric Cancer/Normal Gastric Tissue |
| TJU_CMC.ID08663.3p-miR | 2.385002504 | 0.018459247 | Stage 1 Gastric Cancer/Normal Gastric Tissue |
| TJU_CMC.ID01474.3p-miR | 2.175335304 | 0.018752613 | Stage 1 Gastric Cancer/Normal Gastric Tissue |
| TJU_CMC.ID06994.3p-miR | 1.770534605 | 0.019217521 | Stage 1 Gastric Cancer/Normal Gastric Tissue |
| TJU_CMC.ID07215.5p-miR | −2.02153499 | 0.01920981 | Stage 1 Gastric Cancer/Normal Gastric Tissue |
| TJU_CMC.ID02450.5p-miR | 3.074617894 | 0.019501436 | Stage 1 Gastric Cancer/Normal Gastric Tissue |
| TJU_CMC.ID03700.3p-miR | 2.022040445 | 0.019483381 | Stage 1 Gastric Cancer/Normal Gastric Tissue |
| TJU_CMC.ID00543.3p-miR | −2.559793688 | 0.020403857 | Stage 1 Gastric Cancer/Normal Gastric Tissue |
| TJU_CMC.ID04635.5p-miR | −1.768150111 | 0.020050026 | Stage 1 Gastric Cancer/Normal Gastric Tissue |
| TJU_CMC.ID05313.5p-miR | 2.332004891 | 0.020192941 | Stage 1 Gastric Cancer/Normal Gastric Tissue |
| TJU_CMC.ID08825.5p-miR | 2.129189041 | 0.020016639 | Stage 1 Gastric Cancer/Normal Gastric Tissue |
| TJU_CMC.ID02254.5p-miR | 0.846597348 | 0.030022777 | PR− Breast Cancer/PR+ Breast Cancer (TCGA) |
| TJU_CMC.ID06634.3p-miR | 2.793694953 | 0.020783262 | Stage 1 Gastric Cancer/Normal Gastric Tissue |
| TJU_CMC.ID07607.3p-miR | −1.755779331 | 0.020832546 | Stage 1 Gastric Cancer/Normal Gastric Tissue |
| TJU_CMC.ID02033.5p-miR | −2.025781962 | 0.021296034 | Stage 1 Gastric Cancer/Normal Gastric Tissue |
| TJU_CMC.ID09450.3p-miR | 4.075418332 | 0.021239077 | Stage 1 Gastric Cancer/Normal Gastric Tissue |
| TJU_CMC.ID07790.5p-miR | −3.448884632 | 0.000406238 | Gastric Cancer (All Stages)/Normal Gastric Tissue |
| TJU_CMC.ID04803.5p-miR | −1.6802627 | 0.021607623 | Stage 1 Gastric Cancer/Normal Gastric Tissue |
| TJU_CMC.ID01178.5p-miR | 2.113761409 | 0.022144989 | Stage 1 Gastric Cancer/Normal Gastric Tissue |
| TJU_CMC.ID01987.5p-miR | 2.338536342 | 0.02197785 | Stage 1 Gastric Cancer/Normal Gastric Tissue |
| TJU_CMC.ID06322.5p-miR | −2.288854644 | 0.022044522 | Stage 1 Gastric Cancer/Normal Gastric Tissue |
| TJU_CMC.ID06548.3p-miR | −2.35561253 | 0.022687276 | Stage 1 Gastric Cancer/Normal Gastric Tissue |
| TJU_CMC.ID03007.3p-miR | −4.782773106 | 0.023567016 | Stage 1 Gastric Cancer/Normal Gastric Tissue |
| TJU_CMC.ID05203.3p-miR | 1.645460066 | 0.023573626 | Stage 1 Gastric Cancer/Normal Gastric Tissue |
| TJU_CMC.ID02573.5p-miR | 1.910333851 | 0.023943836 | Stage 1 Gastric Cancer/Normal Gastric Tissue |
| TJU_CMC_MD2.ID00121.5p-miR | −0.677750071 | 0.036899736 | PR− Breast Cancer/PR+ Breast Cancer (TCGA) |
| TJU_CMC.ID01756.3p-miR | 1.800767716 | 0.024285856 | Stage 1 Gastric Cancer/Normal Gastric Tissue |
| TJU_CMC.ID04427.3p-miR | 1.777738941 | 0.024584722 | Stage 1 Gastric Cancer/Normal Gastric Tissue |
| TJU_CMC.ID09661.5p-miR | −2.13052798 | 0.024499508 | Stage 1 Gastric Cancer/Normal Gastric Tissue |
| TJU_CMC.ID03290.3p-miR | 1.861979216 | 0.024898137 | Stage 1 Gastric Cancer/Normal Gastric Tissue |
| TJU_CMC.ID04435.5p-miR | 1.901680316 | 0.025033691 | Stage 1 Gastric Cancer/Normal Gastric Tissue |
| TJU_CMC.ID03542.5p-miR | 1.458859282 | 0.025368833 | Stage 1 Gastric Cancer/Normal Gastric Tissue |
| TJU_CMC.ID01979.3p-miR | −2.200462458 | 0.026533005 | Stage 1 Gastric Cancer/Normal Gastric Tissue |
| TJU_CMC.ID02232.3p-miR | 2.820569719 | 0.026297322 | Stage 1 Gastric Cancer/Normal Gastric Tissue |
| TJU_CMC.ID02658.5p-miR | −2.091347003 | 0.025541927 | Stage 1 Gastric Cancer/Normal Gastric Tissue |
| TJU_CMC.ID03781.3p-miR | 3.583905629 | 0.026450254 | Stage 1 Gastric Cancer/Normal Gastric Tissue |
| TJU_CMC.ID05049.5p-miR | −2.160540938 | 0.025854201 | Stage 1 Gastric Cancer/Normal Gastric Tissue |
| TJU_CMC.ID06537.3p-miR | 2.90612632 | 0.025947367 | Stage 1 Gastric Cancer/Normal Gastric Tissue |
| TJU_CMC.ID08597.5p-miR | −1.657859844 | 0.025898359 | Stage 1 Gastric Cancer/Normal Gastric Tissue |
| TJU_CMC.ID09273.3p-miR | 3.49373008 | 0.02566989 | Stage 1 Gastric Cancer/Normal Gastric Tissue |
| TJU_CMC.ID03886.3p-miR | 3.846813383 | 0.027325624 | Stage 1 Gastric Cancer/Normal Gastric Tissue |
| TJU_CMC.ID00362.3p-miR | 2.004690628 | 0.027537299 | Stage 1 Gastric Cancer/Normal Gastric Tissue |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID04015.5p-miR | −1.696789953 | 0.027738226 | Stage 1 Gastric Cancer/Normal Gastric Tissue |
| TJU_CMC.ID04848.3p-miR | 1.504367112 | 0.027970622 | Stage 1 Gastric Cancer/Normal Gastric Tissue |
| TJU_CMC.ID00399.3p-miR | 1.86923165 | 0.028478098 | Stage 1 Gastric Cancer/Normal Gastric Tissue |
| TJU_CMC.ID02696.5p-miR | 3.394279871 | 0.028852121 | Stage 1 Gastric Cancer/Normal Gastric Tissue |
| TJU_CMC.ID03641.5p-miR | −1.537500732 | 0.028218629 | Stage 1 Gastric Cancer/Normal Gastric Tissue |
| TJU_CMC.ID03895.5p-miR | 2.117157524 | 0.028771843 | Stage 1 Gastric Cancer/Normal Gastric Tissue |
| TJU_CMC.ID05169.3p-miR | −2.254702741 | 0.02873992 | Stage 1 Gastric Cancer/Normal Gastric Tissue |
| TJU_CMC.ID07831.3p-miR | 1.857964134 | 0.028906939 | Stage 1 Gastric Cancer/Normal Gastric Tissue |
| TJU_CMC.ID09027.5p-miR | −1.730870257 | 0.028240138 | Stage 1 Gastric Cancer/Normal Gastric Tissue |
| TJU_CMC.ID09251.3p-miR | 2.099237579 | 0.028783856 | Stage 1 Gastric Cancer/Normal Gastric Tissue |
| TJU_CMC.ID00316.5p-miR | 5.391193344 | 0.029285182 | Stage 1 Gastric Cancer/Normal Gastric Tissue |
| TJU_CMC.ID02122.5p-miR | −2.083758565 | 0.02957992 | Stage 1 Gastric Cancer/Normal Gastric Tissue |
| TJU_CMC.ID06120.5p-miR | 10.07874658 | 0.029951987 | Stage 1 Gastric Cancer/Normal Gastric Tissue |
| TJU_CMC.ID02928.3p-miR | 1.439304727 | 0.030421372 | Stage 1 Gastric Cancer/Normal Gastric Tissue |
| TJU_CMC.ID01384.3p-miR | −1.514093873 | 0.030652927 | Stage 1 Gastric Cancer/Normal Gastric Tissue |
| TJU_CMC.ID00657.5p-miR | −1.95472253 | 0.031165954 | Stage 1 Gastric Cancer/Normal Gastric Tissue |
| TJU_CMC.ID06067.5p-miR | 2.020483018 | 0.031338715 | Stage 1 Gastric Cancer/Normal Gastric Tissue |
| TJU_CMC.ID06171.5p-miR | 2.192147142 | 0.031661783 | Stage 1 Gastric Cancer/Normal Gastric Tissue |
| TJU_CMC.ID07621.5p-miR | −1.627568334 | 0.031656234 | Stage 1 Gastric Cancer/Normal Gastric Tissue |
| TJU_CMC.ID01475.5p-miR | −1.650495677 | 0.032045423 | Stage 1 Gastric Cancer/Normal Gastric Tissue |
| TJU_CMC.ID05551.3p-miR | 1.743804934 | 0.031958613 | Stage 1 Gastric Cancer/Normal Gastric Tissue |
| TJU_CMC.ID05497.5p-miR | −1.925503003 | 0.032980165 | Stage 1 Gastric Cancer/Normal Gastric Tissue |
| TJU_CMC.ID06140.3p-miR | −3.695678844 | 0.032857827 | Stage 1 Gastric Cancer/Normal Gastric Tissue |
| TJU_CMC.ID05355.5p-miR | −1.668282195 | 0.033340954 | Stage 1 Gastric Cancer/Normal Gastric Tissue |
| TJU_CMC.ID01897.5p-miR | −1.670761008 | 0.034026544 | Stage 1 Gastric Cancer/Normal Gastric Tissue |
| TJU_CMC.ID07980.3p-miR | 1.947577562 | 0.033775432 | Stage 1 Gastric Cancer/Normal Gastric Tissue |
| TJU_CMC.ID00655.5p-miR | 1.724749947 | 0.034445379 | Stage 1 Gastric Cancer/Normal Gastric Tissue |
| TJU_CMC.ID07746.3p-miR | −1.512560985 | 0.035394075 | Stage 1 Gastric Cancer/Normal Gastric Tissue |
| TJU_CMC.ID00649.3p-miR | −1.417671335 | 0.036131597 | Stage 1 Gastric Cancer/Normal Gastric Tissue |
| TJU_CMC.ID01354.5p-miR | −1.568861306 | 0.036080821 | Stage 1 Gastric Cancer/Normal Gastric Tissue |
| TJU_CMC.ID04796.5p-miR | −2.01546058 | 0.036177296 | Stage 1 Gastric Cancer/Normal Gastric Tissue |
| TJU_CMC.ID05864.5p-miR | −3.573410271 | 0.035660449 | Stage 1 Gastric Cancer/Normal Gastric Tissue |
| TJU_CMC.ID07502.3p-miR | 1.743984055 | 0.035703936 | Stage 1 Gastric Cancer/Normal Gastric Tissue |
| TJU_CMC.ID07611.5p-miR | −1.714093241 | 0.035869892 | Stage 1 Gastric Cancer/Normal Gastric Tissue |
| TJU_CMC.ID01593.3p-miR | 1.605664473 | 0.036412631 | Stage 1 Gastric Cancer/Normal Gastric Tissue |
| TJU_CMC.ID03574.5p-miR | −1.664336846 | 0.036445651 | Stage 1 Gastric Cancer/Normal Gastric Tissue |
| TJU_CMC.ID02897.3p-miR | 1.359871297 | 0.036639227 | Stage 1 Gastric Cancer/Normal Gastric Tissue |
| TJU_CMC.ID00028.5p-miR | 999999 | 0.037217161 | Stage 1 Gastric Cancer/Normal Gastric Tissue |
| TJU_CMC.ID06935.5p-miR | 1.970997085 | 0.037249063 | Stage 1 Gastric Cancer/Normal Gastric Tissue |
| TJU_CMC.ID00529.5p-miR | −1.87499046 | 0.037915223 | Stage 1 Gastric Cancer/Normal Gastric Tissue |
| TJU_CMC.ID03321.3p-miR | 2.510429351 | 0.038074992 | Stage 1 Gastric Cancer/Normal Gastric Tissue |
| TJU_CMC.ID05942.5p-miR | −2.052000935 | 0.0380364 | Stage 1 Gastric Cancer/Normal Gastric Tissue |
| TJU_CMC.ID01056.3p-miR | 2.323343113 | 0.038188637 | Stage 1 Gastric Cancer/Normal Gastric Tissue |
| TJU_CMC.ID02982.3p-miR | 1.827891802 | 0.038229827 | Stage 1 Gastric Cancer/Normal Gastric Tissue |
| TJU_CMC.ID01560.3p-miR | 1.561285467 | 0.038391402 | Stage 1 Gastric Cancer/Normal Gastric Tissue |
| TJU_CMC.ID02513.5p-miR | 1.935460253 | 0.038528593 | Stage 1 Gastric Cancer/Normal Gastric Tissue |
| TJU_CMC.ID01950.5p-miR | −1.740687512 | 0.038938428 | Stage 1 Gastric Cancer/Normal Gastric Tissue |
| TJU_CMC.ID00712.3p-miR | −3.578820565 | 0.000802636 | Gastric Cancer (All Stages)/Normal Gastric Tissue |
| TJU_CMC.ID03003.3p-miR | −4.105448707 | 0.000602992 | Gastric Cancer (All Stages)/Normal Gastric Tissue |
| TJU_CMC_MD2.ID01679.5p-miR | −2.857222319 | 0.000800548 | Gastric Cancer (All Stages)/Normal Gastric Tissue |
| TJU_CMC.ID03818.3p-miR | 2.771556746 | 0.039337222 | Stage 1 Gastric Cancer/Normal Gastric Tissue |
| TJU_CMC.ID04845.5p-miR | −1.862684838 | 0.039680261 | Stage 1 Gastric Cancer/Normal Gastric Tissue |
| TJU_CMC.ID01893.3p-miR | −1.985105144 | 0.039854534 | Stage 1 Gastric Cancer/Normal Gastric Tissue |
| TJU_CMC.ID01219.5p-miR | −1.534319701 | 0.040088793 | Stage 1 Gastric Cancer/Normal Gastric Tissue |
| TJU_CMC.ID04676.3p-miR | −1.8439995 | 0.04021418 | Stage 1 Gastric Cancer/Normal Gastric Tissue |
| TJU_CMC.ID07163.3p-miR | −1.531242371 | 0.040236773 | Stage 1 Gastric Cancer/Normal Gastric Tissue |
| TJU_CMC.ID05587.5p-miR | 1.869978992 | 0.040353167 | Stage 1 Gastric Cancer/Normal Gastric Tissue |
| TJU_CMC.ID07537.5p-miR | −1.872554033 | 0.040625072 | Stage 1 Gastric Cancer/Normal Gastric Tissue |
| TJU_CMC.ID07356.3p-miR | −2.118855359 | 0.041199329 | Stage 1 Gastric Cancer/Normal Gastric Tissue |
| TJU_CMC.ID05439.5p-miR | 1.508153637 | 0.041577774 | Stage 1 Gastric Cancer/Normal Gastric Tissue |
| TJU_CMC.ID06989.3p-miR | 2.006062026 | 0.041594159 | Stage 1 Gastric Cancer/Normal Gastric Tissue |
| TJU_CMC.ID01444.3p-miR | 2.555115061 | 0.046060647 | Stage 1 Gastric Cancer/Normal Gastric Tissue |
| TJU_CMC.ID01479.3p-miR | 2.058604722 | 0.045693455 | Stage 1 Gastric Cancer/Normal Gastric Tissue |
| TJU_CMC.ID01480.3p-miR | 3.687615024 | 0.044941569 | Stage 1 Gastric Cancer/Normal Gastric Tissue |
| TJU_CMC.ID02100.3p-miR | 1.489891693 | 0.045528966 | Stage 1 Gastric Cancer/Normal Gastric Tissue |
| TJU_CMC.ID02150.3p-miR | 1.391882669 | 0.044235737 | Stage 1 Gastric Cancer/Normal Gastric Tissue |
| TJU_CMC.ID02856.5p-miR | −1.504663531 | 0.044931996 | Stage 1 Gastric Cancer/Normal Gastric Tissue |
| TJU_CMC.ID03480.3p-miR | −1.480600601 | 0.045814693 | Stage 1 Gastric Cancer/Normal Gastric Tissue |
| TJU_CMC.ID03814.3p-miR | −2.042242263 | 0.045171368 | Stage 1 Gastric Cancer/Normal Gastric Tissue |
| TJU_CMC.ID03817.3p-miR | 3.621894525 | 0.047175638 | Stage 1 Gastric Cancer/Normal Gastric Tissue |
| TJU_CMC.ID03994.5p-miR | −1.518059123 | 0.045706439 | Stage 1 Gastric Cancer/Normal Gastric Tissue |
| TJU_CMC.ID05164.5p-miR | −1.544533389 | 0.044049298 | Stage 1 Gastric Cancer/Normal Gastric Tissue |
| TJU_CMC.ID05184.3p-miR | 3.267063409 | 0.047372465 | Stage 1 Gastric Cancer/Normal Gastric Tissue |
| TJU_CMC.ID05337.3p-miR | 1.833858164 | 0.043601761 | Stage 1 Gastric Cancer/Normal Gastric Tissue |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID06035.3p-miR | −999999 | 0.042638355 | Stage 1 Gastric Cancer/Normal Gastric Tissue |
| TJU_CMC.ID06232.3p-miR | 3.246545679 | 0.046176078 | Stage 1 Gastric Cancer/Normal Gastric Tissue |
| TJU_CMC.ID06262.5p-miR | 1.698765745 | 0.043332951 | Stage 1 Gastric Cancer/Normal Gastric Tissue |
| TJU_CMC.ID06636.5p-miR | 1.919980395 | 0.04699867 | Stage 1 Gastric Cancer/Normal Gastric Tissue |
| TJU_CMC.ID06724.5p-miR | 2.168014304 | 0.045874228 | Stage 1 Gastric Cancer/Normal Gastric Tissue |
| TJU_CMC.ID07132.3p-miR | −1.721871795 | 0.046320233 | Stage 1 Gastric Cancer/Normal Gastric Tissue |
| TJU_CMC.ID07608.3p-miR | 1.628464608 | 0.04428472 | Stage 1 Gastric Cancer/Normal Gastric Tissue |
| TJU_CMC.ID07932.3p-miR | 2.369370345 | 0.04736313 | Stage 1 Gastric Cancer/Normal Gastric Tissue |
| TJU_CMC.ID08106.5p-miR | 1.786172532 | 0.042705749 | Stage 1 Gastric Cancer/Normal Gastric Tissue |
| TJU_CMC.ID09086.3p-miR | 1.758695636 | 0.042816967 | Stage 1 Gastric Cancer/Normal Gastric Tissue |
| TJU_CMC.ID09269.3p-miR | 2.219421129 | 0.04599574 | Stage 1 Gastric Cancer/Normal Gastric Tissue |
| TJU_CMC.ID09371.5p-miR | 1.896231138 | 0.043158252 | Stage 1 Gastric Cancer/Normal Gastric Tissue |
| TJU_CMC.ID05831.5p-miR | −4.761579292 | 0.048202506 | Stage 1 Gastric Cancer/Normal Gastric Tissue |
| TJU_CMC.ID00767.5p-miR | −2.527150757 | 0.048321 | Stage 1 Gastric Cancer/Normal Gastric Tissue |
| TJU_CMC.ID05812.5p-miR | −2.517265076 | 0.048359017 | Stage 1 Gastric Cancer/Normal Gastric Tissue |
| TJU_CMC.ID06419.5p-miR | −5.793641439 | 0.003012534 | MIA PaCa-2 cells/HPNE cells (Pancreas cell lines) |
| TJU_CMC.ID04247.5p-miR | 4.395280759 | 0.001679836 | PBMC Scleroderma Patients/PBMC Control Individuals |
| TJU_CMC.ID01210.3p-miR | 999999 | 0.049941853 | Stage 1 Gastric Cancer/Normal Gastric Tissue |
| TJU_CMC.ID03472.3p-miR | −1.475216055 | 0.049699193 | Stage 1 Gastric Cancer/Normal Gastric Tissue |
| TJU_CMC.ID03557.5p-miR | 1.533416634 | 0.049795982 | Stage 1 Gastric Cancer/Normal Gastric Tissue |
| TJU_CMC.ID00512.3p-miR | 2.029773173 | 0.002051085 | Gastric Cancer (All Stages)/Normal Gastric Tissue |
| TJU_CMC.ID01099.3p-miR | −3.269626886 | 0.001077378 | Gastric Cancer (All Stages)/Normal Gastric Tissue |
| TJU_CMC.ID02447.3p-miR | −3.138250987 | 0.001684081 | Gastric Cancer (All Stages)/Normal Gastric Tissue |
| TJU_CMC.ID03472.3p-miR | −2.770632211 | 0.002091258 | Gastric Cancer (All Stages)/Normal Gastric Tissue |
| TJU_CMC.ID03778.3p-miR | −2.566149717 | 0.001432757 | Gastric Cancer (All Stages)/Normal Gastric Tissue |
| TJU_CMC.ID04082.3p-miR | −2.292365086 | 0.001517484 | Gastric Cancer (All Stages)/Normal Gastric Tissue |
| TJU_CMC.ID04470.5p-miR | −9.863088018 | 0.001502956 | Gastric Cancer (All Stages)/Normal Gastric Tissue |
| TJU_CMC.ID06821.5p-miR | −3.25417007 | 0.002307217 | Gastric Cancer (All Stages)/Normal Gastric Tissue |
| TJU_CMC.ID06444.3p-miR | 1.653214013 | 0.000185226 | Hypo-reactive/Hyper-reactive (Platelets) |
| TJU_CMC.ID07305.3p-miR | 2.42654381 | 0.0002754 | Hypo-reactive/Hyper-reactive (Platelets) |
| TJU_CMC.ID09231.3p-miR | 2.335032738 | 0.000381281 | Hypo-reactive/Hyper-reactive (Platelets) |
| TJU_CMC.ID09257.3p-miR | 1.774945288 | 0.000320958 | Hypo-reactive/Hyper-reactive (Platelets) |
| TJU_CMC.ID06656.5p-miR | 2.943589432 | 0.002959778 | Gastric Cancer (All Stages)/Normal Gastric Tissue |
| TJU_CMC.ID00543.3p-miR | −2.952746517 | 0.002860035 | Gastric Cancer (All Stages)/Normal Gastric Tissue |
| TJU_CMC.ID03641.5p-miR | −1.737261622 | 0.003077421 | Gastric Cancer (All Stages)/Normal Gastric Tissue |
| TJU_CMC.ID06731.3p-miR | −2.157167272 | 0.002987265 | Gastric Cancer (All Stages)/Normal Gastric Tissue |
| TJU_CMC.ID06081.3p-miR | 1.613609556 | 0.000795092 | Hypo-reactive/Hyper-reactive (Platelets) |
| TJU_CMC.ID07748.3p-miR | 3.632924218 | 0.000734968 | Hypo-reactive/Hyper-reactive (Platelets) |
| TJU_CMC.ID08608.5p-miR | −4.761294513 | 0.000494056 | Hypo-reactive/Hyper-reactive (Platelets) |
| TJU_CMC.ID09409.5p-miR | 2.051129669 | 0.000679156 | Hypo-reactive/Hyper-reactive (Platelets) |
| TJU_CMC.ID01835.5p-miR | 3.18205863 | 0.002083819 | PBMC Scleroderma Patients/PBMC Control Individuals |
| TJU_CMC.ID06439.5p-miR | −1.977866648 | 0.000932038 | Hypo-reactive/Hyper-reactive (Platelets) |
| TJU_CMC.ID04635.5p-miR | −1.934426287 | 0.003545121 | Gastric Cancer (All Stages)/Normal Gastric Tissue |
| TJU_CMC.ID07938.3p-miR | 3.311028792 | 0.002242892 | PBMC Scleroderma Patients/PBMC Control Individuals |
| TJU_CMC.ID05537.5p-miR | 2.641046763 | 0.0026369 | PBMC Scleroderma Patients/PBMC Control Individuals |
| TJU_CMC.ID00225.3p-miR | 3.951746463 | 0.004153786 | Gastric Cancer (All Stages)/Normal Gastric Tissue |
| TJU_CMC.ID01606.3p-miR | 6.346718292 | 0.004046096 | Gastric Cancer (All Stages)/Normal Gastric Tissue |
| TJU_CMC.ID02015.5p-miR | −2.21281534 | 0.004111365 | Gastric Cancer (All Stages)/Normal Gastric Tissue |
| TJU_CMC.ID00641.5p-miR | 2.868879593 | 0.00453698 | Gastric Cancer (All Stages)/Normal Gastric Tissue |
| TJU_CMC.ID01724.5p-miR | 3.457748523 | 0.003316639 | PBMC Scleroderma Patients/PBMC Control Individuals |
| TJU_CMC.ID01869.5p-miR | −999999 | 0.003192327 | PBMC Scleroderma Patients/PBMC Control Individuals |
| TJU_CMC.ID01093.3p-miR | −2.897451699 | 0.004835397 | Gastric Cancer (All Stages)/Normal Gastric Tissue |
| TJU_CMC.ID02648.3p-miR | 2.950522108 | 0.004231351 | PBMC Scleroderma Patients/PBMC Control Individuals |
| TJU_CMC.ID04455.3p-miR | 999999 | 0.004199682 | PBMC Scleroderma Patients/PBMC Control Individuals |
| TJU_CMC.ID06720.3p-miR | 4.543488868 | 0.004329511 | PBMC Scleroderma Patients/PBMC Control Individuals |
| TJU_CMC.ID00955.3p-miR | 6.831164867 | 0.004772912 | PBMC Scleroderma Patients/PBMC Control Individuals |
| TJU_CMC.ID09015.3p-miR | 3.12609034 | 0.00483077 | PBMC Scleroderma Patients/PBMC Control Individuals |
| TJU_CMC.ID00649.3p-miR | −1.82174396 | 0.005864792 | Gastric Cancer (All Stages)/Normal Gastric Tissue |
| TJU_CMC.ID02426.3p-miR | 999999 | 0.00558375 | PBMC Scleroderma Patients/PBMC Control Individuals |
| TJU_CMC.ID01200.5p-miR | 5.20008035 | 0.005742175 | PBMC Scleroderma Patients/PBMC Control Individuals |
| TJU_CMC.ID05623.3p-miR | 2.925825533 | 0.005784479 | PBMC Scleroderma Patients/PBMC Control Individuals |
| TJU_CMC.ID00340.3p-miR | 1.993239112 | 0.001601574 | Hypo-reactive/Hyper-reactive (Platelets) |
| TJU_CMC.ID04683.5p-miR | 2.246604768 | 0.006516713 | Gastric Cancer (All Stages)/Normal Gastric Tissue |
| TJU_CMC.ID00956.5p-miR | −1.644563996 | 0.006872914 | Gastric Cancer (All Stages)/Normal Gastric Tissue |
| TJU_CMC.ID04312.3p-miR | −2.480319042 | 0.007310973 | Gastric Cancer (All Stages)/Normal Gastric Tissue |
| TJU_CMC.ID05355.5p-miR | −1.855768435 | 0.00715091 | Gastric Cancer (All Stages)/Normal Gastric Tissue |
| TJU_CMC.ID05823.5p-miR | 4.284212647 | 0.007316774 | Gastric Cancer (All Stages)/Normal Gastric Tissue |
| TJU_CMC.ID06673.3p-miR | −3.150401134 | 0.007470134 | Gastric Cancer (All Stages)/Normal Gastric Tissue |
| TJU_CMC.ID07039.3p-miR | 3.463613833 | 0.007037041 | Gastric Cancer (All Stages)/Normal Gastric Tissue |
| TJU_CMC.ID06649.3p-miR | −1.934587257 | 0.007616704 | Gastric Cancer (All Stages)/Normal Gastric Tissue |
| TJU_CMC.ID03702.5p-miR | 3.461908651 | 0.006315937 | PBMC Scleroderma Patients/PBMC Control Individuals |
| TJU_CMC.ID08197.5p-miR | −2.348254142 | 0.008018667 | Gastric Cancer (All Stages)/Normal Gastric Tissue |
| TJU_CMC.ID00773.5p-miR | 2.301016376 | 0.008162097 | Gastric Cancer (All Stages)/Normal Gastric Tissue |
| TJU_CMC.ID00912.5p-miR | 1.96238007 | 0.001862198 | Hypo-reactive/Hyper-reactive (Platelets) |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID00409.5p-miR | −1.824781674 | 0.010067209 | Gastric Cancer (All Stages)/Normal Gastric Tissue |
| TJU_CMC.ID02510.3p-miR | −1.939092573 | 0.010071596 | Gastric Cancer (All Stages)/Normal Gastric Tissue |
| TJU_CMC.ID02658.5p-miR | −2.196705585 | 0.009912383 | Gastric Cancer (All Stages)/Normal Gastric Tissue |
| TJU_CMC.ID08835.3p-miR | −2.675705482 | 0.009634574 | Gastric Cancer (All Stages)/Normal Gastric Tissue |
| TJU_CMC_MD2.ID00858.5p-miR | 4.323371122 | 0.010095344 | Gastric Cancer (All Stages)/Normal Gastric Tissue |
| TJU_CMC.ID00299.5p-miR | 3.787100783 | 0.010281539 | Gastric Cancer (All Stages)/Normal Gastric Tissue |
| TJU_CMC.ID05262.3p-miR | 3.427190631 | 0.007094902 | PBMC Scleroderma Patients/PBMC Control Individuals |
| TJU_CMC.ID03383.3p-miR | 3.451124625 | 0.00782853 | PBMC Scleroderma Patients/PBMC Control Individuals |
| TJU_CMC.ID07583.3p-miR | −4.673021177 | 0.007512288 | PBMC Scleroderma Patients/PBMC Control Individuals |
| TJU_CMC.ID08289.5p-miR | −2.373992253 | 0.010900817 | Gastric Cancer (All Stages)/Normal Gastric Tissue |
| TJU_CMC.ID03699.3p-miR | −1.742638842 | 0.011043398 | Gastric Cancer (All Stages)/Normal Gastric Tissue |
| TJU_CMC.ID01788.5p-miR | −999999 | 0.008110928 | PBMC Scleroderma Patients/PBMC Control Individuals |
| TJU_CMC.ID02580.5p-miR | 1.61352745 | 0.002330424 | Hypo-reactive/Hyper-reactive (Platelets) |
| TJU_CMC.ID00747.3p-miR | 1.691988375 | 0.003680397 | Hypo-reactive/Hyper-reactive (Platelets) |
| TJU_CMC.ID01720.5p-miR | 1.714723319 | 0.004129298 | Hypo-reactive/Hyper-reactive (Platelets) |
| TJU_CMC.ID02109.3p-miR | −1.975837467 | 0.004168064 | Hypo-reactive/Hyper-reactive (Platelets) |
| TJU_CMC.ID06436.3p-miR | 1.503891979 | 0.003179432 | Hypo-reactive/Hyper-reactive (Platelets) |
| TJU_CMC.ID07393.3p-miR | −1.619332054 | 0.004050664 | Hypo-reactive/Hyper-reactive (Platelets) |
| TJU_CMC.ID09218.5p-miR | 3.556651643 | 0.003192236 | Hypo-reactive/Hyper-reactive (Platelets) |
| TJU_CMC.ID00341.3p-miR | −1.726729129 | 0.011967311 | Gastric Cancer (All Stages)/Normal Gastric Tissue |
| TJU_CMC.ID09085.5p-miR | 2.437603929 | 0.012499213 | Gastric Cancer (All Stages)/Normal Gastric Tissue |
| TJU_CMC.ID07062.5p-miR | 1.574930362 | 0.00458083 | Hypo-reactive/Hyper-reactive (Platelets) |
| TJU_CMC.ID07941.3p-miR | 2.999225899 | 0.012768627 | Gastric Cancer (All Stages)/Normal Gastric Tissue |
| TJU_CMC.ID00107.3p-miR | −2.229420458 | 0.01311175 | Gastric Cancer (All Stages)/Normal Gastric Tissue |
| TJU_CMC.ID06672.3p-miR | 2.248698546 | 0.004908521 | Hypo-reactive/Hyper-reactive (Platelets) |
| TJU_CMC.ID03038.3p-miR | −1.908413945 | 0.01358092 | Gastric Cancer (All Stages)/Normal Gastric Tissue |
| TJU_CMC.ID03048.5p-miR | −2.237365771 | 0.00617588 | Hypo-reactive/Hyper-reactive (Platelets) |
| TJU_CMC.ID04575.5p-miR | 1.374083779 | 0.005749961 | Hypo-reactive/Hyper-reactive (Platelets) |
| TJU_CMC.ID07579.5p-miR | 1.513417789 | 0.005707046 | Hypo-reactive/Hyper-reactive (Platelets) |
| TJU_CMC.ID00117.3p-miR | −2.013676533 | 0.014763149 | Gastric Cancer (All Stages)/Normal Gastric Tissue |
| TJU_CMC.ID08644.5p-miR | 3.07740616 | 0.014681356 | Gastric Cancer (All Stages)/Normal Gastric Tissue |
| TJU_CMC.ID01789.5p-miR | −1.528641892 | 0.015622037 | Gastric Cancer (All Stages)/Normal Gastric Tissue |
| TJU_CMC.ID04560.3p-miR | 1.926472464 | 0.015686032 | Gastric Cancer (All Stages)/Normal Gastric Tissue |
| TJU_CMC.ID07132.3p-miR | −2.145459446 | 0.015765732 | Gastric Cancer (All Stages)/Normal Gastric Tissue |
| TJU_CMC.ID03166.3p-miR | −1.367271523 | 0.007441783 | Hypo-reactive/Hyper-reactive (Platelets) |
| TJU_CMC.ID06406.3p-miR | 1.503842206 | 0.007351872 | Hypo-reactive/Hyper-reactive (Platelets) |
| TJU_CMC.ID07180.5p-miR | 2.534389089 | 0.007426857 | Hypo-reactive/Hyper-reactive (Platelets) |
| TJU_CMC.ID02391.5p-miR | 2.065765985 | 0.017318452 | Gastric Cancer (All Stages)/Normal Gastric Tissue |
| TJU_CMC.ID09252.5p-miR | 1.45046237 | 0.008429204 | Hypo-reactive/Hyper-reactive (Platelets) |
| TJU_CMC.ID01025.5p-miR | 2.165904826 | 0.023339219 | Gastric Cancer (All Stages)/Normal Gastric Tissue |
| TJU_CMC.ID01304.5p-miR | 3.221546361 | 0.024071294 | Gastric Cancer (All Stages)/Normal Gastric Tissue |
| TJU_CMC.ID01746.5p-miR | −1.583604032 | 0.026592602 | Gastric Cancer (All Stages)/Normal Gastric Tissue |
| TJU_CMC.ID01910.3p-miR | −2.441311954 | 0.018396986 | Gastric Cancer (All Stages)/Normal Gastric Tissue |
| TJU_CMC.ID02033.5p-miR | −1.774828076 | 0.027084114 | Gastric Cancer (All Stages)/Normal Gastric Tissue |
| TJU_CMC.ID02628.3p-miR | −1.787353578 | 0.023789006 | Gastric Cancer (All Stages)/Normal Gastric Tissue |
| TJU_CMC.ID03007.3p-miR | −3.612174848 | 0.019862328 | Gastric Cancer (All Stages)/Normal Gastric Tissue |
| TJU_CMC.ID03895.5p-miR | 1.981250026 | 0.020003969 | Gastric Cancer (All Stages)/Normal Gastric Tissue |
| TJU_CMC.ID04157.3p-miR | −1.717742097 | 0.023237959 | Gastric Cancer (All Stages)/Normal Gastric Tissue |
| TJU_CMC.ID04253.5p-miR | −1.766416339 | 0.020243759 | Gastric Cancer (All Stages)/Normal Gastric Tissue |
| TJU_CMC.ID04299.5p-miR | 1.997983535 | 0.026818988 | Gastric Cancer (All Stages)/Normal Gastric Tissue |
| TJU_CMC.ID04423.3p-miR | −1.306189429 | 0.027161254 | Gastric Cancer (All Stages)/Normal Gastric Tissue |
| TJU_CMC.ID04427.3p-miR | 1.989335741 | 0.023912734 | Gastric Cancer (All Stages)/Normal Gastric Tissue |
| TJU_CMC.ID04609.5p-miR | −1.598892336 | 0.021224882 | Gastric Cancer (All Stages)/Normal Gastric Tissue |
| TJU_CMC.ID04627.3p-miR | −1.738444442 | 0.027126725 | Gastric Cancer (All Stages)/Normal Gastric Tissue |
| TJU_CMC.ID05571.3p-miR | 2.001384289 | 0.027073479 | Gastric Cancer (All Stages)/Normal Gastric Tissue |
| TJU_CMC.ID05587.5p-miR | 1.889486869 | 0.023685507 | Gastric Cancer (All Stages)/Normal Gastric Tissue |
| TJU_CMC.ID05831.5p-miR | −4.315550633 | 0.025696698 | Gastric Cancer (All Stages)/Normal Gastric Tissue |
| TJU_CMC.ID06140.3p-miR | −2.938939032 | 0.018689128 | Gastric Cancer (All Stages)/Normal Gastric Tissue |
| TJU_CMC.ID07032.3p-miR | −2.678233377 | 0.022403467 | Gastric Cancer (All Stages)/Normal Gastric Tissue |
| TJU_CMC.ID07163.3p-miR | −1.551579634 | 0.018813489 | Gastric Cancer (All Stages)/Normal Gastric Tissue |
| TJU_CMC.ID07328.3p-miR | −1.812228701 | 0.018202268 | Gastric Cancer (All Stages)/Normal Gastric Tissue |
| TJU_CMC.ID07621.5p-miR | −1.630123804 | 0.019632235 | Gastric Cancer (All Stages)/Normal Gastric Tissue |
| TJU_CMC.ID07831.3p-miR | 2.22789396 | 0.023659153 | Gastric Cancer (All Stages)/Normal Gastric Tissue |
| TJU_CMC.ID07957.5p-miR | −1.640732883 | 0.022518983 | Gastric Cancer (All Stages)/Normal Gastric Tissue |
| TJU_CMC.ID08188.3p-miR | −2.548460682 | 0.019403294 | Gastric Cancer (All Stages)/Normal Gastric Tissue |
| TJU_CMC.ID08433.5p-miR | 1.837320352 | 0.02452899 | Gastric Cancer (All Stages)/Normal Gastric Tissue |
| TJU_CMC.ID08542.3p-miR | −1.641071987 | 0.020214569 | Gastric Cancer (All Stages)/Normal Gastric Tissue |
| TJU_CMC.ID08726.5p-miR | 2.41129203 | 0.020897802 | Gastric Cancer (All Stages)/Normal Gastric Tissue |
| TJU_CMC.ID08763.5p-miR | 2.352548471 | 0.025146309 | Gastric Cancer (All Stages)/Normal Gastric Tissue |
| TJU_CMC.ID08919.5p-miR | −1.571636109 | 0.025768628 | Gastric Cancer (All Stages)/Normal Gastric Tissue |
| TJU_CMC.ID09200.5p-miR | 3.751805405 | 0.022814355 | Gastric Cancer (All Stages)/Normal Gastric Tissue |
| TJU_CMC.ID09566.3p-miR | −2.039506479 | 0.027493623 | Gastric Cancer (All Stages)/Normal Gastric Tissue |
| TJU_CMC.ID09661.5p-miR | −1.801675613 | 0.019398026 | Gastric Cancer (All Stages)/Normal Gastric Tissue |
| TJU_CMC.ID01161.5p-miR | −1.871147808 | 0.029528949 | Gastric Cancer (All Stages)/Normal Gastric Tissue |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID04906.3p-miR | −1.621951722 | 0.029550075 | Gastric Cancer (All Stages)/Normal Gastric Tissue |
| TJU_CMC.ID05795.3p-miR | 2.58568564 | 0.029598595 | Gastric Cancer (All Stages)/Normal Gastric Tissue |
| TJU_CMC.ID07769.3p-miR | 9.292014054 | 0.028305422 | Gastric Cancer (All Stages)/Normal Gastric Tissue |
| TJU_CMC.ID08178.3p-miR | −1.642677666 | 0.028858406 | Gastric Cancer (All Stages)/Normal Gastric Tissue |
| TJU_CMC.ID03480.3p-miR | −1.545934793 | 0.03021484 | Gastric Cancer (All Stages)/Normal Gastric Tissue |
| TJU_CMC.ID05411.3p-miR | 1.93344821 | 0.031313051 | Gastric Cancer (All Stages)/Normal Gastric Tissue |
| TJU_CMC.ID05815.3p-miR | −1.667436954 | 0.031498296 | Gastric Cancer (All Stages)/Normal Gastric Tissue |
| TJU_CMC.ID02123.5p-miR | −1.748033387 | 0.033136473 | Gastric Cancer (All Stages)/Normal Gastric Tissue |
| TJU_CMC.ID02311.3p-miR | 2.312634562 | 0.03349258 | Gastric Cancer (All Stages)/Normal Gastric Tissue |
| TJU_CMC.ID04010.5p-miR | −2.448628541 | 0.03400175 | Gastric Cancer (All Stages)/Normal Gastric Tissue |
| TJU_CMC.ID05546.5p-miR | 1.629003531 | 0.031926249 | Gastric Cancer (All Stages)/Normal Gastric Tissue |
| TJU_CMC.ID06935.5p-miR | 1.854549293 | 0.033391047 | Gastric Cancer (All Stages)/Normal Gastric Tissue |
| TJU_CMC.ID01479.3p-miR | 1.986409421 | 0.035272638 | Gastric Cancer (All Stages)/Normal Gastric Tissue |
| TJU_CMC_MD2.ID03086.5p-miR | 2.111181769 | 0.035337682 | Gastric Cancer (All Stages)/Normal Gastric Tissue |
| TJU_CMC.ID08761.5p-miR | −4.267548625 | 0.010203613 | PBMC Scleroderma Patients/PBMC Control Individuals |
| TJU_CMC.ID00938.5p-miR | −1.613840774 | 0.040784364 | Gastric Cancer (All Stages)/Normal Gastric Tissue |
| TJU_CMC.ID00977.5p-miR | −1.341670399 | 0.039528803 | Gastric Cancer (All Stages)/Normal Gastric Tissue |
| TJU_CMC.ID00993.3p-miR | 1.970492029 | 0.038198466 | Gastric Cancer (All Stages)/Normal Gastric Tissue |
| TJU_CMC.ID01429.5p-miR | 2.867504225 | 0.036707831 | Gastric Cancer (All Stages)/Normal Gastric Tissue |
| TJU_CMC.ID02586.5p-miR | 999999 | 0.036738061 | Gastric Cancer (All Stages)/Normal Gastric Tissue |
| TJU_CMC.ID03305.5p-miR | −1.609862851 | 0.037390013 | Gastric Cancer (All Stages)/Normal Gastric Tissue |
| TJU_CMC.ID03732.5p-miR | 2.004244641 | 0.040079898 | Gastric Cancer (All Stages)/Normal Gastric Tissue |
| TJU_CMC.ID04015.5p-miR | −1.498719744 | 0.039679831 | Gastric Cancer (All Stages)/Normal Gastric Tissue |
| TJU_CMC.ID04681.3p-miR | −1.63555378 | 0.038292529 | Gastric Cancer (All Stages)/Normal Gastric Tissue |
| TJU_CMC.ID04702.3p-miR | 2.271594216 | 0.039538409 | Gastric Cancer (All Stages)/Normal Gastric Tissue |
| TJU_CMC.ID04813.5p-miR | −1.58255416 | 0.038834773 | Gastric Cancer (All Stages)/Normal Gastric Tissue |
| TJU_CMC.ID05559.5p-miR | −1.375051006 | 0.040184485 | Gastric Cancer (All Stages)/Normal Gastric Tissue |
| TJU_CMC.ID07960.3p-miR | 2.165855447 | 0.038981849 | Gastric Cancer (All Stages)/Normal Gastric Tissue |
| TJU_CMC.ID08674.5p-miR | 1.601114325 | 0.038080565 | Gastric Cancer (All Stages)/Normal Gastric Tissue |
| TJU_CMC.ID09116.3p-miR | 1.968435382 | 0.04000353 | Gastric Cancer (All Stages)/Normal Gastric Tissue |
| TJU_CMC.ID02809.3p-miR | −2.771104044 | 0.041691648 | Gastric Cancer (All Stages)/Normal Gastric Tissue |
| TJU_CMC.ID06403.5p-miR | −1.920068702 | 0.041883968 | Gastric Cancer (All Stages)/Normal Gastric Tissue |
| TJU_CMC.ID03494.5p-miR | 3.95939225 | 0.010418164 | PBMC Scleroderma Patients/PBMC Control Individuals |
| TJU_CMC.ID00900.5p-miR | 1.895343037 | 0.043922464 | Gastric Cancer (All Stages)/Normal Gastric Tissue |
| TJU_CMC.ID01174.5p-miR | 4.633172229 | 0.042653376 | Gastric Cancer (All Stages)/Normal Gastric Tissue |
| TJU_CMC.ID08272.3p-miR | 3.508139003 | 0.043302973 | Gastric Cancer (All Stages)/Normal Gastric Tissue |
| TJU_CMC.ID00815.3p-miR | −1.772489511 | 0.044945986 | Gastric Cancer (All Stages)/Normal Gastric Tissue |
| TJU_CMC.ID07737.3p-miR | 2.504446699 | 0.045000353 | Gastric Cancer (All Stages)/Normal Gastric Tissue |
| TJU_CMC.ID00269.3p-miR | 2.505206495 | 0.046165249 | Gastric Cancer (All Stages)/Normal Gastric Tissue |
| TJU_CMC.ID03292.3p-miR | −1.424577368 | 0.045752924 | Gastric Cancer (All Stages)/Normal Gastric Tissue |
| TJU_CMC.ID08442.5p-miR | 2.030145449 | 0.0470639 | Gastric Cancer (All Stages)/Normal Gastric Tissue |
| TJU_CMC.ID05497.5p-miR | −1.294583047 | 0.048367954 | Gastric Cancer (All Stages)/Normal Gastric Tissue |
| TJU_CMC.ID02249.3p-miR | 1.895760363 | 0.049410912 | Gastric Cancer (All Stages)/Normal Gastric Tissue |
| TJU_CMC.ID09776.5p-miR | 1.489037083 | 0.038181576 | Prostate Cancer/Normal Prostate |
| TJU_CMC_MD2.ID01581.5p-miR | −1.263595505 | 0.039312083 | Hypo-reactive/Hyper-reactive (Platelets) |
| TJU_CMC.ID00009.3p-miR | 1.477830676 | 0.047912781 | Stage 4/Stage 3 (Gastric Cancer) |
| TJU_CMC.ID00052.3p-miR | −1.563173 | 0.012266671 | Hypo-reactive/Hyper-reactive (Platelets) |
| TJU_CMC.ID00084.5p-miR | −2.939458889 | 0.016355399 | Stage 2/Stage 1 (Gastric Cancer) |
| TJU_CMC.ID00195.5p-miR | 1.079999173 | 0.032878597 | Hypo-reactive/Hyper-reactive (Platelets) |
| TJU_CMC.ID00244.3p-miR | 7.100886471 | 0.038288489 | PBMC Scleroderma Patients/PBMC Control Individuals |
| TJU_CMC.ID00247.5p-miR | 1.3472225 | 0.036882313 | Hypo-reactive/Hyper-reactive (Platelets) |
| TJU_CMC.ID00297.3p-miR | 7.738409678 | 0.012633237 | PBMC Scleroderma Patients/PBMC Control Individuals |
| TJU_CMC.ID00314.3p-miR | −3.076506181 | 0.03766979 | Stage 3/Stage 2 (Gastric Cancer) |
| TJU_CMC.ID00348.3p-miR | 1.327956897 | 0.015928599 | Hypo-reactive/Hyper-reactive (Platelets) |
| TJU_CMC.ID00350.3p-miR | 1.885888423 | 0.042088708 | PBMC Scleroderma Patients/PBMC Control Individuals |
| TJU_CMC.ID00362.3p-miR | −2.085240193 | 0.042942951 | Stage 2/Stage 1 (Gastric Cancer) |
| TJU_CMC.ID00380.3p-miR | −999999 | 0.030703538 | MIA PaCa-2 cells/HPNE cells (Pancreas cell lines) |
| TJU_CMC.ID00568.5p-miR | 2.344610964 | 0.01887733 | PBMC Scleroderma Patients/PBMC Control Individuals |
| TJU_CMC.ID00768.5p-miR | 1.193133606 | 0.047495635 | Hypo-reactive/Hyper-reactive (Platelets) |
| TJU_CMC.ID00768.5p-miR | 2.432325887 | 0.018620428 | PBMC Scleroderma Patients/PBMC Control Individuals |
| TJU_CMC.ID00789.3p-miR | 1.181960622 | 0.043194929 | Hypo-reactive/Hyper-reactive (Platelets) |
| TJU_CMC.ID00863.3p-miR | −1.360451143 | 0.01096608 | Hypo-reactive/Hyper-reactive (Platelets) |
| TJU_CMC.ID00894.5p-miR | −2.728939887 | 0.043569208 | PBMC Scleroderma Patients/PBMC Control Individuals |
| TJU_CMC.ID00919.5p-miR | −2.002438715 | 0.033421367 | Prostate Cancer/Normal Prostate |
| TJU_CMC.ID00971.3p-miR | −2.743521401 | 0.028929917 | Stage 2/Stage 1 (Gastric Cancer) |
| TJU_CMC.ID01018.3p-miR | 5.635072153 | 0.022841887 | MIA PaCa-2 cells/HPNE cells (Pancreas cell lines) |
| TJU_CMC.ID01069.3p-miR | 2.605972125 | 0.021994098 | Psoriasis Biopsy/Normal Skin Biopsy |
| TJU_CMC.ID01080.3p-miR | 0.916170345 | 0.015991941 | Hypo-reactive/Hyper-reactive (Platelets) |
| TJU_CMC.ID01085.3p-miR | 1.678188162 | 0.015798823 | Hypo-reactive/Hyper-reactive (Platelets) |
| TJU_CMC.ID01088.3p-miR | 0.979367272 | 0.042853103 | Hypo-reactive/Hyper-reactive (Platelets) |
| TJU_CMC.ID01135.3p-miR | −1.838228767 | 0.01684644 | Stage 2/Stage 1 (Gastric Cancer) |
| TJU_CMC.ID01162.3p-miR | −1.077075181 | 0.048758702 | Hypo-reactive/Hyper-reactive (Platelets) |
| TJU_CMC.ID01261.3p-miR | 4.587419352 | 0.01645577 | PBMC Scleroderma Patients/PBMC Control Individuals |
| TJU_CMC.ID01273.3p-miR | 1.108485397 | 0.025187843 | Hypo-reactive/Hyper-reactive (Platelets) |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID01296.3p-miR | −6.537795507 | 0.030638518 | MIA PaCa-2 cells/HPNE cells (Pancreas cell lines) |
| TJU_CMC.ID01339.5p-miR | −2.919610922 | 0.012677767 | Stage 2/Stage 1 (Gastric Cancer) |
| TJU_CMC.ID01410.3p-miR | 1.564842602 | 0.010625095 | Hypo-reactive/Hyper-reactive (Platelets) |
| TJU_CMC.ID01421.5p-miR | 2.445206236 | 0.038660729 | PBMC Scleroderma Patients/PBMC Control Individuals |
| TJU_CMC.ID01517.5p-miR | 2.510345858 | 0.043562113 | Stage 3/Stage 2 (Gastric Cancer) |
| TJU_CMC.ID01546.3p-miR | 3.849540809 | 0.03881563 | Prostate Cancer/Normal Prostate |
| TJU_CMC.ID01589.5p-miR | 7.52282662 | 0.01203502 | PBMC Scleroderma Patients/PBMC Control Individuals |
| TJU_CMC.ID01637.5p-miR | −0.951688288 | 0.046805673 | Hypo-reactive/Hyper-reactive (Platelets) |
| TJU_CMC.ID01657.5p-miR | 1.200240685 | 0.044669458 | Hypo-reactive/Hyper-reactive (Platelets) |
| TJU_CMC.ID01691.3p-miR | 6.706337157 | 0.048069193 | PBMC Scleroderma Patients/PBMC Control Individuals |
| TJU_CMC.ID01706.5p-miR | 1.143990065 | 0.049962547 | Hypo-reactive/Hyper-reactive (Platelets) |
| TJU_CMC.ID01719.5p-miR | −4.87303582 | 0.022572743 | MIA PaCa-2 cells/HPNE cells (Pancreas cell lines) |
| TJU_CMC.ID01763.5p-miR | −6.573089908 | 0.038624619 | Stage 2/Stage 1 (Gastric Cancer) |
| TJU_CMC.ID01805.5p-miR | −3.499450023 | 0.022188591 | PBMC Scleroderma Patients/PBMC Control Individuals |
| TJU_CMC.ID01806.3p-miR | 4.789701655 | 0.026115412 | Stage 3/Stage 2 (Gastric Cancer) |
| TJU_CMC.ID01864.5p-miR | −2.332814508 | 0.016055 | Stage 3/Stage 2 (Gastric Cancer) |
| TJU_CMC.ID01909.3p-miR | 3.565702913 | 0.014056536 | PBMC Scleroderma Patients/PBMC Control Individuals |
| TJU_CMC.ID01943.5p-miR | −2.212509523 | 0.010809204 | Prostate Cancer/Normal Prostate |
| TJU_CMC.ID01953.5p-miR | −4.342884428 | 0.045146045 | Stage 2/Stage 1 (Gastric Cancer) |
| TJU_CMC.ID02018.5p-miR | −1.781518856 | 0.028018214 | Prostate Cancer/Normal Prostate |
| TJU_CMC.ID02034.5p-miR | −1.555519162 | 0.012591791 | Hypo-reactive/Hyper-reactive (Platelets) |
| TJU_CMC.ID02138.5p-miR | 2.512632326 | 0.032846065 | PBMC Scleroderma Patients/PBMC Control Individuals |
| TJU_CMC.ID02211.5p-miR | −3.428004423 | 0.014486957 | PBMC Scleroderma Patients/PBMC Control Individuals |
| TJU_CMC.ID02258.3p-miR | 7.462523283 | 0.044389508 | Stage 2/Stage 1 (Gastric Cancer) |
| TJU_CMC.ID02289.5p-miR | 4.806026864 | 0.040544693 | MIA PaCa-2 cells/HPNE cells (Pancreas cell lines) |
| TJU_CMC.ID02290.5p-miR | 6.550642842 | 0.041935162 | PBMC Scleroderma Patients/PBMC Control Individuals |
| TJU_CMC.ID02305.3p-miR | 1.215472034 | 0.031476713 | Hypo-reactive/Hyper-reactive (Platelets) |
| TJU_CMC.ID02326.5p-miR | 4.891081095 | 0.027029515 | PBMC Scleroderma Patients/PBMC Control Individuals |
| TJU_CMC.ID02376.5p-miR | 2.889831458 | 0.0367707 | Psoriasis Biopsy/Normal Skin Biopsy |
| TJU_CMC.ID02420.5p-miR | 1.134690166 | 0.024073365 | Psoriasis Biopsy/Normal Skin Biopsy |
| TJU_CMC.ID02453.5p-miR | 2.283757315 | 0.042273906 | PBMC Scleroderma Patients/PBMC Control Individuals |
| TJU_CMC.ID02479.3p-miR | 1.340706073 | 0.022305849 | Hypo-reactive/Hyper-reactive (Platelets) |
| TJU_CMC.ID02495.5p-miR | 3.40896854 | 0.046205988 | PBMC Scleroderma Patients/PBMC Control Individuals |
| TJU_CMC.ID02499.3p-miR | −2.561743968 | 0.048800688 | Stage 2/Stage 1 (Gastric Cancer) |
| TJU_CMC.ID02522.5p-miR | −1.327874509 | 0.020841274 | Hypo-reactive/Hyper-reactive (Platelets) |
| TJU_CMC.ID02561.5p-miR | −2.513059732 | 0.035711835 | Stage 3/Stage 2 (Gastric Cancer) |
| TJU_CMC.ID02629.3p-miR | −999999 | 0.048131214 | MIA PaCa-2 cells/HPNE cells (Pancreas cell lines) |
| TJU_CMC.ID02630.5p-miR | 1.267984776 | 0.012279347 | Hypo-reactive/Hyper-reactive (Platelets) |
| TJU_CMC.ID02641.5p-miR | 3.851807621 | 0.019760885 | Prostate Cancer/Normal Prostate |
| TJU_CMC.ID02702.5p-miR | −0.848362775 | 0.044000798 | Hypo-reactive/Hyper-reactive (Platelets) |
| TJU_CMC.ID02760.3p-miR | 2.015420588 | 0.044677375 | PBMC Scleroderma Patients/PBMC Control Individuals |
| TJU_CMC.ID02819.5p-miR | 1.080945126 | 0.021311897 | Hypo-reactive/Hyper-reactive (Platelets) |
| TJU_CMC.ID02835.3p-miR | −1.268285688 | 0.047845428 | Hypo-reactive/Hyper-reactive (Platelets) |
| TJU_CMC.ID02909.3p-miR | −0.997536853 | 0.019442636 | Hypo-reactive/Hyper-reactive (Platelets) |
| TJU_CMC.ID02914.3p-miR | −2.5089258 | 0.018325608 | Stage 2/Stage 1 (Gastric Cancer) |
| TJU_CMC.ID02928.3p-miR | −1.823624294 | 0.026092911 | Stage 3/Stage 2 (Gastric Cancer) |
| TJU_CMC.ID02936.3p-miR | 2.230440371 | 0.028695444 | PBMC Scleroderma Patients/PBMC Control Individuals |
| TJU_CMC.ID02951.5p-miR | 3.370149449 | 0.017946247 | PBMC Scleroderma Patients/PBMC Control Individuals |
| TJU_CMC.ID02963.3p-miR | 1.346154092 | 0.049843133 | Hypo-reactive/Hyper-reactive (Platelets) |
| TJU_CMC.ID02974.3p-miR | −3.445625017 | 0.025122478 | PBMC Scleroderma Patients/PBMC Control Individuals |
| TJU_CMC.ID02983.5p-miR | 1.475207022 | 0.019934104 | Hypo-reactive/Hyper-reactive (Platelets) |
| TJU_CMC.ID03009.3p-miR | 1.649167015 | 0.02902873 | Hypo-reactive/Hyper-reactive (Platelets) |
| TJU_CMC.ID03046.3p-miR | −1.19936191 | 0.042007511 | Hypo-reactive/Hyper-reactive (Platelets) |
| TJU_CMC.ID03054.3p-miR | −999999 | 0.013013719 | MIA PaCa-2 cells/HPNE cells (Pancreas cell lines) |
| TJU_CMC.ID03078.3p-miR | 1.531824418 | 0.016192411 | Hypo-reactive/Hyper-reactive (Platelets) |
| TJU_CMC.ID03104.5p-miR | 2.23497465 | 0.029259981 | PBMC Scleroderma Patients/PBMC Control Individuals |
| TJU_CMC.ID03128.3p-miR | 1.359735036 | 0.026875852 | Hypo-reactive/Hyper-reactive (Platelets) |
| TJU_CMC.ID03148.5p-miR | 1.363629432 | 0.017882699 | Hypo-reactive/Hyper-reactive (Platelets) |
| TJU_CMC.ID03152.5p-miR | −1.058108022 | 0.043698842 | Hypo-reactive/Hyper-reactive (Platelets) |
| TJU_CMC.ID03322.5p-miR | −2.726379148 | 0.003149937 | Stage 2/Stage 1 (Gastric Cancer) |
| TJU_CMC.ID03328.5p-miR | 7.228105391 | 0.041174743 | Stage 2/Stage 1 (Gastric Cancer) |
| TJU_CMC.ID03395.3p-miR | −999999 | 0.024920128 | Hypo-reactive/Hyper-reactive (Platelets) |
| TJU_CMC.ID03444.5p-miR | −2.425956557 | 0.014239203 | Stage 2/Stage 1 (Gastric Cancer) |
| TJU_CMC.ID03468.3p-miR | −999999 | 0.026548308 | MIA PaCa-2 cells/HPNE cells (Pancreas cell lines) |
| TJU_CMC.ID03469.3p-miR | −999999 | 0.02046219 | MIA PaCa-2 cells/HPNE cells (Pancreas cell lines) |
| TJU_CMC.ID03525.5p-miR | 2.024236382 | 0.043013288 | Hypo-reactive/Hyper-reactive (Platelets) |
| TJU_CMC.ID03547.3p-miR | 1.088942611 | 0.031389761 | Hypo-reactive/Hyper-reactive (Platelets) |
| TJU_CMC.ID03569.5p-miR | −1.783878949 | 0.041663766 | Stage 2/Stage 1 (Gastric Cancer) |
| TJU_CMC.ID03579.3p-miR | 2.339529876 | 0.031743547 | PBMC Scleroderma Patients/PBMC Control Individuals |
| TJU_CMC.ID03586.5p-miR | 1.559085474 | 0.038078855 | Hypo-reactive/Hyper-reactive (Platelets) |
| TJU_CMC.ID03705.5p-miR | 2.314969901 | 0.01268648 | Hypo-reactive/Hyper-reactive (Platelets) |
| TJU_CMC.ID03708.5p-miR | −2.037179611 | 0.043388527 | Stage 3/Stage 2 (Gastric Cancer) |
| TJU_CMC.ID03820.3p-miR | 2.846686172 | 0.022838815 | Stage 2/Stage 1 (Gastric Cancer) |
| TJU_CMC.ID03902.3p-miR | 1.198598227 | 0.039618344 | Hypo-reactive/Hyper-reactive (Platelets) |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID03912.5p-miR | 1.25809572 | 0.027856237 | Hypo-reactive/Hyper-reactive (Platelets) |
| TJU_CMC.ID04075.5p-miR | 2.310361088 | 0.040051908 | PBMC Scleroderma Patients/PBMC Control Individuals |
| TJU_CMC.ID04080.5p-miR | 3.19306214 | 0.028960073 | Hypo-reactive/Hyper-reactive (Platelets) |
| TJU_CMC.ID04092.3p-miR | -4.408668432 | 0.024276182 | PBMC Scleroderma Patients/PBMC Control Individuals |
| TJU_CMC.ID04286.5p-miR | 4.478044918 | 0.027879142 | MIA PaCa-2 cells/HPNE cells (Pancreas cell lines) |
| TJU_CMC.ID04324.5p-miR | -999999 | 0.043530936 | MIA PaCa-2 cells/HPNE cells (Pancreas cell lines) |
| TJU_CMC.ID04342.5p-miR | 1.800326099 | 0.047129364 | Stage 2/Stage 1 (Gastric Cancer) |
| TJU_CMC.ID04424.5p-miR | -2.001146748 | 0.019798024 | Stage 3/Stage 2 (Gastric Cancer) |
| TJU_CMC.ID04572.5p-miR | -1.08873462 | 0.048571828 | Hypo-reactive/Hyper-reactive (Platelets) |
| TJU_CMC.ID04614.5p-miR | 3.732040576 | 0.049558403 | MIA PaCa-2 cells/HPNE cells (Pancreas cell lines) |
| TJU_CMC.ID04617.3p-miR | 2.237425363 | 0.035202753 | Prostate Cancer/Normal Prostate |
| TJU_CMC.ID04630.3p-miR | 1.247278138 | 0.0465399 | HER2-type Breast Cancer/Basal-like Breast Cancer (TCGA) |
| TJU_CMC.ID04668.3p-miR | 3.319215229 | 0.018021822 | PBMC Scleroderma Patients/PBMC Control Individuals |
| TJU_CMC.ID04740.3p-miR | -2.346176139 | 0.043984837 | PBMC Scleroderma Patients/PBMC Control Individuals |
| TJU_CMC.ID04779.3p-miR | 6.486114799 | 0.045280745 | PBMC Scleroderma Patients/PBMC Control Individuals |
| TJU_CMC.ID04788.5p-miR | -999999 | 0.0487335 | MIA PaCa-2 cells/HPNE cells (Pancreas cell lines) |
| TJU_CMC.ID04803.5p-miR | -999999 | 0.043205027 | MIA PaCa-2 cells/HPNE cells (Pancreas cell lines) |
| TJU_CMC.ID04820.3p-miR | 2.452780432 | 0.017802552 | PBMC Scleroderma Patients/PBMC Control Individuals |
| TJU_CMC.ID04842.5p-miR | -2.421514896 | 0.047905247 | Stage 2/Stage 1 (Gastric Cancer) |
| TJU_CMC.ID04865.5p-miR | -999999 | 0.047614773 | MIA PaCa-2 cells/HPNE cells (Pancreas cell lines) |
| TJU_CMC.ID04868.5p-miR | -1.002409588 | 0.025247313 | Hypo-reactive/Hyper-reactive (Platelets) |
| TJU_CMC.ID04928.5p-miR | 1.359874336 | 0.024281153 | Hypo-reactive/Hyper-reactive (Platelets) |
| TJU_CMC.ID04992.3p-miR | 1.741755955 | 0.033510108 | Stage 3/Stage 2 (Gastric Cancer) |
| TJU_CMC.ID05017.5p-miR | -2.266144482 | 0.027216363 | Stage 3/Stage 2 (Gastric Cancer) |
| TJU_CMC.ID05313.5p-miR | -3.770479664 | 0.003877615 | Stage 2/Stage 1 (Gastric Cancer) |
| TJU_CMC.ID05357.3p-miR | 2.339487344 | 0.049616356 | PBMC Scleroderma Patients/PBMC Control Individuals |
| TJU_CMC.ID05397.3p-miR | 1.526453747 | 0.010537367 | Hypo-reactive/Hyper-reactive (Platelets) |
| TJU_CMC.ID05415.3p-miR | -1.455138672 | 0.041024695 | Prostate Cancer/Normal Prostate |
| TJU_CMC.ID05419.5p-miR | 3.086717415 | 0.01653433 | Stage 3/Stage 2 (Gastric Cancer) |
| TJU_CMC.ID05478.5p-miR | 2.6303543 | 0.012681579 | PBMC Scleroderma Patients/PBMC Control Individuals |
| TJU_CMC.ID05499.5p-miR | 2.419491 | 0.014931304 | PBMC Scleroderma Patients/PBMC Control Individuals |
| TJU_CMC.ID05510.3p-miR | -2.538816142 | 0.041195298 | Stage 2/Stage 1 (Gastric Cancer) |
| TJU_CMC.ID05546.5p-miR | 3.2306874 | 0.0184641 | Psoriasis Biopsy/Normal Skin Biopsy |
| TJU_CMC.ID05548.3p-miR | 2.704833671 | 0.034293728 | Psoriasis Biopsy/Normal Skin Biopsy |
| TJU_CMC.ID05639.5p-miR | -1.086178426 | 0.029198929 | Hypo-reactive/Hyper-reactive (Platelets) |
| TJU_CMC.ID05664.5p-miR | -3.396746446 | 0.048216431 | Stage 3/Stage 2 (Gastric Cancer) |
| TJU_CMC.ID05700.5p-miR | -999999 | 0.042411288 | Hypo-reactive/Hyper-reactive (Platelets) |
| TJU_CMC.ID05758.5p-miR | -2.925617594 | 0.017181581 | Stage 3/Stage 2 (Gastric Cancer) |
| TJU_CMC.ID05781.3p-miR | 1.434647567 | 0.019638069 | Hypo-reactive/Hyper-reactive (Platelets) |
| TJU_CMC.ID05857.5p-miR | 1.447991864 | 0.010024548 | Hypo-reactive/Hyper-reactive (Platelets) |
| TJU_CMC.ID05896.3p-miR | 1.235764812 | 0.016312488 | Hypo-reactive/Hyper-reactive (Platelets) |
| TJU_CMC.ID05937.5p-miR | -1.273568266 | 0.040227023 | Hypo-reactive/Hyper-reactive (Platelets) |
| TJU_CMC.ID05970.3p-miR | 2.879521084 | 0.017012637 | PBMC Scleroderma Patients/PBMC Control Individuals |
| TJU_CMC.ID05977.5p-miR | 999999 | 0.046469869 | Stage 2/Stage 1 (Gastric Cancer) |
| TJU_CMC.ID06037.5p-miR | -3.081541785 | 0.030474184 | PBMC Scleroderma Patients/PBMC Control Individuals |
| TJU_CMC.ID06061.5p-miR | 0.94952706 | 0.035513757 | Hypo-reactive/Hyper-reactive (Platelets) |
| TJU_CMC.ID06076.5p-miR | 1.344256788 | 0.029915762 | Hypo-reactive/Hyper-reactive (Platelets) |
| TJU_CMC.ID06115.3p-miR | 3.10982229 | 0.031329725 | Prostate Cancer/Normal Prostate |
| TJU_CMC.ID06117.5p-miR | 4.085677992 | 0.037262132 | Stage 2/Stage 1 (Gastric Cancer) |
| TJU_CMC.ID06146.3p-miR | -1.277339046 | 0.037711719 | Hypo-reactive/Hyper-reactive (Platelets) |
| TJU_CMC.ID06228.3p-miR | -1.444106832 | 0.01997565 | Hypo-reactive/Hyper-reactive (Platelets) |
| TJU_CMC.ID06339.3p-miR | -2.809713442 | 0.008258968 | Stage 2/Stage 1 (Gastric Cancer) |
| TJU_CMC.ID06484.5p-miR | -1.573142702 | 0.049709755 | Prostate Cancer/Normal Prostate |
| TJU_CMC.ID06539.3p-miR | -3.729993502 | 0.000799716 | Stage 2/Stage 1 (Gastric Cancer) |
| TJU_CMC.ID06553.5p-miR | 1.216440491 | 0.017832843 | Hypo-reactive/Hyper-reactive (Platelets) |
| TJU_CMC.ID06610.5p-miR | -2.398369481 | 0.021323249 | Stage 2/Stage 1 (Gastric Cancer) |
| TJU_CMC.ID06620.5p-miR | 4.717528041 | 0.029027538 | MIA PaCa-2 cells/HPNE cells (Pancreas cell lines) |
| TJU_CMC.ID06651.3p-miR | 1.503525114 | 0.029348763 | Hypo-reactive/Hyper-reactive (Platelets) |
| TJU_CMC.ID06672.3p-miR | 2.363876542 | 0.014376798 | PBMC Scleroderma Patients/PBMC Control Individuals |
| TJU_CMC.ID06684.5p-miR | 1.184849137 | 0.012498505 | Hypo-reactive/Hyper-reactive (Platelets) |
| TJU_CMC.ID06736.5p-miR | 1.027632873 | 0.022289989 | Hypo-reactive/Hyper-reactive (Platelets) |
| TJU_CMC.ID06760.3p-miR | 5.719410568 | 0.038997076 | PBMC Scleroderma Patients/PBMC Control Individuals |
| TJU_CMC.ID06765.5p-miR | -2.734935036 | 0.022526889 | Stage 2/Stage 1 (Gastric Cancer) |
| TJU_CMC.ID06798.3p-miR | -999999 | 0.040991372 | MIA PaCa-2 cells/HPNE cells (Pancreas cell lines) |
| TJU_CMC.ID06865.5p-miR | 2.266458461 | 0.049772174 | Psoriasis Biopsy/Normal Skin Biopsy |
| TJU_CMC.ID06987.5p-miR | 1.32602718 | 0.013148506 | Hypo-reactive/Hyper-reactive (Platelets) |
| TJU_CMC.ID07029.5p-miR | 1.025819086 | 0.039590943 | Hypo-reactive/Hyper-reactive (Platelets) |
| TJU_CMC.ID07034.5p-miR | -999999 | 0.026977278 | Prostate Cancer/Normal Prostate |
| TJU_CMC.ID07073.5p-miR | 1.362074466 | 0.025985874 | Hypo-reactive/Hyper-reactive (Platelets) |
| TJU_CMC.ID07118.3p-miR | 1.358192938 | 0.025833509 | Hypo-reactive/Hyper-reactive (Platelets) |
| TJU_CMC.ID07253.3p-miR | 2.141867332 | 0.042181369 | Stage 2/Stage 1 (Gastric Cancer) |
| TJU_CMC.ID07263.3p-miR | -1.422644797 | 0.017719 | Hypo-reactive/Hyper-reactive (Platelets) |
| TJU_CMC.ID07272.3p-miR | 2.336599302 | 0.04398778 | PBMC Scleroderma Patients/PBMC Control Individuals |
| TJU_CMC.ID07373.5p-miR | -9.715672414 | 0.01529549 | PBMC Scleroderma Patients/PBMC Control Individuals |

TABLE 11-continued

Differential expression of miRNAs in tissues of various disease states

| Name | Log2 fold change of Set A/Set B | p-Val | Sets Compared (A/B) |
|---|---|---|---|
| TJU_CMC.ID07383.5p-miR | −3.198512488 | 0.004985778 | Stage 3/Stage 2 (Gastric Cancer) |
| TJU_CMC.ID07421.5p-miR | 2.135062062 | 0.043113573 | Stage 2/Stage 1 (Gastric Cancer) |
| TJU_CMC.ID07469.3p-miR | 1.025498261 | 0.032668928 | Hypo-reactive/Hyper-reactive (Platelets) |
| TJU_CMC.ID07488.5p-miR | 1.195912797 | 0.026248769 | Hypo-reactive/Hyper-reactive (Platelets) |
| TJU_CMC.ID07510.3p-miR | 1.275122876 | 0.035611377 | Hypo-reactive/Hyper-reactive (Platelets) |
| TJU_CMC.ID07519.3p-miR | 3.836738075 | 0.022542145 | Prostate Cancer/Normal Prostate |
| TJU_CMC.ID07559.3p-miR | −1.460592419 | 0.030481404 | Hypo-reactive/Hyper-reactive (Platelets) |
| TJU_CMC.ID07610.5p-miR | 2.552174284 | 0.022439374 | PBMC Scleroderma Patients/PBMC Control Individuals |
| TJU_CMC.ID07769.3p-miR | 999999 | 0.044834717 | Stage 2/Stage 1 (Gastric Cancer) |
| TJU_CMC.ID07801.3p-miR | −1.119418093 | 0.013262881 | Hypo-reactive/Hyper-reactive (Platelets) |
| TJU_CMC.ID07809.5p-miR | −1.107946725 | 0.031809701 | Hypo-reactive/Hyper-reactive (Platelets) |
| TJU_CMC.ID07834.3p-miR | 2.63743159 | 0.041377417 | Stage 3/Stage 2 (Gastric Cancer) |
| TJU_CMC.ID07841.3p-miR | 2.465873748 | 0.027102666 | Psoriasis Biopsy/Normal Skin Biopsy |
| TJU_CMC.ID07861.5p-miR | 0.985777139 | 0.049157741 | Hypo-reactive/Hyper-reactive (Platelets) |
| TJU_CMC.ID07871.3p-miR | 1.397277995 | 0.018354634 | Hypo-reactive/Hyper-reactive (Platelets) |
| TJU_CMC.ID07914.5p-miR | 1.28398237 | 0.049006487 | Hypo-reactive/Hyper-reactive (Platelets) |
| TJU_CMC.ID07954.3p-miR | −3.239335055 | 0.03042949 | PBMC Scleroderma Patients/PBMC Control Individuals |
| TJU_CMC.ID07960.3p-miR | −2.422033216 | 0.022135075 | Prostate Cancer/Normal Prostate |
| TJU_CMC.ID07973.3p-miR | 2.613660743 | 0.018542662 | Hypo-reactive/Hyper-reactive (Platelets) |
| TJU_CMC.ID08019.5p-miR | −1.394101883 | 0.029579628 | Hypo-reactive/Hyper-reactive (Platelets) |
| TJU_CMC.ID08043.3p-miR | 1.951144233 | 0.045679546 | Stage 2/Stage 1 (Gastric Cancer) |
| TJU_CMC.ID08074.3p-miR | 1.194016545 | 0.016403084 | Hypo-reactive/Hyper-reactive (Platelets) |
| TJU_CMC.ID08202.5p-miR | −2.711995889 | 0.039866728 | Stage 2/Stage 1 (Gastric Cancer) |
| TJU_CMC.ID08252.3p-miR | −2.005602975 | 0.031304754 | Stage 3/Stage 2 (Gastric Cancer) |
| TJU_CMC.ID08284.5p-miR | 1.270489064 | 0.036750125 | Hypo-reactive/Hyper-reactive (Platelets) |
| TJU_CMC.ID08389.5p-miR | −2.706964681 | 0.03043225 | Stage 2/Stage 1 (Gastric Cancer) |
| TJU_CMC.ID08391.3p-miR | 4.402016384 | 0.016291452 | PBMC Scleroderma Patients/PBMC Control Individuals |
| TJU_CMC.ID08401.5p-miR | −5.124839457 | 0.017106129 | PBMC Scleroderma Patients/PBMC Control Individuals |
| TJU_CMC.ID08486.5p-miR | −1.294807018 | 0.032293633 | Hypo-reactive/Hyper-reactive (Platelets) |
| TJU_CMC.ID08586.3p-miR | 2.133653292 | 0.047329924 | PBMC Scleroderma Patients/PBMC Control Individuals |
| TJU_CMC.ID08622.3p-miR | −1.266121461 | 0.025040345 | Hypo-reactive/Hyper-reactive (Platelets) |
| TJU_CMC.ID08632.3p-miR | 1.277309014 | 0.019995413 | Hypo-reactive/Hyper-reactive (Platelets) |
| TJU_CMC.ID08687.5p-miR | 1.209697855 | 0.032166429 | Hypo-reactive/Hyper-reactive (Platelets) |
| TJU_CMC.ID08726.5p-miR | 3.241011862 | 0.001321656 | Psoriasis Biopsy/Normal Skin Biopsy |
| TJU_CMC.ID08800.3p-miR | 2.124294119 | 0.024098946 | PBMC Scleroderma Patients/PBMC Control Individuals |
| TJU_CMC.ID08803.3p-miR | 2.325924074 | 0.040336565 | PBMC Scleroderma Patients/PBMC Control Individuals |
| TJU_CMC.ID08842.3p-miR | −1.501463396 | 0.030740633 | Prostate Cancer/Normal Prostate |
| TJU_CMC.ID08880.5p-miR | −3.156695744 | 0.019176545 | PBMC Scleroderma Patients/PBMC Control Individuals |
| TJU_CMC.ID09005.3p-miR | −5.489788623 | 0.012212712 | PBMC Scleroderma Patients/PBMC Control Individuals |
| TJU_CMC.ID09009.3p-miR | 2.705944072 | 0.033944204 | PBMC Scleroderma Patients/PBMC Control Individuals |
| TJU_CMC.ID09016.3p-miR | 4.989971469 | 0.041187184 | MIA PaCa-2 cells/HPNE cells (Pancreas cell lines) |
| TJU_CMC.ID09037.3p-miR | −1.737934328 | 0.030312535 | Prostate Cancer/Normal Prostate |
| TJU_CMC.ID09069.5p-miR | 1.353962462 | 0.045436789 | Hypo-reactive/Hyper-reactive (Platelets) |
| TJU_CMC.ID09079.3p-miR | 2.222284363 | 0.018051479 | Stage 3/Stage 2 (Gastric Cancer) |
| TJU_CMC.ID09120.3p-miR | 2.195852413 | 0.029115755 | Stage 2/Stage 1 (Gastric Cancer) |
| TJU_CMC.ID09230.3p-miR | 2.171964668 | 0.048313984 | Stage 2/Stage 1 (Gastric Cancer) |
| TJU_CMC.ID09232.5p-miR | −4.639075346 | 0.026129589 | PBMC Scleroderma Patients/PBMC Control Individuals |
| TJU_CMC.ID09235.5p-miR | 3.134775183 | 0.008287097 | Stage 3/Stage 2 (Gastric Cancer) |
| TJU_CMC.ID09235.5p-miR | −2.943457352 | 0.044162599 | Stage 4/Stage 3 (Gastric Cancer) |
| TJU_CMC.ID09252.5p-miR | 2.856342709 | 0.024364685 | PBMC Scleroderma Patients/PBMC Control Individuals |
| TJU_CMC.ID09261.5p-miR | 1.736182465 | 0.011353491 | Hypo-reactive/Hyper-reactive (Platelets) |
| TJU_CMC.ID09273.3p-miR | −5.126428551 | 0.005936221 | Stage 2/Stage 1 (Gastric Cancer) |
| TJU_CMC.ID09283.5p-miR | 999999 | 0.038985348 | Stage 3/Stage 2 (Gastric Cancer) |
| TJU_CMC.ID09315.5p-miR | −3.038172331 | 0.006109781 | Stage 2/Stage 1 (Gastric Cancer) |
| TJU_CMC.ID09441.5p-miR | 4.08569959 | 0.025506003 | Prostate Cancer/Normal Prostate |
| TJU_CMC.ID09442.5p-miR | 1.710183562 | 0.03839507 | PBMC Scleroderma Patients/PBMC Control Individuals |
| TJU_CMC.ID09660.3p-miR | 4.907722665 | 0.020611751 | MIA PaCa-2 cells/HPNE cells (Pancreas cell lines) |
| TJU_CMC.ID09753.5p-miR | −6.066785381 | 0.020677688 | MIA PaCa-2 cells/HPNE cells (Pancreas cell lines) |
| TJU_CMC.ID09799.3p-miR | 2.576122738 | 0.040874487 | Psoriasis Biopsy/Normal Skin Biopsy |
| TJU_CMC_MD2.ID00602.3p-miR | 3.794286038 | 0.042507991 | MIA PaCa-2 cells/HPNE cells (Pancreas cell lines) |
| TJU_CMC_MD2.ID00858.5p-miR | 2.538206626 | 0.043510714 | Prostate Cancer/Normal Prostate |
| TJU_CMC_MD2.ID01526.3p-miR | −1.195280658 | 0.049628324 | Hypo-reactive/Hyper-reactive (Platelets) |
| TJU_CMC_MD2.ID01878.5p-miR | 2.011665229 | 0.010441931 | Hypo-reactive/Hyper-reactive (Platelets) |
| TJU_CMC_MD2.ID01959.5p-miR | −1.286480278 | 0.030700595 | Hypo-reactive/Hyper-reactive (Platelets) |
| TJU_CMC_MD2.ID02369.5p-miR | 2.913986759 | 0.046604875 | PBMC Scleroderma Patients/PBMC Control Individuals |
| TJU_CMC_MD2.ID02968.3p-miR | −1.19449432 | 0.038131744 | Hypo-reactive/Hyper-reactive (Platelets) |
| TJU_CMC_MD2.ID03322.3p-miR | −1.191709316 | 0.034506286 | Hypo-reactive/Hyper-reactive (Platelets) |
| TJU_CMC_MD2.ID03345.5p-miR | −1.709921748 | 0.011392242 | Hypo-reactive/Hyper-reactive (Platelets) |
| TJU_CMC_MD2.ID03472.3p-miR | 5.102327203 | 0.029176763 | Stage 2/Stage 1 (Gastric Cancer) |
| TJU_CMC_MD2.ID03495.5p-miR | 2.563610753 | 0.023443767 | PBMC Scleroderma Patients/PBMC Control Individuals |

Example 8. Differential Expression by Disease States for Novel isomiRs Derived from Known miRNA Loci Using samples from different disease states, the inventors identified differentially expressed novel isomiRs (as listed in Table 3) that were identified as arising from known miRNA loci. As stated above, an isomiR is considered to be differentially expressed if it had a mean expression of at least 50 sequenced reads, a log 2-change in expression between the compared states of ≥0.58 or ≤−0.58, and a p-Value ≤0.05.

Table 12 below shows the fold-change of the isomiRs in pairs of the same tissue of different states. Abbreviations: TCGA=The Cancer Genome Atlas; PBMC=Peripheral Blood Mononuclear Cells; GEO=Gene Expression Omnibus. The actual miRNA/isomiR sequences and corresponding SEQ ID NOs. can be identified in Table 3 according to the "Name" listed in Table 12.

Lengthy table referenced here

US11293064-20220405-T00002

Please refer to the end of the specification for access instructions.

Lengthy table referenced here

US11293064-20220405-T00003

Please refer to the end of the specification for access instructions.

Lengthy table referenced here

US11293064-20220405-T00004

Please refer to the end of the specification for access instructions.

Lengthy table referenced here

US11293064-20220405-T00005

Please refer to the end of the specification for access instructions.

REFERENCES

1.—Lim, L. P., et al., Vertebrate microRNA genes. Science (New York, N.Y.), 2003. 299(5612): p. 1540-1540.
2.—Miranda, K. C., et al., A pattern-based method for the identification of MicroRNA binding sites and their corresponding heteroduplexes. Cell, 2006. 126(6): p. 1203-1217.
3.—Rigoutsos, I., et al., Short blocks from the noncoding parts of the human genome have instances within nearly all known genes and relate to biological processes. Proceedings of the National Academy of Sciences of the United States of America, 2006. 103(17): p. 6605-6610.
4.—Griffiths-Jones, S., miRBase: microRNA sequences, targets and gene nomenclature. Nucleic Acids Research, 2006. 34(90001): p. D140-D144.
5.—Bartel, D. P., MicroRNAs: genomics, biogenesis, mechanism, and function. Cell, 2004. 116(2): p. 281-97.
6.—Bartel, D. P., MicroRNAs: target recognition and regulatory functions. Cell, 2009. 136(2): p. 215-33.
7.—Ambros, V., A hierarchy of regulatory genes controls a larva-to-adult developmental switch in *C. elegans*. Cell, 1989. 57(1): p. 49-57.
8.—Ruvkun, G. and J. Giusto, The *Caenorhabditis elegans* heterochronic gene lin-14 encodes a nuclear protein that forms a temporal developmental switch. Nature, 1989. 338(6213): p. 313-9.
9.—Reinhart, B. J., et al., The 21-nucleotide let-7 RNA regulates developmental timing in *Caenorhabditis elegans*. Nature, 2000. 403(6772): p. 901-6.
10.—Chang, S., et al., MicroRNAs act sequentially and asymmetrically to control chemosensory laterality in the nematode. Nature, 2004. 430(7001): p. 785-9.
11.—Johnston, R. J. and O. Hobert, A microRNA controlling left/right neuronal asymmetry in *Caenorhabditis elegans*. Nature, 2003. 426(6968): p. 845-9.
12. [193649]—Brennecke, J. and S. M. Cohen, Towards a complete description of the microRNA complement of animal genomes. Genome Biol, 2003. 4(9): p. 228.
13.—Bartel, D. P., MicroRNAs: genomics, biogenesis, mechanism, and function. Cell, 2004. 116(2): p. 281-297.
14.—Bartel, D. P., MicroRNAs: target recognition and regulatory functions. Cell, 2009. 136(2): p. 215-233.
15.—Rigoutsos, 1., New tricks for animal microRNAS: targeting of amino acid coding regions at conserved and nonconserved sites. Cancer Research, 2009. 69(8): p. 3245-3248.
16.—Lee, R. C., R. L. Feinbaum, and V. Ambros, The *C. elegans* heterochronic gene lin-4 encodes small RNAs with antisense complementarity to lin-14. Cell, 1993. 75(5): p. 843-854.
17.—Wightman, B., I. Ila, and G. Ruvkun, Posttranscriptional regulation of the heterochronic gene lin-14 by lin-4 mediates temporal pattern formation in *C. clegans*. Cell, 1993. 75(5): p. 855-862.
18.—Tay, Y., et al., MicroRNAs to Nanog, Oct4 and Sox2 coding regions modulate embryonic stem cell differentiation. Nature, 2008. 455(7216): p. 1124-1128.
19.—Brodersen, P. and O. Voinnet, Revisiting the principles of microRNA target recognition and mode of action. Nat Rev Mol Cell Biol, 2009. 10(2): p. 141-8.
20. [2757794]—Lal, A., et al., miR-24 Inhibits cell proliferation by targeting E2F2, MYC, and other cell-cycle genes via binding to "seedless" 3'UTR microRNA recognition elements. Mol Cell, 2009. 35(5): p. 610-25.
21.—Rigoutsos, I. and A. Tsirigos, in MicroRNAs in Development and Cancer Molecular Medicine and Medicinal Chemistry Ch. 10, ed. F. J. Slack. Vol. Vol. 1. 2010: Imperial College Press.
22. [3415692]—Xia, Z., et al., Molecular dynamics simulations of Ago silencing complexes reveal a large repertoire of admissible 'seed-less' targets. Sci Rep, 2012. 2: p. 569.
23.—Xia, 1., B. Wightman, and G. Ruvkun, A bulged lin-4/lin-14 RNA duplex is sufficient for *Caenorhabditis elegans* lin-14 temporal gradient formation. Genes Dev, 1996. 10(23): p. 3041-50.
24. [324419]—Vella, M. C., et al., The *C. elegans* microRNA let-7 binds to imperfect let-7 complementary sites from the lin-41 3'UTR. Genes Dev, 2004. 18(2): p. 132-7.
25.—Farh, K. K., et al., The widespread impact of mammalian MicroRNAs on mRNA repression and evolution. Science, 2005. 310(5755): p. 1817-21.

26.—Stark, A., et al., Animal MicroRNAs confer robustness to gene expression and have a significant impact on 3'UTR evolution. Cell, 2005. 123(6): p. 1133-46.
27.—Didiano, D. and O. Hobert, Perfect seed pairing is not a generally reliable predictor for miRNA-target interactions. Nat Struct Mol Biol, 2006. 13(9): p. 849-51.
28. [1924889]—Easow, G., A. A. Teleman, and S. M. Cohen, Isolation of microRNA targets by miRNP immunopurification. RNA, 2007. 13(8): p. 1198-204.
29. [2745094]—Baek, D., et al., The impact of microRNAs on protein output. Nature, 2008. 455(7209): p. 64-71.
30.—Selbach, M., et al., Widespread changes in protein synthesis induced by microRNAs. Nature, 2008. 455 (7209): p. 58-63.
31. [2733940]—Chi, S. W., et al., Argonaute HITS-CLIP decodes microRNA-mRNA interaction maps. Nature, 2009. 460(7254): p. 479-86.
32.—Fabian, M. R., N. Sonenberg, and W. Filipowicz, Regulation of mRNA translation and stability by microRNAs. Annu Rev Biochem, 2010. 79: p. 351-79.
33. [2861495]—Hafner, M., et al., Transcriptome-wide identification of RNA-binding protein and microRNA target sites by PAR-CLIP. Cell, 2010. 141(1): p. 129-41.
34.—Thomas, M., J. Lieberman, and A. Lal, Desperately seeking microRNA targets. Nat Struct Mol Biol, 2010. 17(10): p. 1169-74.
35. [2834287]—Zisoulis, D. G., et al., Comprehensive discovery of endogenous Argonaute binding sites in *Caenorhabditis elegans*. Nat Struct Mol Biol, 2010. 17(2): p. 173-9.
36.—Chi, S. W., G. J. Hannon, and R. B. Darnell, An alternative mode of microRNA target recognition. Nat Struct Mol Biol, 2012. 19(3): p. 321-7.
37. [3266933]—Skalsky, R. L., et al., The viral and cellular microRNA targetome in lymphoblastoid cell lines. PLoS Pathog, 2012. 8(1): p. e1002484.
38.—Calin, G. A., et al., Frequent deletions and down-regulation of micro-RNA genes miR15 and miR16 at 13q14 in chronic lymphocytic leukemia. Proc Natl Acad Sci USA, 2002. 99(24): p. 15524-9.
39.—Calin, G. A. and C. M. Croce, Chronic lymphocytic leukemia: interplay between non-coding RNAs and protein-coding genes. Blood, 2009. 114(23): p. 4761-4770.
40.—Ha, I., B. Wightman, and G. Ruvkun, A bulged lin-4/ lin-14 RNA duplex is sufficient for *Caenorhabditis elegans* lin-14 temporal gradient formation. Genes & Development, 1996. 10(23): p. 3041-3050.
41.—Ruvkun, G., et al., The 21-nucleotide let-7 RNA regulates developmental timing in *Caenorhabditis elegans*. Nature, 2000. 403(6772): p. 901-906.
42.—Didiano, D. and O. Hobert, Molecular architecture of a miRNA-regulated 3' UTR. RNA, 2008. 14(7): p. 1297-1317.
43.—Small, E. M., R. J. A. Frost, and E. N. Olson, MicroRNAs add a new dimension to cardiovascular disease. Circulation, 2010. 121(8): p. 1022-1032.
44.—Small, E. M. and E. N. Olson, Pervasive roles of microRNAs in cardiovascular biology. Nature, 2011. 469 (7330): p. 336-342.
45.—Taganov, K. D., M. P. Boldin, and D. Baltimore, MicroRNAs and immunity: tiny players in a big field. Immunity, 2007. 26(2): p. 133-137.
46.—Perkins, D. O., et al., microRNA expression in the prefrontal cortex of individuals with schizophrenia and schizoaffective disorder. Genome Biology, 2007. 8(2): p. R27.
47.—Liu, X., K. Fortin, and Z. Mourelatos, MicroRNAs: biogenesis and molecular functions. Brain Pathol, 2008. 18(1): p. 113-21.
48.—Wang, Y., et al., MicroRNA: past and present. Front Biosci, 2007. 12: p. 2316-29.
49.—Wang, W.-X., et al., The expression of microRNA miR-107 decreases early in Alzheimer's disease and may accelerate disease progression through regulation of beta-site amyloid precursor protein-cleaving enzyme 1. Journal of Neuroscience, 2008. 28(5): p. 1213-1223.
50.—Wang, W.-X., et al., miR-107 regulates granulin/progranulin with implications for traumatic brain injury and neurodegenerative disease. The American journal of pathology, 2010. 177(1): p. 334-345.
51.—Abelson, J. F., et al., Sequence variants in SLITRK1 are associated with Tourette's syndrome. Science, 2005. 310(5746): p. 317-320.
52. [2859437]—Nelson, P. T., W. X. Wang, and B. W. Rajeev, MicroRNAs (miRNAs) in neurodegenerative diseases. Brain Pathol, 2008. 18(1): p. 130-8.
53.—Hebert, S. S. and B. De Strooper, Alterations of the microRNA network cause neurodegenerative disease. Trends Neurosci, 2009. 32(4): p. 199-206.
54. [2705848]—Ibanez-Ventoso, C. and M. Driscoll, MicroRNAs in *C. elegans* Aging: Molecular Insurance for Robustness? Curr Genomics, 2009. 10(3): p. 144-53.
55. [2928499]—Somel, M., et al., MicroRNA, mRNA, and protein expression link development and aging in human and macaque brain. Genome Res, 2010. 20(9): p. 1207-18.
56.—Mendell, J. T., miRiad roles for the miR-17-92 cluster in development and disease. Cell, 2008. 133(2): p. 217-222.
57.—Vasilescu, C., et al., MicroRNA fingerprints identify miR-150 as a plasma prognostic marker in patients with sepsis. PLoS ONE, 2009. 4(10): p. e7405.
58.—Williams, A. H., et al., MicroRNA-206 delays ALS progression and promotes regeneration of neuromuscular synapses in mice. Science (New York, N.Y.), 2009. 326 (5959): p. 1549-1554.
59.—Esquela-Kerscher, A. and F. J. Slack, Oncomirs—microRNAs with a role in cancer. Nature Reviews Cancer, 2006. 6(4): p. 259-269.
60.—Hammond, S. M., MicroRNAs as tumor suppressors, in Nature Genetics. 2007, Nature Publishing Group. p. 582-583.
61.—Poliseno, L., et al., A coding-independent function of gene and pseudogene mRNAs regulates tumour biology-Supplement. Nature, 2010. 465(7301): p. 1-19.
62.—Ma, L., J. Teruya-Feldstein, and R. A. Weinberg, Tumour invasion and metastasis initiated by microRNA-10b in breast cancer. Nature, 2007. 449(7163): p. 682-688.
63.—Calin, G. A. and C. M. Croce, MicroRNA-cancer connection: the beginning of a new talc. Cancer Research, 2006. 66(15): p. 7390-7394.
64.—Lu, M., et al., An analysis of human microRNA and disease associations. PLoS ONE, 2008. 3(10): p. e3420.
65.—Godshalk, S. E., et al., A Variant in a MicroRNA complementary site in the 3' UTR of the KIT oncogene increases risk of acral melanoma. Oncogene, 2010.
66.—Ryan, B. M., A. I. Robles, and C. C. Harris, Genetic variation in microRNA networks: the implications for cancer research. Nature Reviews Cancer, 2010. 10(6): p. 389-402.
67.—Saey, T., Cancer's little helpers: Tiny pieces of RNA may turn cells to the dark side. Science News, 2010.

68.—Spizzo, R., et al., SnapShot: MicroRNAs in Cancer. Cell, 2009. 137(3): p. 586-586.c1.
69.—Ventura, A. and T. Jacks, MicroRNAs and cancer: novel miRNAs go a long way. Cell, 2009. 136(4): p. 586-591.
70.—Voorhoeve, P. M. and R. Agami, Classifying microRNAs in cancer: The good, the bad and the ugly. Biochimica et Biophysica Acta (BBA)-Reviews on Cancer, 2007. 1775(2): p. 274-282.

It is understood that the foregoing detailed description and examples are illustrative only and are not to be taken as limitations upon the scope of the invention. Various changes and modifications to the disclosed embodiments, which will be apparent to those of skill in the art, may be made without departing from the spirit and scope of the present invention.

Further, all patents and other publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventor is not entitled to antedate such disclosure by virtue of prior invention or for any other reason. All statements as to the date or representation as to the contents of these documents is based on the information available to the applicants and does not constitute any admission as to the correctness of the dates or contents of these documents.

LENGTHY TABLES

The patent contains a lengthy table section. A copy of the table is available in electronic form from the USPTO web site (https://seqdata.uspto.gov/?pageRequest=docDetail&DocID=US11293064B2). An electronic copy of the table will also be available from the USPTO upon request and payment of the fee set forth in 37 CFR 1.19(b)(3).

SEQUENCE LISTING (47972 sequences)

SEQ ID NO: 1 - DNA, 21 bp, Homo sapiens
cctcagcagggatgccccagg

SEQ ID NO: 2 - DNA, 21 bp, Homo sapiens
cctgtgacgcgggagccccca

SEQ ID NO: 3 - DNA, 22 bp, Homo sapiens
cggctccgggacggctcccctc

SEQ ID NO: 4 - DNA, 23 bp, Homo sapiens
catcattaccaggcagtattaga

SEQ ID NO: 5 - DNA, 20 bp, Homo sapiens
gagcccggagggcgaggggg

SEQ ID NO: 6 - DNA, 23 bp, Homo sapiens
caatctgaaagtcgtcctggtca

SEQ ID NO: 7 - DNA, 21 bp, Homo sapiens
ttgtctccgataacagctgac

SEQ ID NO: 8 - DNA, 23 bp, Homo sapiens
cagtctgacctagtgaagtgtca

SEQ ID NO: 9 - DNA, 20 bp, Homo sapiens
cgagaatagtctgaccaaca

SEQ ID NO: 10 - DNA, 20 bp, Homo sapiens
aggctgaagaggacgcggac

SEQ ID NO: 11 - DNA, 21 bp, Homo sapiens
gtccagttttcccgagcaccc

SEQ ID NO: 12 - DNA, 20 bp, Homo sapiens
aatgcgtcaaaataggctgg

SEQ ID NO: 13 - DNA, 21 bp, Homo sapiens
gtgtggcgtcccggtagtgtg

SEQ ID NO: 14 - DNA, 21 bp, Homo sapiens
cagaggcggcctgcaccccag

SEQ ID NO: 15 - DNA, 20 bp, Homo sapiens
gtgcacgagcgcacgtgttt

SEQ ID NO: 16 - DNA, 22 bp, Homo sapiens
tcaggctcatggggcttccagc

SEQ ID NO: 17 - DNA, 20 bp, Homo sapiens
cgcgggagcgccgcgtgggg

SEQ ID NO: 18 - DNA, 20 bp, Homo sapiens
gggtgcccttagaagatgag

SEQ ID NO: 19 - DNA, 20 bp, Homo sapiens
gttagaacaggatcccgacg

SEQ ID NO: 20 - DNA, 23 bp, Homo sapiens
tgtcctaggcatgggcgttttgg

SEQ ID NO: 21 - DNA, 21 bp, Homo sapiens
cagagttctgagctgggtgcc

SEQ ID NO: 22 - DNA, 21 bp, Homo sapiens
agaagcccactggtatgggcc

SEQ ID NO: 23 - DNA, 21 bp, Homo sapiens
agctacatttgagtagctaaa

SEQ ID NO: 24 - DNA, 22 bp, Homo sapiens
tcctgagctgggatcaggtgct

SEQ ID NO: 25 - DNA, 22 bp, Homo sapiens
gtccagagggcccaggggcttt

SEQ ID NO: 26 - DNA, 22 bp, Homo sapiens
atctgtaaaggctttatttcca

SEQ ID NO: 27 - DNA, 22 bp, Homo sapiens
tgacctgaatccaggattccga

SEQ ID NO: 28 - DNA, 20 bp, Homo sapiens
ggtcgcatagctcagtaatg

SEQ ID NO: 29 - DNA, 21 bp, Homo sapiens
accctgtagtaggctgccctg

SEQ ID NO: 30 - DNA, 22 bp, Homo sapiens
ttcactgcccttgacaatctga

SEQ ID NO: 31 - DNA, 23 bp, Homo sapiens
tagctgcgactttcagcacactg

SEQ ID NO: 32 - DNA, 22 bp, Homo sapiens
gaacataatccatgcagtctgg

SEQ ID NO: 33 - DNA, 22 bp, Homo sapiens
gccctgagagccgagtccacag

SEQ ID NO: 34 - DNA, 20 bp, Homo sapiens
gccatctgccatcggatcct

SEQ ID NO: 35 - DNA, 21 bp, Homo sapiens
gatgtcaaatcccaggaatcc

SEQ ID NO: 36 - DNA, 21 bp, Homo sapiens
agcagcaaaggatgaaatata

SEQ ID NO: 37 - DNA, 22 bp, Homo sapiens
gtaatgcctgtcggagccacca

SEQ ID NO: 38 - DNA, 23 bp, Homo sapiens
catagctatcccatggtgatggg

SEQ ID NO: 39 - DNA, 23 bp, Homo sapiens
acgtaccatcgacatcggcagta

SEQ ID NO: 40 - DNA, 20 bp, Homo sapiens
cgactctgtcgcccaagctg

SEQ ID NO: 41 - DNA, 22 bp, Homo sapiens
atacctgttaggagctactatc

SEQ ID NO: 42 - DNA, 20 bp, Homo sapiens
ggcacccccctcgcggctct

SEQ ID NO: 43 - DNA, 20 bp, Homo sapiens
gtccagttttcccagcaaaa

SEQ ID NO: 44 - DNA, 20 bp, Homo sapiens
cagcggccgcagaggagcac

SEQ ID NO: 45 - DNA, 22 bp, Homo sapiens
tgaggttcatctggtgctctga

SEQ ID NO: 46 - DNA, 22 bp, Homo sapiens
tagcgtcactcacattttggca

SEQ ID NO: 47 - DNA, 21 bp, Homo sapiens
taatactgcctggtaagcatt

SEQ ID NO: 48 - DNA, 22 bp, Homo sapiens
tgagtcattcagtttatgaatt

SEQ ID NO: 49 - DNA, 22 bp, Homo sapiens
cccgtccgtccgtccatccgtc

SEQ ID NO: 50 - DNA, 22 bp, Homo sapiens
tggaggtgatgaactgtttgca

SEQ ID NO: 51 - DNA, 22 bp, Homo sapiens
ctcttgccaaaaacatggtcac

SEQ ID NO: 52 - DNA, 23 bp, Homo sapiens
agcaatgccatgtgaggctatga

SEQ ID NO: 53 - DNA, 20 bp, Homo sapiens
ctgaaccataaactatgccg

SEQ ID NO: 54 - DNA, 20 bp, Homo sapiens
gcaaggataatgcactacag

SEQ ID NO: 55 - DNA, 20 bp, Homo sapiens
ccactacgcctcccggccag

SEQ ID NO: 56 - DNA, 22 bp, Homo sapiens
taaagtgctgggatgattggtg

SEQ ID NO: 57 - DNA, 23 bp, Homo sapiens
agcaggaggacacaggagagctg

SEQ ID NO: 58 - DNA, 24 bp, Homo sapiens
acccaggatgggggggttgcagtg

SEQ ID NO: 59 - DNA, 22 bp, Homo sapiens
tagaaaccaaaggcatagtcac

SEQ ID NO: 60 - DNA, 22 bp, Homo sapiens
tgtattattgagtgtatgcata

SEQ ID NO: 61 - DNA, 21 bp, Homo sapiens
agcccgtggacgcacactcac

SEQ ID NO: 62 - DNA, 20 bp, Homo sapiens
gctgagaatcgggtggatct

SEQ ID NO: 63 - DNA, 24 bp, Homo sapiens
gcccaagggtcaaatacagccctt

SEQ ID NO: 64 - DNA, 23 bp, Homo sapiens
agcagcaggtgcacttttatatg

SEQ ID NO: 65 - DNA, 20 bp, Homo sapiens
gggagtgaaatagaaccaag

SEQ ID NO: 66 - DNA, 21 bp, Homo sapiens
cgaagggcggctacagctccc

SEQ ID NO: 67 - DNA, 20 bp, Homo sapiens
cccagccctgcctttctgtc

SEQ ID NO: 68 - DNA, 22 bp, Homo sapiens
gggccgctggcagctgttgcga

SEQ ID NO: 69 - DNA, 22 bp, Homo sapiens
cggagaagccggcgggagcagc

SEQ ID NO: 70 - DNA, 21 bp, Homo sapiens
tactctcataaccatcggctg

SEQ ID NO: 71 - DNA, 20 bp, Homo sapiens
tgggatgaagcactgagcca

SEQ ID NO: 72 - DNA, 22 bp, Homo sapiens
tccaaaggggctgcccgagcca

SEQ ID NO: 73 - DNA, 23 bp, Homo sapiens
agccgtgggtggtgaaggaggga

SEQ ID NO: 74 - DNA, 20 bp, Homo sapiens
tgcccagtacctccaccaag

SEQ ID NO: 75 - DNA, 22 bp, Homo sapiens
tctaccttgggttgtaggtcac

SEQ ID NO: 76 - DNA, 20 bp, Homo sapiens
gtcttgctgcttggtgggtg

SEQ ID NO: 77 - DNA, 21 bp, Homo sapiens
atctggatacttaactgctat

SEQ ID NO: 78 - DNA, 22 bp, Homo sapiens
agctacagcaaagcctccacag

SEQ ID NO: 79 - DNA, 20 bp, Homo sapiens
aacatctaagtaccctgctc

SEQ ID NO: 80 - DNA, 20 bp, Homo sapiens
gcagctgtttacctagaagt

SEQ ID NO: 81 - DNA, 24 bp, Homo sapiens
ccaggcgacccctgcccctcgcca

SEQ ID NO: 82 - DNA, 21 bp, Homo sapiens
ggctggtccgataaatttata

SEQ ID NO: 83 - DNA, 22 bp, Homo sapiens
aacagtcctggtcacggagcca

SEQ ID NO: 84 - DNA, 22 bp, Homo sapiens
gttgcctgagggtgggatggtc

SEQ ID NO: 85 - DNA, 22 bp, Homo sapiens
caggtcgttgtcatggcaattg

SEQ ID NO: 86 - DNA, 21 bp, Homo sapiens
cctttggggaaacatggtcac

SEQ ID NO: 87 - DNA, 20 bp, Homo sapiens
caagatgaaatctacgattg

SEQ ID NO: 88 - DNA, 23 bp, Homo sapiens
agcgatgacagtcatcctcactg

SEQ ID NO: 89 - DNA, 23 bp, Homo sapiens
ctctgtgagagggctgcagggca

SEQ ID NO: 90 - DNA, 21 bp, Homo sapiens
tccctgtgctgatagtgctga

SEQ ID NO: 91 - DNA, 22 bp, Homo sapiens
gatctacccactgggcccccca

SEQ ID NO: 92 - DNA, 20 bp, Homo sapiens
gccggcgggagggggcccag

SEQ ID NO: 93 - DNA, 20 bp, Homo sapiens
cccagccctgctccttgtga

SEQ ID NO: 94 - DNA, 20 bp, Homo sapiens
ctgacctatgaatgtgactg

SEQ ID NO: 95 - DNA, 21 bp, Homo sapiens
ctgacctattggccaggctta

SEQ ID NO: 96 - DNA, 22 bp, Homo sapiens
ctcgtgccactgggccttggcc

SEQ ID NO: 97 - DNA, 21 bp, Homo sapiens
gatctgagatgggaaataagg

SEQ ID NO: 98 - DNA, 23 bp, Homo sapiens
tgctacccaggtacgtgggtctt

SEQ ID NO: 99 - DNA, 20 bp, Homo sapiens
gatcccattcaccttgtggt

SEQ ID NO: 100 - DNA, 22 bp, Homo sapiens
cccaaacctgctgggccacact

SEQ ID NO: 101 - DNA, 20 bp, Homo sapiens
atcccataggactgtggttt

SEQ ID NO: 102 - DNA, 21 bp, Homo sapiens
agaagctaccatctgtggatc

SEQ ID NO: 103 - DNA, 23 bp, Homo sapiens
tggctcagggacacaggacaaga

SEQ ID NO: 104 - DNA, 22 bp, Homo sapiens
taggtgccattgaaagccattg

SEQ ID NO: 105 - DNA, 22 bp, Homo sapiens
cgagtgctgccaggtctgcttc

SEQ ID NO: 106 - DNA, 22 bp, Homo sapiens
ggagaacgccgtgtgatgatgg

SEQ ID NO: 107 - DNA, 20 bp, Homo sapiens
gggcatctacgaccgcgcca

SEQ ID NO: 108 - DNA, 21 bp, Homo sapiens
ctaataatgaaaaccatcagc

SEQ ID NO: 109 - DNA, 22 bp, Homo sapiens
agcagcggtaactggacctcca

SEQ ID NO: 110 - DNA, 23 bp, Homo sapiens
accctggcggctccgggccacac

SEQ ID NO: 111 - DNA, 22 bp, Homo sapiens
acgagactcaaagccaggtgtc

SEQ ID NO: 112 - DNA, 22 bp, Homo sapiens
tgagatgaagcctcaccatctc

SEQ ID NO: 113 - DNA, 22 bp, Homo sapiens
aggtggaagccaacaatgcctt

SEQ ID NO: 114 - DNA, 20 bp, Homo sapiens
agtctccaggcaggaattac

SEQ ID NO: 115 - DNA, 22 bp, Homo sapiens
tctcccacccccactccacaat

SEQ ID NO: 116 - DNA, 21 bp, Homo sapiens
cgatctcggctcatggcaact

SEQ ID NO: 117 - DNA, 23 bp, Homo sapiens
aggcaagatgttggcataaccag

SEQ ID NO: 118 - DNA, 20 bp, Homo sapiens
acttcttactcaacacacgc

SEQ ID NO: 119 - DNA, 23 bp, Homo sapiens
tagcaccatccaggactggcaac

SEQ ID NO: 120 - DNA, 22 bp, Homo sapiens
ttgcttaagttcacatagttga

SEQ ID NO: 121 - DNA, 22 bp, Homo sapiens
atccttaactcgctcttctaga

SEQ ID NO: 122 - DNA, 20 bp, Homo sapiens
cggcggcggcgcgccgcccg

SEQ ID NO: 123 - DNA, 22 bp, Homo sapiens
ctgacaggagcactccagggtg

SEQ ID NO: 124 - DNA, 21 bp, Homo sapiens
ccactcccttcctctccacca

SEQ ID NO: 125 - DNA, 22 bp, Homo sapiens
tggctcagttcagtgaaggtgg

SEQ ID NO: 126 - DNA, 20 bp, Homo sapiens
atcccaggcgacggtgggaa

SEQ ID NO: 127 - DNA, 20 bp, Homo sapiens
ccatcatcctgcacgtggag

SEQ ID NO: 128 - DNA, 21 bp, Homo sapiens
gggggattagctcagctgggc

SEQ ID NO: 129 - DNA, 20 bp, Homo sapiens
cccccgccccaccccgcatc

SEQ ID NO: 130 - DNA, 20 bp, Homo sapiens
tcagcccctctccggcccta

SEQ ID NO: 131 - DNA, 22 bp, Homo sapiens
cactgacccactaaatataaag

SEQ ID NO: 132 - DNA, 23 bp, Homo sapiens
tgcattataactacttagttgac

SEQ ID NO: 133 - DNA, 23 bp, Homo sapiens
tcctccctcataagctctgcttc

SEQ ID NO: 134 - DNA, 20 bp, Homo sapiens
agagcttatgagggaggaga

SEQ ID NO: 135 - DNA, 20 bp, Homo sapiens
acccacccccgcggggacag

SEQ ID NO: 136 - DNA, 21 bp, Homo sapiens
ccccggggatcccggcggatc

SEQ ID NO: 137 - DNA, 21 bp, Homo sapiens
gatctgggttcaaataccaac

SEQ ID NO: 138 - DNA, 23 bp, Homo sapiens
gtggggctaaacagaggaagact

SEQ ID NO: 139 - DNA, 21 bp, Homo sapiens
gaagcgtgttctggggaaaca

SEQ ID NO: 140 - DNA, 22 bp, Homo sapiens
tccctgagacagataaggtgtc

SEQ ID NO: 141 - DNA, 20 bp, Homo sapiens
catcaccccaatttgtggtt

SEQ ID NO: 142 - DNA, 22 bp, Homo sapiens
tccctggagaagatcaggtgca

SEQ ID NO: 143 - DNA, 24 bp, Homo sapiens
ttttaagaaaatgaagaaaaaaag

SEQ ID NO: 144 - DNA, 20 bp, Homo sapiens
tggctcagcctgatgaggcc

SEQ ID NO: 145 - DNA, 20 bp, Homo sapiens
ctgacctatgggcactgtca

SEQ ID NO: 146 - DNA, 20 bp, Homo sapiens
cgggggacagtgccaggatc

SEQ ID NO: 147 - DNA, 20 bp, Homo sapiens
tagcagcacagaaatactgt

SEQ ID NO: 148 - DNA, 23 bp, Homo sapiens
cccccgccacgtgaccccgcccc

SEQ ID NO: 149 - DNA, 22 bp, Homo sapiens
gttgtgccattaaaataacttg

SEQ ID NO: 150 - DNA, 23 bp, Homo sapiens
atctggtaatctggtatgttgac

SEQ ID NO: 151 - DNA, 22 bp, Homo sapiens
gtagacccatcaaatgttttcc

SEQ ID NO: 152 - DNA, 20 bp, Homo sapiens
cgttggtcccggcgcccttt

SEQ ID NO: 153 - DNA, 22 bp, Homo sapiens
tcggaatagtctgactcgttga

SEQ ID NO: 154 - DNA, 23 bp, Homo sapiens
caagcatcacagaacaatctcct

SEQ ID NO: 155 - DNA, 23 bp, Homo sapiens
tggagaaacctgatgaacgtgac

SEQ ID NO: 156 - DNA, 20 bp, Homo sapiens
tcccatctgggtcgccaata

SEQ ID NO: 157 - DNA, 21 bp, Homo sapiens
cggcggcacctgcaattacta

SEQ ID NO: 158 - DNA, 21 bp, Homo sapiens
tcctgtactgagctggaaggc

SEQ ID NO: 159 - DNA, 21 bp, Homo sapiens
tccctgagaccccagtccatg

SEQ ID NO: 160 - DNA, 20 bp, Homo sapiens
attgtgaagcagaattcatc

SEQ ID NO: 161 - DNA, 22 bp, Homo sapiens
agctcaggggaagagccaaggc

SEQ ID NO: 162 - DNA, 21 bp, Homo sapiens
tagctgggtctgggcgttttc

SEQ ID NO: 163 - DNA, 20 bp, Homo sapiens
cccttccccacctaggcccc

SEQ ID NO: 164 - DNA, 20 bp, Homo sapiens
ggaaagcggctgtgcaaatg

SEQ ID NO: 165 - DNA, 22 bp, Homo sapiens
tgagatgaagcactgcctggga

SEQ ID NO: 166 - DNA, 22 bp, Homo sapiens
tagctggctctcagtcatggtg

SEQ ID NO: 167 - DNA, 22 bp, Homo sapiens
tgtcctgaacagtttatgggaa

SEQ ID NO: 168 - DNA, 24 bp, Homo sapiens
cggcggcggcggcgcgggtgtggg

SEQ ID NO: 169 - DNA, 23 bp, Homo sapiens
tgctgacttgtcgggcctgggtg

SEQ ID NO: 170 - DNA, 20 bp, Homo sapiens
cttataatgaaaaccattgc

SEQ ID NO: 171 - DNA, 21 bp, Homo sapiens
ccttcgcgggggaagcgcctg

SEQ ID NO: 172 - DNA, 22 bp, Homo sapiens
ggagcccggaggtgctccgggc

SEQ ID NO: 173 - DNA, 22 bp, Homo sapiens
tgcatcattaggtaatttcata

SEQ ID NO: 174 - DNA, 22 bp, Homo sapiens
cccgagtccctgatgactgtgg

SEQ ID NO: 175 - DNA, 20 bp, Homo sapiens
ctttcagagtcctacaggtg

SEQ ID NO: 176 - DNA, 21 bp, Homo sapiens
acccgagactcagtgaggtca

SEQ ID NO: 177 - DNA, 21 bp, Homo sapiens
acaacctgagtacagccaaaa

SEQ ID NO: 178 - DNA, 21 bp, Homo sapiens
agggactctgggattgtccag

SEQ ID NO: 179 - DNA, 22 bp, Homo sapiens
aaacctttattgctactagaca

SEQ ID NO: 180 - DNA, 23 bp, Homo sapiens
tcgtctgtggactaccctgtgac

SEQ ID NO: 181 - DNA, 21 bp, Homo sapiens
gaggtcaaaagggtctgtaga

SEQ ID NO: 182 - DNA, 20 bp, Homo sapiens
ggctggtctgagcctaggtc

SEQ ID NO: 183 - DNA, 20 bp, Homo sapiens
gggatggggcgcgaagcggg

SEQ ID NO: 184 - DNA, 22 bp, Homo sapiens
tgccccaaatgcaaatacccca

SEQ ID NO: 185 - DNA, 21 bp, Homo sapiens
ttaggtcatggaggtggtttt

SEQ ID NO: 186 - DNA, 20 bp, Homo sapiens
tccctggagtttcctggttc

SEQ ID NO: 187 - DNA, 20 bp, Homo sapiens
tatgtgtatctcaacctgga

SEQ ID NO: 188 - DNA, 20 bp, Homo sapiens
caggttgagatacacataac

SEQ ID NO: 189 - DNA, 22 bp, Homo sapiens
ccggccgcaggggtcatgcgct

SEQ ID NO: 190 - DNA, 20 bp, Homo sapiens
catagttctgagctggggct

SEQ ID NO: 191 - DNA, 23 bp, Homo sapiens
tgaagacccctttgaagtagttg

SEQ ID NO: 192 - DNA, 20 bp, Homo sapiens
cctatctgaggggggaaaag

SEQ ID NO: 193 - DNA, 22 bp, Homo sapiens
caagagtccctgcagaagctga

SEQ ID NO: 194 - DNA, 20 bp, Homo sapiens
ctgatggctgctgccgccac

SEQ ID NO: 195 - DNA, 22 bp, Homo sapiens
cactggttcactggggacaaac

SEQ ID NO: 196 - DNA, 24 bp, Homo sapiens
cgggcggcgggcggcggggcgggg

SEQ ID NO: 197 - DNA, 22 bp, Homo sapiens
acagtcactgctgggcgtggtg

SEQ ID NO: 198 - DNA, 20 bp, Homo sapiens
tctgatttccattaccaact

SEQ ID NO: 199 - DNA, 21 bp, Homo sapiens
tccctgtccagatcactggct

SEQ ID NO: 200 - DNA, 20 bp, Homo sapiens
atcacattattgacctttgg

SEQ ID NO: 201 - DNA, 20 bp, Homo sapiens
atctatcctgctccctacag

SEQ ID NO: 202 - DNA, 20 bp, Homo sapiens
gctaggatcagactgatcat

SEQ ID NO: 203 - DNA, 22 bp, Homo sapiens
atatactgcctgacagtagcag

SEQ ID NO: 204 - DNA, 20 bp, Homo sapiens
ggaggttgaggccagaccac

SEQ ID NO: 205 - DNA, 20 bp, Homo sapiens
cgtaccgtgagtacttcata

SEQ ID NO: 206 - DNA, 22 bp, Homo sapiens
tggctcagcctgaactcccacg

SEQ ID NO: 207 - DNA, 23 bp, Homo sapiens
agcctccccaccacttcctccct

SEQ ID NO: 208 - DNA, 20 bp, Homo sapiens
ggtgatgcggagttaggtca

SEQ ID NO: 209 - DNA, 22 bp, Homo sapiens
tccactgttaaactgataggct

SEQ ID NO: 210 - DNA, 23 bp, Homo sapiens
tggatcagtctgatgaagcactt

SEQ ID NO: 211 - DNA, 22 bp, Homo sapiens
gtttcagcaataaggccagggg

SEQ ID NO: 212 - DNA, 24 bp, Homo sapiens
cgctgccacttcaagtcacgaaat

SEQ ID NO: 213 - DNA, 22 bp, Homo sapiens
tgagtcaggcagggtatggagt

SEQ ID NO: 214 - DNA, 21 bp, Homo sapiens
gcttctggggaaacttcaggg

SEQ ID NO: 215 - DNA, 22 bp, Homo sapiens
tgagatgaagcagtgttgctct

SEQ ID NO: 216 - DNA, 23 bp, Homo sapiens
gctagtatcatcagtgacttgac

SEQ ID NO: 217 - DNA, 20 bp, Homo sapiens
tccccggcacctccaactca

SEQ ID NO: 218 - DNA, 23 bp, Homo sapiens
ccctcccttcccccgctgcccct

SEQ ID NO: 219 - DNA, 20 bp, Homo sapiens
agcgttgtcatattgcccac

SEQ ID NO: 220 - DNA, 23 bp, Homo sapiens
cttgtcagagcgagggcgagatg

SEQ ID NO: 221 - DNA, 22 bp, Homo sapiens
gcatacctgaaacaagtcctgc

SEQ ID NO: 222 - DNA, 21 bp, Homo sapiens
gcttcttgtaaacatttagga

SEQ ID NO: 223 - DNA, 21 bp, Homo sapiens
gtgtatgatgacaactcggta

SEQ ID NO: 224 - DNA, 21 bp, Homo sapiens
cccatactttcacccctctct

SEQ ID NO: 225 - DNA, 21 bp, Homo sapiens
ataggcttttcattccagtga

SEQ ID NO: 226 - DNA, 20 bp, Homo sapiens
atgtcatttttaaataccca

SEQ ID NO: 227 - DNA, 20 bp, Homo sapiens
acacaggtggttgggtatag

SEQ ID NO: 228 - DNA, 23 bp, Homo sapiens
gttcacaaaggatgaaattaaag

SEQ ID NO: 229 - DNA, 23 bp, Homo sapiens
ggccagttttcccaggaaggttt

SEQ ID NO: 230 - DNA, 23 bp, Homo sapiens
gggcgttgcccagggctggtgtt

SEQ ID NO: 231 - DNA, 22 bp, Homo sapiens
tgaggaagtagcccacgttgac

SEQ ID NO: 232 - DNA, 20 bp, Homo sapiens
ctcagaatccctcccagatc

SEQ ID NO: 233 - DNA, 20 bp, Homo sapiens
cctgctctagcggtggattc

SEQ ID NO: 234 - DNA, 22 bp, Homo sapiens
accgaggcccagccccacctgc

SEQ ID NO: 235 - DNA, 23 bp, Homo sapiens
cgcccggggcacccgggagcccc

SEQ ID NO: 236 - DNA, 20 bp, Homo sapiens
agacatgtcagtgtagtgac

SEQ ID NO: 237 - DNA, 20 bp, Homo sapiens
tgagaactgaattccactgg

SEQ ID NO: 238 - DNA, 22 bp, Homo sapiens
gcaatggtggtgactgttgtag

SEQ ID NO: 239 - DNA, 20 bp, Homo sapiens
caaacctattaaaatccttg

SEQ ID NO: 240 - DNA, 22 bp, Homo sapiens
tgaggtagtagatcagggaggg

SEQ ID NO: 241 - DNA, 21 bp, Homo sapiens
gtccagttttccctggccacc

SEQ ID NO: 242 - DNA, 23 bp, Homo sapiens
aacttaacagaataccactattc

SEQ ID NO: 243 - DNA, 20 bp, Homo sapiens
atctttacaagctattttgt

SEQ ID NO: 244 - DNA, 22 bp, Homo sapiens
tatacaaatttggggctctgac

SEQ ID NO: 245 - DNA, 22 bp, Homo sapiens
catgttacatcattgctacttc

SEQ ID NO: 246 - DNA, 22 bp, Homo sapiens
gaggcagctggagctgaacact

SEQ ID NO: 247 - DNA, 22 bp, Homo sapiens
tgacagtaataacttataaagt

SEQ ID NO: 248 - DNA, 22 bp, Homo sapiens
tgagtcaccactcccggcccca

SEQ ID NO: 249 - DNA, 22 bp, Homo sapiens
cagctcattattgactacttag

SEQ ID NO: 250 - DNA, 22 bp, Homo sapiens
tgagacaggatgtcacgctgtc

SEQ ID NO: 251 - DNA, 22 bp, Homo sapiens
ctcacagtggcgcctgagggct

SEQ ID NO: 252 - DNA, 23 bp, Homo sapiens
cattcacaggcagagtacttaca

SEQ ID NO: 253 - DNA, 20 bp, Homo sapiens
tgaggtaggaggtttgcctg

SEQ ID NO: 254 - DNA, 23 bp, Homo sapiens
tgctctgaggacgcaggatcagc

SEQ ID NO: 255 - DNA, 21 bp, Homo sapiens
acagcaggcacagaacctaca

SEQ ID NO: 256 - DNA, 21 bp, Homo sapiens
cgctcttctacaaaaaataca

SEQ ID NO: 257 - DNA, 22 bp, Homo sapiens
tgtcagtttagcattatggggc

SEQ ID NO: 258 - DNA, 20 bp, Homo sapiens
gtcggctgcgagaatgccgt

SEQ ID NO: 259 - DNA, 21 bp, Homo sapiens
gctcttggcaggccagtgatt

SEQ ID NO: 260 - DNA, 20 bp, Homo sapiens
cgccgctcgctccctcccgc

SEQ ID NO: 261 - DNA, 23 bp, Homo sapiens
agcatacccagcactggctaact

SEQ ID NO: 262 - DNA, 20 bp, Homo sapiens
ggggccctacaaccctgtga

SEQ ID NO: 263 - DNA, 20 bp, Homo sapiens
cgagcaagcccgctcctaag

SEQ ID NO: 264 - DNA, 23 bp, Homo sapiens
agcagcaggaggtcctcgaggga

SEQ ID NO: 265 - DNA, 22 bp, Homo sapiens
tggagagaaaggcagaaaagtt

SEQ ID NO: 266 - DNA, 21 bp, Homo sapiens
tcaccgagcttcctggtctgt

SEQ ID NO: 267 - DNA, 22 bp, Homo sapiens
agcctcccagtctggcctgagt

SEQ ID NO: 268 - DNA, 21 bp, Homo sapiens
tttccccatgtgagagtgaac

SEQ ID NO: 269 - DNA, 22 bp, Homo sapiens
tttattcattcacattcctact

SEQ ID NO: 270 - DNA, 22 bp, Homo sapiens
tctgtgaaatatttgaaatcag

SEQ ID NO: 271 - DNA, 21 bp, Homo sapiens
aaggagctcacagtccattga

SEQ ID NO: 272 - DNA, 22 bp, Homo sapiens
tgaggtgatcaaaggggaggtc

SEQ ID NO: 273 - DNA, 22 bp, Homo sapiens
gccctgagcaaagccagtgtga

SEQ ID NO: 274 - DNA, 20 bp, Homo sapiens
cttttaatgttcttgtatgc

SEQ ID NO: 275 - DNA, 23 bp, Homo sapiens
aatactcataaataccactactc

SEQ ID NO: 276 - DNA, 22 bp, Homo sapiens
tctactacatgcatagcaccgg

SEQ ID NO: 277 - DNA, 22 bp, Homo sapiens
gtctgcaaagcaagacgatgtg

SEQ ID NO: 278 - DNA, 21 bp, Homo sapiens
ccgatattataagataaaaaa

SEQ ID NO: 279 - DNA, 20 bp, Homo sapiens
ggttcagccacccgagacct

SEQ ID NO: 280 - DNA, 20 bp, Homo sapiens
tcagcttttactctattatg

SEQ ID NO: 281 - DNA, 20 bp, Homo sapiens
tggtgatgtagcaataggtt

SEQ ID NO: 282 - DNA, 22 bp, Homo sapiens
tccagtggaccagctgaacact

SEQ ID NO: 283 - DNA, 22 bp, Homo sapiens
tgaggtagtattggtgtgaatg

SEQ ID NO: 284 - DNA, 22 bp, Homo sapiens
cacccttgtaataatccaagca

SEQ ID NO: 285 - DNA, 21 bp, Homo sapiens
ggcatggttctgactagctgg

SEQ ID NO: 286 - DNA, 22 bp, Homo sapiens
tggcagccatgcaattagtata

SEQ ID NO: 287 - DNA, 22 bp, Homo sapiens
aatgctattgaagtcatattgg

SEQ ID NO: 288 - DNA, 23 bp, Homo sapiens
agctctgaacattttatgaaacc

SEQ ID NO: 289 - DNA, 21 bp, Homo sapiens
aatgatgccatatgattactg

SEQ ID NO: 290 - DNA, 22 bp, Homo sapiens
cagattcccaagtttataagct

SEQ ID NO: 291 - DNA, 21 bp, Homo sapiens
acaccaaacaccaccatgttc

SEQ ID NO: 292 - DNA, 20 bp, Homo sapiens
tttggcaatggtaatgagtg

SEQ ID NO: 293 - DNA, 21 bp, Homo sapiens
agcgcactgtggcttcaaact

SEQ ID NO: 294 - DNA, 20 bp, Homo sapiens
tacagcaggcaactcacttc

SEQ ID NO: 295 - DNA, 22 bp, Homo sapiens
gcggactctggagccaggtgac

SEQ ID NO: 296 - DNA, 22 bp, Homo sapiens
actgggtctgcaaataccaacc

SEQ ID NO: 297 - DNA, 22 bp, Homo sapiens
aacaaggatggtggcaggagtt

SEQ ID NO: 298 - DNA, 22 bp, Homo sapiens
tggctcatgtcagcaggacaca

SEQ ID NO: 299 - DNA, 22 bp, Homo sapiens
tatggcttttcatgaagctgtc

SEQ ID NO: 300 - DNA, 21 bp, Homo sapiens
gtatgttgctcagggctaacc

SEQ ID NO: 301 - DNA, 22 bp, Homo sapiens
atcatcttattagtagccctca

SEQ ID NO: 302 - DNA, 23 bp, Homo sapiens
tactgatggtgagggcaccaacc

SEQ ID NO: 303 - DNA, 24 bp, Homo sapiens
gggcaggcggggggcatgggggga

SEQ ID NO: 304 - DNA, 22 bp, Homo sapiens
taggcatagatagcactacact

SEQ ID NO: 305 - DNA, 21 bp, Homo sapiens
tggtgaagttattgcttgaga

SEQ ID NO: 306 - DNA, 21 bp, Homo sapiens
actggacttggagtcagacaa

SEQ ID NO: 307 - DNA, 22 bp, Homo sapiens
ctagactctgagctgagtacag

SEQ ID NO: 308 - DNA, 20 bp, Homo sapiens
ttaatcttgtaagctttaga

SEQ ID NO: 309 - DNA, 21 bp, Homo sapiens
tagcaccattcagtgagcacc

SEQ ID NO: 310 - DNA, 20 bp, Homo sapiens
catgcagctacttctgtatg

SEQ ID NO: 311 - DNA, 21 bp, Homo sapiens
ctgacccgtgaattgacagtt

SEQ ID NO: 312 - DNA, 23 bp, Homo sapiens
ccactgcagtctgtaagtaagag

SEQ ID NO: 313 - DNA, 22 bp, Homo sapiens
agtccctttgtcaaatacccca

SEQ ID NO: 314 - DNA, 20 bp, Homo sapiens
atccaatagtctgacccact

SEQ ID NO: 315 - DNA, 22 bp, Homo sapiens
gttaaatgatccttaaaggcag

SEQ ID NO: 316 - DNA, 23 bp, Homo sapiens
tctagtatgtgctgtgcaccagt

SEQ ID NO: 317 - DNA, 22 bp, Homo sapiens
tagaaaatgagagatagagggg

SEQ ID NO: 318 - DNA, 23 bp, Homo sapiens
catgctaactacttaatctgggt

SEQ ID NO: 319 - DNA, 23 bp, Homo sapiens
gagaaacagggaacatggagtga

SEQ ID NO: 320 - DNA, 22 bp, Homo sapiens
gttctctaaaggctcaagagtc

SEQ ID NO: 321 - DNA, 21 bp, Homo sapiens
gctacatgctctcctagccag

SEQ ID NO: 322 - DNA, 22 bp, Homo sapiens
agctacattgtctggagttggg

SEQ ID NO: 323 - DNA, 22 bp, Homo sapiens
ttagttgttatattgctgcgtt

SEQ ID NO: 324 - DNA, 20 bp, Homo sapiens
cttgctgtcttagcggtggc

SEQ ID NO: 325 - DNA, 20 bp, Homo sapiens
gattggggggggctcacaat

SEQ ID NO: 326 - DNA, 22 bp, Homo sapiens
tagctaaagtctgactatgctg

SEQ ID NO: 327 - DNA, 20 bp, Homo sapiens
acataagctgtgcatatgca

SEQ ID NO: 328 - DNA, 21 bp, Homo sapiens
ccatatgctgttgcttctctc

SEQ ID NO: 329 - DNA, 20 bp, Homo sapiens
taaaggcgactaccatacag

SEQ ID NO: 330 - DNA, 23 bp, Homo sapiens
ggctgacttgtcaaatattttat

SEQ ID NO: 331 - DNA, 23 bp, Homo sapiens
ttttcagaaaataactattcttc

SEQ ID NO: 332 - DNA, 22 bp, Homo sapiens
tatagataacttgactactttc

SEQ ID NO: 333 - DNA, 20 bp, Homo sapiens
ccttttgtcatattgcttgc

SEQ ID NO: 334 - DNA, 22 bp, Homo sapiens
tgtcagtttgagtttattgatg

SEQ ID NO: 335 - DNA, 23 bp, Homo sapiens
taagggaacccttgtacactgtc

SEQ ID NO: 336 - DNA, 22 bp, Homo sapiens
tacatgagagcctagtccacag

SEQ ID NO: 337 - DNA, 20 bp, Homo sapiens
atgttcattgtgtcttaaag

SEQ ID NO: 338 - DNA, 20 bp, Homo sapiens
tcctcccgggcgatggcctg

SEQ ID NO: 339 - DNA, 21 bp, Homo sapiens
tagcttatctctggccattca

SEQ ID NO: 340 - DNA, 22 bp, Homo sapiens
tgaaagtaatccaaatattttg

SEQ ID NO: 341 - DNA, 20 bp, Homo sapiens
gcagtgcactacagaattgg

SEQ ID NO: 342 - DNA, 22 bp, Homo sapiens
gaaagtcacaaagccaggttga

SEQ ID NO: 343 - DNA, 22 bp, Homo sapiens
tttcagtaatctgggatgtttg

SEQ ID NO: 344 - DNA, 20 bp, Homo sapiens
gtctctggggaaacttctcc

SEQ ID NO: 345 - DNA, 21 bp, Homo sapiens
cagccagcaggctggacttgc

SEQ ID NO: 346 - DNA, 24 bp, Homo sapiens
gtggtttgagttactcatgccttc

SEQ ID NO: 347 - DNA, 23 bp, Homo sapiens
taaggtgcaactaactactcacc

SEQ ID NO: 348 - DNA, 23 bp, Homo sapiens
cactgacctgctgccgcttttgc

SEQ ID NO: 349 - DNA, 23 bp, Homo sapiens
actggaacccttcatatggggtt

SEQ ID NO: 350 - DNA, 22 bp, Homo sapiens
gtctgaaacagtggcgtggggg

SEQ ID NO: 351 - DNA, 21 bp, Homo sapiens
ccacgcccggttagttttttc

SEQ ID NO: 352 - DNA, 24 bp, Homo sapiens
cagcctctttatatatatgatttt

SEQ ID NO: 353 - DNA, 22 bp, Homo sapiens
cagcagtgtacaggcattgcgc

SEQ ID NO: 354 - DNA, 20 bp, Homo sapiens
ccacgggttcattttctaac

SEQ ID NO: 355 - DNA, 22 bp, Homo sapiens
aagcagtggcatgggctgggca

SEQ ID NO: 356 - DNA, 20 bp, Homo sapiens
acgacgtcagtgctcctgtg

SEQ ID NO: 357 - DNA, 22 bp, Homo sapiens
atggagatcatctagtccacag

SEQ ID NO: 358 - DNA, 22 bp, Homo sapiens
agactgggtagtttataaaggt

SEQ ID NO: 359 - DNA, 23 bp, Homo sapiens
tcctgagggccacagggaaccat

SEQ ID NO: 360 - DNA, 21 bp, Homo sapiens
cagcagcataagtcagaaact

SEQ ID NO: 361 - DNA, 22 bp, Homo sapiens
ggctactatgggatacttgtgt

SEQ ID NO: 362 - DNA, 23 bp, Homo sapiens
taagaatagtctgactcatgaag

SEQ ID NO: 363 - DNA, 21 bp, Homo sapiens
catagtgagtctggtcttgag

SEQ ID NO: 364 - DNA, 22 bp, Homo sapiens
ccaaatctgccagcactctgtc

SEQ ID NO: 365 - DNA, 20 bp, Homo sapiens
ccatggcacagtaataaaga

SEQ ID NO: 366 - DNA, 22 bp, Homo sapiens
tatgcaatagagcatgcacata

SEQ ID NO: 367 - DNA, 22 bp, Homo sapiens
tgagtcaggtgacccatcccca

SEQ ID NO: 368 - DNA, 20 bp, Homo sapiens
tcaggatgataagataatgt

SEQ ID NO: 369 - DNA, 21 bp, Homo sapiens
gctacaactctgaaatcagaa

SEQ ID NO: 370 - DNA, 23 bp, Homo sapiens
atagcatagaccagcagtggtca

SEQ ID NO: 371 - DNA, 20 bp, Homo sapiens
cttcgtgatcttcgtgatct

SEQ ID NO: 372 - DNA, 23 bp, Homo sapiens
caaagactgtggatgtactgtct

SEQ ID NO: 373 - DNA, 22 bp, Homo sapiens
ctgacctgtgagccagtcagtt

SEQ ID NO: 374 - DNA, 22 bp, Homo sapiens
ctgcttgtcctagggctccaag

SEQ ID NO: 375 - DNA, 22 bp, Homo sapiens
ggtggcatctaggctcactgca

SEQ ID NO: 376 - DNA, 24 bp, Homo sapiens
cccttattccagggaaatattttt

SEQ ID NO: 377 - DNA, 20 bp, Homo sapiens
cagcctatcccccataggag

SEQ ID NO: 378 - DNA, 22 bp, Homo sapiens
agcgaatacagtactaatctct

SEQ ID NO: 379 - DNA, 21 bp, Homo sapiens
agcctcttgcccattatttct

SEQ ID NO: 380 - DNA, 22 bp, Homo sapiens
ctttcagagtttcttatggaca

SEQ ID NO: 381 - DNA, 21 bp, Homo sapiens
gcatggcacctgcatagtgca

SEQ ID NO: 382 - DNA, 24 bp, Homo sapiens
cagcaatttttccaacctggattc

SEQ ID NO: 383 - DNA, 20 bp, Homo sapiens
tttgtaggacacattgaatc

SEQ ID NO: 384 - DNA, 21 bp, Homo sapiens
cccaggtattacgtctactac

SEQ ID NO: 385 - DNA, 20 bp, Homo sapiens
ctgtaaggctttggagatga

SEQ ID NO: 386 - DNA, 22 bp, Homo sapiens
tgacttgattactgtcgcttta

SEQ ID NO: 387 - DNA, 21 bp, Homo sapiens
gagaatccactccatacccca

SEQ ID NO: 388 - DNA, 20 bp, Homo sapiens
gtctagttttccaggaatcc

SEQ ID NO: 389 - DNA, 22 bp, Homo sapiens
tccctgagaccctgacttggtt

SEQ ID NO: 390 - DNA, 22 bp, Homo sapiens
aatgcatacagagttcggcata

SEQ ID NO: 391 - DNA, 22 bp, Homo sapiens
tgctgcatcaccaaatacccca

SEQ ID NO: 392 - DNA, 22 bp, Homo sapiens
agggaagtcaatggattaagca

SEQ ID NO: 393 - DNA, 24 bp, Homo sapiens
cttctttttatttagagttatttg

SEQ ID NO: 394 - DNA, 20 bp, Homo sapiens
ttggctgcaatcactattcc

SEQ ID NO: 395 - DNA, 22 bp, Homo sapiens
ttctttccaaattgttccacag

SEQ ID NO: 396 - DNA, 21 bp, Homo sapiens
tagcaaatgggttagaacaac

SEQ ID NO: 397 - DNA, 22 bp, Homo sapiens
aaacctcaccatgatgagctat

SEQ ID NO: 398 - DNA, 21 bp, Homo sapiens
ctgacctatcttaacttggaa

SEQ ID NO: 399 - DNA, 22 bp, Homo sapiens
caaagtgcttactcacgtagca

SEQ ID NO: 400 - DNA, 20 bp, Homo sapiens
aatttaatgctcttaccaaa

SEQ ID NO: 401 - DNA, 20 bp, Homo sapiens
cagcattgtacagggtgttc

SEQ ID NO: 402 - DNA, 22 bp, Homo sapiens
gctgtgccattgatagctggtt

SEQ ID NO: 403 - DNA, 22 bp, Homo sapiens
tagcagcacagccacgccagtg

SEQ ID NO: 404 - DNA, 22 bp, Homo sapiens
gtgggtcttgatttagttttat

SEQ ID NO: 405 - DNA, 23 bp, Homo sapiens
tagcttatgttcacagtactgtc

SEQ ID NO: 406 - DNA, 20 bp, Homo sapiens
agaggaatttcccaaccctg

SEQ ID NO: 407 - DNA, 21 bp, Homo sapiens
gctaaggaaggagggggtaac

SEQ ID NO: 408 - DNA, 24 bp, Homo sapiens
tagatacaggtgaaatatttgtat

SEQ ID NO: 409 - DNA, 20 bp, Homo sapiens
tagcaccatttgattatctc

SEQ ID NO: 410 - DNA, 22 bp, Homo sapiens
tagcaggttttgaaatcagtaa

SEQ ID NO: 411 - DNA, 23 bp, Homo sapiens
agtgcgggcttgcatggctgcat

SEQ ID NO: 412 - DNA, 23 bp, Homo sapiens
ctcgtagtgattatggtctactt

SEQ ID NO: 413 - DNA, 21 bp, Homo sapiens
tagcaggtagagaagctacat

SEQ ID NO: 414 - DNA, 22 bp, Homo sapiens
gcatgtccactcaaatacccca

SEQ ID NO: 415 - DNA, 20 bp, Homo sapiens
aaatattctgctccctacac

SEQ ID NO: 416 - DNA, 20 bp, Homo sapiens
acctacccttaatctaggaa

SEQ ID NO: 417 - DNA, 23 bp, Homo sapiens
tagcaccatcctcctagtctgtg

SEQ ID NO: 418 - DNA, 20 bp, Homo sapiens
caatggcacgataacggctc

SEQ ID NO: 419 - DNA, 23 bp, Homo sapiens
aaaaactcatatttaaactgagg

SEQ ID NO: 420 - DNA, 23 bp, Homo sapiens
cactgacagtgaccagcaaaaac

SEQ ID NO: 421 - DNA, 23 bp, Homo sapiens
ttagtggaactaccatacaaact

SEQ ID NO: 422 - DNA, 23 bp, Homo sapiens
atcagctaaacagtttatccccc

SEQ ID NO: 423 - DNA, 20 bp, Homo sapiens
tccctgagacaagccatgga

SEQ ID NO: 424 - DNA, 22 bp, Homo sapiens
atcatgccattgacccaaagga

SEQ ID NO: 425 - DNA, 24 bp, Homo sapiens
taataattgctttatggatgcaag

SEQ ID NO: 426 - DNA, 22 bp, Homo sapiens
taagtcaccactggtatgggtt

SEQ ID NO: 427 - DNA, 21 bp, Homo sapiens
cattttgattagcagatgaaa

SEQ ID NO: 428 - DNA, 20 bp, Homo sapiens
atcatggggtaacctaactg

SEQ ID NO: 429 - DNA, 24 bp, Homo sapiens
tatgctgagtgatatataatcagt

SEQ ID NO: 430 - DNA, 20 bp, Homo sapiens
tgattacctaattcgacata

SEQ ID NO: 431 - DNA, 21 bp, Homo sapiens
tctcccaaccctggtacctca

SEQ ID NO: 432 - DNA, 21 bp, Homo sapiens
catattgagtgcgcccaagaa

SEQ ID NO: 433 - DNA, 22 bp, Homo sapiens
tatccatcattccccgcacttg

SEQ ID NO: 434 - DNA, 22 bp, Homo sapiens
gcccacaggctaaaatccaaac

SEQ ID NO: 435 - DNA, 22 bp, Homo sapiens
ttcatcattcttgactttcttg

SEQ ID NO: 436 - DNA, 20 bp, Homo sapiens
tggctcagttcaggtccctt

SEQ ID NO: 437 - DNA, 20 bp, Homo sapiens
gtagttcacaagctaagaat

SEQ ID NO: 438 - DNA, 21 bp, Homo sapiens
tgatgttgcccagaatattcc

SEQ ID NO: 439 - DNA, 22 bp, Homo sapiens
tagcaccatatgattagctact

SEQ ID NO: 440 - DNA, 22 bp, Homo sapiens
tggactgggagcaaagcaaaac

SEQ ID NO: 441 - DNA, 21 bp, Homo sapiens
caagctgaggacagtggagag

SEQ ID NO: 442 - DNA, 20 bp, Homo sapiens
tgagcacagcagtacatgcc

SEQ ID NO: 443 - DNA, 20 bp, Homo sapiens
ggctattctgctaaagcact

SEQ ID NO: 444 - DNA, 21 bp, Homo sapiens
atggcacctactgaaccagct

SEQ ID NO: 445 - DNA, 22 bp, Homo sapiens
taggtggagataggtgatgtga

SEQ ID NO: 446 - DNA, 22 bp, Homo sapiens
tgggagctggactgtcctcact

SEQ ID NO: 447 - DNA, 22 bp, Homo sapiens
gtgactgaatgaccttacccca

SEQ ID NO: 448 - DNA, 22 bp, Homo sapiens
gctagttacagaaatatttgtt

SEQ ID NO: 449 - DNA, 20 bp, Homo sapiens
gggacagtaaggaaatgttg

SEQ ID NO: 450 - DNA, 20 bp, Homo sapiens
ctaccaggttgatcctgatc

SEQ ID NO: 451 - DNA, 20 bp, Homo sapiens
tttttaatgttcctgttgtt

SEQ ID NO: 452 - DNA, 23 bp, Homo sapiens
ttagaatagtctgactcatgcag

SEQ ID NO: 453 - DNA, 24 bp, Homo sapiens
ggctacagctgggggtggggtgtt

SEQ ID NO: 454 - DNA, 22 bp, Homo sapiens
ttgcttatcctcagtatgccag

SEQ ID NO: 455 - DNA, 23 bp, Homo sapiens
tctaggcgtctcacatactttca

SEQ ID NO: 456 - DNA, 22 bp, Homo sapiens
atctgtatgctgaaagccgtta

SEQ ID NO: 457 - DNA, 21 bp, Homo sapiens
caacggaataaaccctcgttt

SEQ ID NO: 458 - DNA, 22 bp, Homo sapiens
gagaccaccccttgtaccagtg

SEQ ID NO: 459 - DNA, 20 bp, Homo sapiens
ggaggcccggggagagtatc

SEQ ID NO: 460 - DNA, 20 bp, Homo sapiens
actgttgcctctccagcaac

SEQ ID NO: 461 - DNA, 20 bp, Homo sapiens
ctgctagacccagcccaaat

SEQ ID NO: 462 - DNA, 20 bp, Homo sapiens
gaaaattatagaggtggtct

SEQ ID NO: 463 - DNA, 22 bp, Homo sapiens
gccctcccgcccagcgcggcaa

SEQ ID NO: 464 - DNA, 20 bp, Homo sapiens
ccgcgcggcgcctcgcccct

SEQ ID NO: 465 - DNA, 22 bp, Homo sapiens
caggagttttcccaggagcttt

SEQ ID NO: 466 - DNA, 20 bp, Homo sapiens
atagcacggtgatgctgtgt

SEQ ID NO: 467 - DNA, 21 bp, Homo sapiens
cgattttgctcaggtagctgc

SEQ ID NO: 468 - DNA, 21 bp, Homo sapiens
cagaaatctatcccacacagt

SEQ ID NO: 469 - DNA, 20 bp, Homo sapiens
cccataactggcttttacag

SEQ ID NO: 470 - DNA, 23 bp, Homo sapiens
ccccgccgcctctcctcctcctc

SEQ ID NO: 471 - DNA, 20 bp, Homo sapiens
tagagccaggactcgagcag

SEQ ID NO: 472 - DNA, 22 bp, Homo sapiens
ttcaagtaaaagctgatagtgg

SEQ ID NO: 473 - DNA, 21 bp, Homo sapiens
tgtaacagcaactccaggcag

SEQ ID NO: 474 - DNA, 20 bp, Homo sapiens
cccctatagtctttttcaac

SEQ ID NO: 475 - DNA, 23 bp, Homo sapiens
gacataaatccatgcaaagcact

SEQ ID NO: 476 - DNA, 22 bp, Homo sapiens
aaactacttggtagcagtctgg

SEQ ID NO: 477 - DNA, 22 bp, Homo sapiens
atcacattgccagttgggcttt

SEQ ID NO: 478 - DNA, 22 bp, Homo sapiens
ttttctctcaggatgaggtgta

SEQ ID NO: 479 - DNA, 22 bp, Homo sapiens
tgaggtaggctgggtgccctgg

SEQ ID NO: 480 - DNA, 20 bp, Homo sapiens
ctccagttttcccaggacat

SEQ ID NO: 481 - DNA, 22 bp, Homo sapiens
tgcaagatgcttgagataggct

SEQ ID NO: 482 - DNA, 21 bp, Homo sapiens
agattgctgcttggtaccctg

SEQ ID NO: 483 - DNA, 22 bp, Homo sapiens
ttttcagagtttattgaacact

SEQ ID NO: 484 - DNA, 21 bp, Homo sapiens
acctcagaaggtctcactttc

SEQ ID NO: 485 - DNA, 20 bp, Homo sapiens
cccagcataagaataggaca

SEQ ID NO: 486 - DNA, 22 bp, Homo sapiens
tgtcagtcccagttgatgtttt

SEQ ID NO: 487 - DNA, 21 bp, Homo sapiens
agctctctagacactgggctg

SEQ ID NO: 488 - DNA, 23 bp, Homo sapiens
tgaggccgagaaggcaaccgcga

SEQ ID NO: 489 - DNA, 22 bp, Homo sapiens
ggcggcagcttccggagggttg

SEQ ID NO: 490 - DNA, 21 bp, Homo sapiens
acctgccaaaccactctggtc

SEQ ID NO: 491 - DNA, 21 bp, Homo sapiens
gggtatatacctaatgactca

SEQ ID NO: 492 - DNA, 22 bp, Homo sapiens
gagcgttgctcagggagccaat

SEQ ID NO: 493 - DNA, 20 bp, Homo sapiens
gggggcggggagcggtctgg

SEQ ID NO: 494 - DNA, 22 bp, Homo sapiens
cagcactgcccagggctaaggc

SEQ ID NO: 495 - DNA, 20 bp, Homo sapiens
tataggccatttcgctttta

SEQ ID NO: 496 - DNA, 22 bp, Homo sapiens
gaattgaagccctattctcttg

SEQ ID NO: 497 - DNA, 23 bp, Homo sapiens
gagctggtcaaaggtagtcactt

SEQ ID NO: 498 - DNA, 23 bp, Homo sapiens
tgtcaacccactgggattttaca

SEQ ID NO: 499 - DNA, 21 bp, Homo sapiens
agatggagcatcaatggcatc

SEQ ID NO: 500 - DNA, 22 bp, Homo sapiens
tcccttctcaaagctgaatgct

SEQ ID NO: 501 - DNA, 20 bp, Homo sapiens
attttgtcttcagtaccaag

SEQ ID NO: 502 - DNA, 20 bp, Homo sapiens
aggaaactctgtgttctgtg

SEQ ID NO: 503 - DNA, 20 bp, Homo sapiens
ggactggcggtggctaacat

SEQ ID NO: 504 - DNA, 24 bp, Homo sapiens
tataggcgacaaccacgtggtcac

SEQ ID NO: 505 - DNA, 21 bp, Homo sapiens
cgggtgcatggaggtggtacc

SEQ ID NO: 506 - DNA, 22 bp, Homo sapiens
tagcaccaaccagggcgcccag

SEQ ID NO: 507 - DNA, 22 bp, Homo sapiens
ttagaatttgagttgcgttttc

SEQ ID NO: 508 - DNA, 22 bp, Homo sapiens
tcagtcacccagccatactttt

SEQ ID NO: 509 - DNA, 22 bp, Homo sapiens
tggctcatggaccgtctttgtc

SEQ ID NO: 510 - DNA, 21 bp, Homo sapiens
aagtaaatgaccagcatgcat

SEQ ID NO: 511 - DNA, 23 bp, Homo sapiens
gctgatgccctgacaggctgtca

SEQ ID NO: 512 - DNA, 23 bp, Homo sapiens
gagccatgatgataccactgagc

SEQ ID NO: 513 - DNA, 22 bp, Homo sapiens
tgacctgggtctactatccttg

SEQ ID NO: 514 - DNA, 21 bp, Homo sapiens
tgagatgaagcactgcctctc

SEQ ID NO: 515 - DNA, 22 bp, Homo sapiens
tgccaatgtagcggtaatgctg

SEQ ID NO: 516 - DNA, 23 bp, Homo sapiens
aatagcctctttacacagtacct

SEQ ID NO: 517 - DNA, 20 bp, Homo sapiens
tcttcaatgtctgccaccat

SEQ ID NO: 518 - DNA, 21 bp, Homo sapiens
gtcatgggtccaaatgcccac

SEQ ID NO: 519 - DNA, 22 bp, Homo sapiens
gactggatacataactgaaaag

SEQ ID NO: 520 - DNA, 23 bp, Homo sapiens
tttgctggcttcaccgcaaagtt

SEQ ID NO: 521 - DNA, 23 bp, Homo sapiens
tatagctggaatatggtgatgag

SEQ ID NO: 522 - DNA, 24 bp, Homo sapiens
cactgggcttatgtttttattgga

SEQ ID NO: 523 - DNA, 24 bp, Homo sapiens
ctaaggtgccggcagattgggtgt

SEQ ID NO: 524 - DNA, 20 bp, Homo sapiens
accccctctgtgggggtgtg

SEQ ID NO: 525 - DNA, 21 bp, Homo sapiens
tgatggctgctattgctatta

SEQ ID NO: 526 - DNA, 23 bp, Homo sapiens
ctttttttaggcggggaggagga

SEQ ID NO: 527 - DNA, 20 bp, Homo sapiens
cccagtgttcagactcctga

SEQ ID NO: 528 - DNA, 22 bp, Homo sapiens
tcctgaccacagacatacagtg

SEQ ID NO: 529 - DNA, 20 bp, Homo sapiens
tgagacaggatgtcaagatg

SEQ ID NO: 530 - DNA, 21 bp, Homo sapiens
taaacagtaagtgtaagatga

SEQ ID NO: 531 - DNA, 20 bp, Homo sapiens
accccggcatttaacaattt

SEQ ID NO: 532 - DNA, 22 bp, Homo sapiens
cagtgcaattggccaaagatgg

SEQ ID NO: 533 - DNA, 22 bp, Homo sapiens
aggcagttaccaaataggagtt

SEQ ID NO: 534 - DNA, 20 bp, Homo sapiens
atcacattgccagagagagt

SEQ ID NO: 535 - DNA, 21 bp, Homo sapiens
ttgcaccatctgaagctatga

SEQ ID NO: 536 - DNA, 22 bp, Homo sapiens
tctcaaccactcaccccaccac

SEQ ID NO: 537 - DNA, 20 bp, Homo sapiens
gtgatatagggaaaagtcac

SEQ ID NO: 538 - DNA, 22 bp, Homo sapiens
aaatgatgtgagaatattggca

SEQ ID NO: 539 - DNA, 20 bp, Homo sapiens
tggggatggcggagcggtct

SEQ ID NO: 540 - DNA, 20 bp, Homo sapiens
gccttgctgctgggtgctgg

SEQ ID NO: 541 - DNA, 23 bp, Homo sapiens
tacacacatccctgtcttacaga

SEQ ID NO: 542 - DNA, 20 bp, Homo sapiens
aggcaagatgagttcataga

SEQ ID NO: 543 - DNA, 20 bp, Homo sapiens
aactattagtgtacaacaga

SEQ ID NO: 544 - DNA, 20 bp, Homo sapiens
aatggatttatctttgtacg

SEQ ID NO: 545 - DNA, 22 bp, Homo sapiens
tatgtgctgctaggggttgaac

SEQ ID NO: 546 - DNA, 20 bp, Homo sapiens
ccgccgggtccgcccccgcg

SEQ ID NO: 547 - DNA, 22 bp, Homo sapiens
ttccagtaatccagatatcgga

SEQ ID NO: 548 - DNA, 20 bp, Homo sapiens
gataaatgatggaacctcca

SEQ ID NO: 549 - DNA, 21 bp, Homo sapiens
ctgtggataaggccagtcaaa

SEQ ID NO: 550 - DNA, 23 bp, Homo sapiens
cttaattgtaaatacctgatgct

SEQ ID NO: 551 - DNA, 20 bp, Homo sapiens
ggctagtaatccagctccat

SEQ ID NO: 552 - DNA, 22 bp, Homo sapiens
tatatatgtcttataatgatga

SEQ ID NO: 553 - DNA, 22 bp, Homo sapiens
gtccagttttcttgaagccaaa

SEQ ID NO: 554 - DNA, 23 bp, Homo sapiens
ccagctgaactcaaatacaaacc

SEQ ID NO: 555 - DNA, 22 bp, Homo sapiens
tagctcgctgaacaccctagga

SEQ ID NO: 556 - DNA, 22 bp, Homo sapiens
gaggagagaaggatcaggtcag

SEQ ID NO: 557 - DNA, 20 bp, Homo sapiens
tgggctgacctgatggagtg

SEQ ID NO: 558 - DNA, 22 bp, Homo sapiens
tgaagcaggcagtttatatcca

SEQ ID NO: 559 - DNA, 22 bp, Homo sapiens
tcctatgaagacagtgctagag

SEQ ID NO: 560 - DNA, 22 bp, Homo sapiens
gtctctggtgtgggtgttttgt

SEQ ID NO: 561 - DNA, 22 bp, Homo sapiens
aagtctgcctccagtccctgct

SEQ ID NO: 562 - DNA, 22 bp, Homo sapiens
gtgatctttgtcaaatacaaag

SEQ ID NO: 563 - DNA, 22 bp, Homo sapiens
tgtccagggactgtataccctg

SEQ ID NO: 564 - DNA, 22 bp, Homo sapiens
ctggacttggagtcagaagtcc

SEQ ID NO: 565 - DNA, 20 bp, Homo sapiens
ctgacagcaaggcaccacta

SEQ ID NO: 566 - DNA, 22 bp, Homo sapiens
gggaacctctctagggccacgc

SEQ ID NO: 567 - DNA, 21 bp, Homo sapiens
tcgcttatcagactggcaaat

SEQ ID NO: 568 - DNA, 20 bp, Homo sapiens
gagacacagagggctatgtg

SEQ ID NO: 569 - DNA, 20 bp, Homo sapiens
ctgacctaaaggccagtaag

SEQ ID NO: 570 - DNA, 20 bp, Homo sapiens
tgaggtagtaggttgggagt

SEQ ID NO: 571 - DNA, 20 bp, Homo sapiens
gcctcttgcataagtggcaa

SEQ ID NO: 572 - DNA, 22 bp, Homo sapiens
tagcttgctggactgcgtggga

SEQ ID NO: 573 - DNA, 20 bp, Homo sapiens
cctgagagctattgaagcag

SEQ ID NO: 574 - DNA, 20 bp, Homo sapiens
ttcacagtggctaaaccaat

SEQ ID NO: 575 - DNA, 21 bp, Homo sapiens
aaacatatctgtaaaggatga

SEQ ID NO: 576 - DNA, 23 bp, Homo sapiens
gagggtaaaagggtccttaggga

SEQ ID NO: 577 - DNA, 22 bp, Homo sapiens
tgatgttgcccagggctggctc

SEQ ID NO: 578 - DNA, 20 bp, Homo sapiens
gctgagatagattgttctca

SEQ ID NO: 579 - DNA, 23 bp, Homo sapiens
ccccccactgcaaaatttggtta

SEQ ID NO: 580 - DNA, 22 bp, Homo sapiens
actgggcttggagtcagaagtc

SEQ ID NO: 581 - DNA, 21 bp, Homo sapiens
tgtcatcagacgtgtagtcct

SEQ ID NO: 582 - DNA, 22 bp, Homo sapiens
tcacactggaactccctgtgcc

SEQ ID NO: 583 - DNA, 23 bp, Homo sapiens
ccgccccccccacgcccggccgg

SEQ ID NO: 584 - DNA, 20 bp, Homo sapiens
tggctcagttcagggaatac

SEQ ID NO: 585 - DNA, 23 bp, Homo sapiens
tccactgaatgcaaataccccaa

SEQ ID NO: 586 - DNA, 22 bp, Homo sapiens
taattattaccattatcactgg

SEQ ID NO: 587 - DNA, 23 bp, Homo sapiens
gatgatgcttatgaaataggtag

SEQ ID NO: 588 - DNA, 21 bp, Homo sapiens
ccccttgtaatgcagataggg

SEQ ID NO: 589 - DNA, 23 bp, Homo sapiens
ccactattatatgagaaaaaagc

SEQ ID NO: 590 - DNA, 22 bp, Homo sapiens
agagggttgttccataccagtg

SEQ ID NO: 591 - DNA, 21 bp, Homo sapiens
agcagcaccacacagggatga

SEQ ID NO: 592 - DNA, 22 bp, Homo sapiens
tcgtttcccggtcagggaacca

SEQ ID NO: 593 - DNA, 23 bp, Homo sapiens
gaggagtgggaaacttccgagaa

SEQ ID NO: 594 - DNA, 21 bp, Homo sapiens
tgatgaagctcaggtagccaa

SEQ ID NO: 595 - DNA, 22 bp, Homo sapiens
atgctttgtttttgtcttgttt

SEQ ID NO: 596 - DNA, 20 bp, Homo sapiens
aagctgcaattcaacccagt

SEQ ID NO: 597 - DNA, 22 bp, Homo sapiens
tgtgcaaatctatgcagtggtc

SEQ ID NO: 598 - DNA, 20 bp, Homo sapiens
agcggctggtacaaaaaaaa

SEQ ID NO: 599 - DNA, 20 bp, Homo sapiens
tagcaccatctgccttcggt

SEQ ID NO: 600 - DNA, 23 bp, Homo sapiens
tgcgagctttcagcagctgtgac

SEQ ID NO: 601 - DNA, 20 bp, Homo sapiens
gaaattagcttctgactaag

SEQ ID NO: 602 - DNA, 24 bp, Homo sapiens
ggctggttcgagtgcagtggtgtt

SEQ ID NO: 603 - DNA, 23 bp, Homo sapiens
agctgcaaacagtggcatctttt

SEQ ID NO: 604 - DNA, 22 bp, Homo sapiens
ctaactggggaaacttctcaaa

SEQ ID NO: 605 - DNA, 23 bp, Homo sapiens
cccagaaaagtctgatggatatt

SEQ ID NO: 606 - DNA, 20 bp, Homo sapiens
gccggcgggagggggcgggg

SEQ ID NO: 607 - DNA, 20 bp, Homo sapiens
agcagggagatgctcgtggg

SEQ ID NO: 608 - DNA, 22 bp, Homo sapiens
tctgatcgttcccctccgtaca

SEQ ID NO: 609 - DNA, 21 bp, Homo sapiens
tatggaggtctctgtctggct

SEQ ID NO: 610 - DNA, 20 bp, Homo sapiens
actggatacttatgacatgt

SEQ ID NO: 611 - DNA, 23 bp, Homo sapiens
cacatgtgggctcatgttcagga

SEQ ID NO: 612 - DNA, 20 bp, Homo sapiens
cattattacttttggccatg

SEQ ID NO: 613 - DNA, 20 bp, Homo sapiens
gggtatgctatagcttaaat

SEQ ID NO: 614 - DNA, 24 bp, Homo sapiens
agatagatatgtagaactaaacta

SEQ ID NO: 615 - DNA, 22 bp, Homo sapiens
tcctcagagtttcacaggtgga

SEQ ID NO: 616 - DNA, 23 bp, Homo sapiens
tggcaggtgtcgtagcaccaaca

SEQ ID NO: 617 - DNA, 22 bp, Homo sapiens
tatctgaaatgatatcataggt

SEQ ID NO: 618 - DNA, 20 bp, Homo sapiens
catctccaggcaggaatcaa

SEQ ID NO: 619 - DNA, 22 bp, Homo sapiens
tgacagtaatccagctacttgg

SEQ ID NO: 620 - DNA, 22 bp, Homo sapiens
gtccatttcaagttaactctgt

SEQ ID NO: 621 - DNA, 22 bp, Homo sapiens
tagcaccatttgatgcagtgtg

SEQ ID NO: 622 - DNA, 22 bp, Homo sapiens
gatgctttactgctgttttagt

SEQ ID NO: 623 - DNA, 20 bp, Homo sapiens
ccttttcgtggagaacagag

SEQ ID NO: 624 - DNA, 20 bp, Homo sapiens
ggccgggggtggggtcgggg

SEQ ID NO: 625 - DNA, 22 bp, Homo sapiens
gaatgtctcaaagccaggtgtc

SEQ ID NO: 626 - DNA, 23 bp, Homo sapiens
tatgaaattgacacagcaggtta

SEQ ID NO: 627 - DNA, 21 bp, Homo sapiens
tgagtgtgtgtgtgacagtgt

SEQ ID NO: 628 - DNA, 20 bp, Homo sapiens
gatataggcatcagtgcaga

SEQ ID NO: 629 - DNA, 22 bp, Homo sapiens
tgatttgatcctgtgtctgatc

SEQ ID NO: 630 - DNA, 21 bp, Homo sapiens
agatgagatgctggcatatat

SEQ ID NO: 631 - DNA, 22 bp, Homo sapiens
gctgcctcatgcctatttccat

SEQ ID NO: 632 - DNA, 23 bp, Homo sapiens
cacatgggcttgcatcccactga

SEQ ID NO: 633 - DNA, 20 bp, Homo sapiens
gaagcaaacatctccggtct

SEQ ID NO: 634 - DNA, 23 bp, Homo sapiens
tggtacaatctatgcaaggccag

SEQ ID NO: 635 - DNA, 21 bp, Homo sapiens
ctttgattaaaatttaaatga

SEQ ID NO: 636 - DNA, 22 bp, Homo sapiens
cctctcctaacctcgctctcgc

SEQ ID NO: 637 - DNA, 22 bp, Homo sapiens
catactgggaggtccactgggg

SEQ ID NO: 638 - DNA, 21 bp, Homo sapiens
atgcattggagtcagctattt

SEQ ID NO: 639 - DNA, 20 bp, Homo sapiens
agcgccgcggtcggagccat

SEQ ID NO: 640 - DNA, 20 bp, Homo sapiens
tctggatacttacagtgatc

SEQ ID NO: 641 - DNA, 22 bp, Homo sapiens
tgagtcaggcagtttttgccct

SEQ ID NO: 642 - DNA, 20 bp, Homo sapiens
gcatgagtggttcagtggtt

SEQ ID NO: 643 - DNA, 22 bp, Homo sapiens
caataaggctttgccctacata

SEQ ID NO: 644 - DNA, 20 bp, Homo sapiens
tccagtctcaaagcacatgt

SEQ ID NO: 645 - DNA, 21 bp, Homo sapiens
gggatgtagatatgtacactg

SEQ ID NO: 646 - DNA, 23 bp, Homo sapiens
gcaatcaaaagggtccttaaaag

SEQ ID NO: 647 - DNA, 22 bp, Homo sapiens
tgtactgggagaggtatccagt

SEQ ID NO: 648 - DNA, 23 bp, Homo sapiens
agagtgcaagtcagattattcca

SEQ ID NO: 649 - DNA, 21 bp, Homo sapiens
ggaataatctgacttgcactc

SEQ ID NO: 650 - DNA, 20 bp, Homo sapiens
ctgacctatcttaattgcta

SEQ ID NO: 651 - DNA, 22 bp, Homo sapiens
ttacatgtaaagaggataggtt

SEQ ID NO: 652 - DNA, 22 bp, Homo sapiens
tggctcctcaaagctgaacact

SEQ ID NO: 653 - DNA, 20 bp, Homo sapiens
aaacgccagtagacctacag

SEQ ID NO: 654 - DNA, 23 bp, Homo sapiens
gttcgaggaggagaagtttacga

SEQ ID NO: 655 - DNA, 22 bp, Homo sapiens
acctgcaatggtggcatgtgtt

SEQ ID NO: 656 - DNA, 21 bp, Homo sapiens
ctgacctatgagccagttcta

SEQ ID NO: 657 - DNA, 23 bp, Homo sapiens
ttcgaatacatcaatcacttgac

SEQ ID NO: 658 - DNA, 20 bp, Homo sapiens
ctggggtatttgtggctgag

SEQ ID NO: 659 - DNA, 21 bp, Homo sapiens
gcagctagttaggatgaggtc

SEQ ID NO: 660 - DNA, 20 bp, Homo sapiens
gctagttgtgttcagtggta

SEQ ID NO: 661 - DNA, 22 bp, Homo sapiens
atagcaaaactcacagcaaact

SEQ ID NO: 662 - DNA, 23 bp, Homo sapiens
tagcaccatttgacctcagagcg

SEQ ID NO: 663 - DNA, 22 bp, Homo sapiens
ttcaggaatcccaaaagcagca

SEQ ID NO: 664 - DNA, 21 bp, Homo sapiens
gggagagtgttttttgtgttg

SEQ ID NO: 665 - DNA, 20 bp, Homo sapiens
tacttctacaccatgccttt

SEQ ID NO: 666 - DNA, 22 bp, Homo sapiens
cccctgtgggctcaggctcagg

SEQ ID NO: 667 - DNA, 20 bp, Homo sapiens
tatggactaacaaatctagg

SEQ ID NO: 668 - DNA, 22 bp, Homo sapiens
tgatgtagtagattgtatcagt

SEQ ID NO: 669 - DNA, 22 bp, Homo sapiens
tagcaatagctaaaatccaaac

SEQ ID NO: 670 - DNA, 21 bp, Homo sapiens
tttgtgccattgaagattggt

SEQ ID NO: 671 - DNA, 22 bp, Homo sapiens
aggttgctgcatggtacgctga

SEQ ID NO: 672 - DNA, 20 bp, Homo sapiens
gctgagatagcgcaccactg

SEQ ID NO: 673 - DNA, 22 bp, Homo sapiens
tcctttgtgggaacatgggtgt

SEQ ID NO: 674 - DNA, 22 bp, Homo sapiens
cagtgcaatgttatttggcact

SEQ ID NO: 675 - DNA, 22 bp, Homo sapiens
tcagagtttgtcaaatactttt

SEQ ID NO: 676 - DNA, 24 bp, Homo sapiens
agctgggagaaagagaggaggtgt

SEQ ID NO: 677 - DNA, 20 bp, Homo sapiens
cctggcgggcaggggcgggg

SEQ ID NO: 678 - DNA, 23 bp, Homo sapiens
tgtgcaaatccatgtgaatgtga

SEQ ID NO: 679 - DNA, 23 bp, Homo sapiens
gaaactggctcccaggaatccct

SEQ ID NO: 680 - DNA, 24 bp, Homo sapiens
cggggcggcgcggcgggaggtggc

SEQ ID NO: 681 - DNA, 21 bp, Homo sapiens
tagcttatcaagtcacactag

SEQ ID NO: 682 - DNA, 22 bp, Homo sapiens
tagcagggtaagaaataaaaac

SEQ ID NO: 683 - DNA, 23 bp, Homo sapiens
agcagcatttatgtcaatcatga

SEQ ID NO: 684 - DNA, 20 bp, Homo sapiens
ccaaatgtagatatggctgc

SEQ ID NO: 685 - DNA, 22 bp, Homo sapiens
tagcattggaagaaatatttta

SEQ ID NO: 686 - DNA, 24 bp, Homo sapiens
gcataccagagtctagtctgtact

SEQ ID NO: 687 - DNA, 20 bp, Homo sapiens
ggcccttgaaaatcctgatc

SEQ ID NO: 688 - DNA, 22 bp, Homo sapiens
tactgttttggatttatttttg

SEQ ID NO: 689 - DNA, 21 bp, Homo sapiens
ggagcctgtttctgtaccaga

SEQ ID NO: 690 - DNA, 23 bp, Homo sapiens
agtagcaaacatgttatttttgg

SEQ ID NO: 691 - DNA, 20 bp, Homo sapiens
cggcatcagaggctatgggg

SEQ ID NO: 692 - DNA, 23 bp, Homo sapiens
gagctgcgtggagagccagtgag

SEQ ID NO: 693 - DNA, 23 bp, Homo sapiens
tggctcagtgactgtggacactg

SEQ ID NO: 694 - DNA, 22 bp, Homo sapiens
cactgacctgctgggcgtgtgc

SEQ ID NO: 695 - DNA, 23 bp, Homo sapiens
atagtcaaacacaaatacaaaaa

SEQ ID NO: 696 - DNA, 20 bp, Homo sapiens
tcactacgcctccgccatcc

SEQ ID NO: 697 - DNA, 22 bp, Homo sapiens
tccctgatcttctaataacact

SEQ ID NO: 698 - DNA, 24 bp, Homo sapiens
ccggcttggtcctgcggtcccttc

SEQ ID NO: 699 - DNA, 23 bp, Homo sapiens
gccactgcccttgaggggctttc

SEQ ID NO: 700 - DNA, 21 bp, Homo sapiens
aacattcaatatccctagtga

SEQ ID NO: 701 - DNA, 21 bp, Homo sapiens
ccccttgctgcactgatgaga

SEQ ID NO: 702 - DNA, 21 bp, Homo sapiens
tcactcctccccagggcagaa

SEQ ID NO: 703 - DNA, 22 bp, Homo sapiens
acaggctgagtacagccagata

SEQ ID NO: 704 - DNA, 23 bp, Homo sapiens
gtgtacccgccctgctccactga

SEQ ID NO: 705 - DNA, 20 bp, Homo sapiens
tcgtggtgggtcatagcagg

SEQ ID NO: 706 - DNA, 21 bp, Homo sapiens
agcacaccattatctagagtt

SEQ ID NO: 707 - DNA, 21 bp, Homo sapiens
cctgagggctgtgtttccagc

SEQ ID NO: 708 - DNA, 22 bp, Homo sapiens
agctacaggtgagatcaggttt

SEQ ID NO: 709 - DNA, 20 bp, Homo sapiens
tggctcagggactactgtag

SEQ ID NO: 710 - DNA, 23 bp, Homo sapiens
tctagacctgactactagtgtca

SEQ ID NO: 711 - DNA, 22 bp, Homo sapiens
cagcactgctcagggctaacat

SEQ ID NO: 712 - DNA, 22 bp, Homo sapiens
tgagttgggtgacaatactctg

SEQ ID NO: 713 - DNA, 21 bp, Homo sapiens
gaatgagatgagttaggctag

SEQ ID NO: 714 - DNA, 22 bp, Homo sapiens
tgctgagcactcaaataccata

SEQ ID NO: 715 - DNA, 22 bp, Homo sapiens
aaacagggcaacggcagctggg

SEQ ID NO: 716 - DNA, 22 bp, Homo sapiens
acttgaccctcccaggaataga

SEQ ID NO: 717 - DNA, 22 bp, Homo sapiens
aagaaaccaaaggtgcaagtgt

SEQ ID NO: 718 - DNA, 23 bp, Homo sapiens
acttctaaggacccttggaatct

SEQ ID NO: 719 - DNA, 20 bp, Homo sapiens
cctcatttcatagggatgtg

SEQ ID NO: 720 - DNA, 23 bp, Homo sapiens
tgctgacggtaaaaataaaaaca

SEQ ID NO: 721 - DNA, 23 bp, Homo sapiens
cagcttaagcctgcagcacctca

SEQ ID NO: 722 - DNA, 20 bp, Homo sapiens
ctctctcccccgctcccagt

SEQ ID NO: 723 - DNA, 20 bp, Homo sapiens
gtgttttacttacattcttg

SEQ ID NO: 724 - DNA, 20 bp, Homo sapiens
ccctgtcagcctcttctagc

SEQ ID NO: 725 - DNA, 21 bp, Homo sapiens
gccaccactggaataggctgc

SEQ ID NO: 726 - DNA, 22 bp, Homo sapiens
gaaagtctctaagctaggtgct

SEQ ID NO: 727 - DNA, 23 bp, Homo sapiens
gcagtgtcacatcttggtgcctt

SEQ ID NO: 728 - DNA, 20 bp, Homo sapiens
agctcccacataaacccatc

SEQ ID NO: 729 - DNA, 20 bp, Homo sapiens
gcagcaggtctcactccaca

SEQ ID NO: 730 - DNA, 23 bp, Homo sapiens
tcactagaatgtgaggacagaaa

SEQ ID NO: 731 - DNA, 23 bp, Homo sapiens
tgatgatggcatggggtggggtg

SEQ ID NO: 732 - DNA, 21 bp, Homo sapiens
ctgacctcacttaacttttgg

SEQ ID NO: 733 - DNA, 22 bp, Homo sapiens
tagcaccacctctggctatggc

SEQ ID NO: 734 - DNA, 21 bp, Homo sapiens
tagtgcaatgttccccttcac

SEQ ID NO: 735 - DNA, 23 bp, Homo sapiens
caccaacccatcaaaatgtttgg

SEQ ID NO: 736 - DNA, 22 bp, Homo sapiens
tagtagcacatcatggttatga

SEQ ID NO: 737 - DNA, 22 bp, Homo sapiens
cctactacatgccaggaatcat

SEQ ID NO: 738 - DNA, 22 bp, Homo sapiens
cgccgggcgcatggggcgcttc

SEQ ID NO: 739 - DNA, 22 bp, Homo sapiens
tgagatgaagcactcatcctgg

SEQ ID NO: 740 - DNA, 22 bp, Homo sapiens
cccgcgcctctccctccgcccc

SEQ ID NO: 741 - DNA, 23 bp, Homo sapiens
gcatctcaaactcaaatacccaa

SEQ ID NO: 742 - DNA, 20 bp, Homo sapiens
ccccggcgcgcggcgagctc

SEQ ID NO: 743 - DNA, 24 bp, Homo sapiens
acacaatgatgaaactgcctgagg

SEQ ID NO: 744 - DNA, 22 bp, Homo sapiens
caagccttaggcaaatctcatc

SEQ ID NO: 745 - DNA, 20 bp, Homo sapiens
acactctcctacagtgacca

SEQ ID NO: 746 - DNA, 20 bp, Homo sapiens
atatagttctgagcgttttt

SEQ ID NO: 747 - DNA, 23 bp, Homo sapiens
tagcagcaatgaaaatactttgg

SEQ ID NO: 748 - DNA, 22 bp, Homo sapiens
ttctgactcaggtttatgggga

SEQ ID NO: 749 - DNA, 21 bp, Homo sapiens
tagcagcataactttatacag

SEQ ID NO: 750 - DNA, 21 bp, Homo sapiens
gcaccaacaacctgactacca

SEQ ID NO: 751 - DNA, 23 bp, Homo sapiens
tgtcattttgagtaattggggta

SEQ ID NO: 752 - DNA, 22 bp, Homo sapiens
tgtatgggcttgcatggagcat

SEQ ID NO: 753 - DNA, 20 bp, Homo sapiens
gttcagtgtatagggaactt

SEQ ID NO: 754 - DNA, 24 bp, Homo sapiens
tcgagaagtttcacaaagtcacca

SEQ ID NO: 755 - DNA, 22 bp, Homo sapiens
aaacataataaattactgtcaa

SEQ ID NO: 756 - DNA, 21 bp, Homo sapiens
cagcagcaattcatgtgttgt

SEQ ID NO: 757 - DNA, 22 bp, Homo sapiens
tagcagtgctccttatgcccat

SEQ ID NO: 758 - DNA, 23 bp, Homo sapiens
cactgtgggtgacccgtttttgt

SEQ ID NO: 759 - DNA, 20 bp, Homo sapiens
accccactcctggtaccatt

SEQ ID NO: 760 - DNA, 22 bp, Homo sapiens
aaatgcaatggtaatgattgga

SEQ ID NO: 761 - DNA, 22 bp, Homo sapiens
tgtaaacatccttgtgcccttc

SEQ ID NO: 762 - DNA, 23 bp, Homo sapiens
gagaagtttccacaggagtctgt

SEQ ID NO: 763 - DNA, 22 bp, Homo sapiens
gctgacccactaaataccggta

SEQ ID NO: 764 - DNA, 20 bp, Homo sapiens
tagcagcacagaaatatgca

SEQ ID NO: 765 - DNA, 20 bp, Homo sapiens
cagtgaaaaggcttagtcac

SEQ ID NO: 766 - DNA, 22 bp, Homo sapiens
agagggaaagggtgtagcagct

SEQ ID NO: 767 - DNA, 20 bp, Homo sapiens
ccactgcacgtggctaactt

SEQ ID NO: 768 - DNA, 22 bp, Homo sapiens
gagcctcggttgcggaggttgc

SEQ ID NO: 769 - DNA, 21 bp, Homo sapiens
attggcaatggtggcatgatg

SEQ ID NO: 770 - DNA, 20 bp, Homo sapiens
gctgagtttgaatactcttg

SEQ ID NO: 771 - DNA, 22 bp, Homo sapiens
tgactgtaatccaaatactttg

SEQ ID NO: 772 - DNA, 22 bp, Homo sapiens
agttcaagtcccttctcatatg

SEQ ID NO: 773 - DNA, 20 bp, Homo sapiens
gctttgttatgtaacaacag

SEQ ID NO: 774 - DNA, 20 bp, Homo sapiens
tataaccaccaagtcaccaa

SEQ ID NO: 775 - DNA, 22 bp, Homo sapiens
gcggactctgggattgaacttc

SEQ ID NO: 776 - DNA, 23 bp, Homo sapiens
actagactggactacttggtgaa

SEQ ID NO: 777 - DNA, 23 bp, Homo sapiens
ctgttgggactaaataccccaat

SEQ ID NO: 778 - DNA, 20 bp, Homo sapiens
ctgtccccccattttttttt

SEQ ID NO: 779 - DNA, 22 bp, Homo sapiens
tcgaatcctgagctcatacaat

SEQ ID NO: 780 - DNA, 22 bp, Homo sapiens
tgtcagtaacagaaataaaaca

SEQ ID NO: 781 - DNA, 23 bp, Homo sapiens
taaaacgtgatatgacttccatt

SEQ ID NO: 782 - DNA, 22 bp, Homo sapiens
acatttgtaggatgttgtgatt

SEQ ID NO: 783 - DNA, 20 bp, Homo sapiens
atcccactcctgactgaccc

SEQ ID NO: 784 - DNA, 20 bp, Homo sapiens
cttatctgggccttctcact

SEQ ID NO: 785 - DNA, 23 bp, Homo sapiens
tagctttttgagtagatgccagt

SEQ ID NO: 786 - DNA, 20 bp, Homo sapiens
gaatggtgccccctccaccc

SEQ ID NO: 787 - DNA, 20 bp, Homo sapiens
ttcacagtggctacattcca

SEQ ID NO: 788 - DNA, 23 bp, Homo sapiens
gtgcaggggtcttgaaggctttc

SEQ ID NO: 789 - DNA, 20 bp, Homo sapiens
ccccaccgctgccaccattg

SEQ ID NO: 790 - DNA, 22 bp, Homo sapiens
ctcacatcattgatctattcca

SEQ ID NO: 791 - DNA, 22 bp, Homo sapiens
gtccagtgggattgaagggtta

SEQ ID NO: 792 - DNA, 22 bp, Homo sapiens
acagcaggcactctgttcctca

SEQ ID NO: 793 - DNA, 21 bp, Homo sapiens
gcccggcagtgcccaatcaca

SEQ ID NO: 794 - DNA, 21 bp, Homo sapiens
accccactcctggtaccaaag

SEQ ID NO: 795 - DNA, 22 bp, Homo sapiens
tgacagtttaggtccatgaatg

SEQ ID NO: 796 - DNA, 22 bp, Homo sapiens
tctacaacgagcttcgcgtggc

SEQ ID NO: 797 - DNA, 20 bp, Homo sapiens
cccggggggattacaatgtt

SEQ ID NO: 798 - DNA, 22 bp, Homo sapiens
tatagtctcagctactccacag

SEQ ID NO: 799 - DNA, 20 bp, Homo sapiens
attttccagcctgccaggag

SEQ ID NO: 800 - DNA, 20 bp, Homo sapiens
ctgacagccaggcccttgat

SEQ ID NO: 801 - DNA, 23 bp, Homo sapiens
gagcacacagaaggatacaaatg

SEQ ID NO: 802 - DNA, 20 bp, Homo sapiens
aactaaataagggtgttccc

SEQ ID NO: 803 - DNA, 22 bp, Homo sapiens
tatctcatttcagaatatctga

SEQ ID NO: 804 - DNA, 22 bp, Homo sapiens
ggaagacccctttgaaggtatt

SEQ ID NO: 805 - DNA, 23 bp, Homo sapiens
tgatctgtggacgcagtttgtca

SEQ ID NO: 806 - DNA, 22 bp, Homo sapiens
ttcactgcctccaggaaagcca

SEQ ID NO: 807 - DNA, 23 bp, Homo sapiens
tgaagactcctgcacttccactg

SEQ ID NO: 808 - DNA, 22 bp, Homo sapiens
tcagtcgggtgaccatgtgggt

SEQ ID NO: 809 - DNA, 22 bp, Homo sapiens
tctggacggcttcaatgcttag

SEQ ID NO: 810 - DNA, 22 bp, Homo sapiens
cacgtcgtgagattatatccac

SEQ ID NO: 811 - DNA, 22 bp, Homo sapiens
tcagtgtgcactgaggtccctg

SEQ ID NO: 812 - DNA, 24 bp, Homo sapiens
ggcggaggggccgcgggccggagc

SEQ ID NO: 813 - DNA, 22 bp, Homo sapiens
gaaagtctcaaagccaggtgcc

SEQ ID NO: 814 - DNA, 20 bp, Homo sapiens
gcagcgaacatctccgcgag

SEQ ID NO: 815 - DNA, 22 bp, Homo sapiens
tgagtcattgagtccatgggga

SEQ ID NO: 816 - DNA, 21 bp, Homo sapiens
tcagtgcactacagcctgggt

SEQ ID NO: 817 - DNA, 24 bp, Homo sapiens
agcccttaatatttctaagcctct

SEQ ID NO: 818 - DNA, 23 bp, Homo sapiens
gctattataagggcaccactaag

SEQ ID NO: 819 - DNA, 20 bp, Homo sapiens
gccttttcttggggcctctc

SEQ ID NO: 820 - DNA, 21 bp, Homo sapiens
tggctcagttcacgtctctac

SEQ ID NO: 821 - DNA, 21 bp, Homo sapiens
gaggagaaatgcccctttagc

SEQ ID NO: 822 - DNA, 21 bp, Homo sapiens
caatggataaggccagttgat

SEQ ID NO: 823 - DNA, 22 bp, Homo sapiens
gcggcgggcggcgggcggcggg

SEQ ID NO: 824 - DNA, 20 bp, Homo sapiens
tttattatattttttcttgg

SEQ ID NO: 825 - DNA, 21 bp, Homo sapiens
ccccataaacatgagatgata

SEQ ID NO: 826 - DNA, 22 bp, Homo sapiens
tgaggtgagctgttgaatagtt

SEQ ID NO: 827 - DNA, 20 bp, Homo sapiens
gatttggtgggcgttatcag

SEQ ID NO: 828 - DNA, 22 bp, Homo sapiens
tagcttatcagtcactatccag

SEQ ID NO: 829 - DNA, 23 bp, Homo sapiens
atctacaaactttgaaggctttc

SEQ ID NO: 830 - DNA, 21 bp, Homo sapiens
tgagacaaagcactgcctaga

SEQ ID NO: 831 - DNA, 21 bp, Homo sapiens
cattggagggcagactccaac

SEQ ID NO: 832 - DNA, 23 bp, Homo sapiens
gaagttttattgcacaagctctt

SEQ ID NO: 833 - DNA, 23 bp, Homo sapiens
gtttctggggcccaggaatccag

SEQ ID NO: 834 - DNA, 21 bp, Homo sapiens
cggcggcgggagaccaaactt

SEQ ID NO: 835 - DNA, 20 bp, Homo sapiens
aacttcgggataaggatgag

SEQ ID NO: 836 - DNA, 22 bp, Homo sapiens
ttcttcattgtcaattatccaa

SEQ ID NO: 837 - DNA, 20 bp, Homo sapiens
ctctcggggccacatagtat

SEQ ID NO: 838 - DNA, 24 bp, Homo sapiens
cggccgcccccgggagccccgcgc

SEQ ID NO: 839 - DNA, 22 bp, Homo sapiens
gctgtgccattctgcatttcca

SEQ ID NO: 840 - DNA, 21 bp, Homo sapiens
ttcacagtggctaagcactgc

SEQ ID NO: 841 - DNA, 22 bp, Homo sapiens
taagccaatcagtttatggttg

SEQ ID NO: 842 - DNA, 21 bp, Homo sapiens
tagtatctccttttagttgca

SEQ ID NO: 843 - DNA, 20 bp, Homo sapiens
gtataaggaaatgcagcaac

SEQ ID NO: 844 - DNA, 24 bp, Homo sapiens
gcggcggcggcggcgggggtgggg

SEQ ID NO: 845 - DNA, 20 bp, Homo sapiens
taattatttctggggcccca

SEQ ID NO: 846 - DNA, 22 bp, Homo sapiens
tagctgcagtctggtgcactgg

SEQ ID NO: 847 - DNA, 20 bp, Homo sapiens
aggggccgtggattgttgct

SEQ ID NO: 848 - DNA, 23 bp, Homo sapiens
acaacattcaaaacctctgcagc

SEQ ID NO: 849 - DNA, 22 bp, Homo sapiens
tggtccacggcagtgatagcct

SEQ ID NO: 850 - DNA, 20 bp, Homo sapiens
cgcgcgccagccccgccgcc

SEQ ID NO: 851 - DNA, 23 bp, Homo sapiens
cagggcatctaggctagaacaca

SEQ ID NO: 852 - DNA, 23 bp, Homo sapiens
cgaggccacttgcaccagcagcg

SEQ ID NO: 853 - DNA, 20 bp, Homo sapiens
ccgccgcgcgggcccaaccc

SEQ ID NO: 854 - DNA, 23 bp, Homo sapiens
taggtatagtagctgatgaacac

SEQ ID NO: 855 - DNA, 20 bp, Homo sapiens
ataatcatatttaccaattt

SEQ ID NO: 856 - DNA, 20 bp, Homo sapiens
gcgtcactcgcagcccgggc

SEQ ID NO: 857 - DNA, 20 bp, Homo sapiens
ctcctgatgcagctacaact

SEQ ID NO: 858 - DNA, 22 bp, Homo sapiens
attgtgccattgagaggtgaca

SEQ ID NO: 859 - DNA, 20 bp, Homo sapiens
cagccccagtggaaccacca

SEQ ID NO: 860 - DNA, 22 bp, Homo sapiens
ctgtgaaatattttacatcctg

SEQ ID NO: 861 - DNA, 23 bp, Homo sapiens
tgtcctgggtgatttatgggcgg

SEQ ID NO: 862 - DNA, 21 bp, Homo sapiens
gcatggcacctgcagcatggg

SEQ ID NO: 863 - DNA, 22 bp, Homo sapiens
tagcatcacggccacgccagct

SEQ ID NO: 864 - DNA, 22 bp, Homo sapiens
agagagccattgaggattcttg

SEQ ID NO: 865 - DNA, 20 bp, Homo sapiens
gatgcaatgtctgctataaa

SEQ ID NO: 866 - DNA, 23 bp, Homo sapiens
cactgcatgactgggcgtattac

SEQ ID NO: 867 - DNA, 22 bp, Homo sapiens
taacactgtctgtgcctccgtg

SEQ ID NO: 868 - DNA, 21 bp, Homo sapiens
cattattacttttgtccatgt

SEQ ID NO: 869 - DNA, 23 bp, Homo sapiens
cattgcacttgtcttaactgcat

SEQ ID NO: 870 - DNA, 22 bp, Homo sapiens
gcatggcacctgccaccgtgca

SEQ ID NO: 871 - DNA, 22 bp, Homo sapiens
acagagcagacgtgtaactagt

SEQ ID NO: 872 - DNA, 20 bp, Homo sapiens
ccctgtataaaatttatttg

SEQ ID NO: 873 - DNA, 22 bp, Homo sapiens
ctggactctgggatgcttgtga

SEQ ID NO: 874 - DNA, 20 bp, Homo sapiens
agaggccgtagaggtggttc

SEQ ID NO: 875 - DNA, 21 bp, Homo sapiens
aatgcacccaaagtttcagtc

SEQ ID NO: 876 - DNA, 21 bp, Homo sapiens
ttcatcatttccaggataaaa

SEQ ID NO: 877 - DNA, 23 bp, Homo sapiens
agcatagtgaaatcaacagcaga

SEQ ID NO: 878 - DNA, 22 bp, Homo sapiens
tagctgagagactaaggcaccc

SEQ ID NO: 879 - DNA, 22 bp, Homo sapiens
tgctgacggtgatttatcaaca

SEQ ID NO: 880 - DNA, 21 bp, Homo sapiens
gtattgaagagcttagcttgc

SEQ ID NO: 881 - DNA, 21 bp, Homo sapiens
atgccagcatttataaggatt

SEQ ID NO: 882 - DNA, 22 bp, Homo sapiens
gtctaaggctttgtcagcagct

SEQ ID NO: 883 - DNA, 20 bp, Homo sapiens
gcatcgcacttcagtgtgca

SEQ ID NO: 884 - DNA, 20 bp, Homo sapiens
tgagggcttagcccatacag

SEQ ID NO: 885 - DNA, 21 bp, Homo sapiens
ctctgtcgcaggccagtgaat

SEQ ID NO: 886 - DNA, 20 bp, Homo sapiens
accacattgccaggcatttc

SEQ ID NO: 887 - DNA, 21 bp, Homo sapiens
gtgtagtggtcaggctccctc

SEQ ID NO: 888 - DNA, 21 bp, Homo sapiens
gctagggctgagggtaggggt

SEQ ID NO: 889 - DNA, 20 bp, Homo sapiens
gctggggcgcgggatacctg

SEQ ID NO: 890 - DNA, 21 bp, Homo sapiens
ccagccagctcccacagttgc

SEQ ID NO: 891 - DNA, 20 bp, Homo sapiens
cgtagaagtaactgcgctac

SEQ ID NO: 892 - DNA, 20 bp, Homo sapiens
tccgcagcaggtctccccgg

SEQ ID NO: 893 - DNA, 22 bp, Homo sapiens
aactgacggcttgaatacaggt

SEQ ID NO: 894 - DNA, 21 bp, Homo sapiens
agagtcggctaggttgctacc

SEQ ID NO: 895 - DNA, 22 bp, Homo sapiens
tgtcagtaatccaggatttttg

SEQ ID NO: 896 - DNA, 23 bp, Homo sapiens
tacaccaggtctggtatgtttca

SEQ ID NO: 897 - DNA, 20 bp, Homo sapiens
ttagcggatgacctgtagtt

SEQ ID NO: 898 - DNA, 23 bp, Homo sapiens
gtgctatgatggaaaaactgagc

SEQ ID NO: 899 - DNA, 20 bp, Homo sapiens
ccaccgcccgtccccgtccc

SEQ ID NO: 900 - DNA, 20 bp, Homo sapiens
gcccggcggggaaggtgcgc

SEQ ID NO: 901 - DNA, 22 bp, Homo sapiens
atcacattgcacttagctcttg

SEQ ID NO: 902 - DNA, 20 bp, Homo sapiens
gcgctggaggagctgagtga

SEQ ID NO: 903 - DNA, 20 bp, Homo sapiens
gccttggtggctcagtggtg

SEQ ID NO: 904 - DNA, 22 bp, Homo sapiens
tagattatgcctccagcaaaac

SEQ ID NO: 905 - DNA, 21 bp, Homo sapiens
ccttccataatggtgatttcc

SEQ ID NO: 906 - DNA, 23 bp, Homo sapiens
aggcccagttctatgaaccactg

SEQ ID NO: 907 - DNA, 22 bp, Homo sapiens
tgggactctgaagccaggcact

SEQ ID NO: 908 - DNA, 23 bp, Homo sapiens
cctgagtaatccaggatatttag

SEQ ID NO: 909 - DNA, 20 bp, Homo sapiens
atagatgaaggtctcacttt

SEQ ID NO: 910 - DNA, 21 bp, Homo sapiens
actacatcatctaacctatca

SEQ ID NO: 911 - DNA, 20 bp, Homo sapiens
tgagtcattgagtttatggc

SEQ ID NO: 912 - DNA, 23 bp, Homo sapiens
tgggactctgggattgaacattt

SEQ ID NO: 913 - DNA, 22 bp, Homo sapiens
ttctgactgctcaaatattttc

SEQ ID NO: 914 - DNA, 22 bp, Homo sapiens
ttacctgcctcctgtcgctatc

SEQ ID NO: 915 - DNA, 22 bp, Homo sapiens
tccctctctgggatcaggcctc

SEQ ID NO: 916 - DNA, 20 bp, Homo sapiens
tggctcagttcaacagactc

SEQ ID NO: 917 - DNA, 21 bp, Homo sapiens
gaggtcaaaagggtcaggtct

SEQ ID NO: 918 - DNA, 22 bp, Homo sapiens
aatcctcactttgaatccatgt

SEQ ID NO: 919 - DNA, 22 bp, Homo sapiens
tgagagtttgagccataggtgt

SEQ ID NO: 920 - DNA, 22 bp, Homo sapiens
acactacgccactacgcctggc

SEQ ID NO: 921 - DNA, 20 bp, Homo sapiens
tacagccaccaagtcaccaa

SEQ ID NO: 922 - DNA, 21 bp, Homo sapiens
gtccagttttcccagcaccaa

SEQ ID NO: 923 - DNA, 22 bp, Homo sapiens
tagcatatatgcccccttgcat

SEQ ID NO: 924 - DNA, 23 bp, Homo sapiens
agtaatgtgaaatacccagcaga

SEQ ID NO: 925 - DNA, 22 bp, Homo sapiens
gtctcttttgaggggcaaaaat

SEQ ID NO: 926 - DNA, 20 bp, Homo sapiens
ctccagttttcccaagaagc

SEQ ID NO: 927 - DNA, 21 bp, Homo sapiens
agcagctgttagcagttgctg

SEQ ID NO: 928 - DNA, 23 bp, Homo sapiens
ataaagtagtgacactgttttca

SEQ ID NO: 929 - DNA, 21 bp, Homo sapiens
aatgacacatgttgccatgcc

SEQ ID NO: 930 - DNA, 22 bp, Homo sapiens
tagcagccatgcttcattgcac

SEQ ID NO: 931 - DNA, 20 bp, Homo sapiens
actccatcatctaactacgc

SEQ ID NO: 932 - DNA, 22 bp, Homo sapiens
tccctgactcgggccaggtgtc

SEQ ID NO: 933 - DNA, 22 bp, Homo sapiens
atgcaaagtgagtttatgtttg

SEQ ID NO: 934 - DNA, 21 bp, Homo sapiens
cagctgtctgagctgatgtgt

SEQ ID NO: 935 - DNA, 20 bp, Homo sapiens
agtgtagttatgtggaagaa

SEQ ID NO: 936 - DNA, 22 bp, Homo sapiens
aaatggaatgctggcatagact

SEQ ID NO: 937 - DNA, 20 bp, Homo sapiens
tgagttcatagttttgcttg

SEQ ID NO: 938 - DNA, 20 bp, Homo sapiens
ggccaacagcgcggtattgc

SEQ ID NO: 939 - DNA, 22 bp, Homo sapiens
tagcaccattcagggcagacat

SEQ ID NO: 940 - DNA, 21 bp, Homo sapiens
cccagtgttcagacacctcac

SEQ ID NO: 941 - DNA, 21 bp, Homo sapiens
tcatggcactcatgtaagtgc

SEQ ID NO: 942 - DNA, 23 bp, Homo sapiens
tgtgctaatccatgcaggactga

SEQ ID NO: 943 - DNA, 22 bp, Homo sapiens
tagaggttgtctgactctggtc

SEQ ID NO: 944 - DNA, 22 bp, Homo sapiens
tagcacctatcatgtagcaggc

SEQ ID NO: 945 - DNA, 21 bp, Homo sapiens
gggctgtggactcagcatcac

SEQ ID NO: 946 - DNA, 21 bp, Homo sapiens
cccgccgtcaggcccgggatc

SEQ ID NO: 947 - DNA, 22 bp, Homo sapiens
cagccataggagtcagtaccag

SEQ ID NO: 948 - DNA, 22 bp, Homo sapiens
ctaggcttccttttgcttgttg

SEQ ID NO: 949 - DNA, 22 bp, Homo sapiens
tcatcagagaaagggccaagtg

SEQ ID NO: 950 - DNA, 24 bp, Homo sapiens
tgtggtaacgtgttttagaatgtt

SEQ ID NO: 951 - DNA, 23 bp, Homo sapiens
atgagggtgggggtgaggtaaat

SEQ ID NO: 952 - DNA, 21 bp, Homo sapiens
aaaccgttaccttgcagttac

SEQ ID NO: 953 - DNA, 23 bp, Homo sapiens
cccagtgttttctgatagtagtt

SEQ ID NO: 954 - DNA, 21 bp, Homo sapiens
tagcttgctgaactgacattg

SEQ ID NO: 955 - DNA, 20 bp, Homo sapiens
tagctcagttcagcaggagg

SEQ ID NO: 956 - DNA, 22 bp, Homo sapiens
aactgcaatggtttatactcaa

SEQ ID NO: 957 - DNA, 22 bp, Homo sapiens
tcagtggtgatgtctacaatgt

SEQ ID NO: 958 - DNA, 24 bp, Homo sapiens
ctgggcccaagcaaagggggcacc

SEQ ID NO: 959 - DNA, 20 bp, Homo sapiens
tggctcagttcagcaccaat

SEQ ID NO: 960 - DNA, 21 bp, Homo sapiens
tccccacatttcttgttgccc

SEQ ID NO: 961 - DNA, 20 bp, Homo sapiens
ccattccaccaagtcaccat

SEQ ID NO: 962 - DNA, 23 bp, Homo sapiens
gcaaagcacacggcctgcagagt

SEQ ID NO: 963 - DNA, 23 bp, Homo sapiens
acagcaggcacaggcaggcaggt

SEQ ID NO: 964 - DNA, 23 bp, Homo sapiens
agctgcaaacatgggcgtcatgg

SEQ ID NO: 965 - DNA, 20 bp, Homo sapiens
atcacattgccaggctggaa

SEQ ID NO: 966 - DNA, 20 bp, Homo sapiens
gttatttgctagagttggat

SEQ ID NO: 967 - DNA, 22 bp, Homo sapiens
gatgatgccaggtgaaatgcct

SEQ ID NO: 968 - DNA, 22 bp, Homo sapiens
atcacatcattgaagatctttg

SEQ ID NO: 969 - DNA, 21 bp, Homo sapiens
tagcactgcccaggttgtcag

SEQ ID NO: 970 - DNA, 20 bp, Homo sapiens
cccgcccacgccccgctcga

SEQ ID NO: 971 - DNA, 24 bp, Homo sapiens
gtgcaatgatgatgatctgagcca

SEQ ID NO: 972 - DNA, 23 bp, Homo sapiens
agcagcatgggccagggcaatga

SEQ ID NO: 973 - DNA, 22 bp, Homo sapiens
gtttgcaggatgtctgctagag

SEQ ID NO: 974 - DNA, 22 bp, Homo sapiens
aagcttgctgagtactacccaa

SEQ ID NO: 975 - DNA, 23 bp, Homo sapiens
tggggttatccatgcaggtgact

SEQ ID NO: 976 - DNA, 22 bp, Homo sapiens
tggcagtgtcttgtagtaccac

SEQ ID NO: 977 - DNA, 22 bp, Homo sapiens
acagtacagtggtttagttttg

SEQ ID NO: 978 - DNA, 20 bp, Homo sapiens
tagagttgcccagggttgac

SEQ ID NO: 979 - DNA, 21 bp, Homo sapiens
cccctgttagtctgatggaca

SEQ ID NO: 980 - DNA, 22 bp, Homo sapiens
tcagtagtcactggtatggggc

SEQ ID NO: 981 - DNA, 21 bp, Homo sapiens
tgaggggcagagagagagaaa

SEQ ID NO: 982 - DNA, 21 bp, Homo sapiens
ttagcgtcctacagtgcaaaa

SEQ ID NO: 983 - DNA, 21 bp, Homo sapiens
agcagcatggtacagggagga

SEQ ID NO: 984 - DNA, 22 bp, Homo sapiens
tgctgacttgacaaaatggggt

SEQ ID NO: 985 - DNA, 22 bp, Homo sapiens
tctatttatctgaccgattggc

SEQ ID NO: 986 - DNA, 22 bp, Homo sapiens
tgtcatagtcagtttatgggat

SEQ ID NO: 987 - DNA, 21 bp, Homo sapiens
gagactgccttgtgaagacga

SEQ ID NO: 988 - DNA, 20 bp, Homo sapiens
cgagaagctgaattgacaat

SEQ ID NO: 989 - DNA, 22 bp, Homo sapiens
tctgaatagtctgactccacag

SEQ ID NO: 990 - DNA, 21 bp, Homo sapiens
gtccagttttcctgagagtcc

SEQ ID NO: 991 - DNA, 23 bp, Homo sapiens
tatatgtaatgacactaccaagt

SEQ ID NO: 992 - DNA, 20 bp, Homo sapiens
tgagatgaagcactctggca

SEQ ID NO: 993 - DNA, 21 bp, Homo sapiens
tctgtgaaatgcctctttagg

SEQ ID NO: 994 - DNA, 20 bp, Homo sapiens
ctgaccttaaggccagtatt

SEQ ID NO: 995 - DNA, 21 bp, Homo sapiens
ccaaccttgatcactgtagga

SEQ ID NO: 996 - DNA, 20 bp, Homo sapiens
gtcctctttacagtgaacca

SEQ ID NO: 997 - DNA, 24 bp, Homo sapiens
agtattgaaaatactagagatcgg

SEQ ID NO: 998 - DNA, 23 bp, Homo sapiens
cagcatggcaggcaggagggcat

SEQ ID NO: 999 - DNA, 20 bp, Homo sapiens
gcgtggtgggctggctgtgt

SEQ ID NO: 1000 - DNA, 20 bp, Homo sapiens
cccagacttgaccaaacttg

SEQ ID NO: 1001 - DNA, 20 bp, Homo sapiens
tacctggttgatcccgccaa

SEQ ID NO: 1002 - DNA, 21 bp, Homo sapiens
agtacctcgtagggcattagg

SEQ ID NO: 1003 - DNA, 21 bp, Homo sapiens
catatatatcaaaggtgtata

SEQ ID NO: 1004 - DNA, 23 bp, Homo sapiens
tgcagactcctgagtcctcactg

SEQ ID NO: 1005 - DNA, 22 bp, Homo sapiens
gcagtgtttcctaaatataaac

SEQ ID NO: 1006 - DNA, 20 bp, Homo sapiens
gatgtatttgtatgaccaaa

SEQ ID NO: 1007 - DNA, 22 bp, Homo sapiens
tgtcagttgtggtttatggtca

SEQ ID NO: 1008 - DNA, 22 bp, Homo sapiens
tattgatttgtctttatggggt

SEQ ID NO: 1009 - DNA, 20 bp, Homo sapiens
ccgcttggggatcccgaggc

SEQ ID NO: 1010 - DNA, 20 bp, Homo sapiens
tccctatctactatctaaaa

SEQ ID NO: 1011 - DNA, 22 bp, Homo sapiens
taggcatagtctgactgcaatt

SEQ ID NO: 1012 - DNA, 20 bp, Homo sapiens
cagctcattaggtcagccag

SEQ ID NO: 1013 - DNA, 22 bp, Homo sapiens
tgtcagtggtgatttataggat

SEQ ID NO: 1014 - DNA, 24 bp, Homo sapiens
agtttgtgaccttattgcagtgac

SEQ ID NO: 1015 - DNA, 21 bp, Homo sapiens
agaggtggtttccagcaactg

SEQ ID NO: 1016 - DNA, 21 bp, Homo sapiens
ttcacagtggctaaactcata

SEQ ID NO: 1017 - DNA, 21 bp, Homo sapiens
gaggtatagttctgagatgtt

SEQ ID NO: 1018 - DNA, 22 bp, Homo sapiens
gcatgctgagaaagcggaggtt

SEQ ID NO: 1019 - DNA, 23 bp, Homo sapiens
cctggaaaaaagaagaagatcat

SEQ ID NO: 1020 - DNA, 22 bp, Homo sapiens
cattgcacttgctccagtctgg

SEQ ID NO: 1021 - DNA, 21 bp, Homo sapiens
aaccagctttggttttggcac

SEQ ID NO: 1022 - DNA, 22 bp, Homo sapiens
gtctgacccagaaataccccag

SEQ ID NO: 1023 - DNA, 22 bp, Homo sapiens
aatcccacttctgacaccaatc

SEQ ID NO: 1024 - DNA, 23 bp, Homo sapiens
tagcttatcagacgggcaccgtg

SEQ ID NO: 1025 - DNA, 21 bp, Homo sapiens
cagcagcaattcatgaattct

SEQ ID NO: 1026 - DNA, 24 bp, Homo sapiens
gccgaatgatgatgatgactgaca

SEQ ID NO: 1027 - DNA, 21 bp, Homo sapiens
gtttgacccctttgaaggtgt

SEQ ID NO: 1028 - DNA, 22 bp, Homo sapiens
catcagttcctaatgcattgcc

SEQ ID NO: 1029 - DNA, 20 bp, Homo sapiens
cctcctaatatttttctagg

SEQ ID NO: 1030 - DNA, 21 bp, Homo sapiens
cgagtccagtttttgagtggt

SEQ ID NO: 1031 - DNA, 22 bp, Homo sapiens
tgatttggtttccatcaactac

SEQ ID NO: 1032 - DNA, 20 bp, Homo sapiens
tagtcagtgagttgccactg

SEQ ID NO: 1033 - DNA, 22 bp, Homo sapiens
gtagctgagctaaaatccaaac

SEQ ID NO: 1034 - DNA, 23 bp, Homo sapiens
tatctgtaacagtgtgcaaaaca

SEQ ID NO: 1035 - DNA, 20 bp, Homo sapiens
tatgatgcacatgtcaatca

SEQ ID NO: 1036 - DNA, 23 bp, Homo sapiens
aggcaagatgctggcagctgaac

SEQ ID NO: 1037 - DNA, 20 bp, Homo sapiens
ggttctaataatacttgtac

SEQ ID NO: 1038 - DNA, 22 bp, Homo sapiens
gcgtcagaggggaccaggtgtc

SEQ ID NO: 1039 - DNA, 21 bp, Homo sapiens
ttcaagtaattcaggatgtga

SEQ ID NO: 1040 - DNA, 20 bp, Homo sapiens
agttaaataagggtgttggt

SEQ ID NO: 1041 - DNA, 23 bp, Homo sapiens
tacatgtaagatagcatgactga

SEQ ID NO: 1042 - DNA, 24 bp, Homo sapiens
tccctgtcctcctggagctcatat

SEQ ID NO: 1043 - DNA, 22 bp, Homo sapiens
ctaagtcccaatggcatacaca

SEQ ID NO: 1044 - DNA, 23 bp, Homo sapiens
tccatgtataattgcactggcta

SEQ ID NO: 1045 - DNA, 20 bp, Homo sapiens
aaagcgaacatccttatttt

SEQ ID NO: 1046 - DNA, 22 bp, Homo sapiens
cgatcatagctcaactatagcc

SEQ ID NO: 1047 - DNA, 22 bp, Homo sapiens
tagcagcagcatttggccatgt

SEQ ID NO: 1048 - DNA, 24 bp, Homo sapiens
catggtaactacttagttcaaggc

SEQ ID NO: 1049 - DNA, 21 bp, Homo sapiens
tgggcacattaaaggtggcat

SEQ ID NO: 1050 - DNA, 24 bp, Homo sapiens
tccctgtcctccaggagcttgtag

SEQ ID NO: 1051 - DNA, 22 bp, Homo sapiens
cagccactgctattgtatagtt

SEQ ID NO: 1052 - DNA, 22 bp, Homo sapiens
ttgaccagtaaaacatccagtg

SEQ ID NO: 1053 - DNA, 23 bp, Homo sapiens
gagagcgtctgggctgcttggcc

SEQ ID NO: 1054 - DNA, 22 bp, Homo sapiens
ggagccctggcaggccagcgac

SEQ ID NO: 1055 - DNA, 20 bp, Homo sapiens
ctaatatttttttaacactg

SEQ ID NO: 1056 - DNA, 22 bp, Homo sapiens
cctgaatgcatagtagttgagt

SEQ ID NO: 1057 - DNA, 20 bp, Homo sapiens
aacatagttctgagatgaga

SEQ ID NO: 1058 - DNA, 20 bp, Homo sapiens
gtccagttttcccagggcca

SEQ ID NO: 1059 - DNA, 22 bp, Homo sapiens
cagtcatagtctgtgatattga

SEQ ID NO: 1060 - DNA, 20 bp, Homo sapiens
tatattctgttgacatagca

SEQ ID NO: 1061 - DNA, 20 bp, Homo sapiens
gccagaacaaaatcccgaga

SEQ ID NO: 1062 - DNA, 21 bp, Homo sapiens
gggatgaacccttgcggcccg

SEQ ID NO: 1063 - DNA, 23 bp, Homo sapiens
taacactgtctgggaacctatgg

SEQ ID NO: 1064 - DNA, 22 bp, Homo sapiens
aagcccagaagctggaaactgc

SEQ ID NO: 1065 - DNA, 20 bp, Homo sapiens
tgagtctttccaatacctgc

SEQ ID NO: 1066 - DNA, 20 bp, Homo sapiens
attcgtgatggggtagcccc

SEQ ID NO: 1067 - DNA, 24 bp, Homo sapiens
ctcggcgcgcagcgcgccgccgcc

SEQ ID NO: 1068 - DNA, 20 bp, Homo sapiens
ttttaatctaggaagccaag

SEQ ID NO: 1069 - DNA, 20 bp, Homo sapiens
ctgaaacggattgcctaggt

SEQ ID NO: 1070 - DNA, 22 bp, Homo sapiens
accccgagtgttacagcccccc

SEQ ID NO: 1071 - DNA, 21 bp, Homo sapiens
tagagctcctacagtgctcac

SEQ ID NO: 1072 - DNA, 20 bp, Homo sapiens
caccacgttcccgtaggtct

SEQ ID NO: 1073 - DNA, 20 bp, Homo sapiens
ccaggaaccattttaggtgc

SEQ ID NO: 1074 - DNA, 22 bp, Homo sapiens
atacacgtgccagggaaatgga

SEQ ID NO: 1075 - DNA, 22 bp, Homo sapiens
cactgacagtgaccatacccct

SEQ ID NO: 1076 - DNA, 21 bp, Homo sapiens
aattcctaaatcagttcctgt

SEQ ID NO: 1077 - DNA, 23 bp, Homo sapiens
accagtgccagcactggagctgc

SEQ ID NO: 1078 - DNA, 20 bp, Homo sapiens
tccccagtacctccactcca

SEQ ID NO: 1079 - DNA, 20 bp, Homo sapiens
tggataatcacatggtggtg

SEQ ID NO: 1080 - DNA, 22 bp, Homo sapiens
aagtcatagtctgactccatct

SEQ ID NO: 1081 - DNA, 22 bp, Homo sapiens
cagtgcacatggccccttgcat

SEQ ID NO: 1082 - DNA, 23 bp, Homo sapiens
tgcgcggtgaacgcagtgcgtga

SEQ ID NO: 1083 - DNA, 20 bp, Homo sapiens
ctgttcattgtgtctgcctt

SEQ ID NO: 1084 - DNA, 21 bp, Homo sapiens
atccaactcctgacaccattt

SEQ ID NO: 1085 - DNA, 22 bp, Homo sapiens
actgtattattgaatcttctgg

SEQ ID NO: 1086 - DNA, 22 bp, Homo sapiens
tctttcctcaaagctgaacact

SEQ ID NO: 1087 - DNA, 22 bp, Homo sapiens
tactaaggatgcatttgacaac

SEQ ID NO: 1088 - DNA, 22 bp, Homo sapiens
tagcttataggatgtgaggatc

SEQ ID NO: 1089 - DNA, 20 bp, Homo sapiens
aaccataacatagcacgaaa

SEQ ID NO: 1090 - DNA, 20 bp, Homo sapiens
agatatccacgctgaccttt

SEQ ID NO: 1091 - DNA, 21 bp, Homo sapiens
agatttggtttggtgcaactg

SEQ ID NO: 1092 - DNA, 20 bp, Homo sapiens
ctccatgatgaacacttctt

SEQ ID NO: 1093 - DNA, 20 bp, Homo sapiens
ccagaaacattatatcaaaa

SEQ ID NO: 1094 - DNA, 20 bp, Homo sapiens
tccctgccctgctaatagca

SEQ ID NO: 1095 - DNA, 22 bp, Homo sapiens
tccctggagttctaataacatg

SEQ ID NO: 1096 - DNA, 22 bp, Homo sapiens
tgagtcaaatagttttcaaaac

SEQ ID NO: 1097 - DNA, 23 bp, Homo sapiens
gagcttattcagtttatggggac

SEQ ID NO: 1098 - DNA, 20 bp, Homo sapiens
cttgaagcacaaaaaccaga

SEQ ID NO: 1099 - DNA, 22 bp, Homo sapiens
ctgacatgtccactcctgggtc

SEQ ID NO: 1100 - DNA, 23 bp, Homo sapiens
atactatagtgatgtctgaatca

SEQ ID NO: 1101 - DNA, 21 bp, Homo sapiens
atattttccaggggccatttt

SEQ ID NO: 1102 - DNA, 20 bp, Homo sapiens
gtcatcagaggctattcgat

SEQ ID NO: 1103 - DNA, 21 bp, Homo sapiens
ctgaccaaggggccagtgatt

SEQ ID NO: 1104 - DNA, 21 bp, Homo sapiens
aggattgttttctgaatttta

SEQ ID NO: 1105 - DNA, 22 bp, Homo sapiens
tgtagacaccttcacttacact

SEQ ID NO: 1106 - DNA, 20 bp, Homo sapiens
tgcttcagaggctattgtga

SEQ ID NO: 1107 - DNA, 23 bp, Homo sapiens
gtccagttttcccagtaccattc

SEQ ID NO: 1108 - DNA, 22 bp, Homo sapiens
taaagttagggtttttttttga

SEQ ID NO: 1109 - DNA, 23 bp, Homo sapiens
taaatttccttgtgtaagcatat

SEQ ID NO: 1110 - DNA, 23 bp, Homo sapiens
ctagtcaggtgcaaatatgggta

SEQ ID NO: 1111 - DNA, 23 bp, Homo sapiens
tggcttatcatcacagcatttgt

SEQ ID NO: 1112 - DNA, 22 bp, Homo sapiens
ggatgatgtgctgcatgctaca

SEQ ID NO: 1113 - DNA, 23 bp, Homo sapiens
caagcctatctgtttatggggtt

SEQ ID NO: 1114 - DNA, 23 bp, Homo sapiens
tttacagtggctaagcctgacat

SEQ ID NO: 1115 - DNA, 21 bp, Homo sapiens
gtaataagatagatatgtttt

SEQ ID NO: 1116 - DNA, 22 bp, Homo sapiens
gagctatagtctgactgcacaa

SEQ ID NO: 1117 - DNA, 22 bp, Homo sapiens
tgagatgaaagttcagctagag

SEQ ID NO: 1118 - DNA, 23 bp, Homo sapiens
tgtgccttaaagtttatggggtt

SEQ ID NO: 1119 - DNA, 23 bp, Homo sapiens
tagctgtggtccatgatgttgaa

SEQ ID NO: 1120 - DNA, 20 bp, Homo sapiens
gggctctgtttcgaaatagt

SEQ ID NO: 1121 - DNA, 22 bp, Homo sapiens
gccacagtgagccatgttcgtg

SEQ ID NO: 1122 - DNA, 22 bp, Homo sapiens
gtaactctagactgatacctcc

SEQ ID NO: 1123 - DNA, 23 bp, Homo sapiens
aggctgtgatgattggcgcaggg

SEQ ID NO: 1124 - DNA, 20 bp, Homo sapiens
tatagttctgagctgggcca

SEQ ID NO: 1125 - DNA, 20 bp, Homo sapiens
ctttactaatccctgagcca

SEQ ID NO: 1126 - DNA, 20 bp, Homo sapiens
gcgaccactgtctttataga

SEQ ID NO: 1127 - DNA, 22 bp, Homo sapiens
gaggactctgaagcttccacag

SEQ ID NO: 1128 - DNA, 24 bp, Homo sapiens
aaacatgtatatctgatttgttcg

SEQ ID NO: 1129 - DNA, 20 bp, Homo sapiens
ctttaaaccctaatgtagct

SEQ ID NO: 1130 - DNA, 20 bp, Homo sapiens
ttcacagtggctaacctctt

SEQ ID NO: 1131 - DNA, 20 bp, Homo sapiens
tcctgccgtagcttgttggt

SEQ ID NO: 1132 - DNA, 22 bp, Homo sapiens
gctcctgggcaggggcgtgggt

SEQ ID NO: 1133 - DNA, 24 bp, Homo sapiens
ggggccttagtctgaagtttcttt

SEQ ID NO: 1134 - DNA, 22 bp, Homo sapiens
gaaatgagaaaagggccaagtg

SEQ ID NO: 1135 - DNA, 22 bp, Homo sapiens
tagcttatactcagtcttaaga

SEQ ID NO: 1136 - DNA, 23 bp, Homo sapiens
ctcctcaattcccagaggaggga

SEQ ID NO: 1137 - DNA, 20 bp, Homo sapiens
ttcttggtagatatggtttc

SEQ ID NO: 1138 - DNA, 22 bp, Homo sapiens
tctctcctgggaacatggtcac

SEQ ID NO: 1139 - DNA, 20 bp, Homo sapiens
ccccggagggggcgggctgc

SEQ ID NO: 1140 - DNA, 22 bp, Homo sapiens
gtccacaaaatttgaatgcttt

SEQ ID NO: 1141 - DNA, 20 bp, Homo sapiens
ccctggatacttatctgtgg

SEQ ID NO: 1142 - DNA, 20 bp, Homo sapiens
ccgctcgctccctcccccgc

SEQ ID NO: 1143 - DNA, 20 bp, Homo sapiens
cccggccctgctccctccag

SEQ ID NO: 1144 - DNA, 22 bp, Homo sapiens
tgtcctgacctgagtcctgtga

SEQ ID NO: 1145 - DNA, 20 bp, Homo sapiens
tcaccttgggcttggccatt

SEQ ID NO: 1146 - DNA, 20 bp, Homo sapiens
caagctagctcccacactct

SEQ ID NO: 1147 - DNA, 22 bp, Homo sapiens
acagcaggctgtctcaggctgt

SEQ ID NO: 1148 - DNA, 21 bp, Homo sapiens
ttcactgggcatgggcgtggg

SEQ ID NO: 1149 - DNA, 21 bp, Homo sapiens
cactggatagccggtcactac

SEQ ID NO: 1150 - DNA, 23 bp, Homo sapiens
aaatacactctgccaacagcaga

SEQ ID NO: 1151 - DNA, 20 bp, Homo sapiens
ataagagatactcaaatcat

SEQ ID NO: 1152 - DNA, 22 bp, Homo sapiens
tctcagtttggacaataaccac

SEQ ID NO: 1153 - DNA, 20 bp, Homo sapiens
tctggacggtaatctgctct

SEQ ID NO: 1154 - DNA, 22 bp, Homo sapiens
caagagcagattaccgtccaga

SEQ ID NO: 1155 - DNA, 20 bp, Homo sapiens
cccacggccctggcggagct

SEQ ID NO: 1156 - DNA, 22 bp, Homo sapiens
agctgtgggttcaagtacccca

SEQ ID NO: 1157 - DNA, 23 bp, Homo sapiens
gctgtcaaatccagaattagaag

SEQ ID NO: 1158 - DNA, 22 bp, Homo sapiens
gaggaatgatgacaagaaaagg

SEQ ID NO: 1159 - DNA, 21 bp, Homo sapiens
agcggctgtgcagacggcgga

SEQ ID NO: 1160 - DNA, 20 bp, Homo sapiens
ggcggggcccactgtattct

SEQ ID NO: 1161 - DNA, 20 bp, Homo sapiens
aggcaagatgctggaagctt

SEQ ID NO: 1162 - DNA, 23 bp, Homo sapiens
gatagcgctgatgtgatagcaga

SEQ ID NO: 1163 - DNA, 22 bp, Homo sapiens
ttttttatcttttacttctttt

SEQ ID NO: 1164 - DNA, 23 bp, Homo sapiens
gaggacatcatgtctgcagtgag

SEQ ID NO: 1165 - DNA, 20 bp, Homo sapiens
cgcagctcgaatacaagctg

SEQ ID NO: 1166 - DNA, 22 bp, Homo sapiens
tcctgtgggttctttatttttg

SEQ ID NO: 1167 - DNA, 21 bp, Homo sapiens
cccagccaggctccagcacct

SEQ ID NO: 1168 - DNA, 22 bp, Homo sapiens
tgagtgctgctattgtgccatt

SEQ ID NO: 1169 - DNA, 22 bp, Homo sapiens
cccttctctccctctctttcca

SEQ ID NO: 1170 - DNA, 22 bp, Homo sapiens
cattattacttttgagggatag

SEQ ID NO: 1171 - DNA, 22 bp, Homo sapiens
acagtgcccatcaaatacccca

SEQ ID NO: 1172 - DNA, 22 bp, Homo sapiens
tgcatacggcttgaaatatata

SEQ ID NO: 1173 - DNA, 20 bp, Homo sapiens
cttgtaaggtagaaagcact

SEQ ID NO: 1174 - DNA, 20 bp, Homo sapiens
aaggaatctaggaagttggg

SEQ ID NO: 1175 - DNA, 22 bp, Homo sapiens
catcaacaacattttatggggt

SEQ ID NO: 1176 - DNA, 23 bp, Homo sapiens
tagctggctggcaacaactgtgt

SEQ ID NO: 1177 - DNA, 20 bp, Homo sapiens
ggcagaatggccgagcggct

SEQ ID NO: 1178 - DNA, 22 bp, Homo sapiens
caaagtgctgttatgtagtggt

SEQ ID NO: 1179 - DNA, 22 bp, Homo sapiens
gctctgggtagtttatggcacc

SEQ ID NO: 1180 - DNA, 23 bp, Homo sapiens
tgcagcatctatgctagaaatga

SEQ ID NO: 1181 - DNA, 22 bp, Homo sapiens
atctgatttacgaaatacccca

SEQ ID NO: 1182 - DNA, 20 bp, Homo sapiens
ctaatatcaattagaatttc

SEQ ID NO: 1183 - DNA, 21 bp, Homo sapiens
aaagtattaccattactgaat

SEQ ID NO: 1184 - DNA, 22 bp, Homo sapiens
tcacacctaccctaacttgtga

SEQ ID NO: 1185 - DNA, 23 bp, Homo sapiens
agaggagcacttttttagattga

SEQ ID NO: 1186 - DNA, 22 bp, Homo sapiens
gcaaatatctaggctagaatgt

SEQ ID NO: 1187 - DNA, 20 bp, Homo sapiens
gagatagtttgcctccaaca

SEQ ID NO: 1188 - DNA, 23 bp, Homo sapiens
tgctctaaacagtaataccccaa

SEQ ID NO: 1189 - DNA, 23 bp, Homo sapiens
agtgagttagggtgggatcgctg

SEQ ID NO: 1190 - DNA, 22 bp, Homo sapiens
agggactctgttaggtccacag

SEQ ID NO: 1191 - DNA, 22 bp, Homo sapiens
tatcttttgcggctctgcccag

SEQ ID NO: 1192 - DNA, 20 bp, Homo sapiens
ccccgccgcgccggggaatg

SEQ ID NO: 1193 - DNA, 20 bp, Homo sapiens
tatttagcattagttaatag

SEQ ID NO: 1194 - DNA, 20 bp, Homo sapiens
cctggcaagtagaaagcact

SEQ ID NO: 1195 - DNA, 21 bp, Homo sapiens
ccgcccccggggagcccggat

SEQ ID NO: 1196 - DNA, 23 bp, Homo sapiens
gctgacatcatcagtgcaggtgg

SEQ ID NO: 1197 - DNA, 20 bp, Homo sapiens
tcagttcgcaggcattgaga

SEQ ID NO: 1198 - DNA, 21 bp, Homo sapiens
gcggatgtggtggaattgtat

SEQ ID NO: 1199 - DNA, 22 bp, Homo sapiens
tcaagtgagtttcgtgccacag

SEQ ID NO: 1200 - DNA, 22 bp, Homo sapiens
tacctatatggtaatgactgtt

SEQ ID NO: 1201 - DNA, 22 bp, Homo sapiens
tgctgacttactgaatacaaag

SEQ ID NO: 1202 - DNA, 23 bp, Homo sapiens
tagaggaaacttggtatggggtg

SEQ ID NO: 1203 - DNA, 20 bp, Homo sapiens
acttcaattaggtatgaatc

SEQ ID NO: 1204 - DNA, 23 bp, Homo sapiens
gaacccctgatgtgttctgctta

SEQ ID NO: 1205 - DNA, 23 bp, Homo sapiens
ttgactgaatctggccgtttcta

SEQ ID NO: 1206 - DNA, 21 bp, Homo sapiens
caatgcaatgagaaagggcat

SEQ ID NO: 1207 - DNA, 22 bp, Homo sapiens
acagtaactcatgtgccactta

SEQ ID NO: 1208 - DNA, 23 bp, Homo sapiens
agtcagtccacttttattgggtg

SEQ ID NO: 1209 - DNA, 22 bp, Homo sapiens
tgaggacaacagtaatacccca

SEQ ID NO: 1210 - DNA, 23 bp, Homo sapiens
cagtgccatagcgggtgagggaa

SEQ ID NO: 1211 - DNA, 23 bp, Homo sapiens
tgagatgacttaaggtatctggt

SEQ ID NO: 1212 - DNA, 21 bp, Homo sapiens
accttgcttgcctttcctgat

SEQ ID NO: 1213 - DNA, 21 bp, Homo sapiens
ctttccataatgcagatgact

SEQ ID NO: 1214 - DNA, 21 bp, Homo sapiens
atgtacctcaggggcttgtgc

SEQ ID NO: 1215 - DNA, 22 bp, Homo sapiens
atcacaggtaactaagcagttg

SEQ ID NO: 1216 - DNA, 20 bp, Homo sapiens
atcacattgccagcctggtc

SEQ ID NO: 1217 - DNA, 22 bp, Homo sapiens
gcctagtgatgtgtgtctgaaa

SEQ ID NO: 1218 - DNA, 23 bp, Homo sapiens
tagagcgctgacacagcaggatg

SEQ ID NO: 1219 - DNA, 20 bp, Homo sapiens
ggcagcgccgcggagccagc

SEQ ID NO: 1220 - DNA, 21 bp, Homo sapiens
ctgcacaaaccctgggactgg

SEQ ID NO: 1221 - DNA, 22 bp, Homo sapiens
agagcacggtgaggctgggcca

SEQ ID NO: 1222 - DNA, 23 bp, Homo sapiens
gttagactactgatgttcacagt

SEQ ID NO: 1223 - DNA, 21 bp, Homo sapiens
tagagcaggaacagtgctgac

SEQ ID NO: 1224 - DNA, 22 bp, Homo sapiens
gatcagtaagtcagatacccca

SEQ ID NO: 1225 - DNA, 22 bp, Homo sapiens
tagcactgctctcagctttgac

SEQ ID NO: 1226 - DNA, 23 bp, Homo sapiens
tgtgcttttcaccaacgtttcat

SEQ ID NO: 1227 - DNA, 22 bp, Homo sapiens
actctcccactccctaccccca

SEQ ID NO: 1228 - DNA, 22 bp, Homo sapiens
gagatattccaagattttagtt

SEQ ID NO: 1229 - DNA, 22 bp, Homo sapiens
ggtcgaaaagtgtttgtgggac

SEQ ID NO: 1230 - DNA, 23 bp, Homo sapiens
ccctctggcgctgacgcaggtaa

SEQ ID NO: 1231 - DNA, 20 bp, Homo sapiens
tcatcttgtcatttacctct

SEQ ID NO: 1232 - DNA, 20 bp, Homo sapiens
cccgtctccgccccccaaag

SEQ ID NO: 1233 - DNA, 20 bp, Homo sapiens
cttcccttccattgtacaac

SEQ ID NO: 1234 - DNA, 22 bp, Homo sapiens
tgcgacagacttagaggtacag

SEQ ID NO: 1235 - DNA, 23 bp, Homo sapiens
cggtcccccggctccctcctgct

SEQ ID NO: 1236 - DNA, 23 bp, Homo sapiens
gttgccttagggtttctatctga

SEQ ID NO: 1237 - DNA, 23 bp, Homo sapiens
ttctggtttgagttttgttttgg

SEQ ID NO: 1238 - DNA, 22 bp, Homo sapiens
tatggctcatttgagtgtgttg

SEQ ID NO: 1239 - DNA, 20 bp, Homo sapiens
ggctggtctagcggtaacaa

SEQ ID NO: 1240 - DNA, 23 bp, Homo sapiens
acaggccagatacacggtgaata

SEQ ID NO: 1241 - DNA, 24 bp, Homo sapiens
accatccagcctgcccttcttctg

SEQ ID NO: 1242 - DNA, 21 bp, Homo sapiens
ttcagaaccatcttgtagcca

SEQ ID NO: 1243 - DNA, 22 bp, Homo sapiens
aactgaggccatgattaagatt

SEQ ID NO: 1244 - DNA, 22 bp, Homo sapiens
ctgttcagctgatttgcagacc

SEQ ID NO: 1245 - DNA, 20 bp, Homo sapiens
taggagcacgtaggagccaa

SEQ ID NO: 1246 - DNA, 22 bp, Homo sapiens
agcctgagacaagctgatcact

SEQ ID NO: 1247 - DNA, 23 bp, Homo sapiens
cgcggccctcccccaccccaccc

SEQ ID NO: 1248 - DNA, 24 bp, Homo sapiens
tggcaacatccttgactccttcgc

SEQ ID NO: 1249 - DNA, 20 bp, Homo sapiens
ccccgctccccgcccccttc

SEQ ID NO: 1250 - DNA, 22 bp, Homo sapiens
tgaggtctgcaaaacgtatcag

SEQ ID NO: 1251 - DNA, 20 bp, Homo sapiens
ctgcaattcaacccacatcc

SEQ ID NO: 1252 - DNA, 24 bp, Homo sapiens
ctgtgcaatgacgccactgagggc

SEQ ID NO: 1253 - DNA, 21 bp, Homo sapiens
cttcaggtaaccaggaggcag

SEQ ID NO: 1254 - DNA, 20 bp, Homo sapiens
ggtatagtgagtcgctgagc

SEQ ID NO: 1255 - DNA, 20 bp, Homo sapiens
gagtacctgaaggtccatca

SEQ ID NO: 1256 - DNA, 23 bp, Homo sapiens
tagtgacccctttgaagactttc

SEQ ID NO: 1257 - DNA, 22 bp, Homo sapiens
tgaggtagtaggatgtgcacag

SEQ ID NO: 1258 - DNA, 22 bp, Homo sapiens
ttctgacggcttgggcagaagt

SEQ ID NO: 1259 - DNA, 21 bp, Homo sapiens
cggttcagctgtaaaaaagac

SEQ ID NO: 1260 - DNA, 21 bp, Homo sapiens
tggctcagggactccttgctc

SEQ ID NO: 1261 - DNA, 22 bp, Homo sapiens
tgtgcgttaggtgtactgagta

SEQ ID NO: 1262 - DNA, 20 bp, Homo sapiens
agcatatctaccatgaagtc

SEQ ID NO: 1263 - DNA, 23 bp, Homo sapiens
agcataaatccatatggctagct

SEQ ID NO: 1264 - DNA, 22 bp, Homo sapiens
tctggatgtgctgtggtttaca

SEQ ID NO: 1265 - DNA, 20 bp, Homo sapiens
tagcaatatgatggtatgtt

SEQ ID NO: 1266 - DNA, 21 bp, Homo sapiens
cctggttcctagatggtggct

SEQ ID NO: 1267 - DNA, 20 bp, Homo sapiens
ctctgtgacagctggaacca

SEQ ID NO: 1268 - DNA, 22 bp, Homo sapiens
tgggactctgggaaactggact

SEQ ID NO: 1269 - DNA, 21 bp, Homo sapiens
gtttagagccccggtgtataa

SEQ ID NO: 1270 - DNA, 22 bp, Homo sapiens
tcttcagagtttcctaacctgt

SEQ ID NO: 1271 - DNA, 22 bp, Homo sapiens
tcaacactttgctccaacatac

SEQ ID NO: 1272 - DNA, 22 bp, Homo sapiens
gtaggtattagaaacatatcaa

SEQ ID NO: 1273 - DNA, 22 bp, Homo sapiens
cagttgggtgacccgcagcacc

SEQ ID NO: 1274 - DNA, 22 bp, Homo sapiens
tctccacacttccagcacagtg

SEQ ID NO: 1275 - DNA, 24 bp, Homo sapiens
aaaaatatatataatagatataaa

SEQ ID NO: 1276 - DNA, 21 bp, Homo sapiens
ctccaggctagctttccctca

SEQ ID NO: 1277 - DNA, 21 bp, Homo sapiens
aggcaagacatcagcacagct

SEQ ID NO: 1278 - DNA, 20 bp, Homo sapiens
agatttactggtggtgcagg

SEQ ID NO: 1279 - DNA, 21 bp, Homo sapiens
gcattggtggttctcacagtt

SEQ ID NO: 1280 - DNA, 21 bp, Homo sapiens
tgagatgaagacagtctgagt

SEQ ID NO: 1281 - DNA, 20 bp, Homo sapiens
gcacctgctgtgtgaattaa

SEQ ID NO: 1282 - DNA, 20 bp, Homo sapiens
taatatctaggaagttggga

SEQ ID NO: 1283 - DNA, 20 bp, Homo sapiens
agagtgacgtctggacaatt

SEQ ID NO: 1284 - DNA, 22 bp, Homo sapiens
gtcagttgtagtttatgttgat

SEQ ID NO: 1285 - DNA, 22 bp, Homo sapiens
gctgctttcagtttatggggta

SEQ ID NO: 1286 - DNA, 21 bp, Homo sapiens
gaacaactttagctccagccc

SEQ ID NO: 1287 - DNA, 23 bp, Homo sapiens
gagcttactccttgtaccagtgt

SEQ ID NO: 1288 - DNA, 22 bp, Homo sapiens
taccaccatttagggctactta

SEQ ID NO: 1289 - DNA, 23 bp, Homo sapiens
tgagtcaaagatgtataccctgg

SEQ ID NO: 1290 - DNA, 24 bp, Homo sapiens
gcctttctatcaaatagaattttt

SEQ ID NO: 1291 - DNA, 22 bp, Homo sapiens
atgcaatgtagtaataataatg

SEQ ID NO: 1292 - DNA, 22 bp, Homo sapiens
tgaggtaggcaggactacaggt

SEQ ID NO: 1293 - DNA, 21 bp, Homo sapiens
tgagatgaaatgtgtgccaac

SEQ ID NO: 1294 - DNA, 22 bp, Homo sapiens
aaagggataaagcaattggttt

SEQ ID NO: 1295 - DNA, 22 bp, Homo sapiens
taattattattattactgagtt

SEQ ID NO: 1296 - DNA, 22 bp, Homo sapiens
ggtatataccatcgctttgtaa

SEQ ID NO: 1297 - DNA, 22 bp, Homo sapiens
aggaatggaaaggtactgagtt

SEQ ID NO: 1298 - DNA, 22 bp, Homo sapiens
tttagaattagaaagatagagg

SEQ ID NO: 1299 - DNA, 22 bp, Homo sapiens
tggctctcttcagcagacacag

SEQ ID NO: 1300 - DNA, 23 bp, Homo sapiens
tttagacacctgatcttcactcc

SEQ ID NO: 1301 - DNA, 20 bp, Homo sapiens
cccctgagtaatgcctagga

SEQ ID NO: 1302 - DNA, 20 bp, Homo sapiens
atactaggctattgtctagt

SEQ ID NO: 1303 - DNA, 21 bp, Homo sapiens
tgtgcattaggtacgcttgta

SEQ ID NO: 1304 - DNA, 24 bp, Homo sapiens
tggcagtggcttagctggtggttc

SEQ ID NO: 1305 - DNA, 21 bp, Homo sapiens
tgtcttatttaaggggaacga

SEQ ID NO: 1306 - DNA, 21 bp, Homo sapiens
gaaactgtttagacgggctca

SEQ ID NO: 1307 - DNA, 20 bp, Homo sapiens
tttggccagtatccctaact

SEQ ID NO: 1308 - DNA, 21 bp, Homo sapiens
tgattagctgtcatatataca

SEQ ID NO: 1309 - DNA, 20 bp, Homo sapiens
ggtggttggatagttggagc

SEQ ID NO: 1310 - DNA, 22 bp, Homo sapiens
tcagctttcagtagcaaacaac

SEQ ID NO: 1311 - DNA, 21 bp, Homo sapiens
tagactacatataaatttggt

SEQ ID NO: 1312 - DNA, 20 bp, Homo sapiens
tagacattgccagggaagcc

SEQ ID NO: 1313 - DNA, 20 bp, Homo sapiens
ctccgtcctcctcctccccc

SEQ ID NO: 1314 - DNA, 21 bp, Homo sapiens
ggactcatttccaaagcgaaa

SEQ ID NO: 1315 - DNA, 22 bp, Homo sapiens
cgatgtacatcagggatatttg

SEQ ID NO: 1316 - DNA, 21 bp, Homo sapiens
tccggtcatggaggtgtgtgc

SEQ ID NO: 1317 - DNA, 20 bp, Homo sapiens
atgacagtgtagctaagaca

SEQ ID NO: 1318 - DNA, 22 bp, Homo sapiens
tagaggcagtctgaccatggtc

SEQ ID NO: 1319 - DNA, 22 bp, Homo sapiens
tgagtaccgtgaccgtacccat

SEQ ID NO: 1320 - DNA, 20 bp, Homo sapiens
tacaagtaacacagatggcc

SEQ ID NO: 1321 - DNA, 21 bp, Homo sapiens
gcgttcaggactaaaattcta

SEQ ID NO: 1322 - DNA, 23 bp, Homo sapiens
acatctggggagaacgcacaacc

SEQ ID NO: 1323 - DNA, 20 bp, Homo sapiens
atggaccaactaggagctgc

SEQ ID NO: 1324 - DNA, 20 bp, Homo sapiens
agaggtagtaggttgcaggt

SEQ ID NO: 1325 - DNA, 22 bp, Homo sapiens
tacctgaggtttcccaggacag

SEQ ID NO: 1326 - DNA, 21 bp, Homo sapiens
gtgattcgcaggccaatgttc

SEQ ID NO: 1327 - DNA, 21 bp, Homo sapiens
cagcagcaatgacgtattttt

SEQ ID NO: 1328 - DNA, 21 bp, Homo sapiens
tgaaaataatttactaggaac

SEQ ID NO: 1329 - DNA, 22 bp, Homo sapiens
aagcgcgttgcggcggcgggag

SEQ ID NO: 1330 - DNA, 23 bp, Homo sapiens
caacatggcaagcaggggggcat

SEQ ID NO: 1331 - DNA, 20 bp, Homo sapiens
atcccacttctgacactgac

SEQ ID NO: 1332 - DNA, 23 bp, Homo sapiens
atcgaacagtagttgcgtttgtc

SEQ ID NO: 1333 - DNA, 21 bp, Homo sapiens
caggacacttacagtacaggt

SEQ ID NO: 1334 - DNA, 22 bp, Homo sapiens
gctcaggatgccatagaatcac

SEQ ID NO: 1335 - DNA, 21 bp, Homo sapiens
aatggcaatggtataatgagt

SEQ ID NO: 1336 - DNA, 20 bp, Homo sapiens
taattatttctttttaaaac

SEQ ID NO: 1337 - DNA, 22 bp, Homo sapiens
ggagaagtagctcagtttctgc

SEQ ID NO: 1338 - DNA, 21 bp, Homo sapiens
cgatgatgcgaaagcaatatg

SEQ ID NO: 1339 - DNA, 22 bp, Homo sapiens
tagcttcagtctctgatgtgag

SEQ ID NO: 1340 - DNA, 23 bp, Homo sapiens
tagcttatcaaggtggcaaactt

SEQ ID NO: 1341 - DNA, 21 bp, Homo sapiens
cactggataaggccactaccc

SEQ ID NO: 1342 - DNA, 22 bp, Homo sapiens
tgagtcagattcattataggtt

SEQ ID NO: 1343 - DNA, 23 bp, Homo sapiens
tcctattatatattattattatc

SEQ ID NO: 1344 - DNA, 22 bp, Homo sapiens
caagctgattgtgaggtttctc

SEQ ID NO: 1345 - DNA, 22 bp, Homo sapiens
gcggaacatgtggctgcattca

SEQ ID NO: 1346 - DNA, 21 bp, Homo sapiens
cgaaggtcggcacactaaaag

SEQ ID NO: 1347 - DNA, 22 bp, Homo sapiens
tggttcagctgatttattctaa

SEQ ID NO: 1348 - DNA, 20 bp, Homo sapiens
atataagtgccagtatatgc

SEQ ID NO: 1349 - DNA, 23 bp, Homo sapiens
tacaagtaattcaggatagggcc

SEQ ID NO: 1350 - DNA, 22 bp, Homo sapiens
ttcagtaacttgaactaaaaac

SEQ ID NO: 1351 - DNA, 20 bp, Homo sapiens
aggcgttctgctagtctgca

SEQ ID NO: 1352 - DNA, 23 bp, Homo sapiens
cactggtgaatcaaataaaatgt

SEQ ID NO: 1353 - DNA, 23 bp, Homo sapiens
agcagcaaactatgaaggctgag

SEQ ID NO: 1354 - DNA, 21 bp, Homo sapiens
cccacgggaatctttcgttca

SEQ ID NO: 1355 - DNA, 21 bp, Homo sapiens
ctgcaatgagctatattacgc

SEQ ID NO: 1356 - DNA, 21 bp, Homo sapiens
agctacattagctgctaacaa

SEQ ID NO: 1357 - DNA, 21 bp, Homo sapiens
tgacctatgggccagtcaaga

SEQ ID NO: 1358 - DNA, 20 bp, Homo sapiens
gcatgcctatagatggattc

SEQ ID NO: 1359 - DNA, 22 bp, Homo sapiens
catccacttccttactagtcga

SEQ ID NO: 1360 - DNA, 21 bp, Homo sapiens
tctacatgctcattatgcata

SEQ ID NO: 1361 - DNA, 22 bp, Homo sapiens
tgacactgtctggtagtggcaa

SEQ ID NO: 1362 - DNA, 20 bp, Homo sapiens
gctccccttatttaccccca

SEQ ID NO: 1363 - DNA, 22 bp, Homo sapiens
cccaatggcaaccatgaccaca

SEQ ID NO: 1364 - DNA, 23 bp, Homo sapiens
gtatctgaggcagcaggatgtca

SEQ ID NO: 1365 - DNA, 22 bp, Homo sapiens
accctgagacaagccaactgtc

SEQ ID NO: 1366 - DNA, 21 bp, Homo sapiens
gaccatgatgcagaactgagt

SEQ ID NO: 1367 - DNA, 21 bp, Homo sapiens
ggacactgttaattcaaggct

SEQ ID NO: 1368 - DNA, 20 bp, Homo sapiens
atctccgctgagtcaggggg

SEQ ID NO: 1369 - DNA, 20 bp, Homo sapiens
cgcagctgctattgttgcat

SEQ ID NO: 1370 - DNA, 20 bp, Homo sapiens
ccatgctgagaatctaacac

SEQ ID NO: 1371 - DNA, 22 bp, Homo sapiens
cagtcaaatgacaataccagtt

SEQ ID NO: 1372 - DNA, 21 bp, Homo sapiens
tccctgagaccctccaggtag

SEQ ID NO: 1373 - DNA, 22 bp, Homo sapiens
aaatcatagttcttgatggggt

SEQ ID NO: 1374 - DNA, 20 bp, Homo sapiens
tcttggatacctgtggtatc

SEQ ID NO: 1375 - DNA, 23 bp, Homo sapiens
tatactattgagtcatacaaaca

SEQ ID NO: 1376 - DNA, 21 bp, Homo sapiens
aggaggactctgttcaggact

SEQ ID NO: 1377 - DNA, 20 bp, Homo sapiens
tgagagtcctacagtcagct

SEQ ID NO: 1378 - DNA, 20 bp, Homo sapiens
cccaatttcatctttatgtc

SEQ ID NO: 1379 - DNA, 22 bp, Homo sapiens
cgagtcattaaacttatgaaaa

SEQ ID NO: 1380 - DNA, 23 bp, Homo sapiens
ctgctagactgggggagggctaa

SEQ ID NO: 1381 - DNA, 22 bp, Homo sapiens
ttctcatatggtagcagtctgg

SEQ ID NO: 1382 - DNA, 22 bp, Homo sapiens
tccctggtggtctagtggtatt

SEQ ID NO: 1383 - DNA, 22 bp, Homo sapiens
ttctgttgctcaggtagcccct

SEQ ID NO: 1384 - DNA, 20 bp, Homo sapiens
gtccagttttcccaggccag

SEQ ID NO: 1385 - DNA, 20 bp, Homo sapiens
tgagatgaagcactttggcc

SEQ ID NO: 1386 - DNA, 20 bp, Homo sapiens
aagacttgaggaatgtagct

SEQ ID NO: 1387 - DNA, 22 bp, Homo sapiens
taggactctgggaaataggaca

SEQ ID NO: 1388 - DNA, 21 bp, Homo sapiens
gtcagaacggctctagagcta

SEQ ID NO: 1389 - DNA, 21 bp, Homo sapiens
tctcttatactcagtctgaga

SEQ ID NO: 1390 - DNA, 23 bp, Homo sapiens
gctaggcaggagtcagcaaactg

SEQ ID NO: 1391 - DNA, 20 bp, Homo sapiens
agacatgtatatctgatttt

SEQ ID NO: 1392 - DNA, 23 bp, Homo sapiens
gtgctcagctcagctcagtgtaa

SEQ ID NO: 1393 - DNA, 20 bp, Homo sapiens
taggatacaagtgtacacca

SEQ ID NO: 1394 - DNA, 22 bp, Homo sapiens
caagccttagggtgaagcagag

SEQ ID NO: 1395 - DNA, 21 bp, Homo sapiens
ctctgtcgctggccagtgatt

SEQ ID NO: 1396 - DNA, 21 bp, Homo sapiens
tagcaccatctgaggcttagg

SEQ ID NO: 1397 - DNA, 23 bp, Homo sapiens
caaatgtagtacagtgcagagag

SEQ ID NO: 1398 - DNA, 22 bp, Homo sapiens
cacttcaatagcttagatttgt

SEQ ID NO: 1399 - DNA, 22 bp, Homo sapiens
atcacatgattgaactaactgg

SEQ ID NO: 1400 - DNA, 20 bp, Homo sapiens
ttgtcgtattgccatatcaa

SEQ ID NO: 1401 - DNA, 20 bp, Homo sapiens
tcctgtaagagattataaaa

SEQ ID NO: 1402 - DNA, 22 bp, Homo sapiens
ttcatcattaagtactatccaa

SEQ ID NO: 1403 - DNA, 22 bp, Homo sapiens
tcaagtccgatatgagtttgat

SEQ ID NO: 1404 - DNA, 22 bp, Homo sapiens
tagcttgctgagtgttatactg

SEQ ID NO: 1405 - DNA, 20 bp, Homo sapiens
cttcgcggtgctcttagact

SEQ ID NO: 1406 - DNA, 20 bp, Homo sapiens
ctaaaaatagaaaatgaaga

SEQ ID NO: 1407 - DNA, 23 bp, Homo sapiens
gtaactggggaaacttctgagaa

SEQ ID NO: 1408 - DNA, 22 bp, Homo sapiens
tagctgtagtccagtcctggta

SEQ ID NO: 1409 - DNA, 21 bp, Homo sapiens
ttccagaaagcccaggaaagg

SEQ ID NO: 1410 - DNA, 23 bp, Homo sapiens
cagcagcaagagtacttttgaat

SEQ ID NO: 1411 - DNA, 22 bp, Homo sapiens
cctaatagggtctagtggtatc

SEQ ID NO: 1412 - DNA, 23 bp, Homo sapiens
ttgcccagttcagcagtcacaga

SEQ ID NO: 1413 - DNA, 23 bp, Homo sapiens
gcatgctcgccgcgctctcccct

SEQ ID NO: 1414 - DNA, 22 bp, Homo sapiens
atcctgaatggcattgcgtaga

SEQ ID NO: 1415 - DNA, 22 bp, Homo sapiens
agggactcgtttcaacttgact

SEQ ID NO: 1416 - DNA, 24 bp, Homo sapiens
ttaaccaggctattgctgcaacta

SEQ ID NO: 1417 - DNA, 22 bp, Homo sapiens
ctgggattattagttatgttac

SEQ ID NO: 1418 - DNA, 24 bp, Homo sapiens
caggctaactacaatcaagggcat

SEQ ID NO: 1419 - DNA, 22 bp, Homo sapiens
cagtgcaataaattttcctgtg

SEQ ID NO: 1420 - DNA, 21 bp, Homo sapiens
tcgttggcacagtaagaatgt

SEQ ID NO: 1421 - DNA, 23 bp, Homo sapiens
tagcttatccagtctgcattctg

SEQ ID NO: 1422 - DNA, 22 bp, Homo sapiens
tctcagtaatctggaataggct

SEQ ID NO: 1423 - DNA, 22 bp, Homo sapiens
tgacctatgaaaactggattat

SEQ ID NO: 1424 - DNA, 22 bp, Homo sapiens
tcgaggagctcacagtctcaca

SEQ ID NO: 1425 - DNA, 22 bp, Homo sapiens
tctcccccaaaggtatgcagag

SEQ ID NO: 1426 - DNA, 20 bp, Homo sapiens
aggataatcacatgcccatg

SEQ ID NO: 1427 - DNA, 23 bp, Homo sapiens
cagctgctacctggtatgacagt

SEQ ID NO: 1428 - DNA, 20 bp, Homo sapiens
caaataatgaaaactatgtg

SEQ ID NO: 1429 - DNA, 23 bp, Homo sapiens
tagctgtagttctcagcaccagt

SEQ ID NO: 1430 - DNA, 22 bp, Homo sapiens
agctgattgcagaaagcccttg

SEQ ID NO: 1431 - DNA, 22 bp, Homo sapiens
atccctgccctttgaaggcttt

SEQ ID NO: 1432 - DNA, 22 bp, Homo sapiens
acagcattaatattgtatggca

SEQ ID NO: 1433 - DNA, 23 bp, Homo sapiens
ccagttgggaagtttattttgtt

SEQ ID NO: 1434 - DNA, 21 bp, Homo sapiens
ttgttgctgcttggtctatca

SEQ ID NO: 1435 - DNA, 24 bp, Homo sapiens
atgctcttgaggttttaattttgt

SEQ ID NO: 1436 - DNA, 20 bp, Homo sapiens
gcatcaggtcagaggaacag

SEQ ID NO: 1437 - DNA, 22 bp, Homo sapiens
agactgggtagtttataaacac

SEQ ID NO: 1438 - DNA, 20 bp, Homo sapiens
aaaaaacagtagccgggcgt

SEQ ID NO: 1439 - DNA, 21 bp, Homo sapiens
ttgacctataggccagtagat

SEQ ID NO: 1440 - DNA, 20 bp, Homo sapiens
tttggccagtagaaagccct

SEQ ID NO: 1441 - DNA, 22 bp, Homo sapiens
tgctcacatgggggtagggctg

SEQ ID NO: 1442 - DNA, 21 bp, Homo sapiens
aacataggagaaatcttgtgt

SEQ ID NO: 1443 - DNA, 22 bp, Homo sapiens
ttagtcattcagtttatggttg

SEQ ID NO: 1444 - DNA, 22 bp, Homo sapiens
ataaaggttaatgtgtcgcttt

SEQ ID NO: 1445 - DNA, 20 bp, Homo sapiens
cccacgttcataggagcact

SEQ ID NO: 1446 - DNA, 20 bp, Homo sapiens
gagttccttcttatgggtga

SEQ ID NO: 1447 - DNA, 20 bp, Homo sapiens
tgatgttgctcaggactgac

SEQ ID NO: 1448 - DNA, 22 bp, Homo sapiens
tggttaaatccatgcagtcttt

SEQ ID NO: 1449 - DNA, 22 bp, Homo sapiens
caaaggtagtggatgtcactcc

SEQ ID NO: 1450 - DNA, 23 bp, Homo sapiens
agcagcagttcagtgaactttct

SEQ ID NO: 1451 - DNA, 21 bp, Homo sapiens
aagacaatgataggtgataca

SEQ ID NO: 1452 - DNA, 20 bp, Homo sapiens
tcactgttgtaacacgagag

SEQ ID NO: 1453 - DNA, 20 bp, Homo sapiens
ctagctgctagttagcttca

SEQ ID NO: 1454 - DNA, 22 bp, Homo sapiens
agctactagtgagctgaacagt

SEQ ID NO: 1455 - DNA, 22 bp, Homo sapiens
tgtctcaaactcaacggaagga

SEQ ID NO: 1456 - DNA, 20 bp, Homo sapiens
tagggggggttaaaaaaaaa

SEQ ID NO: 1457 - DNA, 23 bp, Homo sapiens
actgctgaacctcagtcctcctt

SEQ ID NO: 1458 - DNA, 22 bp, Homo sapiens
tagctgttcaggatgattgtga

SEQ ID NO: 1459 - DNA, 20 bp, Homo sapiens
gagagctgggttcagaacgt

SEQ ID NO: 1460 - DNA, 20 bp, Homo sapiens
cattcgctggagtttccccc

SEQ ID NO: 1461 - DNA, 23 bp, Homo sapiens
agcagcatcatcactaatctgga

SEQ ID NO: 1462 - DNA, 22 bp, Homo sapiens
tcaagtctcaaagggcaccttg

SEQ ID NO: 1463 - DNA, 20 bp, Homo sapiens
actacatcagctgctccata

SEQ ID NO: 1464 - DNA, 21 bp, Homo sapiens
agctcctcgagtgagtctact

SEQ ID NO: 1465 - DNA, 20 bp, Homo sapiens
tgagaactgaattcccaggg

SEQ ID NO: 1466 - DNA, 24 bp, Homo sapiens
gttcaatgatgatttctatttgtt

SEQ ID NO: 1467 - DNA, 21 bp, Homo sapiens
ttgggacatctaggcttatct

SEQ ID NO: 1468 - DNA, 22 bp, Homo sapiens
gtctctggtttcaatattttgt

SEQ ID NO: 1469 - DNA, 24 bp, Homo sapiens
ggcggcggcggcggcggccgtggg

SEQ ID NO: 1470 - DNA, 22 bp, Homo sapiens
tagcaccattgtcctgatggcc

SEQ ID NO: 1471 - DNA, 22 bp, Homo sapiens
tcagtagtcttacacgattggc

SEQ ID NO: 1472 - DNA, 22 bp, Homo sapiens
tgtcgtgggtcaaatatgggac

SEQ ID NO: 1473 - DNA, 22 bp, Homo sapiens
agtcctccccagtttatggggt

SEQ ID NO: 1474 - DNA, 20 bp, Homo sapiens
tcagatgaagcactgaagtc

SEQ ID NO: 1475 - DNA, 20 bp, Homo sapiens
gtccagttttcccagccacc

SEQ ID NO: 1476 - DNA, 20 bp, Homo sapiens
tagtaatagtctgacttaga

SEQ ID NO: 1477 - DNA, 20 bp, Homo sapiens
acacatggtgcatggttgtc

SEQ ID NO: 1478 - DNA, 21 bp, Homo sapiens
tttggatggggtatttgtggt

SEQ ID NO: 1479 - DNA, 20 bp, Homo sapiens
gtgccaataacctgacaaac

SEQ ID NO: 1480 - DNA, 23 bp, Homo sapiens
taagaatagtctgaagcaggagt

SEQ ID NO: 1481 - DNA, 20 bp, Homo sapiens
gttcaggtccctgtttgatc

SEQ ID NO: 1482 - DNA, 22 bp, Homo sapiens
tcagacattgtcaaatacccac

SEQ ID NO: 1483 - DNA, 23 bp, Homo sapiens
gtccacaaaagggtcccaacgga

SEQ ID NO: 1484 - DNA, 22 bp, Homo sapiens
agcagcattaggtctttaaatc

SEQ ID NO: 1485 - DNA, 20 bp, Homo sapiens
gtccagttttcccagagctg

SEQ ID NO: 1486 - DNA, 23 bp, Homo sapiens
tagcaccatcctcccagttgtga

SEQ ID NO: 1487 - DNA, 20 bp, Homo sapiens
cttggccctgctccctacat

SEQ ID NO: 1488 - DNA, 22 bp, Homo sapiens
gtcagcccactggtatggaatc

SEQ ID NO: 1489 - DNA, 20 bp, Homo sapiens
agaaacgcttcaccttaatc

SEQ ID NO: 1490 - DNA, 21 bp, Homo sapiens
ctctttagggaagtaccagtg

SEQ ID NO: 1491 - DNA, 21 bp, Homo sapiens
agacggacctctctctttcgt

SEQ ID NO: 1492 - DNA, 22 bp, Homo sapiens
ctcaaggaatcactcttaggcg

SEQ ID NO: 1493 - DNA, 22 bp, Homo sapiens
cagaacagtagattgtgccacc

SEQ ID NO: 1494 - DNA, 20 bp, Homo sapiens
catcaccccatgggtgtttg

SEQ ID NO: 1495 - DNA, 20 bp, Homo sapiens
ttgctcttgaattccttaat

SEQ ID NO: 1496 - DNA, 22 bp, Homo sapiens
tgcgagtcaagtccaggactcg

SEQ ID NO: 1497 - DNA, 22 bp, Homo sapiens
gagtcaaagtcaaatgccaacc

SEQ ID NO: 1498 - DNA, 23 bp, Homo sapiens
gagctgcgactctgagcacactg

SEQ ID NO: 1499 - DNA, 22 bp, Homo sapiens
gttttcaaaagggtccttgaag

SEQ ID NO: 1500 - DNA, 22 bp, Homo sapiens
tgaggttcatcgtttgtgttgg

SEQ ID NO: 1501 - DNA, 21 bp, Homo sapiens
cctacataaattccttcagaa

SEQ ID NO: 1502 - DNA, 20 bp, Homo sapiens
ataggtttgacttcaattat

SEQ ID NO: 1503 - DNA, 24 bp, Homo sapiens
atcacattgttgaaataacaacaa

SEQ ID NO: 1504 - DNA, 23 bp, Homo sapiens
gtttctgattcagcaggtgtgag

SEQ ID NO: 1505 - DNA, 22 bp, Homo sapiens
caaattgccagaccatacccca

SEQ ID NO: 1506 - DNA, 23 bp, Homo sapiens
atattagtgaaataaacagcaga

SEQ ID NO: 1507 - DNA, 22 bp, Homo sapiens
gccctgagtggagctgaaccag

SEQ ID NO: 1508 - DNA, 22 bp, Homo sapiens
cagcttatcagactgactggtc

SEQ ID NO: 1509 - DNA, 20 bp, Homo sapiens
actgtggtaatgagctgtta

SEQ ID NO: 1510 - DNA, 20 bp, Homo sapiens
tgttaggaccagaaagatct

SEQ ID NO: 1511 - DNA, 20 bp, Homo sapiens
tggatggcggtcctattaaa

SEQ ID NO: 1512 - DNA, 23 bp, Homo sapiens
taataggaccgccatccaaagaa

SEQ ID NO: 1513 - DNA, 23 bp, Homo sapiens
tgtctcatgtcagcaggacactc

SEQ ID NO: 1514 - DNA, 22 bp, Homo sapiens
tctcaaccaaaggtgcaaggga

SEQ ID NO: 1515 - DNA, 24 bp, Homo sapiens
taaattagctctcagtctgaagag

SEQ ID NO: 1516 - DNA, 21 bp, Homo sapiens
tgaatcctgtctcccgttggt

SEQ ID NO: 1517 - DNA, 23 bp, Homo sapiens
agaactgtggaaactgaatccca

SEQ ID NO: 1518 - DNA, 22 bp, Homo sapiens
tcgcgttacactgcctacacta

SEQ ID NO: 1519 - DNA, 23 bp, Homo sapiens
tgagagtacagaccagcacccac

SEQ ID NO: 1520 - DNA, 22 bp, Homo sapiens
taatgttgtttgaagctacaat

SEQ ID NO: 1521 - DNA, 20 bp, Homo sapiens
ctattagtataaatggttga

SEQ ID NO: 1522 - DNA, 22 bp, Homo sapiens
accttatctccaagcagtctgg

SEQ ID NO: 1523 - DNA, 20 bp, Homo sapiens
tccgagtcacggcaccagat

SEQ ID NO: 1524 - DNA, 22 bp, Homo sapiens
ttccagttttcccattccgatc

SEQ ID NO: 1525 - DNA, 20 bp, Homo sapiens
cctcccaagggaacatggtc

SEQ ID NO: 1526 - DNA, 23 bp, Homo sapiens
tagcttatcagcatgctgggtgt

SEQ ID NO: 1527 - DNA, 20 bp, Homo sapiens
cctgtgacttgccacgtggt

SEQ ID NO: 1528 - DNA, 21 bp, Homo sapiens
atgacctatgaattttactca

SEQ ID NO: 1529 - DNA, 20 bp, Homo sapiens
cttccatcaagtgtacactg

SEQ ID NO: 1530 - DNA, 24 bp, Homo sapiens
atttaagaatggtaaagattggct

SEQ ID NO: 1531 - DNA, 20 bp, Homo sapiens
gtccagtttctttggcttag

SEQ ID NO: 1532 - DNA, 21 bp, Homo sapiens
ccgcagcaggtctccaatata

SEQ ID NO: 1533 - DNA, 22 bp, Homo sapiens
aagctgccagttgaaaagtcac

SEQ ID NO: 1534 - DNA, 23 bp, Homo sapiens
caggaatagtctcgagcaggtca

SEQ ID NO: 1535 - DNA, 21 bp, Homo sapiens
tctcctcgtggaaaaaaggaa

SEQ ID NO: 1536 - DNA, 24 bp, Homo sapiens
ccccccgagtgttacagctcttaa

SEQ ID NO: 1537 - DNA, 22 bp, Homo sapiens
tgagtatgtactaaatattcca

SEQ ID NO: 1538 - DNA, 21 bp, Homo sapiens
gtgccactaccagaacccaag

SEQ ID NO: 1539 - DNA, 22 bp, Homo sapiens
ggacgacccaggtcctatctag

SEQ ID NO: 1540 - DNA, 22 bp, Homo sapiens
tagcaccatttcttggtgatgt

SEQ ID NO: 1541 - DNA, 20 bp, Homo sapiens
accgccgggtcccccggggc

SEQ ID NO: 1542 - DNA, 20 bp, Homo sapiens
cgctggtcccggcgccctta

SEQ ID NO: 1543 - DNA, 20 bp, Homo sapiens
accagcagagcctgccaagt

SEQ ID NO: 1544 - DNA, 23 bp, Homo sapiens
ccgcccgctccagaccccacgct

SEQ ID NO: 1545 - DNA, 22 bp, Homo sapiens
tgatcatagtctcgtgctccag

SEQ ID NO: 1546 - DNA, 20 bp, Homo sapiens
caaagtgagtctagtctgca

SEQ ID NO: 1547 - DNA, 20 bp, Homo sapiens
cgcgacctcagatccccagc

SEQ ID NO: 1548 - DNA, 22 bp, Homo sapiens
aggaataatacattactgagtt

SEQ ID NO: 1549 - DNA, 22 bp, Homo sapiens
tgaggtgacttcccatggctgt

SEQ ID NO: 1550 - DNA, 21 bp, Homo sapiens
acagaacactaataacagcta

SEQ ID NO: 1551 - DNA, 24 bp, Homo sapiens
cctggctttggggggtttctgtgg

SEQ ID NO: 1552 - DNA, 22 bp, Homo sapiens
tgtactggaacttaatacccca

SEQ ID NO: 1553 - DNA, 21 bp, Homo sapiens
ttctcagtggctaaaccttca

SEQ ID NO: 1554 - DNA, 23 bp, Homo sapiens
agcagcatacaacaggaactata

SEQ ID NO: 1555 - DNA, 20 bp, Homo sapiens
tatagttctgagctgagctc

SEQ ID NO: 1556 - DNA, 23 bp, Homo sapiens
atcatagggaggtgaagctatct

SEQ ID NO: 1557 - DNA, 22 bp, Homo sapiens
gactaaaatcctgggcgttttc

SEQ ID NO: 1558 - DNA, 20 bp, Homo sapiens
gagggcccctgtaaaattta

SEQ ID NO: 1559 - DNA, 20 bp, Homo sapiens
tccccggcatctccacagtt

SEQ ID NO: 1560 - DNA, 21 bp, Homo sapiens
caggaatagtctgactgcaga

SEQ ID NO: 1561 - DNA, 20 bp, Homo sapiens
ctgacctatgaatttaatca

SEQ ID NO: 1562 - DNA, 20 bp, Homo sapiens
ctcagatatcgccacctagt

SEQ ID NO: 1563 - DNA, 22 bp, Homo sapiens
ttctgaccacagtttatgccac

SEQ ID NO: 1564 - DNA, 23 bp, Homo sapiens
tgtaacaattcatacttccagac

SEQ ID NO: 1565 - DNA, 23 bp, Homo sapiens
tggctcagggactacaagtcagt

SEQ ID NO: 1566 - DNA, 21 bp, Homo sapiens
cccataaagatctttctgtat

SEQ ID NO: 1567 - DNA, 23 bp, Homo sapiens
aagcattgcccagggctgagatg

SEQ ID NO: 1568 - DNA, 22 bp, Homo sapiens
ggtgcttttcctacttgttttg

SEQ ID NO: 1569 - DNA, 21 bp, Homo sapiens
tgtaaacatcctcgaatgctt

SEQ ID NO: 1570 - DNA, 20 bp, Homo sapiens
tagggtttggctgtgtcctt

SEQ ID NO: 1571 - DNA, 20 bp, Homo sapiens
ctgataacgccaaggttaca

SEQ ID NO: 1572 - DNA, 21 bp, Homo sapiens
gaacttgagaatcgctaccta

SEQ ID NO: 1573 - DNA, 22 bp, Homo sapiens
tccctgctagggatccttgtga

SEQ ID NO: 1574 - DNA, 22 bp, Homo sapiens
aagcaccatccagggctggcag

SEQ ID NO: 1575 - DNA, 22 bp, Homo sapiens
aggcaagatgctggcaccttga

SEQ ID NO: 1576 - DNA, 20 bp, Homo sapiens
tcttttggtttccatgttgt

SEQ ID NO: 1577 - DNA, 20 bp, Homo sapiens
gtggccgagtggttaagatg

SEQ ID NO: 1578 - DNA, 22 bp, Homo sapiens
aagaacaggatgtcacgatgct

SEQ ID NO: 1579 - DNA, 22 bp, Homo sapiens
actgcaaactcaagcaccccaa

SEQ ID NO: 1580 - DNA, 22 bp, Homo sapiens
ttctagggctgatgcgcaaagt

SEQ ID NO: 1581 - DNA, 22 bp, Homo sapiens
ggcacaatgaccagctactgct

SEQ ID NO: 1582 - DNA, 22 bp, Homo sapiens
gtatgtgatgaagcaccgatac

SEQ ID NO: 1583 - DNA, 22 bp, Homo sapiens
ttataccatctgaagctatggc

SEQ ID NO: 1584 - DNA, 24 bp, Homo sapiens
gctcacatcaccccagtccacaac

SEQ ID NO: 1585 - DNA, 23 bp, Homo sapiens
tggcttatcaagtactattttca

SEQ ID NO: 1586 - DNA, 22 bp, Homo sapiens
tgagagcttcagtttatggggt

SEQ ID NO: 1587 - DNA, 20 bp, Homo sapiens
ctctcggggccactattcca

SEQ ID NO: 1588 - DNA, 22 bp, Homo sapiens
attgtcaaccttgatctgagtg

SEQ ID NO: 1589 - DNA, 21 bp, Homo sapiens
tcccagcacctgctgcaatct

SEQ ID NO: 1590 - DNA, 24 bp, Homo sapiens
ccctgggtcccaatgtcaggacct

SEQ ID NO: 1591 - DNA, 20 bp, Homo sapiens
tccatttgtttgttttgaat

SEQ ID NO: 1592 - DNA, 20 bp, Homo sapiens
aggagatgatatatatacag

SEQ ID NO: 1593 - DNA, 21 bp, Homo sapiens
ttcacagtggctaatttacat

SEQ ID NO: 1594 - DNA, 24 bp, Homo sapiens
cggaaacccactacgcctccacta

SEQ ID NO: 1595 - DNA, 20 bp, Homo sapiens
aatggcaatggtaatggcgt

SEQ ID NO: 1596 - DNA, 21 bp, Homo sapiens
acttgactatctagaggaatt

SEQ ID NO: 1597 - DNA, 22 bp, Homo sapiens
gtctgtaggaagccagcgcttt

SEQ ID NO: 1598 - DNA, 22 bp, Homo sapiens
agatggtgggaagcaggcgcac

SEQ ID NO: 1599 - DNA, 22 bp, Homo sapiens
tgtgctgggtgacccgcaacct

SEQ ID NO: 1600 - DNA, 23 bp, Homo sapiens
cgggtcgcgcccagcccgggcgc

SEQ ID NO: 1601 - DNA, 20 bp, Homo sapiens
cccaccaggtcgccatccac

SEQ ID NO: 1602 - DNA, 21 bp, Homo sapiens
ccagctgcctctcctccatcg

SEQ ID NO: 1603 - DNA, 20 bp, Homo sapiens
tcgtccgctgagtcaggatg

SEQ ID NO: 1604 - DNA, 21 bp, Homo sapiens
ttcacagtggctactgccaac

SEQ ID NO: 1605 - DNA, 20 bp, Homo sapiens
agcagcattgatgtcgttct

SEQ ID NO: 1606 - DNA, 21 bp, Homo sapiens
tgtggcttttcattcctgtga

SEQ ID NO: 1607 - DNA, 20 bp, Homo sapiens
agcatgctgagagccattga

SEQ ID NO: 1608 - DNA, 22 bp, Homo sapiens
cagtcctagagctgacatgcca

SEQ ID NO: 1609 - DNA, 22 bp, Homo sapiens
aagattggcttgcataccactg

SEQ ID NO: 1610 - DNA, 22 bp, Homo sapiens
cctggataatccaggaaagatc

SEQ ID NO: 1611 - DNA, 22 bp, Homo sapiens
tagctgatcagacactctggta

SEQ ID NO: 1612 - DNA, 20 bp, Homo sapiens
gcggtccccttaggctgagc

SEQ ID NO: 1613 - DNA, 24 bp, Homo sapiens
caccgtaaggcaggctggaccacg

SEQ ID NO: 1614 - DNA, 22 bp, Homo sapiens
gggttaccgttcgacatgaggt

SEQ ID NO: 1615 - DNA, 23 bp, Homo sapiens
gcttctgtcctttgaaggttttc

SEQ ID NO: 1616 - DNA, 23 bp, Homo sapiens
ggtcagtgttcccaggaataaga

SEQ ID NO: 1617 - DNA, 20 bp, Homo sapiens
ctgacctatgaatacagtct

SEQ ID NO: 1618 - DNA, 21 bp, Homo sapiens
gccagaaatcatacccttggt

SEQ ID NO: 1619 - DNA, 20 bp, Homo sapiens
tttgggtgacgaaaatttga

SEQ ID NO: 1620 - DNA, 22 bp, Homo sapiens
cagaacttcagtttatggttgg

SEQ ID NO: 1621 - DNA, 22 bp, Homo sapiens
ttcctgcgaccagcagcaccag

SEQ ID NO: 1622 - DNA, 20 bp, Homo sapiens
aggtgccctgctccctatga

SEQ ID NO: 1623 - DNA, 23 bp, Homo sapiens
agcagctaaggcactggctacag

SEQ ID NO: 1624 - DNA, 20 bp, Homo sapiens
cggtatttctagaagatggg

SEQ ID NO: 1625 - DNA, 23 bp, Homo sapiens
gtcgtcacaagggtccttataag

SEQ ID NO: 1626 - DNA, 20 bp, Homo sapiens
tatgagacgataacaaatga

SEQ ID NO: 1627 - DNA, 23 bp, Homo sapiens
tgtgcaccgacatgcagggagcc

SEQ ID NO: 1628 - DNA, 22 bp, Homo sapiens
cccgtccgtccgtccgtccgtc

SEQ ID NO: 1629 - DNA, 21 bp, Homo sapiens
ccattataacagccccatgct

SEQ ID NO: 1630 - DNA, 21 bp, Homo sapiens
aatgccaggatttgattccta

SEQ ID NO: 1631 - DNA, 20 bp, Homo sapiens
ccacacaaaacgcctgtggt

SEQ ID NO: 1632 - DNA, 22 bp, Homo sapiens
cacattcatcccttttctggct

SEQ ID NO: 1633 - DNA, 23 bp, Homo sapiens
cactctgggtggtcctacccatt

SEQ ID NO: 1634 - DNA, 20 bp, Homo sapiens
cccgcgcccccgccccggcg

SEQ ID NO: 1635 - DNA, 22 bp, Homo sapiens
ggtgctccgcggcggcggcccc

SEQ ID NO: 1636 - DNA, 21 bp, Homo sapiens
caatataggcctgcaccccag

SEQ ID NO: 1637 - DNA, 23 bp, Homo sapiens
tggctcagtgactgtcctgtgtg

SEQ ID NO: 1638 - DNA, 22 bp, Homo sapiens
ttctgacggcctgggacaaaac

SEQ ID NO: 1639 - DNA, 22 bp, Homo sapiens
acctcagccccacagcctcagt

SEQ ID NO: 1640 - DNA, 20 bp, Homo sapiens
atcccaggcgacggtgtgag

SEQ ID NO: 1641 - DNA, 22 bp, Homo sapiens
ctgcagcccagtgggcgtggca

SEQ ID NO: 1642 - DNA, 22 bp, Homo sapiens
cactgacttgtccccgcacctg

SEQ ID NO: 1643 - DNA, 21 bp, Homo sapiens
ctgacctaaaggcactgtatg

SEQ ID NO: 1644 - DNA, 22 bp, Homo sapiens
acctgctgaacgtgtacttggc

SEQ ID NO: 1645 - DNA, 22 bp, Homo sapiens
tagcaccgcccagacgactggc

SEQ ID NO: 1646 - DNA, 20 bp, Homo sapiens
cccaccgcgccgtccttgtc

SEQ ID NO: 1647 - DNA, 22 bp, Homo sapiens
tagctgtaatccagttatccca

SEQ ID NO: 1648 - DNA, 20 bp, Homo sapiens
cagggcaacagctcccaagg

SEQ ID NO: 1649 - DNA, 23 bp, Homo sapiens
tatcccactccttgtaccagtgt

SEQ ID NO: 1650 - DNA, 22 bp, Homo sapiens
atctgtaatgtctttatttcca

SEQ ID NO: 1651 - DNA, 24 bp, Homo sapiens
cttcctctctttctccccatgtga

SEQ ID NO: 1652 - DNA, 20 bp, Homo sapiens
attttgcttctactattgtc

SEQ ID NO: 1653 - DNA, 22 bp, Homo sapiens
agctagtcactcaaatacccgg

SEQ ID NO: 1654 - DNA, 22 bp, Homo sapiens
aagctgccagttgatgtactgc

SEQ ID NO: 1655 - DNA, 21 bp, Homo sapiens
ggaaagttttcccagaaatcc

SEQ ID NO: 1656 - DNA, 20 bp, Homo sapiens
caatcttttagagatagctc

SEQ ID NO: 1657 - DNA, 21 bp, Homo sapiens
agtcaatgtctattgctacta

SEQ ID NO: 1658 - DNA, 20 bp, Homo sapiens
cccaaaactgctcccccact

SEQ ID NO: 1659 - DNA, 22 bp, Homo sapiens
gggtacatgcctagctatcagg

SEQ ID NO: 1660 - DNA, 22 bp, Homo sapiens
gttggtggttttgtttccttga

SEQ ID NO: 1661 - DNA, 20 bp, Homo sapiens
gggcaccatctgattagctg

SEQ ID NO: 1662 - DNA, 21 bp, Homo sapiens
ctccagtaaagagtccttagg

SEQ ID NO: 1663 - DNA, 20 bp, Homo sapiens
gctggtgagtgccgattggg

SEQ ID NO: 1664 - DNA, 22 bp, Homo sapiens
ggatcaggagtgagagttaggt

SEQ ID NO: 1665 - DNA, 22 bp, Homo sapiens
ctagtcatgactgatatggtta

SEQ ID NO: 1666 - DNA, 21 bp, Homo sapiens
tccccatatggaggtggggag

SEQ ID NO: 1667 - DNA, 22 bp, Homo sapiens
ctgcatcagaggctaatgtttc

SEQ ID NO: 1668 - DNA, 22 bp, Homo sapiens
ggacagtaatccaggagcagct

SEQ ID NO: 1669 - DNA, 22 bp, Homo sapiens
gtcgacgctgagtgaagtaaaa

SEQ ID NO: 1670 - DNA, 22 bp, Homo sapiens
ttgcagacatgcaatgcgttat

SEQ ID NO: 1671 - DNA, 22 bp, Homo sapiens
taatcatagttctactaccaga

SEQ ID NO: 1672 - DNA, 22 bp, Homo sapiens
ttgacatcattgaaagcctggt

SEQ ID NO: 1673 - DNA, 22 bp, Homo sapiens
tcaggctcagtttttcaaagga

SEQ ID NO: 1674 - DNA, 21 bp, Homo sapiens
tgacctatgggcactgagcca

SEQ ID NO: 1675 - DNA, 21 bp, Homo sapiens
tgcagcccactggatacccca

SEQ ID NO: 1676 - DNA, 22 bp, Homo sapiens
taaagtctcaaaggcagacact

SEQ ID NO: 1677 - DNA, 24 bp, Homo sapiens
acttcacattagcagatgaaacac

SEQ ID NO: 1678 - DNA, 20 bp, Homo sapiens
agcaggggagcaagatgatc

SEQ ID NO: 1679 - DNA, 22 bp, Homo sapiens
ggccgcccccggggagccaggc

SEQ ID NO: 1680 - DNA, 20 bp, Homo sapiens
cggccccggggccgcggatc

SEQ ID NO: 1681 - DNA, 21 bp, Homo sapiens
agtacagatgctggcatcaag

SEQ ID NO: 1682 - DNA, 21 bp, Homo sapiens
acaggggtcagtcggtccatc

SEQ ID NO: 1683 - DNA, 23 bp, Homo sapiens
tagcttatcaacacacaactgtg

SEQ ID NO: 1684 - DNA, 20 bp, Homo sapiens
acacagagggcactgtcagc

SEQ ID NO: 1685 - DNA, 23 bp, Homo sapiens
tgagtacccagataataggggta

SEQ ID NO: 1686 - DNA, 22 bp, Homo sapiens
tttggcatatttagcagcccaa

SEQ ID NO: 1687 - DNA, 22 bp, Homo sapiens
tatcatgtttgagggccccctt

SEQ ID NO: 1688 - DNA, 21 bp, Homo sapiens
caacctgatcagcccatctca

SEQ ID NO: 1689 - DNA, 20 bp, Homo sapiens
gttggatcatgggagcgatc

SEQ ID NO: 1690 - DNA, 20 bp, Homo sapiens
ctgatgaggtttcctttatg

SEQ ID NO: 1691 - DNA, 23 bp, Homo sapiens
tataggcagtcttcagctccagg

SEQ ID NO: 1692 - DNA, 20 bp, Homo sapiens
gggagccgacttagaacatc

SEQ ID NO: 1693 - DNA, 21 bp, Homo sapiens
gactggaagaggccagtggtt

SEQ ID NO: 1694 - DNA, 20 bp, Homo sapiens
ctgaatctctttctctcaag

SEQ ID NO: 1695 - DNA, 20 bp, Homo sapiens
ccgcccccggggccgcggtt

SEQ ID NO: 1696 - DNA, 23 bp, Homo sapiens
tgtgcaaatccacattaaacttg

SEQ ID NO: 1697 - DNA, 22 bp, Homo sapiens
cccatgtggactcagcagctgg

SEQ ID NO: 1698 - DNA, 23 bp, Homo sapiens
ggggccgagggagcgagaggcca

SEQ ID NO: 1699 - DNA, 22 bp, Homo sapiens
tagagcaggatgtcctacagag

SEQ ID NO: 1700 - DNA, 20 bp, Homo sapiens
aattttgcctacctttgttt

SEQ ID NO: 1701 - DNA, 22 bp, Homo sapiens
gctagatagtctagtcgcttga

SEQ ID NO: 1702 - DNA, 22 bp, Homo sapiens
tccctgagaccctatgccctga

SEQ ID NO: 1703 - DNA, 21 bp, Homo sapiens
ggccaggggccatcgagcaag

SEQ ID NO: 1704 - DNA, 23 bp, Homo sapiens
cacatgaatccatgcacagtctg

SEQ ID NO: 1705 - DNA, 24 bp, Homo sapiens
gaagctaagggcatggccagtggg

SEQ ID NO: 1706 - DNA, 22 bp, Homo sapiens
tagcagccagctgtggtggcac

SEQ ID NO: 1707 - DNA, 20 bp, Homo sapiens
ggccctcccccgccccaaga

SEQ ID NO: 1708 - DNA, 23 bp, Homo sapiens
ctgatcaaacagtggtaccctgg

SEQ ID NO: 1709 - DNA, 23 bp, Homo sapiens
aatctgtgcatacagaaatgatt

SEQ ID NO: 1710 - DNA, 22 bp, Homo sapiens
cctctaatgacccttggaattt

SEQ ID NO: 1711 - DNA, 20 bp, Homo sapiens
ggtattgtcatagtggaaat

SEQ ID NO: 1712 - DNA, 20 bp, Homo sapiens
tagcagcacatcatagggcc

SEQ ID NO: 1713 - DNA, 22 bp, Homo sapiens
ccacttgatctaggatcgaaga

SEQ ID NO: 1714 - DNA, 21 bp, Homo sapiens
ttcacagcgtagcctggaatt

SEQ ID NO: 1715 - DNA, 21 bp, Homo sapiens
atgctatgtctgcataataca

SEQ ID NO: 1716 - DNA, 20 bp, Homo sapiens
tggctcagaagtccaggagt

SEQ ID NO: 1717 - DNA, 22 bp, Homo sapiens
agcatggcatctatatacgtat

SEQ ID NO: 1718 - DNA, 22 bp, Homo sapiens
tctgtcattgttgggcgttttg

SEQ ID NO: 1719 - DNA, 22 bp, Homo sapiens
gtccagtgcagtagccgctggc

SEQ ID NO: 1720 - DNA, 22 bp, Homo sapiens
ggagtcattagggttatggggt

SEQ ID NO: 1721 - DNA, 23 bp, Homo sapiens
cgatattgtggtacaactatgct

SEQ ID NO: 1722 - DNA, 23 bp, Homo sapiens
gatttatgattcagtcagttagg

SEQ ID NO: 1723 - DNA, 22 bp, Homo sapiens
agctctgaagtcattatggggt

SEQ ID NO: 1724 - DNA, 22 bp, Homo sapiens
ctagagtttgagtggcgttttg

SEQ ID NO: 1725 - DNA, 20 bp, Homo sapiens
attctgcttccagagtgtaa

SEQ ID NO: 1726 - DNA, 21 bp, Homo sapiens
ctgacctattaattgaatgaa

SEQ ID NO: 1727 - DNA, 20 bp, Homo sapiens
aataatcacatgaggggaaa

SEQ ID NO: 1728 - DNA, 22 bp, Homo sapiens
atataatacaattcggatttgt

SEQ ID NO: 1729 - DNA, 22 bp, Homo sapiens
atatgtatcactgtgacaactt

SEQ ID NO: 1730 - DNA, 23 bp, Homo sapiens
agtcaacccactgggctgaaaca

SEQ ID NO: 1731 - DNA, 23 bp, Homo sapiens
aagtctttgggttttttttttct

SEQ ID NO: 1732 - DNA, 24 bp, Homo sapiens
gctttaatggcaggtagagcagtg

SEQ ID NO: 1733 - DNA, 21 bp, Homo sapiens
ctaagggctgccagccagcca

SEQ ID NO: 1734 - DNA, 24 bp, Homo sapiens
gcgcgcgcgcgcgcgcgtgtgagc

SEQ ID NO: 1735 - DNA, 22 bp, Homo sapiens
tggcttgacccagcaggacaga

SEQ ID NO: 1736 - DNA, 22 bp, Homo sapiens
aagcttatcctcagtaaaccag

SEQ ID NO: 1737 - DNA, 23 bp, Homo sapiens
aactatgccactgtagtataaag

SEQ ID NO: 1738 - DNA, 20 bp, Homo sapiens
accccagaggaccatgtgac

SEQ ID NO: 1739 - DNA, 22 bp, Homo sapiens
tagcaccatgactaaacagact

SEQ ID NO: 1740 - DNA, 22 bp, Homo sapiens
gctacaagagactaagatgtta

SEQ ID NO: 1741 - DNA, 20 bp, Homo sapiens
ctggccttccaaaactcaga

SEQ ID NO: 1742 - DNA, 20 bp, Homo sapiens
caagccaccttgggaatgct

SEQ ID NO: 1743 - DNA, 22 bp, Homo sapiens
ttctaaccacagtgtatgttgt

SEQ ID NO: 1744 - DNA, 22 bp, Homo sapiens
gtcatggtgagtttacaaaagg

SEQ ID NO: 1745 - DNA, 21 bp, Homo sapiens
cagacctttgagacctctggg

SEQ ID NO: 1746 - DNA, 20 bp, Homo sapiens
atgcaatgtctgccgctctc

SEQ ID NO: 1747 - DNA, 21 bp, Homo sapiens
ctggcctatgaattgatagat

SEQ ID NO: 1748 - DNA, 20 bp, Homo sapiens
tagaatctagactgaaggct

SEQ ID NO: 1749 - DNA, 21 bp, Homo sapiens
gatctttgtgacaagctaata

SEQ ID NO: 1750 - DNA, 24 bp, Homo sapiens
ctggacttggagtcagaaggcctt

SEQ ID NO: 1751 - DNA, 21 bp, Homo sapiens
acgcacttgcggccccagcta

SEQ ID NO: 1752 - DNA, 22 bp, Homo sapiens
tgacaagagctagacactgtgt

SEQ ID NO: 1753 - DNA, 22 bp, Homo sapiens
tgctgttcatccaacacaccag

SEQ ID NO: 1754 - DNA, 20 bp, Homo sapiens
aatttaggttgggacaaaaa

SEQ ID NO: 1755 - DNA, 20 bp, Homo sapiens
cctcgagggtatagttgttt

SEQ ID NO: 1756 - DNA, 22 bp, Homo sapiens
tagcttattgagtcacttggcc

SEQ ID NO: 1757 - DNA, 21 bp, Homo sapiens
tgtacaaaattatttgtgaga

SEQ ID NO: 1758 - DNA, 21 bp, Homo sapiens
acctcacgagcttagacccac

SEQ ID NO: 1759 - DNA, 22 bp, Homo sapiens
taacactgtctggtaactaatc

SEQ ID NO: 1760 - DNA, 22 bp, Homo sapiens
tgtctcaaacagtttatggttt

SEQ ID NO: 1761 - DNA, 20 bp, Homo sapiens
cccacccccggccccccgta

SEQ ID NO: 1762 - DNA, 23 bp, Homo sapiens
tgtagtgatggtcttgcataggc

SEQ ID NO: 1763 - DNA, 21 bp, Homo sapiens
aggcaagatgctaatgactat

SEQ ID NO: 1764 - DNA, 22 bp, Homo sapiens
ttcgtggcctatcacagcagtc

SEQ ID NO: 1765 - DNA, 22 bp, Homo sapiens
tgtctcaaagtcaaaaaaaaac

SEQ ID NO: 1766 - DNA, 21 bp, Homo sapiens
ctactctttgcacccctctgc

SEQ ID NO: 1767 - DNA, 23 bp, Homo sapiens
aaagggtgcacagagcccagcca

SEQ ID NO: 1768 - DNA, 22 bp, Homo sapiens
ttctggtttgtcaaatcaaaca

SEQ ID NO: 1769 - DNA, 23 bp, Homo sapiens
tggctcagggactctccagtgac

SEQ ID NO: 1770 - DNA, 22 bp, Homo sapiens
tggctatagtaaatgatcccag

SEQ ID NO: 1771 - DNA, 22 bp, Homo sapiens
ttccagcacggtccctaaaggc

SEQ ID NO: 1772 - DNA, 21 bp, Homo sapiens
aatatgtactggcttcaagga

SEQ ID NO: 1773 - DNA, 20 bp, Homo sapiens
tacaaaggctagaccagttt

SEQ ID NO: 1774 - DNA, 23 bp, Homo sapiens
tggctcagtccagccttccatat

SEQ ID NO: 1775 - DNA, 21 bp, Homo sapiens
catactctagaaagcaagcag

SEQ ID NO: 1776 - DNA, 20 bp, Homo sapiens
cattgctattacccacaatt

SEQ ID NO: 1777 - DNA, 20 bp, Homo sapiens
gagcactctgtcaagccggg

SEQ ID NO: 1778 - DNA, 22 bp, Homo sapiens
ggtaacagcacagaacacacct

SEQ ID NO: 1779 - DNA, 22 bp, Homo sapiens
cagagtttgtcaaatattttgc

SEQ ID NO: 1780 - DNA, 22 bp, Homo sapiens
tactggtttcagtttatgtcca

SEQ ID NO: 1781 - DNA, 20 bp, Homo sapiens
cgcgggcccgggtggagggg

SEQ ID NO: 1782 - DNA, 22 bp, Homo sapiens
tccctgagagttgggtccaact

SEQ ID NO: 1783 - DNA, 22 bp, Homo sapiens
cgggaactaatgatgatgatta

SEQ ID NO: 1784 - DNA, 22 bp, Homo sapiens
aatgtgcattgcaggatctgcc

SEQ ID NO: 1785 - DNA, 22 bp, Homo sapiens
ttcaagtaattcagctttcatt

SEQ ID NO: 1786 - DNA, 23 bp, Homo sapiens
gaggaatagtctgagatagtgtg

SEQ ID NO: 1787 - DNA, 23 bp, Homo sapiens
aaatgatgccaccaaccctttgc

SEQ ID NO: 1788 - DNA, 20 bp, Homo sapiens
ttcacagtggctaatgcctc

SEQ ID NO: 1789 - DNA, 20 bp, Homo sapiens
gaagcgggtgctcgtacagc

SEQ ID NO: 1790 - DNA, 20 bp, Homo sapiens
tagcaccattttccccactg

SEQ ID NO: 1791 - DNA, 20 bp, Homo sapiens
tgaggtagtgcaactgattt

SEQ ID NO: 1792 - DNA, 20 bp, Homo sapiens
ggatctgattcagcaggatg

SEQ ID NO: 1793 - DNA, 20 bp, Homo sapiens
cttacctatgaattaacagg

SEQ ID NO: 1794 - DNA, 23 bp, Homo sapiens
acctggtttgtcaaataccctca

SEQ ID NO: 1795 - DNA, 22 bp, Homo sapiens
acagcaggcacagcactgtggt

SEQ ID NO: 1796 - DNA, 23 bp, Homo sapiens
cactcatctctcttgcgcccaca

SEQ ID NO: 1797 - DNA, 20 bp, Homo sapiens
agtttgactggaataatgca

SEQ ID NO: 1798 - DNA, 20 bp, Homo sapiens
ctattggaccaagtcactgc

SEQ ID NO: 1799 - DNA, 21 bp, Homo sapiens
tccccagcacctccaccaaaa

SEQ ID NO: 1800 - DNA, 24 bp, Homo sapiens
ggctgtgggtgcaaatacaaaaat

SEQ ID NO: 1801 - DNA, 22 bp, Homo sapiens
cctgtatttccatatcaaagct

SEQ ID NO: 1802 - DNA, 21 bp, Homo sapiens
acacagctggttgggtagaaa

SEQ ID NO: 1803 - DNA, 20 bp, Homo sapiens
tcccgggtgctgtaggcatt

SEQ ID NO: 1804 - DNA, 21 bp, Homo sapiens
aaacacgacatcagctgctcc

SEQ ID NO: 1805 - DNA, 22 bp, Homo sapiens
tgccttgccctctccctctagg

SEQ ID NO: 1806 - DNA, 23 bp, Homo sapiens
gcgccgagaccgcgaggccctga

SEQ ID NO: 1807 - DNA, 20 bp, Homo sapiens
tccgagtcacggcaccaaaa

SEQ ID NO: 1808 - DNA, 22 bp, Homo sapiens
acagcagtacactacaggtgta

SEQ ID NO: 1809 - DNA, 22 bp, Homo sapiens
tgtctcaaaagaccctaggtga

SEQ ID NO: 1810 - DNA, 23 bp, Homo sapiens
ggacgaaatccaagcgcagctgg

SEQ ID NO: 1811 - DNA, 23 bp, Homo sapiens
ttctcatacgagtcattcttgac

SEQ ID NO: 1812 - DNA, 20 bp, Homo sapiens
ttagattcccttcacttgct

SEQ ID NO: 1813 - DNA, 22 bp, Homo sapiens
tgtcatacttgctgattggtta

SEQ ID NO: 1814 - DNA, 24 bp, Homo sapiens
gcccctacagagtatgacagcaga

SEQ ID NO: 1815 - DNA, 22 bp, Homo sapiens
ttttagtatagtagcatagtct

SEQ ID NO: 1816 - DNA, 20 bp, Homo sapiens
gttggtcccatcttggcctg

SEQ ID NO: 1817 - DNA, 22 bp, Homo sapiens
agcagcattgtacaggtgctag

SEQ ID NO: 1818 - DNA, 22 bp, Homo sapiens
agaggggcaggaggggggaaat

SEQ ID NO: 1819 - DNA, 20 bp, Homo sapiens
gcttgaatgctattgaagta

SEQ ID NO: 1820 - DNA, 20 bp, Homo sapiens
tagcttatactcacagtgtc

SEQ ID NO: 1821 - DNA, 23 bp, Homo sapiens
gccgccgggtcccgcaacaatgg

SEQ ID NO: 1822 - DNA, 24 bp, Homo sapiens
aaggagggtttggaattttagagt

SEQ ID NO: 1823 - DNA, 22 bp, Homo sapiens
catcaaccgtgacccgcacctg

SEQ ID NO: 1824 - DNA, 22 bp, Homo sapiens
ttataggcaagagccgctacat

SEQ ID NO: 1825 - DNA, 20 bp, Homo sapiens
catcaagcgcttatgacagc

SEQ ID NO: 1826 - DNA, 20 bp, Homo sapiens
gccccagtggacaacaagcc

SEQ ID NO: 1827 - DNA, 22 bp, Homo sapiens
gagcagcccgtcaaataggaac

SEQ ID NO: 1828 - DNA, 21 bp, Homo sapiens
tctcctgggagcaatatggga

SEQ ID NO: 1829 - DNA, 20 bp, Homo sapiens
gctaaccaccaatgacctgt

SEQ ID NO: 1830 - DNA, 22 bp, Homo sapiens
ccttctcgagccttgagtgtgc

SEQ ID NO: 1831 - DNA, 23 bp, Homo sapiens
caacaggccttgctctgctcaca

SEQ ID NO: 1832 - DNA, 20 bp, Homo sapiens
gggcaccgccgctggacccc

SEQ ID NO: 1833 - DNA, 23 bp, Homo sapiens
aggcaagatgctggcctaggcca

SEQ ID NO: 1834 - DNA, 21 bp, Homo sapiens
gagtgtcccgattttccagaa

SEQ ID NO: 1835 - DNA, 22 bp, Homo sapiens
cacaggcaggagaccccacagc

SEQ ID NO: 1836 - DNA, 20 bp, Homo sapiens
agtggcaatggtagcagtct

SEQ ID NO: 1837 - DNA, 23 bp, Homo sapiens
ctccagtcccttcaggaatcccc

SEQ ID NO: 1838 - DNA, 20 bp, Homo sapiens
gtaggtgaacctgcggaagg

SEQ ID NO: 1839 - DNA, 21 bp, Homo sapiens
ctggaaggccgtacagtgtcc

SEQ ID NO: 1840 - DNA, 20 bp, Homo sapiens
ccaataatgctcttgttggg

SEQ ID NO: 1841 - DNA, 21 bp, Homo sapiens
tcctgaaacatgccagcatgt

SEQ ID NO: 1842 - DNA, 22 bp, Homo sapiens
tgctggtttgtgtttatgtttc

SEQ ID NO: 1843 - DNA, 20 bp, Homo sapiens
cccagcccttagaaaggtca

SEQ ID NO: 1844 - DNA, 21 bp, Homo sapiens
cctcttttagagatagtctga

SEQ ID NO: 1845 - DNA, 20 bp, Homo sapiens
ctcatgctgagaattgccac

SEQ ID NO: 1846 - DNA, 22 bp, Homo sapiens
tgtctcagaagaggtatggggc

SEQ ID NO: 1847 - DNA, 23 bp, Homo sapiens
atggttcgattccacagcctccc

SEQ ID NO: 1848 - DNA, 22 bp, Homo sapiens
tgtcagattcttgaatatccca

SEQ ID NO: 1849 - DNA, 20 bp, Homo sapiens
ggccgaggtgaagctggctc

SEQ ID NO: 1850 - DNA, 22 bp, Homo sapiens
accaacaatggtataggtctga

SEQ ID NO: 1851 - DNA, 22 bp, Homo sapiens
tctagatgtagctacttccaag

SEQ ID NO: 1852 - DNA, 21 bp, Homo sapiens
ctggggagtctggcagcactc

SEQ ID NO: 1853 - DNA, 21 bp, Homo sapiens
gtgttgggtgaccatacccca

SEQ ID NO: 1854 - DNA, 22 bp, Homo sapiens
ttcttcattaggtcagactcct

SEQ ID NO: 1855 - DNA, 20 bp, Homo sapiens
aattgcgtaatgatattata

SEQ ID NO: 1856 - DNA, 22 bp, Homo sapiens
aagcttatcagacactcaaaag

SEQ ID NO: 1857 - DNA, 22 bp, Homo sapiens
ttcactgggctcccctattttg

SEQ ID NO: 1858 - DNA, 22 bp, Homo sapiens
gaggtcaaaaggcaggagatcc

SEQ ID NO: 1859 - DNA, 22 bp, Homo sapiens
cacttcactgctgggagtttgc

SEQ ID NO: 1860 - DNA, 22 bp, Homo sapiens
catatcgcatgcattatttgat

SEQ ID NO: 1861 - DNA, 22 bp, Homo sapiens
tagtgataatccagctctcaat

SEQ ID NO: 1862 - DNA, 22 bp, Homo sapiens
gctgggccatcaaataccccaa

SEQ ID NO: 1863 - DNA, 23 bp, Homo sapiens
accagcacagctgtctttcatga

SEQ ID NO: 1864 - DNA, 22 bp, Homo sapiens
tttggacataagaggatcttgg

SEQ ID NO: 1865 - DNA, 20 bp, Homo sapiens
tagcttaagtctgactaact

SEQ ID NO: 1866 - DNA, 20 bp, Homo sapiens
ccgcgctctcccccctccag

SEQ ID NO: 1867 - DNA, 23 bp, Homo sapiens
tttgacactactcagcaagactc

SEQ ID NO: 1868 - DNA, 22 bp, Homo sapiens
tgcatgggcttgcacagggtcc

SEQ ID NO: 1869 - DNA, 22 bp, Homo sapiens
ttgcttatcagatgagcaggtc

SEQ ID NO: 1870 - DNA, 20 bp, Homo sapiens
cgcggccgcccccggggagt

SEQ ID NO: 1871 - DNA, 22 bp, Homo sapiens
tagtcagagaaagcacttgtga

SEQ ID NO: 1872 - DNA, 23 bp, Homo sapiens
agctacatcacttatcaaaggga

SEQ ID NO: 1873 - DNA, 22 bp, Homo sapiens
catgtagggattattacaatta

SEQ ID NO: 1874 - DNA, 20 bp, Homo sapiens
cctggtccccttgaatcagt

SEQ ID NO: 1875 - DNA, 21 bp, Homo sapiens
tagcaccatttctggcttcaa

SEQ ID NO: 1876 - DNA, 23 bp, Homo sapiens
cagctgttccgtctgtactcact

SEQ ID NO: 1877 - DNA, 23 bp, Homo sapiens
ctttggatacttaactgttgata

SEQ ID NO: 1878 - DNA, 21 bp, Homo sapiens
gctagaatcaaggtgcaactg

SEQ ID NO: 1879 - DNA, 21 bp, Homo sapiens
ttggaaaccagcttcatgagt

SEQ ID NO: 1880 - DNA, 23 bp, Homo sapiens
gagcttagactcttgattggtca

SEQ ID NO: 1881 - DNA, 24 bp, Homo sapiens
actgggcaacaaagtgagacctat

SEQ ID NO: 1882 - DNA, 23 bp, Homo sapiens
atccagtttttccagcttagggt

SEQ ID NO: 1883 - DNA, 22 bp, Homo sapiens
ttctcatagttctactacacgg

SEQ ID NO: 1884 - DNA, 22 bp, Homo sapiens
gaagcaggtatcagtgaggcaa

SEQ ID NO: 1885 - DNA, 21 bp, Homo sapiens
taggtggtagtgactgattgg

SEQ ID NO: 1886 - DNA, 22 bp, Homo sapiens
tgctgtgggaagcaatattttc

SEQ ID NO: 1887 - DNA, 23 bp, Homo sapiens
tgcactgggcagtaataccccaa

SEQ ID NO: 1888 - DNA, 22 bp, Homo sapiens
actgtgccattcttctccctag

SEQ ID NO: 1889 - DNA, 23 bp, Homo sapiens
tgcctcatcactgggcgtttgtt

SEQ ID NO: 1890 - DNA, 22 bp, Homo sapiens
tagaaatgtgctatggttgcaa

SEQ ID NO: 1891 - DNA, 22 bp, Homo sapiens
gctacaactctgaggctggaat

SEQ ID NO: 1892 - DNA, 23 bp, Homo sapiens
ggcagcaaacatgtccttagggg

SEQ ID NO: 1893 - DNA, 22 bp, Homo sapiens
tgtattgcgaagcacagagata

SEQ ID NO: 1894 - DNA, 21 bp, Homo sapiens
tggagcaggatgtcatgagag

SEQ ID NO: 1895 - DNA, 22 bp, Homo sapiens
tgagtcagacagaaatattttt

SEQ ID NO: 1896 - DNA, 21 bp, Homo sapiens
ttcatgacaatcggatcttaa

SEQ ID NO: 1897 - DNA, 20 bp, Homo sapiens
tggggcgtaggaggtggttt

SEQ ID NO: 1898 - DNA, 21 bp, Homo sapiens
gtccagttttcccactttggt

SEQ ID NO: 1899 - DNA, 22 bp, Homo sapiens
attttaggaaattctgatttgg

SEQ ID NO: 1900 - DNA, 23 bp, Homo sapiens
gagggcaaaagggtccttggtgg

SEQ ID NO: 1901 - DNA, 22 bp, Homo sapiens
tggaacagcaactccatgggtt

SEQ ID NO: 1902 - DNA, 22 bp, Homo sapiens
tccctgagtccctaataacact

SEQ ID NO: 1903 - DNA, 22 bp, Homo sapiens
tctcaactgccaacacttgaca

SEQ ID NO: 1904 - DNA, 22 bp, Homo sapiens
tgtagactttctctataggttg

SEQ ID NO: 1905 - DNA, 20 bp, Homo sapiens
acatgtgaacagcagttggg

SEQ ID NO: 1906 - DNA, 20 bp, Homo sapiens
ctgacctacaggccacagac

SEQ ID NO: 1907 - DNA, 24 bp, Homo sapiens
agctactaaatagtagtttgggag

SEQ ID NO: 1908 - DNA, 23 bp, Homo sapiens
aggagcattgtacagcctgtact

SEQ ID NO: 1909 - DNA, 20 bp, Homo sapiens
gactggatacttaaccccat

SEQ ID NO: 1910 - DNA, 23 bp, Homo sapiens
aaactgtgctaggtctttaccat

SEQ ID NO: 1911 - DNA, 20 bp, Homo sapiens
agacaagatgctggctatct

SEQ ID NO: 1912 - DNA, 22 bp, Homo sapiens
agcagcattgtacctttacttc

SEQ ID NO: 1913 - DNA, 20 bp, Homo sapiens
gccggaatttcaccgacgga

SEQ ID NO: 1914 - DNA, 22 bp, Homo sapiens
gtatctggtttagcaggacact

SEQ ID NO: 1915 - DNA, 22 bp, Homo sapiens
ggctgggccgaggggcttgggt

SEQ ID NO: 1916 - DNA, 20 bp, Homo sapiens
ctgacctatgaattaccatt

SEQ ID NO: 1917 - DNA, 22 bp, Homo sapiens
tgagattaagctgacatctgat

SEQ ID NO: 1918 - DNA, 21 bp, Homo sapiens
cccagtgttctctgagttcaa

SEQ ID NO: 1919 - DNA, 20 bp, Homo sapiens
acaaagacaccccccacaca

SEQ ID NO: 1920 - DNA, 22 bp, Homo sapiens
taagtggtagactggctataat

SEQ ID NO: 1921 - DNA, 22 bp, Homo sapiens
tgtctacttccactgtatccct

SEQ ID NO: 1922 - DNA, 20 bp, Homo sapiens
cctcttcacagtgaccaatc

SEQ ID NO: 1923 - DNA, 22 bp, Homo sapiens
tgagtaccacagaaataaaaat

SEQ ID NO: 1924 - DNA, 20 bp, Homo sapiens
aatatcggttgggaaaaaaa

SEQ ID NO: 1925 - DNA, 20 bp, Homo sapiens
acacacacccataaacacca

SEQ ID NO: 1926 - DNA, 22 bp, Homo sapiens
ttctgataatccaggatagtct

SEQ ID NO: 1927 - DNA, 22 bp, Homo sapiens
aacagcataagaatagatatga

SEQ ID NO: 1928 - DNA, 22 bp, Homo sapiens
ttcttcaggctttcagcagatc

SEQ ID NO: 1929 - DNA, 22 bp, Homo sapiens
ttcaagtaattcagcaatctgc

SEQ ID NO: 1930 - DNA, 23 bp, Homo sapiens
gcttgatgggaaagaaggctttg

SEQ ID NO: 1931 - DNA, 22 bp, Homo sapiens
ttcaagtaatcactaggtccat

SEQ ID NO: 1932 - DNA, 23 bp, Homo sapiens
tatagactcctctcaggaacagt

SEQ ID NO: 1933 - DNA, 22 bp, Homo sapiens
tatcatgtcacctttataaaaa

SEQ ID NO: 1934 - DNA, 23 bp, Homo sapiens
tagctcaagtctgtctacaatct

SEQ ID NO: 1935 - DNA, 21 bp, Homo sapiens
aaagatcaaaccagagaacat

SEQ ID NO: 1936 - DNA, 20 bp, Homo sapiens
ggaaggtcaccaccaggatc

SEQ ID NO: 1937 - DNA, 22 bp, Homo sapiens
gctgagtaacttgactatgatc

SEQ ID NO: 1938 - DNA, 20 bp, Homo sapiens
atcacattgccctttctcaa

SEQ ID NO: 1939 - DNA, 20 bp, Homo sapiens
gtccagttttcccatgccat

SEQ ID NO: 1940 - DNA, 20 bp, Homo sapiens
tagcttatcagaagtctgga

SEQ ID NO: 1941 - DNA, 22 bp, Homo sapiens
actgataatggtaatcgtcttt

SEQ ID NO: 1942 - DNA, 22 bp, Homo sapiens
tggcttatcagatcagactctg

SEQ ID NO: 1943 - DNA, 21 bp, Homo sapiens
ctgccaacaacctgacaaagc

SEQ ID NO: 1944 - DNA, 23 bp, Homo sapiens
tccaggagagacagagagagtaa

SEQ ID NO: 1945 - DNA, 22 bp, Homo sapiens
attaaaaaagccgtggtcactg

SEQ ID NO: 1946 - DNA, 20 bp, Homo sapiens
gcaaaccaccaagtcacatg

SEQ ID NO: 1947 - DNA, 22 bp, Homo sapiens
actccatcatcaaatgcaagaa

SEQ ID NO: 1948 - DNA, 23 bp, Homo sapiens
atgtaatagtgacactacttgac

SEQ ID NO: 1949 - DNA, 21 bp, Homo sapiens
gatcaacccttaacatggtca

SEQ ID NO: 1950 - DNA, 23 bp, Homo sapiens
tgcatgggcccatgcaatagaca

SEQ ID NO: 1951 - DNA, 21 bp, Homo sapiens
gtccagttttcccagaagctt

SEQ ID NO: 1952 - DNA, 22 bp, Homo sapiens
gtcagtagattgatttaactta

SEQ ID NO: 1953 - DNA, 22 bp, Homo sapiens
ttagtcaaatgaccatacaatg

SEQ ID NO: 1954 - DNA, 23 bp, Homo sapiens
cagctgtagtagcactacaaagt

SEQ ID NO: 1955 - DNA, 20 bp, Homo sapiens
gtttgactggggattgcaca

SEQ ID NO: 1956 - DNA, 20 bp, Homo sapiens
cccgattagtagaactacag

SEQ ID NO: 1957 - DNA, 23 bp, Homo sapiens
ggcagcaaacattgaagcatttc

SEQ ID NO: 1958 - DNA, 22 bp, Homo sapiens
atagtgggtaacttctaaaggt

SEQ ID NO: 1959 - DNA, 20 bp, Homo sapiens
taggttgacctgttttgtat

SEQ ID NO: 1960 - DNA, 22 bp, Homo sapiens
tcatgaatccgagccttctgtg

SEQ ID NO: 1961 - DNA, 22 bp, Homo sapiens
gagactacagcactccaggaag

SEQ ID NO: 1962 - DNA, 22 bp, Homo sapiens
atcacatttaactggattgtgg

SEQ ID NO: 1963 - DNA, 21 bp, Homo sapiens
ttgggcatctaggtcacttga

SEQ ID NO: 1964 - DNA, 20 bp, Homo sapiens
gaactaatgctctgtgggcc

SEQ ID NO: 1965 - DNA, 22 bp, Homo sapiens
ctctacaatccatgcacccagt

SEQ ID NO: 1966 - DNA, 22 bp, Homo sapiens
tgtctcaaactcaaggaggttg

SEQ ID NO: 1967 - DNA, 23 bp, Homo sapiens
tagcttatcaggtgaatgcttgt

SEQ ID NO: 1968 - DNA, 21 bp, Homo sapiens
cgggatataggcttttcagtc

SEQ ID NO: 1969 - DNA, 23 bp, Homo sapiens
tttaataagtagggaaataaaaa

SEQ ID NO: 1970 - DNA, 22 bp, Homo sapiens
cagtgtttgtcaaattccccaa

SEQ ID NO: 1971 - DNA, 20 bp, Homo sapiens
cactggatacttagctgtga

SEQ ID NO: 1972 - DNA, 22 bp, Homo sapiens
tccctgaaatttcgacttgtga

SEQ ID NO: 1973 - DNA, 20 bp, Homo sapiens
atataaagtggtcatactac

SEQ ID NO: 1974 - DNA, 22 bp, Homo sapiens
atcctcattaggtcttatcgct

SEQ ID NO: 1975 - DNA, 22 bp, Homo sapiens
actgtacccagctgggaaatgc

SEQ ID NO: 1976 - DNA, 22 bp, Homo sapiens
tagaaaggtttaacagccacac

SEQ ID NO: 1977 - DNA, 20 bp, Homo sapiens
actcaatatggcaggaacta

SEQ ID NO: 1978 - DNA, 23 bp, Homo sapiens
agcagcatagtacagggctagtc

SEQ ID NO: 1979 - DNA, 20 bp, Homo sapiens
caaaatgaatgtaagaaagg

SEQ ID NO: 1980 - DNA, 21 bp, Homo sapiens
cagcacacgggtcaatcgcaa

SEQ ID NO: 1981 - DNA, 22 bp, Homo sapiens
agacacccactagtagccctca

SEQ ID NO: 1982 - DNA, 21 bp, Homo sapiens
ttggggtggaaggtaccagga

SEQ ID NO: 1983 - DNA, 22 bp, Homo sapiens
actccatttgttttggcagcaa

SEQ ID NO: 1984 - DNA, 24 bp, Homo sapiens
gtgagctgttctggtaccctctgg

SEQ ID NO: 1985 - DNA, 22 bp, Homo sapiens
tagcagcagtgaaaatacaaat

SEQ ID NO: 1986 - DNA, 20 bp, Homo sapiens
gtttaagcgatctagtctat

SEQ ID NO: 1987 - DNA, 21 bp, Homo sapiens
gccccggcagtgccaccaaat

SEQ ID NO: 1988 - DNA, 20 bp, Homo sapiens
aaagtggagaaatgtatggt

SEQ ID NO: 1989 - DNA, 20 bp, Homo sapiens
gcaaaccaccaagtcaggga

SEQ ID NO: 1990 - DNA, 23 bp, Homo sapiens
cctggaacataaactgcgctact

SEQ ID NO: 1991 - DNA, 20 bp, Homo sapiens
tctatctcctgcatcacccc

SEQ ID NO: 1992 - DNA, 20 bp, Homo sapiens
accggttttcaacaaggagt

SEQ ID NO: 1993 - DNA, 23 bp, Homo sapiens
agcagcaaacattgaatatccca

SEQ ID NO: 1994 - DNA, 20 bp, Homo sapiens
aactgctgagtacactctgg

SEQ ID NO: 1995 - DNA, 22 bp, Homo sapiens
tgagtcaaacagttgccaaatg

SEQ ID NO: 1996 - DNA, 22 bp, Homo sapiens
aggtaaatgacaagatgattct

SEQ ID NO: 1997 - DNA, 20 bp, Homo sapiens
gcccccggagccccggcctg

SEQ ID NO: 1998 - DNA, 20 bp, Homo sapiens
cttactaaagaagaagctga

SEQ ID NO: 1999 - DNA, 21 bp, Homo sapiens
gtcactcccgatttttttagt

SEQ ID NO: 2000 - DNA, 22 bp, Homo sapiens
atcacagtgggtccctcatggc

SEQ ID NO: 2001 - DNA, 20 bp, Homo sapiens
catctggggtatttgtaaaa

SEQ ID NO: 2002 - DNA, 20 bp, Homo sapiens
cttcaggacttcaatgaggg

SEQ ID NO: 2003 - DNA, 21 bp, Homo sapiens
acaatagtctgcactaaccac

SEQ ID NO: 2004 - DNA, 20 bp, Homo sapiens
gcagaggagctgtttttatt

SEQ ID NO: 2005 - DNA, 20 bp, Homo sapiens
gatgatgccaccactgtagc

SEQ ID NO: 2006 - DNA, 23 bp, Homo sapiens
agcagacccagcacttcctccat

SEQ ID NO: 2007 - DNA, 23 bp, Homo sapiens
tggctcagttcaagtccaacagc

SEQ ID NO: 2008 - DNA, 20 bp, Homo sapiens
actgtgccattgaaagcagt

SEQ ID NO: 2009 - DNA, 22 bp, Homo sapiens
tatatccccagtagtggggttg

SEQ ID NO: 2010 - DNA, 22 bp, Homo sapiens
ctggaacatttggtgatgaagt

SEQ ID NO: 2011 - DNA, 22 bp, Homo sapiens
ggcggggtgaaataccactatt

SEQ ID NO: 2012 - DNA, 23 bp, Homo sapiens
tgatcatgagtctgatggacagt

SEQ ID NO: 2013 - DNA, 23 bp, Homo sapiens
acttgatttttttaaaggctttc

SEQ ID NO: 2014 - DNA, 20 bp, Homo sapiens
taaggcaatggtaatgtact

SEQ ID NO: 2015 - DNA, 21 bp, Homo sapiens
tttgcatcagaggctatttgt

SEQ ID NO: 2016 - DNA, 22 bp, Homo sapiens
aggcaagatgtcaatcgcttag

SEQ ID NO: 2017 - DNA, 20 bp, Homo sapiens
tttataactgctccctatga

SEQ ID NO: 2018 - DNA, 22 bp, Homo sapiens
tgtcaacccactgggagttcct

SEQ ID NO: 2019 - DNA, 23 bp, Homo sapiens
tgacagaaagaaacttccgaaag

SEQ ID NO: 2020 - DNA, 21 bp, Homo sapiens
agggactctgggaatgtcact

SEQ ID NO: 2021 - DNA, 23 bp, Homo sapiens
aatcaacagtatggtatgtttgg

SEQ ID NO: 2022 - DNA, 23 bp, Homo sapiens
aatgatgtagctgtctttatgtt

SEQ ID NO: 2023 - DNA, 20 bp, Homo sapiens
ttgggtacacggcttcattt

SEQ ID NO: 2024 - DNA, 21 bp, Homo sapiens
tagggttcccaacatggtcac

SEQ ID NO: 2025 - DNA, 22 bp, Homo sapiens
cagcaccatccaggatcagaca

SEQ ID NO: 2026 - DNA, 21 bp, Homo sapiens
gtccagttttcccaaccctgt

SEQ ID NO: 2027 - DNA, 21 bp, Homo sapiens
catcattacttttgtgctata

SEQ ID NO: 2028 - DNA, 23 bp, Homo sapiens
agaagcattgtacagctagggtg

SEQ ID NO: 2029 - DNA, 24 bp, Homo sapiens
cacccagaaggaatgatgagggca

SEQ ID NO: 2030 - DNA, 21 bp, Homo sapiens
agcaccatttgaagagtcact

SEQ ID NO: 2031 - DNA, 22 bp, Homo sapiens
cttctaagaccctaacttgtga

SEQ ID NO: 2032 - DNA, 21 bp, Homo sapiens
tgccctccttgggaatctaca

SEQ ID NO: 2033 - DNA, 23 bp, Homo sapiens
gagactgccttgtgaaagcacag

SEQ ID NO: 2034 - DNA, 20 bp, Homo sapiens
tgcatcagaggctaagtggg

SEQ ID NO: 2035 - DNA, 23 bp, Homo sapiens
agcagcaaaagtgtcctgaggga

SEQ ID NO: 2036 - DNA, 22 bp, Homo sapiens
gtgctaggatcataagcatgag

SEQ ID NO: 2037 - DNA, 20 bp, Homo sapiens
atttgtgaggactgtggtgt

SEQ ID NO: 2038 - DNA, 22 bp, Homo sapiens
attagtacattgaaagccagca

SEQ ID NO: 2039 - DNA, 20 bp, Homo sapiens
cagatccagtgagtctgttt

SEQ ID NO: 2040 - DNA, 21 bp, Homo sapiens
tggagcagggtctaccaggaa

SEQ ID NO: 2041 - DNA, 21 bp, Homo sapiens
ggatggcactcaaataatgta

SEQ ID NO: 2042 - DNA, 22 bp, Homo sapiens
ttcttgcaggagctgatatcgg

SEQ ID NO: 2043 - DNA, 20 bp, Homo sapiens
atcacattgccaggctttat

SEQ ID NO: 2044 - DNA, 21 bp, Homo sapiens
gcaaaccaccaagctgtgcac

SEQ ID NO: 2045 - DNA, 23 bp, Homo sapiens
cattatgcagtcaccgcttggca

SEQ ID NO: 2046 - DNA, 23 bp, Homo sapiens
tacatggtaggtacatttgtcaa

SEQ ID NO: 2047 - DNA, 20 bp, Homo sapiens
aatgcgtgcatttaacagaa

SEQ ID NO: 2048 - DNA, 20 bp, Homo sapiens
atcgacgctgactgtgggct

SEQ ID NO: 2049 - DNA, 21 bp, Homo sapiens
ccatggcagtcattgcctggc

SEQ ID NO: 2050 - DNA, 23 bp, Homo sapiens
tgcatacccactgttataggcag

SEQ ID NO: 2051 - DNA, 23 bp, Homo sapiens
gagcttcgtgagtgtcgtggtcc

SEQ ID NO: 2052 - DNA, 20 bp, Homo sapiens
tgacccgcaggctgtcagcc

SEQ ID NO: 2053 - DNA, 23 bp, Homo sapiens
acagctcaacatgggcctggaca

SEQ ID NO: 2054 - DNA, 22 bp, Homo sapiens
tatgtctcactggattgaaatc

SEQ ID NO: 2055 - DNA, 24 bp, Homo sapiens
agctggtatcctacactctcagca

SEQ ID NO: 2056 - DNA, 21 bp, Homo sapiens
gctacagtagactagagcacc

SEQ ID NO: 2057 - DNA, 23 bp, Homo sapiens
aaataacatactgggggcttgac

SEQ ID NO: 2058 - DNA, 22 bp, Homo sapiens
atatcggaatgaatgaatgaat

SEQ ID NO: 2059 - DNA, 20 bp, Homo sapiens
tctgcaatgtctgctgccct

SEQ ID NO: 2060 - DNA, 21 bp, Homo sapiens
cagacgccaccacgctggcta

SEQ ID NO: 2061 - DNA, 20 bp, Homo sapiens
tccgagtcacggcaccacat

SEQ ID NO: 2062 - DNA, 22 bp, Homo sapiens
tggtgtcatctggtaacgcagc

SEQ ID NO: 2063 - DNA, 22 bp, Homo sapiens
gcctgtagctgtctccacccac

SEQ ID NO: 2064 - DNA, 24 bp, Homo sapiens
tgccactgatgggggaaactgagg

SEQ ID NO: 2065 - DNA, 23 bp, Homo sapiens
tagcttatcactgtgagacactg

SEQ ID NO: 2066 - DNA, 22 bp, Homo sapiens
atcagaagtaactggatttcca

SEQ ID NO: 2067 - DNA, 21 bp, Homo sapiens
gtttagtggggtatttgtgtg

SEQ ID NO: 2068 - DNA, 22 bp, Homo sapiens
gaaagtgctgcactgtactgca

SEQ ID NO: 2069 - DNA, 22 bp, Homo sapiens
tatgcaaatccatgcaaataat

SEQ ID NO: 2070 - DNA, 23 bp, Homo sapiens
tgagaggtgctggtccttaggga

SEQ ID NO: 2071 - DNA, 22 bp, Homo sapiens
atccatgcgatctagctggggc

SEQ ID NO: 2072 - DNA, 22 bp, Homo sapiens
agggtgagcatctatgaactag

SEQ ID NO: 2073 - DNA, 23 bp, Homo sapiens
gtggtgtgttcctgagggtccct

SEQ ID NO: 2074 - DNA, 21 bp, Homo sapiens
ggatcaatcagtttacaaaac

SEQ ID NO: 2075 - DNA, 22 bp, Homo sapiens
tagtgcaatgttaaccttccat

SEQ ID NO: 2076 - DNA, 20 bp, Homo sapiens
ccatatcagaggctattcag

SEQ ID NO: 2077 - DNA, 20 bp, Homo sapiens
agataatcacatgtgtgagg

SEQ ID NO: 2078 - DNA, 22 bp, Homo sapiens
gaactgtgagtctgatggagtg

SEQ ID NO: 2079 - DNA, 22 bp, Homo sapiens
caccaatgttcatttaatgatg

SEQ ID NO: 2080 - DNA, 23 bp, Homo sapiens
tgtcagttcactgggccttgggt

SEQ ID NO: 2081 - DNA, 20 bp, Homo sapiens
ggataccaagccactcacga

SEQ ID NO: 2082 - DNA, 20 bp, Homo sapiens
ctgctatgtccttcatgtac

SEQ ID NO: 2083 - DNA, 22 bp, Homo sapiens
atgcaatgtctgagtaatggca

SEQ ID NO: 2084 - DNA, 20 bp, Homo sapiens
tcccgggttctaatgtgtca

SEQ ID NO: 2085 - DNA, 22 bp, Homo sapiens
tctctgagatttcggtcctcag

SEQ ID NO: 2086 - DNA, 21 bp, Homo sapiens
gctactgggatttgaaggctt

SEQ ID NO: 2087 - DNA, 23 bp, Homo sapiens
tgtaaacatccttgacaagacag

SEQ ID NO: 2088 - DNA, 22 bp, Homo sapiens
cgaacacagaggctattgttcc

SEQ ID NO: 2089 - DNA, 23 bp, Homo sapiens
ttccatgggctccaggaatccct

SEQ ID NO: 2090 - DNA, 21 bp, Homo sapiens
gctgtttggcctgaggtaaaa

SEQ ID NO: 2091 - DNA, 22 bp, Homo sapiens
gctagaattagtttatggggtt

SEQ ID NO: 2092 - DNA, 20 bp, Homo sapiens
cagcaggtctccagaagtgg

SEQ ID NO: 2093 - DNA, 21 bp, Homo sapiens
ggagagctggccgagatgcgg

SEQ ID NO: 2094 - DNA, 22 bp, Homo sapiens
ggcccccggcgcgccgggcgtc

SEQ ID NO: 2095 - DNA, 21 bp, Homo sapiens
cccagccctgctttttgtggc

SEQ ID NO: 2096 - DNA, 22 bp, Homo sapiens
cctaagatatccagctgcactc

SEQ ID NO: 2097 - DNA, 22 bp, Homo sapiens
atttgtaaattagggatttcct

SEQ ID NO: 2098 - DNA, 22 bp, Homo sapiens
tagcttatcaagttgatgtagc

SEQ ID NO: 2099 - DNA, 20 bp, Homo sapiens
attttacttacattcttgaa

SEQ ID NO: 2100 - DNA, 20 bp, Homo sapiens
ttttaatctaaaggaccaaa

SEQ ID NO: 2101 - DNA, 20 bp, Homo sapiens
atgacctatgaattgaggtg

SEQ ID NO: 2102 - DNA, 20 bp, Homo sapiens
ttggggacactaagagccca

SEQ ID NO: 2103 - DNA, 22 bp, Homo sapiens
tagcttatactcgcagaagcag

SEQ ID NO: 2104 - DNA, 24 bp, Homo sapiens
ttgtattcaacttcaggcttagtc

SEQ ID NO: 2105 - DNA, 23 bp, Homo sapiens
tagcttactgtgctgatgaagaa

SEQ ID NO: 2106 - DNA, 21 bp, Homo sapiens
cccagtgaagtctgatttcac

SEQ ID NO: 2107 - DNA, 23 bp, Homo sapiens
agcagcaggaaacagggctatct

SEQ ID NO: 2108 - DNA, 20 bp, Homo sapiens
tcgagataaggattggcatc

SEQ ID NO: 2109 - DNA, 22 bp, Homo sapiens
tgagttgggtctggtctgtttg

SEQ ID NO: 2110 - DNA, 21 bp, Homo sapiens
ttccgttatgagtaataatgc

SEQ ID NO: 2111 - DNA, 22 bp, Homo sapiens
agctatgaagctgctcaggttg

SEQ ID NO: 2112 - DNA, 21 bp, Homo sapiens
ccttgaacgcaggaggtagag

SEQ ID NO: 2113 - DNA, 22 bp, Homo sapiens
tgtcaacccagacctacaccca

SEQ ID NO: 2114 - DNA, 23 bp, Homo sapiens
tgggatttttcagtgaaggtgac

SEQ ID NO: 2115 - DNA, 21 bp, Homo sapiens
actggacttggagtcagttat

SEQ ID NO: 2116 - DNA, 22 bp, Homo sapiens
tgatgatgtctattagggaaaa

SEQ ID NO: 2117 - DNA, 20 bp, Homo sapiens
agagatgctggttcgaggta

SEQ ID NO: 2118 - DNA, 24 bp, Homo sapiens
catcctcatggctcttgcttgtgt

SEQ ID NO: 2119 - DNA, 22 bp, Homo sapiens
ttcatcattaacagttatcagg

SEQ ID NO: 2120 - DNA, 22 bp, Homo sapiens
atagttgggcagaaagcaaaac

SEQ ID NO: 2121 - DNA, 23 bp, Homo sapiens
gcttggttcctttgaaggcttct

SEQ ID NO: 2122 - DNA, 23 bp, Homo sapiens
agctatcctcccactttagcgtc

SEQ ID NO: 2123 - DNA, 22 bp, Homo sapiens
ccatgtcactcatgtaatgtag

SEQ ID NO: 2124 - DNA, 22 bp, Homo sapiens
agtgtgcactacagacaggggt

SEQ ID NO: 2125 - DNA, 22 bp, Homo sapiens
acctgctgagtacagctgaaat

SEQ ID NO: 2126 - DNA, 22 bp, Homo sapiens
gtagtcaggtagtttatgggca

SEQ ID NO: 2127 - DNA, 20 bp, Homo sapiens
caaaacttatatgacttatt

SEQ ID NO: 2128 - DNA, 22 bp, Homo sapiens
aaacacttcgcagggatgtcgt

SEQ ID NO: 2129 - DNA, 23 bp, Homo sapiens
ctatgctgtaatatggtgatgtc

SEQ ID NO: 2130 - DNA, 22 bp, Homo sapiens
tagcagccccataatattgtat

SEQ ID NO: 2131 - DNA, 22 bp, Homo sapiens
tctttcttcctttttcttgttg

SEQ ID NO: 2132 - DNA, 21 bp, Homo sapiens
tagcagcacggccatgccact

SEQ ID NO: 2133 - DNA, 22 bp, Homo sapiens
tgtcatgtccatggtaacccca

SEQ ID NO: 2134 - DNA, 20 bp, Homo sapiens
ctgacctatgaattaaaaag

SEQ ID NO: 2135 - DNA, 23 bp, Homo sapiens
tggctcagcctgagtccttattg

SEQ ID NO: 2136 - DNA, 22 bp, Homo sapiens
gtccagttgtcttttaccccca

SEQ ID NO: 2137 - DNA, 20 bp, Homo sapiens
tgggacgagatcataccatt

SEQ ID NO: 2138 - DNA, 20 bp, Homo sapiens
gaacagggctcttgagttag

SEQ ID NO: 2139 - DNA, 23 bp, Homo sapiens
gagcttatcatactgtacttggt

SEQ ID NO: 2140 - DNA, 21 bp, Homo sapiens
acaggtgtcatcggtaaaagt

SEQ ID NO: 2141 - DNA, 22 bp, Homo sapiens
tagcagcacatcaacatggcac

SEQ ID NO: 2142 - DNA, 23 bp, Homo sapiens
acagtcaagtggaaataccttgg

SEQ ID NO: 2143 - DNA, 21 bp, Homo sapiens
tttggactaggattttaagag

SEQ ID NO: 2144 - DNA, 23 bp, Homo sapiens
gaagatgatgtggcttcaaatcc

SEQ ID NO: 2145 - DNA, 23 bp, Homo sapiens
aagacgttgataggttggacagt

SEQ ID NO: 2146 - DNA, 21 bp, Homo sapiens
ttcttgctgctgccacgtgac

SEQ ID NO: 2147 - DNA, 21 bp, Homo sapiens
tgtggtagtaggttgtgagaa

SEQ ID NO: 2148 - DNA, 22 bp, Homo sapiens
ttctgagggcttgaatatttaa

SEQ ID NO: 2149 - DNA, 20 bp, Homo sapiens
tctcgctggggcctccaaaa

SEQ ID NO: 2150 - DNA, 23 bp, Homo sapiens
tgagagtcaagtccagggtgtca

SEQ ID NO: 2151 - DNA, 20 bp, Homo sapiens
ttcacagtggctaagatttg

SEQ ID NO: 2152 - DNA, 23 bp, Homo sapiens
aacaaagtctgcgttccctgaat

SEQ ID NO: 2153 - DNA, 23 bp, Homo sapiens
aacaaatgtgggctaagtacagt

SEQ ID NO: 2154 - DNA, 22 bp, Homo sapiens
taacacacaaagacatcaggtg

SEQ ID NO: 2155 - DNA, 21 bp, Homo sapiens
ccttaactgccttcccgtggg

SEQ ID NO: 2156 - DNA, 22 bp, Homo sapiens
ataccgtggagcttagcaggtg

SEQ ID NO: 2157 - DNA, 22 bp, Homo sapiens
gctactacatgctgcatgagga

SEQ ID NO: 2158 - DNA, 22 bp, Homo sapiens
tgagtcattagacttatacaca

SEQ ID NO: 2159 - DNA, 21 bp, Homo sapiens
tagcaccatctctttagtgct

SEQ ID NO: 2160 - DNA, 22 bp, Homo sapiens
tccctggctggagctgatgtga

SEQ ID NO: 2161 - DNA, 22 bp, Homo sapiens
gctacacatggtcatagccaat

SEQ ID NO: 2162 - DNA, 23 bp, Homo sapiens
tgtcagtttcactttatgggtct

SEQ ID NO: 2163 - DNA, 21 bp, Homo sapiens
tattgttctgagctgagtgag

SEQ ID NO: 2164 - DNA, 23 bp, Homo sapiens
gctagatttgagtgaattagggt

SEQ ID NO: 2165 - DNA, 22 bp, Homo sapiens
ctgacctattcattgacgcatt

SEQ ID NO: 2166 - DNA, 21 bp, Homo sapiens
cctatctgaggggggcagctg

SEQ ID NO: 2167 - DNA, 23 bp, Homo sapiens
atacttattgagtgaatgaacag

SEQ ID NO: 2168 - DNA, 22 bp, Homo sapiens
tgacataatgttatttccatgc

SEQ ID NO: 2169 - DNA, 23 bp, Homo sapiens
ctatatacagcatatgtgtacag

SEQ ID NO: 2170 - DNA, 21 bp, Homo sapiens
agaaggtcggctgtgatgaac

SEQ ID NO: 2171 - DNA, 22 bp, Homo sapiens
gtaaagtgcacagccatgccta

SEQ ID NO: 2172 - DNA, 23 bp, Homo sapiens
aggatgtaatgctgctggtgact

SEQ ID NO: 2173 - DNA, 22 bp, Homo sapiens
gagcccacaccttgtaccagtg

SEQ ID NO: 2174 - DNA, 21 bp, Homo sapiens
gtgagagattttaacataata

SEQ ID NO: 2175 - DNA, 20 bp, Homo sapiens
ccatctgagagcattctttg

SEQ ID NO: 2176 - DNA, 23 bp, Homo sapiens
aaaaatgcttaggctgggcacag

SEQ ID NO: 2177 - DNA, 20 bp, Homo sapiens
gaaactaactggggcagcca

SEQ ID NO: 2178 - DNA, 22 bp, Homo sapiens
tagcacgtcgacttgctacttt

SEQ ID NO: 2179 - DNA, 22 bp, Homo sapiens
agctactaatgagttcattgag

SEQ ID NO: 2180 - DNA, 22 bp, Homo sapiens
ggtacctaacagttgcgttttg

SEQ ID NO: 2181 - DNA, 22 bp, Homo sapiens
cgatgttgcccaggtaggcaat

SEQ ID NO: 2182 - DNA, 22 bp, Homo sapiens
cgatgtacattagggatccttg

SEQ ID NO: 2183 - DNA, 20 bp, Homo sapiens
tctgaatagcttgactaatg

SEQ ID NO: 2184 - DNA, 22 bp, Homo sapiens
ccagtacccagaggtataacca

SEQ ID NO: 2185 - DNA, 22 bp, Homo sapiens
caacccttagggtaaaacagtc

SEQ ID NO: 2186 - DNA, 23 bp, Homo sapiens
ctgaatctctaggggaaaatacc

SEQ ID NO: 2187 - DNA, 22 bp, Homo sapiens
ccgactttgggaacatgcagtg

SEQ ID NO: 2188 - DNA, 22 bp, Homo sapiens
cgacaactctcaagcaataact

SEQ ID NO: 2189 - DNA, 22 bp, Homo sapiens
tatcttttataagagaaattga

SEQ ID NO: 2190 - DNA, 24 bp, Homo sapiens
aaagtgctcggcttctaatggtga

SEQ ID NO: 2191 - DNA, 23 bp, Homo sapiens
cctacagctagcacaaaaggcag

SEQ ID NO: 2192 - DNA, 20 bp, Homo sapiens
gctactacatgcccatagtg

SEQ ID NO: 2193 - DNA, 22 bp, Homo sapiens
ctgaaagggaagtttatggggt

SEQ ID NO: 2194 - DNA, 23 bp, Homo sapiens
gtctgcaaatcccaggaattttc

SEQ ID NO: 2195 - DNA, 20 bp, Homo sapiens
ttgagcaggatgttacgaag

SEQ ID NO: 2196 - DNA, 22 bp, Homo sapiens
cattattacttttggtattaag

SEQ ID NO: 2197 - DNA, 22 bp, Homo sapiens
tgtcagccacagaaatattttg

SEQ ID NO: 2198 - DNA, 22 bp, Homo sapiens
ctgtggatagaattgatagcac

SEQ ID NO: 2199 - DNA, 20 bp, Homo sapiens
tagctttgttggactgccac

SEQ ID NO: 2200 - DNA, 20 bp, Homo sapiens
cctaaatatgaaccacagtg

SEQ ID NO: 2201 - DNA, 21 bp, Homo sapiens
cctgctgagtacataaccagt

SEQ ID NO: 2202 - DNA, 22 bp, Homo sapiens
tagttgatctctgactgtaact

SEQ ID NO: 2203 - DNA, 23 bp, Homo sapiens
tgacctatgggccagtttcactg

SEQ ID NO: 2204 - DNA, 21 bp, Homo sapiens
aagagttcatatctaatctaa

SEQ ID NO: 2205 - DNA, 20 bp, Homo sapiens
gagtaactataatcctaaaa

SEQ ID NO: 2206 - DNA, 22 bp, Homo sapiens
tgagatgggatgtcacccagga

SEQ ID NO: 2207 - DNA, 23 bp, Homo sapiens
caggacatccacagtgcaggcag

SEQ ID NO: 2208 - DNA, 20 bp, Homo sapiens
agcgccggcgtctcctccag

SEQ ID NO: 2209 - DNA, 20 bp, Homo sapiens
aggctggcggcaggcctacc

SEQ ID NO: 2210 - DNA, 21 bp, Homo sapiens
cgccttgattacacagcatga

SEQ ID NO: 2211 - DNA, 22 bp, Homo sapiens
taggcacgtgatgccgcatgcg

SEQ ID NO: 2212 - DNA, 20 bp, Homo sapiens
ggcgtagatgctggcatagt

SEQ ID NO: 2213 - DNA, 22 bp, Homo sapiens
aatgtcattaggtccgctttag

SEQ ID NO: 2214 - DNA, 23 bp, Homo sapiens
cagcttcccacaccataccccac

SEQ ID NO: 2215 - DNA, 21 bp, Homo sapiens
taggaaacggttgaggctaaa

SEQ ID NO: 2216 - DNA, 20 bp, Homo sapiens
atttcatctatcatattggc

SEQ ID NO: 2217 - DNA, 22 bp, Homo sapiens
cccaaaggtcataggttatcca

SEQ ID NO: 2218 - DNA, 22 bp, Homo sapiens
atcaattaataagccgggcgcg

SEQ ID NO: 2219 - DNA, 23 bp, Homo sapiens
agcagaaaaagccaggaagaaag

SEQ ID NO: 2220 - DNA, 21 bp, Homo sapiens
gcttgacaaatttgacttggg

SEQ ID NO: 2221 - DNA, 22 bp, Homo sapiens
cttgccttagggtttaacagcc

SEQ ID NO: 2222 - DNA, 20 bp, Homo sapiens
tccaggtgccccctccagtg

SEQ ID NO: 2223 - DNA, 20 bp, Homo sapiens
atattccccgacgggagaga

SEQ ID NO: 2224 - DNA, 23 bp, Homo sapiens
ttattatgaggcacaacagcaga

SEQ ID NO: 2225 - DNA, 22 bp, Homo sapiens
ttcgtggggtgcaaatacccca

SEQ ID NO: 2226 - DNA, 22 bp, Homo sapiens
cggtggtgtctgcagccgtgca

SEQ ID NO: 2227 - DNA, 24 bp, Homo sapiens
tctgtgaaagtaaaatttaaacgc

SEQ ID NO: 2228 - DNA, 20 bp, Homo sapiens
agcagtgtggttcagtggta

SEQ ID NO: 2229 - DNA, 23 bp, Homo sapiens
ggtgtaggaggagagttgtgtga

SEQ ID NO: 2230 - DNA, 21 bp, Homo sapiens
tgaggtagtaggttgggctgg

SEQ ID NO: 2231 - DNA, 22 bp, Homo sapiens
tagcaccatttctttatggaat

SEQ ID NO: 2232 - DNA, 20 bp, Homo sapiens
gtttatgtagcttacccaat

SEQ ID NO: 2233 - DNA, 20 bp, Homo sapiens
tctagccgtagaggtggtat

SEQ ID NO: 2234 - DNA, 22 bp, Homo sapiens
gaagcttctttattataaacta

SEQ ID NO: 2235 - DNA, 20 bp, Homo sapiens
ctgataccattccgaaaaac

SEQ ID NO: 2236 - DNA, 20 bp, Homo sapiens
ctctttggggaacatgtgtg

SEQ ID NO: 2237 - DNA, 22 bp, Homo sapiens
tgtaaacatccttgactgagtc

SEQ ID NO: 2238 - DNA, 20 bp, Homo sapiens
gagtccagttatctgagttg

SEQ ID NO: 2239 - DNA, 20 bp, Homo sapiens
acatcaccccataaacagcg

SEQ ID NO: 2240 - DNA, 22 bp, Homo sapiens
ttccgttgctgagtcacttgct

SEQ ID NO: 2241 - DNA, 23 bp, Homo sapiens
gtgtggggcttgcatgggtgaca

SEQ ID NO: 2242 - DNA, 23 bp, Homo sapiens
gcctgagcctcccaggaatccct

SEQ ID NO: 2243 - DNA, 22 bp, Homo sapiens
tccctgctcaaagcctccaggc

SEQ ID NO: 2244 - DNA, 22 bp, Homo sapiens
gaataattcagtccatggccta

SEQ ID NO: 2245 - DNA, 21 bp, Homo sapiens
gatgatgccacgtagagatga

SEQ ID NO: 2246 - DNA, 22 bp, Homo sapiens
tgagtcaggcagccatgcccca

SEQ ID NO: 2247 - DNA, 20 bp, Homo sapiens
atcatcttacgccacctagt

SEQ ID NO: 2248 - DNA, 22 bp, Homo sapiens
caaaaccacaattactcttcca

SEQ ID NO: 2249 - DNA, 21 bp, Homo sapiens
acgacgactcatgtgccctga

SEQ ID NO: 2250 - DNA, 22 bp, Homo sapiens
tcctgggggccgtagatgtggt

SEQ ID NO: 2251 - DNA, 22 bp, Homo sapiens
gcagtagacacggggagggctg

SEQ ID NO: 2252 - DNA, 22 bp, Homo sapiens
tccctgagatttcgtggtcaag

SEQ ID NO: 2253 - DNA, 20 bp, Homo sapiens
atccgggtatttttcttgaa

SEQ ID NO: 2254 - DNA, 21 bp, Homo sapiens
ggcgctggagcgtcgggcacc

SEQ ID NO: 2255 - DNA, 20 bp, Homo sapiens
tatactacatgccatatttt

SEQ ID NO: 2256 - DNA, 22 bp, Homo sapiens
agcccaggatgaaactctgaca

SEQ ID NO: 2257 - DNA, 22 bp, Homo sapiens
gtcacaaacgacccatgggggt

SEQ ID NO: 2258 - DNA, 22 bp, Homo sapiens
ggccttgcggccacagcagcaa

SEQ ID NO: 2259 - DNA, 22 bp, Homo sapiens
attctttgtttttgtctttgtt

SEQ ID NO: 2260 - DNA, 22 bp, Homo sapiens
tcagtgcatgacagaactccac

SEQ ID NO: 2261 - DNA, 23 bp, Homo sapiens
gataggctcagcgactacaactc

SEQ ID NO: 2262 - DNA, 22 bp, Homo sapiens
gtcagtttgctgggcgtttcat

SEQ ID NO: 2263 - DNA, 24 bp, Homo sapiens
gcgcaggtgttgaagtttagggac

SEQ ID NO: 2264 - DNA, 22 bp, Homo sapiens
cccaccaggagcctggcactgt

SEQ ID NO: 2265 - DNA, 24 bp, Homo sapiens
cttctaagcttcaggtagttgttc

SEQ ID NO: 2266 - DNA, 20 bp, Homo sapiens
gctgaggagccagcggggcg

SEQ ID NO: 2267 - DNA, 22 bp, Homo sapiens
ccttcagagccctatgaacact

SEQ ID NO: 2268 - DNA, 23 bp, Homo sapiens
caaggagagaatctctcccttgt

SEQ ID NO: 2269 - DNA, 20 bp, Homo sapiens
gtaaaacgggactgatgatc

SEQ ID NO: 2270 - DNA, 21 bp, Homo sapiens
tgtgctgttttgcgggttggt

SEQ ID NO: 2271 - DNA, 21 bp, Homo sapiens
tcttgacccctttgatggctg

SEQ ID NO: 2272 - DNA, 22 bp, Homo sapiens
tccactgggctgtgtttccttg

SEQ ID NO: 2273 - DNA, 22 bp, Homo sapiens
aggccccgccccacctgccaca

SEQ ID NO: 2274 - DNA, 22 bp, Homo sapiens
tccctgactggctagtccacaa

SEQ ID NO: 2275 - DNA, 22 bp, Homo sapiens
ccatcagatcgactctccactt

SEQ ID NO: 2276 - DNA, 22 bp, Homo sapiens
tctcagtaatccagctatcaga

SEQ ID NO: 2277 - DNA, 21 bp, Homo sapiens
atgtcccagggggtgaggagg

SEQ ID NO: 2278 - DNA, 20 bp, Homo sapiens
cgccccacggcagtgatgaa

SEQ ID NO: 2279 - DNA, 21 bp, Homo sapiens
ctcccgcctttttctggggac

SEQ ID NO: 2280 - DNA, 21 bp, Homo sapiens
atcctgccattgaaagagctt

SEQ ID NO: 2281 - DNA, 22 bp, Homo sapiens
tcctcagggcaaccccagcgtt

SEQ ID NO: 2282 - DNA, 24 bp, Homo sapiens
ttccagtgatgcttccctgaggat

SEQ ID NO: 2283 - DNA, 21 bp, Homo sapiens
gtcacattgccagggacagtt

SEQ ID NO: 2284 - DNA, 20 bp, Homo sapiens
cttaatttttacggatgccc

SEQ ID NO: 2285 - DNA, 21 bp, Homo sapiens
ttgggttttaagcaggaggca

SEQ ID NO: 2286 - DNA, 23 bp, Homo sapiens
acttcccccacctcactgcccgg

SEQ ID NO: 2287 - DNA, 24 bp, Homo sapiens
cgctgggggcggggagcgcaggcc

SEQ ID NO: 2288 - DNA, 23 bp, Homo sapiens
tgagtctttgataaataccccaa

SEQ ID NO: 2289 - DNA, 20 bp, Homo sapiens
tgtttctgtggggggtgtct

SEQ ID NO: 2290 - DNA, 22 bp, Homo sapiens
aatggtagcaacaatgagagtt

SEQ ID NO: 2291 - DNA, 21 bp, Homo sapiens
atgtacctcctttaagctgct

SEQ ID NO: 2292 - DNA, 22 bp, Homo sapiens
tagcttgctgctatctagggtc

SEQ ID NO: 2293 - DNA, 20 bp, Homo sapiens
cccaccccgcgcgcgccgca

SEQ ID NO: 2294 - DNA, 22 bp, Homo sapiens
gcaatgtagtgcctttccacta

SEQ ID NO: 2295 - DNA, 22 bp, Homo sapiens
tagctcatcagactgagcttat

SEQ ID NO: 2296 - DNA, 22 bp, Homo sapiens
ccttccaaagggtataccatgg

SEQ ID NO: 2297 - DNA, 22 bp, Homo sapiens
actccacagcaggtgtgcaatc

SEQ ID NO: 2298 - DNA, 21 bp, Homo sapiens
aaatggagaaatgtctctggt

SEQ ID NO: 2299 - DNA, 20 bp, Homo sapiens
ccagcatctgtatccagaca

SEQ ID NO: 2300 - DNA, 21 bp, Homo sapiens
caggctggggaccaggaatcc

SEQ ID NO: 2301 - DNA, 22 bp, Homo sapiens
ttcctgagaccagccagacact

SEQ ID NO: 2302 - DNA, 22 bp, Homo sapiens
ctttactctgggatcaggctga

SEQ ID NO: 2303 - DNA, 21 bp, Homo sapiens
ggttgtgggttgctctatagc

SEQ ID NO: 2304 - DNA, 21 bp, Homo sapiens
tgacgaagtgatctgtacaac

SEQ ID NO: 2305 - DNA, 21 bp, Homo sapiens
gtagtgtagaagcagctatgg

SEQ ID NO: 2306 - DNA, 22 bp, Homo sapiens
taaacatctgggatcaggtgta

SEQ ID NO: 2307 - DNA, 22 bp, Homo sapiens
catgtattgattcacttaatct

SEQ ID NO: 2308 - DNA, 22 bp, Homo sapiens
tgggtcaaatccaaatactttt

SEQ ID NO: 2309 - DNA, 21 bp, Homo sapiens
cttttaatgagggtacgtata

SEQ ID NO: 2310 - DNA, 21 bp, Homo sapiens
accacagggatcttggtcctg

SEQ ID NO: 2311 - DNA, 20 bp, Homo sapiens
gagctggtggttcagtggtt

SEQ ID NO: 2312 - DNA, 23 bp, Homo sapiens
ctttttgtcatcgccccacaaac

SEQ ID NO: 2313 - DNA, 22 bp, Homo sapiens
ccgtggtgatcagtggaggtct

SEQ ID NO: 2314 - DNA, 21 bp, Homo sapiens
ggagttgggtttcaaagtcag

SEQ ID NO: 2315 - DNA, 20 bp, Homo sapiens
gacttggtggttcagtgggc

SEQ ID NO: 2316 - DNA, 23 bp, Homo sapiens
caaagtgctgcactgccagcagc

SEQ ID NO: 2317 - DNA, 20 bp, Homo sapiens
aggcaagatgctgtacatgt

SEQ ID NO: 2318 - DNA, 22 bp, Homo sapiens
gtgatgctgctgaacatgtcaa

SEQ ID NO: 2319 - DNA, 20 bp, Homo sapiens
tcatttttattgcacaagtg

SEQ ID NO: 2320 - DNA, 22 bp, Homo sapiens
cagaacagatacccacgtgata

SEQ ID NO: 2321 - DNA, 23 bp, Homo sapiens
tggttcagggactgtcctacatg

SEQ ID NO: 2322 - DNA, 20 bp, Homo sapiens
ccaggaaatgttatcgccaa

SEQ ID NO: 2323 - DNA, 21 bp, Homo sapiens
actggacttggagtctctcta

SEQ ID NO: 2324 - DNA, 20 bp, Homo sapiens
tagcaccacttgaaatcctg

SEQ ID NO: 2325 - DNA, 21 bp, Homo sapiens
gttcaattccagtctctaatg

SEQ ID NO: 2326 - DNA, 21 bp, Homo sapiens
agtaagtgggtctatgatggg

SEQ ID NO: 2327 - DNA, 20 bp, Homo sapiens
cccaattctgctccctatag

SEQ ID NO: 2328 - DNA, 21 bp, Homo sapiens
atgggtttggctgtgtccacc

SEQ ID NO: 2329 - DNA, 21 bp, Homo sapiens
tctcccacaaagtgtacactg

SEQ ID NO: 2330 - DNA, 21 bp, Homo sapiens
ttcacagtggctagtttctat

SEQ ID NO: 2331 - DNA, 22 bp, Homo sapiens
agcataggctttgtccttgctc

SEQ ID NO: 2332 - DNA, 21 bp, Homo sapiens
taaacctattgctcctccata

SEQ ID NO: 2333 - DNA, 22 bp, Homo sapiens
cacatgtgcatgtacaccacac

SEQ ID NO: 2334 - DNA, 21 bp, Homo sapiens
ttcagagtggctaagttccct

SEQ ID NO: 2335 - DNA, 23 bp, Homo sapiens
tcgatcatacagtttattcaata

SEQ ID NO: 2336 - DNA, 21 bp, Homo sapiens
accctgtaagcttaggcacag

SEQ ID NO: 2337 - DNA, 22 bp, Homo sapiens
atacagtaattcaggataggtt

SEQ ID NO: 2338 - DNA, 21 bp, Homo sapiens
ggtacagatcaaaccactggc

SEQ ID NO: 2339 - DNA, 20 bp, Homo sapiens
agggctgtctgagctgagtg

SEQ ID NO: 2340 - DNA, 23 bp, Homo sapiens
tgcatggatccacatggtggaac

SEQ ID NO: 2341 - DNA, 20 bp, Homo sapiens
gcaccttgcaaatgtgcgtg

SEQ ID NO: 2342 - DNA, 22 bp, Homo sapiens
gtccagtttttttgaaggtatt

SEQ ID NO: 2343 - DNA, 21 bp, Homo sapiens
tgaggtaggaggttgatgctg

SEQ ID NO: 2344 - DNA, 22 bp, Homo sapiens
ctactacctgtcaaatactttg

SEQ ID NO: 2345 - DNA, 21 bp, Homo sapiens
tgaagccgtctggtatggcgt

SEQ ID NO: 2346 - DNA, 22 bp, Homo sapiens
tgtgagtaatccaggcgcgtac

SEQ ID NO: 2347 - DNA, 20 bp, Homo sapiens
atgttcatgtgtgaggccag

SEQ ID NO: 2348 - DNA, 22 bp, Homo sapiens
tagcctggtgttgtggtgcttg

SEQ ID NO: 2349 - DNA, 21 bp, Homo sapiens
tcgaagcccccatggggctgg

SEQ ID NO: 2350 - DNA, 21 bp, Homo sapiens
ctggaactaatgcactagact

SEQ ID NO: 2351 - DNA, 21 bp, Homo sapiens
atcacattgccagcctgcaaa

SEQ ID NO: 2352 - DNA, 20 bp, Homo sapiens
agcagcaagtagacctacag

SEQ ID NO: 2353 - DNA, 21 bp, Homo sapiens
cgcctttaaagtggctgcctt

SEQ ID NO: 2354 - DNA, 22 bp, Homo sapiens
gacctgggatcactggtgtgct

SEQ ID NO: 2355 - DNA, 22 bp, Homo sapiens
ccccaacagtagcctaaactga

SEQ ID NO: 2356 - DNA, 20 bp, Homo sapiens
aggaaaggctgctgttatcc

SEQ ID NO: 2357 - DNA, 21 bp, Homo sapiens
agcataatgaaacaggcatag

SEQ ID NO: 2358 - DNA, 20 bp, Homo sapiens
atcacattgccagggttgtt

SEQ ID NO: 2359 - DNA, 21 bp, Homo sapiens
gagtttgactgtttatttcac

SEQ ID NO: 2360 - DNA, 22 bp, Homo sapiens
tgtctcaaactcatgatttggt

SEQ ID NO: 2361 - DNA, 20 bp, Homo sapiens
gagttccttgaatagggtga

SEQ ID NO: 2362 - DNA, 23 bp, Homo sapiens
tcagtcattgtcaggtgcttggg

SEQ ID NO: 2363 - DNA, 22 bp, Homo sapiens
ccaaatgcttaggttgtccatc

SEQ ID NO: 2364 - DNA, 20 bp, Homo sapiens
gattctcattcaggatcggt

SEQ ID NO: 2365 - DNA, 22 bp, Homo sapiens
taatctgcccttgactatctag

SEQ ID NO: 2366 - DNA, 22 bp, Homo sapiens
tagctctgtgctgcttgaatgt

SEQ ID NO: 2367 - DNA, 22 bp, Homo sapiens
attgtgctaggtcctcgggatg

SEQ ID NO: 2368 - DNA, 21 bp, Homo sapiens
cattattacttttgcattagt

SEQ ID NO: 2369 - DNA, 22 bp, Homo sapiens
ggacagtggcttgatctaggct

SEQ ID NO: 2370 - DNA, 23 bp, Homo sapiens
ggatttcctttacaagttacttg

SEQ ID NO: 2371 - DNA, 20 bp, Homo sapiens
acacagagggctgacagttg

SEQ ID NO: 2372 - DNA, 22 bp, Homo sapiens
cagaaaacatgagatgatatat

SEQ ID NO: 2373 - DNA, 22 bp, Homo sapiens
gtgtacctatcatgcaaacagt

SEQ ID NO: 2374 - DNA, 23 bp, Homo sapiens
ctctttggccctgtgcaatcact

SEQ ID NO: 2375 - DNA, 20 bp, Homo sapiens
ccgcgcctcgcctcggccgc

SEQ ID NO: 2376 - DNA, 20 bp, Homo sapiens
ggttttgcctgtggctcatc

SEQ ID NO: 2377 - DNA, 20 bp, Homo sapiens
tgcactggagtctagtttgt

SEQ ID NO: 2378 - DNA, 21 bp, Homo sapiens
cctctgggcctccttcttggc

SEQ ID NO: 2379 - DNA, 20 bp, Homo sapiens
ggggcgtcgcggccgccccc

SEQ ID NO: 2380 - DNA, 22 bp, Homo sapiens
gtcagttcaagtttatgggttg

SEQ ID NO: 2381 - DNA, 20 bp, Homo sapiens
gagcacgtgttagctgggga

SEQ ID NO: 2382 - DNA, 23 bp, Homo sapiens
ttatctatcactgactacccagt

SEQ ID NO: 2383 - DNA, 20 bp, Homo sapiens
gctactgcttctgttcctca

SEQ ID NO: 2384 - DNA, 21 bp, Homo sapiens
tgaggaacagaagcagtagcc

SEQ ID NO: 2385 - DNA, 22 bp, Homo sapiens
tagcagcactgccaggccagcc

SEQ ID NO: 2386 - DNA, 23 bp, Homo sapiens
agaactgctaactcatgcccccc

SEQ ID NO: 2387 - DNA, 22 bp, Homo sapiens
caacatggcaacgattcagagg

SEQ ID NO: 2388 - DNA, 23 bp, Homo sapiens
gcttagccctcttgaagggaaag

SEQ ID NO: 2389 - DNA, 22 bp, Homo sapiens
tgatagtaatctgaatatttgt

SEQ ID NO: 2390 - DNA, 20 bp, Homo sapiens
gcatttgtggttcagtagtt

SEQ ID NO: 2391 - DNA, 21 bp, Homo sapiens
acggacgtgcgtgacatgaac

SEQ ID NO: 2392 - DNA, 22 bp, Homo sapiens
gctcagccacactttatggaaa

SEQ ID NO: 2393 - DNA, 22 bp, Homo sapiens
ttcaagtaaggattctatctgg

SEQ ID NO: 2394 - DNA, 22 bp, Homo sapiens
atctcaaacagtggatggggtg

SEQ ID NO: 2395 - DNA, 20 bp, Homo sapiens
gtagacttcaactgtaagat

SEQ ID NO: 2396 - DNA, 21 bp, Homo sapiens
ttttgcttctagattggtgtc

SEQ ID NO: 2397 - DNA, 20 bp, Homo sapiens
atatacctcagatcagttaa

SEQ ID NO: 2398 - DNA, 21 bp, Homo sapiens
gagaaagtgcttctatctaat

SEQ ID NO: 2399 - DNA, 22 bp, Homo sapiens
aaacatggcaataattcaagtt

SEQ ID NO: 2400 - DNA, 20 bp, Homo sapiens
atgttcattgcactctaatt

SEQ ID NO: 2401 - DNA, 24 bp, Homo sapiens
atgtaacaagcattccaattaagt

SEQ ID NO: 2402 - DNA, 21 bp, Homo sapiens
tggcctatgaatgtccctata

SEQ ID NO: 2403 - DNA, 24 bp, Homo sapiens
gagcttatcatcagtgcactgacc

SEQ ID NO: 2404 - DNA, 22 bp, Homo sapiens
tcgatatttttctagtgctctt

SEQ ID NO: 2405 - DNA, 22 bp, Homo sapiens
tagcacctagagaagctaattt

SEQ ID NO: 2406 - DNA, 22 bp, Homo sapiens
tggctcagaccctagtccatga

SEQ ID NO: 2407 - DNA, 22 bp, Homo sapiens
ggcgcgacctcagatcactgca

SEQ ID NO: 2408 - DNA, 20 bp, Homo sapiens
tccataaagtggaaagcact

SEQ ID NO: 2409 - DNA, 23 bp, Homo sapiens
tggttcagttcagtgaaggtgag

SEQ ID NO: 2410 - DNA, 22 bp, Homo sapiens
tagctttagtctggtcttggtg

SEQ ID NO: 2411 - DNA, 20 bp, Homo sapiens
gccagctaggggagtagaag

SEQ ID NO: 2412 - DNA, 22 bp, Homo sapiens
gtctgtttgtcaaatacttggt

SEQ ID NO: 2413 - DNA, 20 bp, Homo sapiens
agaaattcatctaatttgca

SEQ ID NO: 2414 - DNA, 20 bp, Homo sapiens
tagcaccatttctttggtta

SEQ ID NO: 2415 - DNA, 22 bp, Homo sapiens
atcgtggctcgcacactaacag

SEQ ID NO: 2416 - DNA, 22 bp, Homo sapiens
agcagcattaggtctataggtg

SEQ ID NO: 2417 - DNA, 23 bp, Homo sapiens
tgatctgtggaagcaggagtgac

SEQ ID NO: 2418 - DNA, 23 bp, Homo sapiens
gggaacattttataaattaagcc

SEQ ID NO: 2419 - DNA, 21 bp, Homo sapiens
ttagaaggttgcgtgttcttc

SEQ ID NO: 2420 - DNA, 21 bp, Homo sapiens
ctggggataaggccagggatt

SEQ ID NO: 2421 - DNA, 24 bp, Homo sapiens
tagaaatagtctgtgatgttgaca

SEQ ID NO: 2422 - DNA, 22 bp, Homo sapiens
actggcaggttcagctatctgg

SEQ ID NO: 2423 - DNA, 21 bp, Homo sapiens
cctactcttattttttaagtt

SEQ ID NO: 2424 - DNA, 23 bp, Homo sapiens
ggtgcagtagctcatgccactca

SEQ ID NO: 2425 - DNA, 20 bp, Homo sapiens
tagttggttagtacacaatg

SEQ ID NO: 2426 - DNA, 22 bp, Homo sapiens
tgagtcaagcttgaatattttt

SEQ ID NO: 2427 - DNA, 22 bp, Homo sapiens
agaggtttgctgggcaccccaa

SEQ ID NO: 2428 - DNA, 21 bp, Homo sapiens
ctcctgcctggtacatactta

SEQ ID NO: 2429 - DNA, 21 bp, Homo sapiens
agctacattgcctggacccaa

SEQ ID NO: 2430 - DNA, 22 bp, Homo sapiens
aagagtagtagtttatgggcaa

SEQ ID NO: 2431 - DNA, 21 bp, Homo sapiens
gcagtagtctgctgattggtc

SEQ ID NO: 2432 - DNA, 23 bp, Homo sapiens
gtagtcaaactacccttgtttgc

SEQ ID NO: 2433 - DNA, 20 bp, Homo sapiens
cttctaaaattgtattatat

SEQ ID NO: 2434 - DNA, 20 bp, Homo sapiens
tttcttacaagctattttga

SEQ ID NO: 2435 - DNA, 22 bp, Homo sapiens
ctggattagatctagtctgtga

SEQ ID NO: 2436 - DNA, 22 bp, Homo sapiens
atagctcacatcatggtttata

SEQ ID NO: 2437 - DNA, 23 bp, Homo sapiens
attgaacatcaataatgaataat

SEQ ID NO: 2438 - DNA, 22 bp, Homo sapiens
tgtcagtttgtcaaactttttc

SEQ ID NO: 2439 - DNA, 21 bp, Homo sapiens
ccctattatatctcttttttc

SEQ ID NO: 2440 - DNA, 24 bp, Homo sapiens
tgagtgtgtgtgtgtgagtgagtg

SEQ ID NO: 2441 - DNA, 23 bp, Homo sapiens
acacgcatcaagaacttcttgga

SEQ ID NO: 2442 - DNA, 23 bp, Homo sapiens
tatatatgtcttatacacatagc

SEQ ID NO: 2443 - DNA, 22 bp, Homo sapiens
gagaactcatggttacatagca

SEQ ID NO: 2444 - DNA, 24 bp, Homo sapiens
aggggatatatattttctatcttt

SEQ ID NO: 2445 - DNA, 22 bp, Homo sapiens
tttacaaatctggggctccaat

SEQ ID NO: 2446 - DNA, 24 bp, Homo sapiens
gcaacagccttcataggctatgtg

SEQ ID NO: 2447 - DNA, 21 bp, Homo sapiens
tagcttatcaagtcagataat

SEQ ID NO: 2448 - DNA, 22 bp, Homo sapiens
aatggcagcggtttaagtcagg

SEQ ID NO: 2449 - DNA, 22 bp, Homo sapiens
taatactgcctgtgccatctct

SEQ ID NO: 2450 - DNA, 23 bp, Homo sapiens
catgtgggataggtataataggt

SEQ ID NO: 2451 - DNA, 21 bp, Homo sapiens
caaataatgctttgcacatag

SEQ ID NO: 2452 - DNA, 20 bp, Homo sapiens
tagcaccataactttatgat

SEQ ID NO: 2453 - DNA, 23 bp, Homo sapiens
accagcacctgctgatgctgcct

SEQ ID NO: 2454 - DNA, 20 bp, Homo sapiens
gactcgcaatgatgctgcaa

SEQ ID NO: 2455 - DNA, 20 bp, Homo sapiens
cagcacttaatggtttgatc

SEQ ID NO: 2456 - DNA, 20 bp, Homo sapiens
ggccccactataaaatttgg

SEQ ID NO: 2457 - DNA, 22 bp, Homo sapiens
tagcttgttgatgtgatgggtc

SEQ ID NO: 2458 - DNA, 21 bp, Homo sapiens
ctggtttaatctagggagttg

SEQ ID NO: 2459 - DNA, 22 bp, Homo sapiens
tctccactgcaaccatcgagtt

SEQ ID NO: 2460 - DNA, 20 bp, Homo sapiens
gcataccattggactgtaat

SEQ ID NO: 2461 - DNA, 21 bp, Homo sapiens
tggctcagttcagcctttctc

SEQ ID NO: 2462 - DNA, 22 bp, Homo sapiens
atcactgccctgaggattcttt

SEQ ID NO: 2463 - DNA, 23 bp, Homo sapiens
agtacagatcaaataatctggta

SEQ ID NO: 2464 - DNA, 21 bp, Homo sapiens
tgaggtagtagctttagtggt

SEQ ID NO: 2465 - DNA, 23 bp, Homo sapiens
tatctttggtctttgatgttgat

SEQ ID NO: 2466 - DNA, 21 bp, Homo sapiens
aaaaaagacaccttttgtggg

SEQ ID NO: 2467 - DNA, 21 bp, Homo sapiens
gccttcagctgattttagagt

SEQ ID NO: 2468 - DNA, 21 bp, Homo sapiens
gtcccgtccgctgcgccgccg

SEQ ID NO: 2469 - DNA, 20 bp, Homo sapiens
atgacctatcttaatcatca

SEQ ID NO: 2470 - DNA, 22 bp, Homo sapiens
tccctgagaccctttcaaaggg

SEQ ID NO: 2471 - DNA, 24 bp, Homo sapiens
tgatttggctttcgactttcctgt

SEQ ID NO: 2472 - DNA, 20 bp, Homo sapiens
atcccaagtagatttttgtt

SEQ ID NO: 2473 - DNA, 21 bp, Homo sapiens
tggctcagttcagctggataa

SEQ ID NO: 2474 - DNA, 22 bp, Homo sapiens
aagttacaattcagctatctaa

SEQ ID NO: 2475 - DNA, 22 bp, Homo sapiens
tggctgagactgatggaacact

SEQ ID NO: 2476 - DNA, 22 bp, Homo sapiens
tcaagtctcacctagtacagtc

SEQ ID NO: 2477 - DNA, 20 bp, Homo sapiens
tgtggagaaatgtcattggt

SEQ ID NO: 2478 - DNA, 24 bp, Homo sapiens
gctaggtttcctacactctcagct

SEQ ID NO: 2479 - DNA, 22 bp, Homo sapiens
taacagcacgtagggattgggc

SEQ ID NO: 2480 - DNA, 21 bp, Homo sapiens
ttgtgtcaccgattcaggact

SEQ ID NO: 2481 - DNA, 24 bp, Homo sapiens
tatactatatgctatatgtatata

SEQ ID NO: 2482 - DNA, 22 bp, Homo sapiens
tctgactctgggatgtccagta

SEQ ID NO: 2483 - DNA, 22 bp, Homo sapiens
tctcaaccaaattgcaccagtg

SEQ ID NO: 2484 - DNA, 23 bp, Homo sapiens
gggtctccaggcgcccccgcgcg

SEQ ID NO: 2485 - DNA, 23 bp, Homo sapiens
cgatgttgcccagggctggtctt

SEQ ID NO: 2486 - DNA, 22 bp, Homo sapiens
tccccagaggggctgtccacag

SEQ ID NO: 2487 - DNA, 20 bp, Homo sapiens
tcccactctggagctgaaca

SEQ ID NO: 2488 - DNA, 21 bp, Homo sapiens
tggtcatagtctgacttaact

SEQ ID NO: 2489 - DNA, 22 bp, Homo sapiens
ttagtcaaatctgaatatcctc

SEQ ID NO: 2490 - DNA, 21 bp, Homo sapiens
gctaggccactgggccttggc

SEQ ID NO: 2491 - DNA, 22 bp, Homo sapiens
tgtcagtttgctgggggtgggg

SEQ ID NO: 2492 - DNA, 22 bp, Homo sapiens
tgtcatcttgtcaaaatgggga

SEQ ID NO: 2493 - DNA, 21 bp, Homo sapiens
ttgggtcatggaggtggttat

SEQ ID NO: 2494 - DNA, 22 bp, Homo sapiens
tggctatatggtaatgagtcaa

SEQ ID NO: 2495 - DNA, 24 bp, Homo sapiens
cagagagagggagagaaaggtgtc

SEQ ID NO: 2496 - DNA, 21 bp, Homo sapiens
attgcaacactgggcgttggt

SEQ ID NO: 2497 - DNA, 22 bp, Homo sapiens
ttcaagtaataacttaatagcc

SEQ ID NO: 2498 - DNA, 22 bp, Homo sapiens
ggcagcattgtgtgaaatgcct

SEQ ID NO: 2499 - DNA, 20 bp, Homo sapiens
gtgggcgtcctcttcagcct

SEQ ID NO: 2500 - DNA, 22 bp, Homo sapiens
aagctcagcctttgaaggcttt

SEQ ID NO: 2501 - DNA, 20 bp, Homo sapiens
aagtggatcaagatggccga

SEQ ID NO: 2502 - DNA, 22 bp, Homo sapiens
gaagccttgaaacaatctgacc

SEQ ID NO: 2503 - DNA, 20 bp, Homo sapiens
tcctggtggtataacgaacc

SEQ ID NO: 2504 - DNA, 22 bp, Homo sapiens
ttgtttatagcagaatttagta

SEQ ID NO: 2505 - DNA, 20 bp, Homo sapiens
ttagcaccagaactagatta

SEQ ID NO: 2506 - DNA, 20 bp, Homo sapiens
taggaatagtctgactcaga

SEQ ID NO: 2507 - DNA, 22 bp, Homo sapiens
tctcccttgaattgtaccaaca

SEQ ID NO: 2508 - DNA, 20 bp, Homo sapiens
cagccattctctaatatttc

SEQ ID NO: 2509 - DNA, 21 bp, Homo sapiens
aaacaagcaagcagagccact

SEQ ID NO: 2510 - DNA, 21 bp, Homo sapiens
gctacaatagcgacaccgcag

SEQ ID NO: 2511 - DNA, 21 bp, Homo sapiens
accattgccatatgattagca

SEQ ID NO: 2512 - DNA, 21 bp, Homo sapiens
aacacctctttacagttacta

SEQ ID NO: 2513 - DNA, 22 bp, Homo sapiens
tatgttacatcattgctacctc

SEQ ID NO: 2514 - DNA, 22 bp, Homo sapiens
actaacatgctgggtgcactgg

SEQ ID NO: 2515 - DNA, 20 bp, Homo sapiens
ccaagagagccaattgtata

SEQ ID NO: 2516 - DNA, 21 bp, Homo sapiens
acaataatgaaaactgcatag

SEQ ID NO: 2517 - DNA, 22 bp, Homo sapiens
tcttcagagtttcgccttgaga

SEQ ID NO: 2518 - DNA, 22 bp, Homo sapiens
tctcagttgtgacatagttcac

SEQ ID NO: 2519 - DNA, 20 bp, Homo sapiens
ccaaggtagcagttgacccg

SEQ ID NO: 2520 - DNA, 20 bp, Homo sapiens
atgttccttgaatacccact

SEQ ID NO: 2521 - DNA, 23 bp, Homo sapiens
gtgagaatcactcaatatgggca

SEQ ID NO: 2522 - DNA, 21 bp, Homo sapiens
attgatctcctttaaggtgac

SEQ ID NO: 2523 - DNA, 20 bp, Homo sapiens
agacaaccagctgtacaata

SEQ ID NO: 2524 - DNA, 22 bp, Homo sapiens
catgaggacaaactaatacaga

SEQ ID NO: 2525 - DNA, 20 bp, Homo sapiens
ggagggggggtaaaaaaaat

SEQ ID NO: 2526 - DNA, 20 bp, Homo sapiens
actgtgccattgaagatagt

SEQ ID NO: 2527 - DNA, 21 bp, Homo sapiens
tttgtaaagtatccagcacta

SEQ ID NO: 2528 - DNA, 20 bp, Homo sapiens
cctaaactcatattgcttgt

SEQ ID NO: 2529 - DNA, 21 bp, Homo sapiens
tgaggtctgctattgtaagtt

SEQ ID NO: 2530 - DNA, 20 bp, Homo sapiens
cggaaagacaactgcgctac

SEQ ID NO: 2531 - DNA, 22 bp, Homo sapiens
tagtgacggcttgaaatagaaa

SEQ ID NO: 2532 - DNA, 21 bp, Homo sapiens
actcagttttcccaggaatca

SEQ ID NO: 2533 - DNA, 21 bp, Homo sapiens
gcattgtgtcttaattgctaa

SEQ ID NO: 2534 - DNA, 20 bp, Homo sapiens
gccccggcatcaggtggtgt

SEQ ID NO: 2535 - DNA, 22 bp, Homo sapiens
gctatttgctcctatagcaggc

SEQ ID NO: 2536 - DNA, 20 bp, Homo sapiens
tggttaatgctctcaccagg

SEQ ID NO: 2537 - DNA, 20 bp, Homo sapiens
gctgcatggcaagcctgtca

SEQ ID NO: 2538 - DNA, 22 bp, Homo sapiens
tttaagtaatccaaatatgggt

SEQ ID NO: 2539 - DNA, 21 bp, Homo sapiens
gattccgtctctttctattga

SEQ ID NO: 2540 - DNA, 21 bp, Homo sapiens
cccccttatttctacaaaaaa

SEQ ID NO: 2541 - DNA, 22 bp, Homo sapiens
tgagtcaggcaggggatgcttg

SEQ ID NO: 2542 - DNA, 21 bp, Homo sapiens
agcatgctgacttaggggtgc

SEQ ID NO: 2543 - DNA, 20 bp, Homo sapiens
ccagttgggtagtttaccca

SEQ ID NO: 2544 - DNA, 22 bp, Homo sapiens
acatagaaacagtttatggggg

SEQ ID NO: 2545 - DNA, 23 bp, Homo sapiens
gctagtatacctccatagtcaca

SEQ ID NO: 2546 - DNA, 22 bp, Homo sapiens
ctatcttctttgctcatccttg

SEQ ID NO: 2547 - DNA, 23 bp, Homo sapiens
ttagaatagtctgactctcactg

SEQ ID NO: 2548 - DNA, 21 bp, Homo sapiens
tagcaccagctgagtagccaa

SEQ ID NO: 2549 - DNA, 22 bp, Homo sapiens
gtaactggggaaactttctagg

SEQ ID NO: 2550 - DNA, 22 bp, Homo sapiens
ttcaagtaatctgacatagcaa

SEQ ID NO: 2551 - DNA, 22 bp, Homo sapiens
ttgcttatcaatgtgccaccag

SEQ ID NO: 2552 - DNA, 20 bp, Homo sapiens
ataccagattatcatagtca

SEQ ID NO: 2553 - DNA, 22 bp, Homo sapiens
tgagttggtgtcaccgaccctg

SEQ ID NO: 2554 - DNA, 20 bp, Homo sapiens
gggattgtgggttcgtctct

SEQ ID NO: 2555 - DNA, 20 bp, Homo sapiens
atctattgaaggtcagcaaa

SEQ ID NO: 2556 - DNA, 21 bp, Homo sapiens
gacctgatgctcgtggcacag

SEQ ID NO: 2557 - DNA, 22 bp, Homo sapiens
ctattttttaaaaacttactta

SEQ ID NO: 2558 - DNA, 22 bp, Homo sapiens
ctttcagagtttcagttaacag

SEQ ID NO: 2559 - DNA, 21 bp, Homo sapiens
agatgtctacagttatatcgt

SEQ ID NO: 2560 - DNA, 20 bp, Homo sapiens
cagcttatcagactgcctca

SEQ ID NO: 2561 - DNA, 20 bp, Homo sapiens
ggttgcaatgggcagactgg

SEQ ID NO: 2562 - DNA, 21 bp, Homo sapiens
tctacaatagcgatgtcatct

SEQ ID NO: 2563 - DNA, 20 bp, Homo sapiens
tagctatagctcttgttctt

SEQ ID NO: 2564 - DNA, 22 bp, Homo sapiens
tgctgctgagtatgtaacctct

SEQ ID NO: 2565 - DNA, 22 bp, Homo sapiens
acagtgagcgcttgtatcagtg

SEQ ID NO: 2566 - DNA, 23 bp, Homo sapiens
gaggacatcccatcctcagtgtc

SEQ ID NO: 2567 - DNA, 21 bp, Homo sapiens
ttcacagtggctatcatggtc

SEQ ID NO: 2568 - DNA, 23 bp, Homo sapiens
tgtgatcgcttgcatggctgact

SEQ ID NO: 2569 - DNA, 22 bp, Homo sapiens
tccctgagactctagattgtac

SEQ ID NO: 2570 - DNA, 22 bp, Homo sapiens
cctataagaatctaatgcccca

SEQ ID NO: 2571 - DNA, 20 bp, Homo sapiens
tgactcagttcagcaggact

SEQ ID NO: 2572 - DNA, 21 bp, Homo sapiens
caaagtgcttacgacacactc

SEQ ID NO: 2573 - DNA, 22 bp, Homo sapiens
atagtgtcatcgatgattgaac

SEQ ID NO: 2574 - DNA, 22 bp, Homo sapiens
aggaagtaatctgggcgttttg

SEQ ID NO: 2575 - DNA, 22 bp, Homo sapiens
cttctgaagctctaaactaaat

SEQ ID NO: 2576 - DNA, 22 bp, Homo sapiens
gctagtatgtgactgaggttga

SEQ ID NO: 2577 - DNA, 22 bp, Homo sapiens
atagagagagaatggaaaataa

SEQ ID NO: 2578 - DNA, 20 bp, Homo sapiens
agtcaaaataagataagaag

SEQ ID NO: 2579 - DNA, 21 bp, Homo sapiens
aaggtggaggaaaatccacgt

SEQ ID NO: 2580 - DNA, 21 bp, Homo sapiens
gcatggcactcttttaggtat

SEQ ID NO: 2581 - DNA, 21 bp, Homo sapiens
tcagtagtctgcacatcaaca

SEQ ID NO: 2582 - DNA, 22 bp, Homo sapiens
atgacctacaggccagtgagtt

SEQ ID NO: 2583 - DNA, 22 bp, Homo sapiens
atgactggtgtctttataaaac

SEQ ID NO: 2584 - DNA, 21 bp, Homo sapiens
tagcttatgttcacaaggtca

SEQ ID NO: 2585 - DNA, 22 bp, Homo sapiens
agttccataatgacagcaatta

SEQ ID NO: 2586 - DNA, 22 bp, Homo sapiens
tagcagcacatcgtggttatgt

SEQ ID NO: 2587 - DNA, 21 bp, Homo sapiens
tatttaaaatgttttttctat

SEQ ID NO: 2588 - DNA, 22 bp, Homo sapiens
aggctccggagtagctgggaat

SEQ ID NO: 2589 - DNA, 22 bp, Homo sapiens
acctattagtgtacaccatttt

SEQ ID NO: 2590 - DNA, 22 bp, Homo sapiens
agccacattgagtttatgggca

SEQ ID NO: 2591 - DNA, 22 bp, Homo sapiens
tgtgctccgactgggctacttc

SEQ ID NO: 2592 - DNA, 22 bp, Homo sapiens
tgagtcattctctttatagggt

SEQ ID NO: 2593 - DNA, 21 bp, Homo sapiens
cctctggatataggataagct

SEQ ID NO: 2594 - DNA, 24 bp, Homo sapiens
tttatgctgctttatggtgataga

SEQ ID NO: 2595 - DNA, 20 bp, Homo sapiens
gctgtgccattgaaagcaga

SEQ ID NO: 2596 - DNA, 20 bp, Homo sapiens
cctgaagcggggggaaaaaa

SEQ ID NO: 2597 - DNA, 21 bp, Homo sapiens
gcggcggcgactccttcatat

SEQ ID NO: 2598 - DNA, 20 bp, Homo sapiens
tggctcagttcagctggatg

SEQ ID NO: 2599 - DNA, 23 bp, Homo sapiens
agcgatagcagccactactatca

SEQ ID NO: 2600 - DNA, 22 bp, Homo sapiens
gctagatgtgctgcaacttaca

SEQ ID NO: 2601 - DNA, 21 bp, Homo sapiens
catacattggggcagactttt

SEQ ID NO: 2602 - DNA, 22 bp, Homo sapiens
tactgattgctctttatggaac

SEQ ID NO: 2603 - DNA, 20 bp, Homo sapiens
atgtatcatgtatagttata

SEQ ID NO: 2604 - DNA, 21 bp, Homo sapiens
tagcacaggagcttgctacat

SEQ ID NO: 2605 - DNA, 20 bp, Homo sapiens
gtcttcaaaagggtccttta

SEQ ID NO: 2606 - DNA, 22 bp, Homo sapiens
atcactatgctgaggatggaac

SEQ ID NO: 2607 - DNA, 21 bp, Homo sapiens
aacacctagggcactggcaac

SEQ ID NO: 2608 - DNA, 22 bp, Homo sapiens
agtggatacttacagtgtggtt

SEQ ID NO: 2609 - DNA, 21 bp, Homo sapiens
ttaaagtaaaggtcagcgagg

SEQ ID NO: 2610 - DNA, 23 bp, Homo sapiens
atagacgctgagtactacttgtg

SEQ ID NO: 2611 - DNA, 23 bp, Homo sapiens
tgtatcaaagatgggtgtttcaa

SEQ ID NO: 2612 - DNA, 22 bp, Homo sapiens
cccggcttatttgaattaattt

SEQ ID NO: 2613 - DNA, 22 bp, Homo sapiens
aaggaattgacggaagccaacc

SEQ ID NO: 2614 - DNA, 21 bp, Homo sapiens
agcatgctctcttagcagtgg

SEQ ID NO: 2615 - DNA, 20 bp, Homo sapiens
gaaaaagtcacaagaatttg

SEQ ID NO: 2616 - DNA, 20 bp, Homo sapiens
ttacaatatggcaggaatag

SEQ ID NO: 2617 - DNA, 20 bp, Homo sapiens
atcatggcactcatatatgc

SEQ ID NO: 2618 - DNA, 23 bp, Homo sapiens
atagcatatgaggcagtgggtca

SEQ ID NO: 2619 - DNA, 20 bp, Homo sapiens
tatctatgctagactcgtgt

SEQ ID NO: 2620 - DNA, 22 bp, Homo sapiens
tttttaatgctctcaccaaaca

SEQ ID NO: 2621 - DNA, 21 bp, Homo sapiens
aaaataatgatttgggcatcg

SEQ ID NO: 2622 - DNA, 20 bp, Homo sapiens
tttaaacatttttcttggta

SEQ ID NO: 2623 - DNA, 22 bp, Homo sapiens
tcaatggcactcattaaatgcc

SEQ ID NO: 2624 - DNA, 22 bp, Homo sapiens
agctcagagttctatgaaccag

SEQ ID NO: 2625 - DNA, 22 bp, Homo sapiens
tcaagtaatccactcgcttccc

SEQ ID NO: 2626 - DNA, 24 bp, Homo sapiens
ctaggtatggtctgcctctttcat

SEQ ID NO: 2627 - DNA, 20 bp, Homo sapiens
tcatgctggggtatttgtgg

SEQ ID NO: 2628 - DNA, 22 bp, Homo sapiens
tggatattcagcactttatgat

SEQ ID NO: 2629 - DNA, 22 bp, Homo sapiens
actcatggcaccaaaatccgta

SEQ ID NO: 2630 - DNA, 20 bp, Homo sapiens
aggtccattgcttacctatt

SEQ ID NO: 2631 - DNA, 20 bp, Homo sapiens
atgcctacaacctgacaaag

SEQ ID NO: 2632 - DNA, 20 bp, Homo sapiens
tgacactgacaggattgatc

SEQ ID NO: 2633 - DNA, 22 bp, Homo sapiens
ttttgttgctcagctagcacat

SEQ ID NO: 2634 - DNA, 20 bp, Homo sapiens
ctgcgcacttcgtcactggg

SEQ ID NO: 2635 - DNA, 22 bp, Homo sapiens
gtggtcaaaagggtgaggcctt

SEQ ID NO: 2636 - DNA, 22 bp, Homo sapiens
tctctgctatcagcctcctgtc

SEQ ID NO: 2637 - DNA, 22 bp, Homo sapiens
cccgccccgccgcgccccccat

SEQ ID NO: 2638 - DNA, 21 bp, Homo sapiens
ctacaatgtgcatttaaacta

SEQ ID NO: 2639 - DNA, 20 bp, Homo sapiens
attctatgaccagtatagca

SEQ ID NO: 2640 - DNA, 20 bp, Homo sapiens
cgcgggtcggggcggcgaac

SEQ ID NO: 2641 - DNA, 22 bp, Homo sapiens
ttataagggggatggggctggt

SEQ ID NO: 2642 - DNA, 21 bp, Homo sapiens
atgggggaacacagcctacta

SEQ ID NO: 2643 - DNA, 23 bp, Homo sapiens
atagtggtattgaaatcatgtga

SEQ ID NO: 2644 - DNA, 21 bp, Homo sapiens
attgtgccattgaaagtaatg

SEQ ID NO: 2645 - DNA, 22 bp, Homo sapiens
atttcagagatctggtccacag

SEQ ID NO: 2646 - DNA, 22 bp, Homo sapiens
taaatgctaccgattgtacact

SEQ ID NO: 2647 - DNA, 21 bp, Homo sapiens
atactatatggtaatgactta

SEQ ID NO: 2648 - DNA, 20 bp, Homo sapiens
agcccaacccttgtgccagt

SEQ ID NO: 2649 - DNA, 20 bp, Homo sapiens
acaccgagggcactgtcaaa

SEQ ID NO: 2650 - DNA, 22 bp, Homo sapiens
gcttgtctcaatcgacttgtga

SEQ ID NO: 2651 - DNA, 23 bp, Homo sapiens
cactgagctgctgggcgtggtgg

SEQ ID NO: 2652 - DNA, 22 bp, Homo sapiens
agacggcctatgcttcttgttg

SEQ ID NO: 2653 - DNA, 22 bp, Homo sapiens
caatgtttgtcaaataccccaa

SEQ ID NO: 2654 - DNA, 20 bp, Homo sapiens
atctggatacttaactttct

SEQ ID NO: 2655 - DNA, 20 bp, Homo sapiens
tgggatgagcatccttaaat

SEQ ID NO: 2656 - DNA, 20 bp, Homo sapiens
ttggcaatgtctgcatatgt

SEQ ID NO: 2657 - DNA, 20 bp, Homo sapiens
gactgtacagcactcagact

SEQ ID NO: 2658 - DNA, 23 bp, Homo sapiens
tgtagactggatcacttcacatt

SEQ ID NO: 2659 - DNA, 23 bp, Homo sapiens
caaagtgcacatatgcaccttct

SEQ ID NO: 2660 - DNA, 20 bp, Homo sapiens
cacgctattgaagtcatgtg

SEQ ID NO: 2661 - DNA, 23 bp, Homo sapiens
tgtgcaaatctatgactcagaag

SEQ ID NO: 2662 - DNA, 23 bp, Homo sapiens
ctgttaaaattattatcaaatat

SEQ ID NO: 2663 - DNA, 22 bp, Homo sapiens
cagcaatgtctattaagcatac

SEQ ID NO: 2664 - DNA, 24 bp, Homo sapiens
aaactttaaatgggtaagagattt

SEQ ID NO: 2665 - DNA, 21 bp, Homo sapiens
ctcagtgttcagattaccttg

SEQ ID NO: 2666 - DNA, 22 bp, Homo sapiens
catcccttgcagttgtctccgt

SEQ ID NO: 2667 - DNA, 22 bp, Homo sapiens
tcctaaggctggtttatggggg

SEQ ID NO: 2668 - DNA, 21 bp, Homo sapiens
atgctcctcgtggggaacctg

SEQ ID NO: 2669 - DNA, 21 bp, Homo sapiens
ctctcccacccctccttccct

SEQ ID NO: 2670 - DNA, 22 bp, Homo sapiens
ttctgcctaatttcaagcagcc

SEQ ID NO: 2671 - DNA, 20 bp, Homo sapiens
ttactcttattttttaaggt

SEQ ID NO: 2672 - DNA, 21 bp, Homo sapiens
tagtgtaacccaggggttccc

SEQ ID NO: 2673 - DNA, 20 bp, Homo sapiens
tgcatcagaggctgtcacct

SEQ ID NO: 2674 - DNA, 21 bp, Homo sapiens
tccctgtcctccaggaatctg

SEQ ID NO: 2675 - DNA, 22 bp, Homo sapiens
tatatacaggtgaaatgccttt

SEQ ID NO: 2676 - DNA, 20 bp, Homo sapiens
tccgaggtgggatcccggaa

SEQ ID NO: 2677 - DNA, 20 bp, Homo sapiens
taaagttgccagatcactga

SEQ ID NO: 2678 - DNA, 22 bp, Homo sapiens
ttaccatggatgtgctcttaat

SEQ ID NO: 2679 - DNA, 22 bp, Homo sapiens
tctcccagttagcacgttgact

SEQ ID NO: 2680 - DNA, 23 bp, Homo sapiens
gatgatcccctgcaggaatgtga

SEQ ID NO: 2681 - DNA, 21 bp, Homo sapiens
ctgacctgtgggccactgatt

SEQ ID NO: 2682 - DNA, 20 bp, Homo sapiens
agtatactagcaggaggtaa

SEQ ID NO: 2683 - DNA, 22 bp, Homo sapiens
tgtactacatgggatattgtat

SEQ ID NO: 2684 - DNA, 22 bp, Homo sapiens
aagcagcaatgcaatatacata

SEQ ID NO: 2685 - DNA, 21 bp, Homo sapiens
atgacctataggccagttgaa

SEQ ID NO: 2686 - DNA, 22 bp, Homo sapiens
tctgactttgctccaacatcca

SEQ ID NO: 2687 - DNA, 23 bp, Homo sapiens
acggagtccctgatgaagcactg

SEQ ID NO: 2688 - DNA, 21 bp, Homo sapiens
cttaaagtagccagcactact

SEQ ID NO: 2689 - DNA, 20 bp, Homo sapiens
tatagcacttgtcaatgcta

SEQ ID NO: 2690 - DNA, 21 bp, Homo sapiens
ctctggatacttagctgttaa

SEQ ID NO: 2691 - DNA, 23 bp, Homo sapiens
tatattatacctacagcattgtg

SEQ ID NO: 2692 - DNA, 24 bp, Homo sapiens
tctcctcttttcctcctcctcctc

SEQ ID NO: 2693 - DNA, 20 bp, Homo sapiens
gctcaagctacacaacactg

SEQ ID NO: 2694 - DNA, 23 bp, Homo sapiens
aagattaggcacgcagctacttg

SEQ ID NO: 2695 - DNA, 20 bp, Homo sapiens
agtatagttctgagtttagt

SEQ ID NO: 2696 - DNA, 23 bp, Homo sapiens
ttgagccagcaggctggaggtgc

SEQ ID NO: 2697 - DNA, 20 bp, Homo sapiens
tacgatatcaagaacatgaa

SEQ ID NO: 2698 - DNA, 22 bp, Homo sapiens
taatactgcctgcattatatgt

SEQ ID NO: 2699 - DNA, 21 bp, Homo sapiens
ctaacctatgaattgactaca

SEQ ID NO: 2700 - DNA, 21 bp, Homo sapiens
tctccaaacagaacccaacca

SEQ ID NO: 2701 - DNA, 20 bp, Homo sapiens
acttcatctatcatattgaa

SEQ ID NO: 2702 - DNA, 22 bp, Homo sapiens
ttcagaaaccatatgcagagac

SEQ ID NO: 2703 - DNA, 23 bp, Homo sapiens
tatcagtcatgtggcgcaactgg

SEQ ID NO: 2704 - DNA, 22 bp, Homo sapiens
ctgcaatgttcatctaatgttg

SEQ ID NO: 2705 - DNA, 20 bp, Homo sapiens
tcctcgtcctgcagcgctag

SEQ ID NO: 2706 - DNA, 20 bp, Homo sapiens
cccttgcctctcggtgcctg

SEQ ID NO: 2707 - DNA, 21 bp, Homo sapiens
tgtgtccaccaacccatatct

SEQ ID NO: 2708 - DNA, 21 bp, Homo sapiens
ctgacctataggcactcctaa

SEQ ID NO: 2709 - DNA, 21 bp, Homo sapiens
cagactttatgttttggcaat

SEQ ID NO: 2710 - DNA, 20 bp, Homo sapiens
ctgacctatgaattgtgagc

SEQ ID NO: 2711 - DNA, 20 bp, Homo sapiens
ctcatgtctgtaatgccaaa

SEQ ID NO: 2712 - DNA, 24 bp, Homo sapiens
atatggctgctgccattattatta

SEQ ID NO: 2713 - DNA, 21 bp, Homo sapiens
aatgatgccatagtcaaggcg

SEQ ID NO: 2714 - DNA, 23 bp, Homo sapiens
tgtagacccctgttgcaggtgaa

SEQ ID NO: 2715 - DNA, 20 bp, Homo sapiens
agatgtgcaggtgaactcag

SEQ ID NO: 2716 - DNA, 23 bp, Homo sapiens
cattggtctatatttataccagt

SEQ ID NO: 2717 - DNA, 20 bp, Homo sapiens
ggctacttagctcagctggt

SEQ ID NO: 2718 - DNA, 23 bp, Homo sapiens
attattatgaatacagatatcta

SEQ ID NO: 2719 - DNA, 22 bp, Homo sapiens
agcagcattaagtacataggtt

SEQ ID NO: 2720 - DNA, 20 bp, Homo sapiens
gtccagttttcccagttgca

SEQ ID NO: 2721 - DNA, 21 bp, Homo sapiens
ctgtgacagtttaactctctg

SEQ ID NO: 2722 - DNA, 22 bp, Homo sapiens
atcgtgccattgccctccagcg

SEQ ID NO: 2723 - DNA, 20 bp, Homo sapiens
gctgcatagcaagcagggat

SEQ ID NO: 2724 - DNA, 21 bp, Homo sapiens
gctacaactctgattatcacc

SEQ ID NO: 2725 - DNA, 21 bp, Homo sapiens
cgaaggagaatgcagatgaac

SEQ ID NO: 2726 - DNA, 22 bp, Homo sapiens
tctctgggaccagtgcctattg

SEQ ID NO: 2727 - DNA, 21 bp, Homo sapiens
ccttccataatgacagcgtgt

SEQ ID NO: 2728 - DNA, 22 bp, Homo sapiens
tttgagtatttcaggataggtt

SEQ ID NO: 2729 - DNA, 20 bp, Homo sapiens
tagcaccatttgactaattg

SEQ ID NO: 2730 - DNA, 22 bp, Homo sapiens
ccgcggattcttcctggataac

SEQ ID NO: 2731 - DNA, 20 bp, Homo sapiens
caataaacacactgcgcttg

SEQ ID NO: 2732 - DNA, 20 bp, Homo sapiens
ttctccgctgatgtgatgtt

SEQ ID NO: 2733 - DNA, 22 bp, Homo sapiens
tgagtgtcatgaccatgtaggc

SEQ ID NO: 2734 - DNA, 21 bp, Homo sapiens
gggactatgcatgatatgaag

SEQ ID NO: 2735 - DNA, 21 bp, Homo sapiens
cgaattacgggtctgggtggt

SEQ ID NO: 2736 - DNA, 22 bp, Homo sapiens
ttgcctatttctagcaaaattt

SEQ ID NO: 2737 - DNA, 20 bp, Homo sapiens
tggctcagttcgatgatagg

SEQ ID NO: 2738 - DNA, 22 bp, Homo sapiens
ttgccaacaacctgaccaagct

SEQ ID NO: 2739 - DNA, 22 bp, Homo sapiens
tgagatgaagtgtcactttgtc

SEQ ID NO: 2740 - DNA, 23 bp, Homo sapiens
tgaaagtttctttgggaatccca

SEQ ID NO: 2741 - DNA, 23 bp, Homo sapiens
gtctgacccctttgaaggagaga

SEQ ID NO: 2742 - DNA, 22 bp, Homo sapiens
cgagcactaaatagaaaacatt

SEQ ID NO: 2743 - DNA, 22 bp, Homo sapiens
gctgcaatgtcttatacctgta

SEQ ID NO: 2744 - DNA, 20 bp, Homo sapiens
ctgacctactcattaacagc

SEQ ID NO: 2745 - DNA, 21 bp, Homo sapiens
tagcaccatctgaagagctac

SEQ ID NO: 2746 - DNA, 21 bp, Homo sapiens
gacctgatgccatcacactga

SEQ ID NO: 2747 - DNA, 20 bp, Homo sapiens
actcaagttctggtctcttt

SEQ ID NO: 2748 - DNA, 23 bp, Homo sapiens
tggctcagttcagctttcaactc

SEQ ID NO: 2749 - DNA, 20 bp, Homo sapiens
gcatggccatcattattagc

SEQ ID NO: 2750 - DNA, 21 bp, Homo sapiens
tgcatcactggctattgttct

SEQ ID NO: 2751 - DNA, 23 bp, Homo sapiens
tagctcgctgcacacaactgtca

SEQ ID NO: 2752 - DNA, 22 bp, Homo sapiens
gcgggtctcaaagccagcacag

SEQ ID NO: 2753 - DNA, 20 bp, Homo sapiens
ggatctggcatctgagaatc

SEQ ID NO: 2754 - DNA, 20 bp, Homo sapiens
ttacaatatgtacttccagt

SEQ ID NO: 2755 - DNA, 23 bp, Homo sapiens
tgcagcaaacaacaggatgaact

SEQ ID NO: 2756 - DNA, 22 bp, Homo sapiens
atagtgccattaggagccctca

SEQ ID NO: 2757 - DNA, 20 bp, Homo sapiens
gtgtcttgcaaatgatatgt

SEQ ID NO: 2758 - DNA, 22 bp, Homo sapiens
ccagtcttagggtttagcagct

SEQ ID NO: 2759 - DNA, 22 bp, Homo sapiens
gcagtagagactgggcgtttta

SEQ ID NO: 2760 - DNA, 23 bp, Homo sapiens
gctacaactttgcagctgtgtgg

SEQ ID NO: 2761 - DNA, 24 bp, Homo sapiens
agaccccaaggatatgaaggcatc

SEQ ID NO: 2762 - DNA, 22 bp, Homo sapiens
tacagcctcttatgctttccaa

SEQ ID NO: 2763 - DNA, 23 bp, Homo sapiens
ttgagacccactgggccttttgc

SEQ ID NO: 2764 - DNA, 21 bp, Homo sapiens
atcctatgtctgcataatgcg

SEQ ID NO: 2765 - DNA, 20 bp, Homo sapiens
taaaattacaagaacaactg

SEQ ID NO: 2766 - DNA, 22 bp, Homo sapiens
atcactactaagccctaaaggt

SEQ ID NO: 2767 - DNA, 22 bp, Homo sapiens
agaggctgtttctggcacagtg

SEQ ID NO: 2768 - DNA, 22 bp, Homo sapiens
taggaattgtaggcagctttga

SEQ ID NO: 2769 - DNA, 21 bp, Homo sapiens
tagcttatggagtcagttcag

SEQ ID NO: 2770 - DNA, 22 bp, Homo sapiens
ttacagtaatccagcttagcca

SEQ ID NO: 2771 - DNA, 24 bp, Homo sapiens
agcagagagaagacatctcagggg

SEQ ID NO: 2772 - DNA, 22 bp, Homo sapiens
tagcagcacgtgaaataaacgt

SEQ ID NO: 2773 - DNA, 21 bp, Homo sapiens
cagtgctattggaaaagagca

SEQ ID NO: 2774 - DNA, 23 bp, Homo sapiens
ttattaacaggtatgggagcaag

SEQ ID NO: 2775 - DNA, 22 bp, Homo sapiens
tgtcagtttgatgggccagggt

SEQ ID NO: 2776 - DNA, 21 bp, Homo sapiens
gaagtgcagtctagtgggagg

SEQ ID NO: 2777 - DNA, 22 bp, Homo sapiens
aactacatctgcgatgacccta

SEQ ID NO: 2778 - DNA, 22 bp, Homo sapiens
tctgctgcatccaggatagtat

SEQ ID NO: 2779 - DNA, 24 bp, Homo sapiens
cattcctcagctacagcagggcac

SEQ ID NO: 2780 - DNA, 20 bp, Homo sapiens
acctattgctcctaggtaac

SEQ ID NO: 2781 - DNA, 20 bp, Homo sapiens
cgctagataggtaccctgcc

SEQ ID NO: 2782 - DNA, 21 bp, Homo sapiens
cagtacccagaccaagtttgt

SEQ ID NO: 2783 - DNA, 24 bp, Homo sapiens
cttcctctctgctctctttcctgt

SEQ ID NO: 2784 - DNA, 23 bp, Homo sapiens
agctcaccaccttgtaggagtga

SEQ ID NO: 2785 - DNA, 21 bp, Homo sapiens
ctctcctaggaattgacaacc

SEQ ID NO: 2786 - DNA, 20 bp, Homo sapiens
gcccagttttcccagtcccg

SEQ ID NO: 2787 - DNA, 23 bp, Homo sapiens
ggctcccccggcccccgcgcggc

SEQ ID NO: 2788 - DNA, 20 bp, Homo sapiens
ccgctccccgcccccgggcg

SEQ ID NO: 2789 - DNA, 21 bp, Homo sapiens
atcgtgcacgacggcggcatg

SEQ ID NO: 2790 - DNA, 20 bp, Homo sapiens
ggctgggcgcgcgccgcctg

SEQ ID NO: 2791 - DNA, 23 bp, Homo sapiens
cctgccttagggtggcttgactg

SEQ ID NO: 2792 - DNA, 23 bp, Homo sapiens
cagcttatcagacagatgcttag

SEQ ID NO: 2793 - DNA, 20 bp, Homo sapiens
cagcagcaattcatgtggaa

SEQ ID NO: 2794 - DNA, 21 bp, Homo sapiens
gtggtgttttcccaggaacct

SEQ ID NO: 2795 - DNA, 22 bp, Homo sapiens
tggactgggtggtttataaaac

SEQ ID NO: 2796 - DNA, 21 bp, Homo sapiens
ggatggacatcattatatgcg

SEQ ID NO: 2797 - DNA, 22 bp, Homo sapiens
cgtggactcgctcacggatcac

SEQ ID NO: 2798 - DNA, 20 bp, Homo sapiens
gcccggctcgctggcgctct

SEQ ID NO: 2799 - DNA, 20 bp, Homo sapiens
cagccgactgagaactgatc

SEQ ID NO: 2800 - DNA, 23 bp, Homo sapiens
cacaattacaattccagctccat

SEQ ID NO: 2801 - DNA, 22 bp, Homo sapiens
tcctggttgtgacacgcaaagc

SEQ ID NO: 2802 - DNA, 21 bp, Homo sapiens
agcatggcactggtatgggtg

SEQ ID NO: 2803 - DNA, 20 bp, Homo sapiens
ctgacctaggaattgaactc

SEQ ID NO: 2804 - DNA, 23 bp, Homo sapiens
agccagttttcccaggaatcctt

SEQ ID NO: 2805 - DNA, 20 bp, Homo sapiens
agcaaacatctgttgagagt

SEQ ID NO: 2806 - DNA, 21 bp, Homo sapiens
cccagtgttcagcagcagaca

SEQ ID NO: 2807 - DNA, 22 bp, Homo sapiens
cgtggacgacctgcttctcact

SEQ ID NO: 2808 - DNA, 20 bp, Homo sapiens
ggccctatagctcaggggcc

SEQ ID NO: 2809 - DNA, 20 bp, Homo sapiens
gggggagtgtttttttgttt

SEQ ID NO: 2810 - DNA, 23 bp, Homo sapiens
tggctcagacactacttccatag

SEQ ID NO: 2811 - DNA, 22 bp, Homo sapiens
cagtgcaatctacgccttgcgt

SEQ ID NO: 2812 - DNA, 20 bp, Homo sapiens
tagcacacgaggaagctgac

SEQ ID NO: 2813 - DNA, 22 bp, Homo sapiens
tgagtgtccctgcccctggctt

SEQ ID NO: 2814 - DNA, 21 bp, Homo sapiens
gctccatcatcaaacatgtct

SEQ ID NO: 2815 - DNA, 21 bp, Homo sapiens
cagtgcaatgtgaaaggggta

SEQ ID NO: 2816 - DNA, 23 bp, Homo sapiens
caaagtgcttacagtcgactgcg

SEQ ID NO: 2817 - DNA, 22 bp, Homo sapiens
gacttcagtggtagaatctcta

SEQ ID NO: 2818 - DNA, 21 bp, Homo sapiens
cagttgggcagtttatgggac

SEQ ID NO: 2819 - DNA, 23 bp, Homo sapiens
gttatcagactgatgatgacatc

SEQ ID NO: 2820 - DNA, 22 bp, Homo sapiens
tcaagtctcaaagctgtactct

SEQ ID NO: 2821 - DNA, 20 bp, Homo sapiens
atgattaagagcctgccaga

SEQ ID NO: 2822 - DNA, 22 bp, Homo sapiens
ccccggcggggaggaggaggag

SEQ ID NO: 2823 - DNA, 22 bp, Homo sapiens
atcacattgccagtctcccttg

SEQ ID NO: 2824 - DNA, 21 bp, Homo sapiens
ctttttgtcatattgcccagg

SEQ ID NO: 2825 - DNA, 20 bp, Homo sapiens
aactttagcataagtgagtc

SEQ ID NO: 2826 - DNA, 21 bp, Homo sapiens
ctgcaagcaaggccatgtcgg

SEQ ID NO: 2827 - DNA, 22 bp, Homo sapiens
agaggtagtaggttgatatagt

SEQ ID NO: 2828 - DNA, 20 bp, Homo sapiens
atggcccctgtaaaaaaagg

SEQ ID NO: 2829 - DNA, 23 bp, Homo sapiens
ctttttggtttccgtaccagcag

SEQ ID NO: 2830 - DNA, 23 bp, Homo sapiens
gaaagtctcagagcactagtgac

SEQ ID NO: 2831 - DNA, 21 bp, Homo sapiens
acatatatgaggcatatatat

SEQ ID NO: 2832 - DNA, 22 bp, Homo sapiens
aaaggcaatggtagcatagaca

SEQ ID NO: 2833 - DNA, 21 bp, Homo sapiens
tagcaccatctgaggataact

SEQ ID NO: 2834 - DNA, 21 bp, Homo sapiens
atactagtgtatactggaaca

SEQ ID NO: 2835 - DNA, 22 bp, Homo sapiens
gccctgtggggtgcagagcagc

SEQ ID NO: 2836 - DNA, 20 bp, Homo sapiens
ccatgataatcaggttagca

SEQ ID NO: 2837 - DNA, 20 bp, Homo sapiens
cacgaggcgccgccgccgcc

SEQ ID NO: 2838 - DNA, 22 bp, Homo sapiens
tatacacatctgatcgatctta

SEQ ID NO: 2839 - DNA, 21 bp, Homo sapiens
cagtcaaatgcaaatcaaaac

SEQ ID NO: 2840 - DNA, 22 bp, Homo sapiens
tccctctctgggattcttctga

SEQ ID NO: 2841 - DNA, 22 bp, Homo sapiens
tagcaccacttctgtgcgtccg

SEQ ID NO: 2842 - DNA, 20 bp, Homo sapiens
cccttgcctagattatgaaa

SEQ ID NO: 2843 - DNA, 21 bp, Homo sapiens
acacaagaggatgtctgacca

SEQ ID NO: 2844 - DNA, 20 bp, Homo sapiens
taggaatacagacactcagt

SEQ ID NO: 2845 - DNA, 22 bp, Homo sapiens
tgtcagtccgctggcccaactg

SEQ ID NO: 2846 - DNA, 20 bp, Homo sapiens
gcattagtatctccgcggca

SEQ ID NO: 2847 - DNA, 23 bp, Homo sapiens
atgctataattcacaatgaactg

SEQ ID NO: 2848 - DNA, 22 bp, Homo sapiens
accaataatggtaatgccattt

SEQ ID NO: 2849 - DNA, 23 bp, Homo sapiens
agcagcaatgttgtttgctacaa

SEQ ID NO: 2850 - DNA, 22 bp, Homo sapiens
atgcaacatcctacagctgata

SEQ ID NO: 2851 - DNA, 20 bp, Homo sapiens
agcactccagggtccttaat

SEQ ID NO: 2852 - DNA, 21 bp, Homo sapiens
ttacactgttagcctgatgca

SEQ ID NO: 2853 - DNA, 22 bp, Homo sapiens
agagggttgggaactgttgaca

SEQ ID NO: 2854 - DNA, 20 bp, Homo sapiens
ctcaagtaatccagccgctt

SEQ ID NO: 2855 - DNA, 20 bp, Homo sapiens
tagcaccatttgaaaaaagc

SEQ ID NO: 2856 - DNA, 20 bp, Homo sapiens
attgcggctgctccctacac

SEQ ID NO: 2857 - DNA, 23 bp, Homo sapiens
tgcgagtccctgatgaaatttct

SEQ ID NO: 2858 - DNA, 22 bp, Homo sapiens
aggagtctcatctaacttgaga

SEQ ID NO: 2859 - DNA, 21 bp, Homo sapiens
gagcagcacctaatggttgtt

SEQ ID NO: 2860 - DNA, 22 bp, Homo sapiens
aaaatgtggactcagcaactag

SEQ ID NO: 2861 - DNA, 21 bp, Homo sapiens
tgtctgctgcttggtgcctga

SEQ ID NO: 2862 - DNA, 22 bp, Homo sapiens
gtctgaaacagattatggggca

SEQ ID NO: 2863 - DNA, 23 bp, Homo sapiens
ggtgcatgcttgcatgcctgact

SEQ ID NO: 2864 - DNA, 20 bp, Homo sapiens
agctcccacattgaccaaac

SEQ ID NO: 2865 - DNA, 22 bp, Homo sapiens
caaataacagggactgcataac

SEQ ID NO: 2866 - DNA, 22 bp, Homo sapiens
gcatttgtaggatgtgagtagg

SEQ ID NO: 2867 - DNA, 20 bp, Homo sapiens
cctctactggggcgaatacg

SEQ ID NO: 2868 - DNA, 22 bp, Homo sapiens
ctaacttgtgatccctggattt

SEQ ID NO: 2869 - DNA, 20 bp, Homo sapiens
ctagttgaatataacgggtt

SEQ ID NO: 2870 - DNA, 22 bp, Homo sapiens
ctactgggtgacaatactttgc

SEQ ID NO: 2871 - DNA, 23 bp, Homo sapiens
caggtcaatttttgaaggctttg

SEQ ID NO: 2872 - DNA, 20 bp, Homo sapiens
gaatcatatggaggtgcact

SEQ ID NO: 2873 - DNA, 20 bp, Homo sapiens
aatgctatggcagcatcaag

SEQ ID NO: 2874 - DNA, 22 bp, Homo sapiens
aagctgccagttcttcccagtt

SEQ ID NO: 2875 - DNA, 22 bp, Homo sapiens
gcatggcactcataactacatg

SEQ ID NO: 2876 - DNA, 20 bp, Homo sapiens
ctgacctatgagttgatcag

SEQ ID NO: 2877 - DNA, 23 bp, Homo sapiens
gtgcctgtttcagcaggaacagt

SEQ ID NO: 2878 - DNA, 20 bp, Homo sapiens
agctacattgtcaatcaggt

SEQ ID NO: 2879 - DNA, 20 bp, Homo sapiens
tggctcagttcagcacattg

SEQ ID NO: 2880 - DNA, 20 bp, Homo sapiens
gcatgctgagaatcatttta

SEQ ID NO: 2881 - DNA, 24 bp, Homo sapiens
gttcgagtcttctcctgacagtgg

SEQ ID NO: 2882 - DNA, 22 bp, Homo sapiens
aatgcaatgtctttatgggtga

SEQ ID NO: 2883 - DNA, 21 bp, Homo sapiens
gccggcgaccgcggcggcggc

SEQ ID NO: 2884 - DNA, 23 bp, Homo sapiens
atagcatagactgtgacaacagg

SEQ ID NO: 2885 - DNA, 20 bp, Homo sapiens
gatgcgactctgagctgagc

SEQ ID NO: 2886 - DNA, 22 bp, Homo sapiens
cctgtcatttccagagccttac

SEQ ID NO: 2887 - DNA, 20 bp, Homo sapiens
cgcgacctcagatcagcctg

SEQ ID NO: 2888 - DNA, 22 bp, Homo sapiens
tccagtctcaggatccttgtgt

SEQ ID NO: 2889 - DNA, 20 bp, Homo sapiens
gctacattgccaggcattac

SEQ ID NO: 2890 - DNA, 20 bp, Homo sapiens
tacctggttgatcctaacca

SEQ ID NO: 2891 - DNA, 20 bp, Homo sapiens
cagaggataaggccagtgag

SEQ ID NO: 2892 - DNA, 22 bp, Homo sapiens
aaaccctgctttggggatgatc

SEQ ID NO: 2893 - DNA, 22 bp, Homo sapiens
tagcttggcttcacactcagct

SEQ ID NO: 2894 - DNA, 22 bp, Homo sapiens
ttgcttatcagactagcaagat

SEQ ID NO: 2895 - DNA, 20 bp, Homo sapiens
tagaggtagtctgcagcacc

SEQ ID NO: 2896 - DNA, 23 bp, Homo sapiens
tacctggttgatcctgccagtta

SEQ ID NO: 2897 - DNA, 22 bp, Homo sapiens
ctcagtggttttgtttcctttc

SEQ ID NO: 2898 - DNA, 22 bp, Homo sapiens
tgtcagtcatctgtctaccaac

SEQ ID NO: 2899 - DNA, 22 bp, Homo sapiens
atccagttttcccagtccattt

SEQ ID NO: 2900 - DNA, 20 bp, Homo sapiens
tagctagtatctggctaatg

SEQ ID NO: 2901 - DNA, 22 bp, Homo sapiens
ctgcaatgaagtagtagcaatg

SEQ ID NO: 2902 - DNA, 20 bp, Homo sapiens
taaaggttgacctgtaaaaa

SEQ ID NO: 2903 - DNA, 22 bp, Homo sapiens
ttaacataacagtaataccata

SEQ ID NO: 2904 - DNA, 20 bp, Homo sapiens
caaggtcacgccattgcgct

SEQ ID NO: 2905 - DNA, 21 bp, Homo sapiens
agctgtctaatctacacctgc

SEQ ID NO: 2906 - DNA, 21 bp, Homo sapiens
gccatagatagtgtgtaaacc

SEQ ID NO: 2907 - DNA, 22 bp, Homo sapiens
acagtacagacgtgtaacccac

SEQ ID NO: 2908 - DNA, 23 bp, Homo sapiens
ccactgttagtctgatggagttc

SEQ ID NO: 2909 - DNA, 22 bp, Homo sapiens
gcaagtctcaaagccaggttta

SEQ ID NO: 2910 - DNA, 21 bp, Homo sapiens
acgagctgagtacagcctacc

SEQ ID NO: 2911 - DNA, 20 bp, Homo sapiens
tccctgttcaggcgccacct

SEQ ID NO: 2912 - DNA, 22 bp, Homo sapiens
attggcaaacagtgatactttg

SEQ ID NO: 2913 - DNA, 23 bp, Homo sapiens
tgataatagtagcactacttcac

SEQ ID NO: 2914 - DNA, 22 bp, Homo sapiens
acagatgggtgacatttgaatg

SEQ ID NO: 2915 - DNA, 22 bp, Homo sapiens
tagtgacggcggtctcgctatg

SEQ ID NO: 2916 - DNA, 22 bp, Homo sapiens
aaagtaccgttattactctcat

SEQ ID NO: 2917 - DNA, 20 bp, Homo sapiens
cttacctcaaaatgttctag

SEQ ID NO: 2918 - DNA, 22 bp, Homo sapiens
aggtctaatccattactagact

SEQ ID NO: 2919 - DNA, 22 bp, Homo sapiens
aggctccggtcacatcaaaggc

SEQ ID NO: 2920 - DNA, 22 bp, Homo sapiens
tccctgagaccctggctggaag

SEQ ID NO: 2921 - DNA, 21 bp, Homo sapiens
tgaggtagtagtttgttcctg

SEQ ID NO: 2922 - DNA, 20 bp, Homo sapiens
gcactctgctatcacctagt

SEQ ID NO: 2923 - DNA, 23 bp, Homo sapiens
ctgtctctccagatttggggaag

SEQ ID NO: 2924 - DNA, 20 bp, Homo sapiens
tctttaatgctcttgtcatt

SEQ ID NO: 2925 - DNA, 22 bp, Homo sapiens
tatgtgccatcaggctaaacca

SEQ ID NO: 2926 - DNA, 22 bp, Homo sapiens
tttctgagaccctaatttgtga

SEQ ID NO: 2927 - DNA, 21 bp, Homo sapiens
tagcttatctctgtgagatga

SEQ ID NO: 2928 - DNA, 23 bp, Homo sapiens
ttacttattgatgtgatgaacac

SEQ ID NO: 2929 - DNA, 22 bp, Homo sapiens
gtctcatcgcttggtgataggc

SEQ ID NO: 2930 - DNA, 20 bp, Homo sapiens
tagaggagaaaaatggtggt

SEQ ID NO: 2931 - DNA, 22 bp, Homo sapiens
ttaaatcctgtcgagtgctgct

SEQ ID NO: 2932 - DNA, 22 bp, Homo sapiens
cctgcttaacagtttatggggc

SEQ ID NO: 2933 - DNA, 23 bp, Homo sapiens
tttcaacagtataaatttgtctg

SEQ ID NO: 2934 - DNA, 23 bp, Homo sapiens
tgtagtgttgaagcagggcatga

SEQ ID NO: 2935 - DNA, 21 bp, Homo sapiens
actgcaaactcaactacccag

SEQ ID NO: 2936 - DNA, 22 bp, Homo sapiens
gctagaatcaagatgtcaccag

SEQ ID NO: 2937 - DNA, 22 bp, Homo sapiens
gccagatgctagactagtctct

SEQ ID NO: 2938 - DNA, 22 bp, Homo sapiens
gagtcatctgggatacttgtga

SEQ ID NO: 2939 - DNA, 23 bp, Homo sapiens
gctatgctacagtgtcaccccca

SEQ ID NO: 2940 - DNA, 21 bp, Homo sapiens
ccagagaatggggagaagcag

SEQ ID NO: 2941 - DNA, 20 bp, Homo sapiens
ggtctggatctatcttcgtg

SEQ ID NO: 2942 - DNA, 21 bp, Homo sapiens
caacaatttagttttgtcttg

SEQ ID NO: 2943 - DNA, 20 bp, Homo sapiens
cggcggcccgggcgccccgg

SEQ ID NO: 2944 - DNA, 21 bp, Homo sapiens
aataaggcctgccacactgtg

SEQ ID NO: 2945 - DNA, 23 bp, Homo sapiens
agcagcatttattgaatagcgag

SEQ ID NO: 2946 - DNA, 23 bp, Homo sapiens
ttcacagattagcctggacgcaa

SEQ ID NO: 2947 - DNA, 22 bp, Homo sapiens
tgtagactggactagaaggcag

SEQ ID NO: 2948 - DNA, 23 bp, Homo sapiens
ttgagtgctgcactgtactcatg

SEQ ID NO: 2949 - DNA, 21 bp, Homo sapiens
aggcaatgttcatggcctact

SEQ ID NO: 2950 - DNA, 22 bp, Homo sapiens
tagactgggcaacttataaaaa

SEQ ID NO: 2951 - DNA, 23 bp, Homo sapiens
ggatattgtcatatggtgatgag

SEQ ID NO: 2952 - DNA, 23 bp, Homo sapiens
taaggaacccagaaatactgtgg

SEQ ID NO: 2953 - DNA, 22 bp, Homo sapiens
tagtttatcagactggcaaatc

SEQ ID NO: 2954 - DNA, 22 bp, Homo sapiens
ttagcttaatcactaggctata

SEQ ID NO: 2955 - DNA, 23 bp, Homo sapiens
ggttagtttcagcatgcaactgg

SEQ ID NO: 2956 - DNA, 22 bp, Homo sapiens
gccccagagtcctagtccacat

SEQ ID NO: 2957 - DNA, 21 bp, Homo sapiens
ttgttaaccgttgaaggttga

SEQ ID NO: 2958 - DNA, 22 bp, Homo sapiens
atcagtttgctgaatcaaacag

SEQ ID NO: 2959 - DNA, 21 bp, Homo sapiens
ctgcaatgttcatggcatggc

SEQ ID NO: 2960 - DNA, 20 bp, Homo sapiens
gtccagttttcccaagagga

SEQ ID NO: 2961 - DNA, 22 bp, Homo sapiens
ttgattgcacagtttatttggt

SEQ ID NO: 2962 - DNA, 21 bp, Homo sapiens
taaataatgatttggccatat

SEQ ID NO: 2963 - DNA, 22 bp, Homo sapiens
cagaccccaatacaaaaataac

SEQ ID NO: 2964 - DNA, 21 bp, Homo sapiens
atcaatggcaacatactgagt

SEQ ID NO: 2965 - DNA, 22 bp, Homo sapiens
tcgatccccagtacctggtgtt

SEQ ID NO: 2966 - DNA, 22 bp, Homo sapiens
ttataaggtgagagtttacttg

SEQ ID NO: 2967 - DNA, 22 bp, Homo sapiens
tcagatgaagcactgtggccag

SEQ ID NO: 2968 - DNA, 21 bp, Homo sapiens
tttgagctccagatttgtcct

SEQ ID NO: 2969 - DNA, 23 bp, Homo sapiens
aagcttatactcacagcagaaga

SEQ ID NO: 2970 - DNA, 22 bp, Homo sapiens
atcgtgccattgccctccaggc

SEQ ID NO: 2971 - DNA, 22 bp, Homo sapiens
tgagtcaccgatggtataaaac

SEQ ID NO: 2972 - DNA, 21 bp, Homo sapiens
gatcgtgccactgtagtccaa

SEQ ID NO: 2973 - DNA, 20 bp, Homo sapiens
cccagccgagctccagcact

SEQ ID NO: 2974 - DNA, 24 bp, Homo sapiens
tgcagagaaaggctcttcctgaat

SEQ ID NO: 2975 - DNA, 21 bp, Homo sapiens
gtcacagtggctaagtaaatc

SEQ ID NO: 2976 - DNA, 20 bp, Homo sapiens
ggttcagtggtaaagtgctt

SEQ ID NO: 2977 - DNA, 22 bp, Homo sapiens
tcgatggcactcaaatacacct

SEQ ID NO: 2978 - DNA, 23 bp, Homo sapiens
tagcttgtcagagcagcaacaac

SEQ ID NO: 2979 - DNA, 22 bp, Homo sapiens
atagctgccactgggtgggggt

SEQ ID NO: 2980 - DNA, 23 bp, Homo sapiens
caaagtgctacactgttctcatc

SEQ ID NO: 2981 - DNA, 23 bp, Homo sapiens
caaagtgcttacagcataggaag

SEQ ID NO: 2982 - DNA, 22 bp, Homo sapiens
aatgtgtcatcgaaagccaggt

SEQ ID NO: 2983 - DNA, 23 bp, Homo sapiens
ctgcaacagctgacaactacact

SEQ ID NO: 2984 - DNA, 20 bp, Homo sapiens
catatgatcaaagaccaagg

SEQ ID NO: 2985 - DNA, 23 bp, Homo sapiens
cccagtgggactcagtgctgtta

SEQ ID NO: 2986 - DNA, 20 bp, Homo sapiens
agcccaccgctgccaccact

SEQ ID NO: 2987 - DNA, 21 bp, Homo sapiens
cggcaatgagctaatggcata

SEQ ID NO: 2988 - DNA, 20 bp, Homo sapiens
cggccccggcggcgggggca

SEQ ID NO: 2989 - DNA, 21 bp, Homo sapiens
agaccgaagttttttttagac

SEQ ID NO: 2990 - DNA, 23 bp, Homo sapiens
ccgatggcacagtttatttttca

SEQ ID NO: 2991 - DNA, 21 bp, Homo sapiens
gtctgaaacagtttcgttttc

SEQ ID NO: 2992 - DNA, 20 bp, Homo sapiens
cagtatccagagctttcttt

SEQ ID NO: 2993 - DNA, 22 bp, Homo sapiens
aaaaatgtctaggcttggtgtg

SEQ ID NO: 2994 - DNA, 20 bp, Homo sapiens
tgaggtagtaggttggtccc

SEQ ID NO: 2995 - DNA, 22 bp, Homo sapiens
caaggtgcagagcagcatatat

SEQ ID NO: 2996 - DNA, 22 bp, Homo sapiens
gggggagaaggggcgggtccac

SEQ ID NO: 2997 - DNA, 22 bp, Homo sapiens
ggacagtaagaattgatagatg

SEQ ID NO: 2998 - DNA, 21 bp, Homo sapiens
ttatctgactcagcaggacac

SEQ ID NO: 2999 - DNA, 21 bp, Homo sapiens
gtctcactatagcgcgcaggc

SEQ ID NO: 3000 - DNA, 21 bp, Homo sapiens
atcatgctcagggtaggtgca

SEQ ID NO: 3001 - DNA, 22 bp, Homo sapiens
tctgccaacccttgtacctcca

SEQ ID NO: 3002 - DNA, 24 bp, Homo sapiens
ggctgctaaatgcttttacatggt

SEQ ID NO: 3003 - DNA, 20 bp, Homo sapiens
cataccactgcgccatccaa

SEQ ID NO: 3004 - DNA, 22 bp, Homo sapiens
actctttccctgttgcactaca

SEQ ID NO: 3005 - DNA, 23 bp, Homo sapiens
cctcagttttcccaggagtccct

SEQ ID NO: 3006 - DNA, 21 bp, Homo sapiens
gtggggggcggttcaggaaga

SEQ ID NO: 3007 - DNA, 22 bp, Homo sapiens
cagagtgtgtctttatggggta

SEQ ID NO: 3008 - DNA, 22 bp, Homo sapiens
tctgatgggtgacaatgttttg

SEQ ID NO: 3009 - DNA, 20 bp, Homo sapiens
gagaacccatgagataattg

SEQ ID NO: 3010 - DNA, 22 bp, Homo sapiens
tgatgacatgactacgattggt

SEQ ID NO: 3011 - DNA, 20 bp, Homo sapiens
ctgagaagatgttttggtaa

SEQ ID NO: 3012 - DNA, 22 bp, Homo sapiens
tgtagactttctccatcttgga

SEQ ID NO: 3013 - DNA, 20 bp, Homo sapiens
aaccccttaggctgacaact

SEQ ID NO: 3014 - DNA, 23 bp, Homo sapiens
aatgatggggtacaggaagccct

SEQ ID NO: 3015 - DNA, 21 bp, Homo sapiens
ccgcgccgccctccacctcgg

SEQ ID NO: 3016 - DNA, 20 bp, Homo sapiens
ctgacctatgaattgattta

SEQ ID NO: 3017 - DNA, 21 bp, Homo sapiens
atcacattgggtcttctatgg

SEQ ID NO: 3018 - DNA, 21 bp, Homo sapiens
caatttgagctaaaatttggg

SEQ ID NO: 3019 - DNA, 22 bp, Homo sapiens
attctgactaatacaaatgtca

SEQ ID NO: 3020 - DNA, 22 bp, Homo sapiens
tgacagtttgtcaaatatttga

SEQ ID NO: 3021 - DNA, 20 bp, Homo sapiens
gtccagttttcccgtgaatt

SEQ ID NO: 3022 - DNA, 21 bp, Homo sapiens
gtgggatgctataggataaca

SEQ ID NO: 3023 - DNA, 21 bp, Homo sapiens
cactgcaattggcaaaggagt

SEQ ID NO: 3024 - DNA, 23 bp, Homo sapiens
gtccagttttcccagcagcattt

SEQ ID NO: 3025 - DNA, 22 bp, Homo sapiens
tagctggtaaactttagtggga

SEQ ID NO: 3026 - DNA, 21 bp, Homo sapiens
cccagttgttggactgaagct

SEQ ID NO: 3027 - DNA, 23 bp, Homo sapiens
aggctacatgatctccctactgt

SEQ ID NO: 3028 - DNA, 20 bp, Homo sapiens
tttggcaatggattaatgga

SEQ ID NO: 3029 - DNA, 22 bp, Homo sapiens
cgtgcaaaagccagcaggctta

SEQ ID NO: 3030 - DNA, 20 bp, Homo sapiens
tactttgactacttggaggt

SEQ ID NO: 3031 - DNA, 20 bp, Homo sapiens
tggggcaacacacgtgttca

SEQ ID NO: 3032 - DNA, 22 bp, Homo sapiens
gaggacaacagaaataccccac

SEQ ID NO: 3033 - DNA, 22 bp, Homo sapiens
tgtcagtgacagtttaccccca

SEQ ID NO: 3034 - DNA, 22 bp, Homo sapiens
tagcttaatgagtgaggtttga

SEQ ID NO: 3035 - DNA, 20 bp, Homo sapiens
attttgttatagccaccata

SEQ ID NO: 3036 - DNA, 22 bp, Homo sapiens
gatgcaatgtctgcattatata

SEQ ID NO: 3037 - DNA, 22 bp, Homo sapiens
tagcaccatttgagatctggtc

SEQ ID NO: 3038 - DNA, 21 bp, Homo sapiens
gaagtcattaacacggagctc

SEQ ID NO: 3039 - DNA, 21 bp, Homo sapiens
ctgcacaccacacgcagcctc

SEQ ID NO: 3040 - DNA, 24 bp, Homo sapiens
taactctcctgacctatcaaatgc

SEQ ID NO: 3041 - DNA, 22 bp, Homo sapiens
gtcatctatcttgaaatagatg

SEQ ID NO: 3042 - DNA, 23 bp, Homo sapiens
tgtggatacttacagtatggttt

SEQ ID NO: 3043 - DNA, 21 bp, Homo sapiens
ctagactgaagctccccagaa

SEQ ID NO: 3044 - DNA, 22 bp, Homo sapiens
tgagtcgaataggggtgtttta

SEQ ID NO: 3045 - DNA, 22 bp, Homo sapiens
ttctgaaatttccttcttgacc

SEQ ID NO: 3046 - DNA, 21 bp, Homo sapiens
caagctcaggtgttgggtcca

SEQ ID NO: 3047 - DNA, 23 bp, Homo sapiens
aacagcataaggttaatgccata

SEQ ID NO: 3048 - DNA, 22 bp, Homo sapiens
tagcacaaagagaaatattggc

SEQ ID NO: 3049 - DNA, 22 bp, Homo sapiens
aaaccaccaccatatgagagtt

SEQ ID NO: 3050 - DNA, 21 bp, Homo sapiens
gcctctaccatttctaattac

SEQ ID NO: 3051 - DNA, 23 bp, Homo sapiens
catgcaaatccatgcaaacagaa

SEQ ID NO: 3052 - DNA, 23 bp, Homo sapiens
agctacattgtctgcttctggcc

SEQ ID NO: 3053 - DNA, 20 bp, Homo sapiens
cacaagactgtgtaaggaaa

SEQ ID NO: 3054 - DNA, 21 bp, Homo sapiens
tctctacaaaaaaattaagcc

SEQ ID NO: 3055 - DNA, 23 bp, Homo sapiens
tgagatgagatgccacgatggtg

SEQ ID NO: 3056 - DNA, 21 bp, Homo sapiens
ccacgcccggggcattttttg

SEQ ID NO: 3057 - DNA, 20 bp, Homo sapiens
actgctttacaatcaccatg

SEQ ID NO: 3058 - DNA, 22 bp, Homo sapiens
gatggtcaaactggatgctccc

SEQ ID NO: 3059 - DNA, 22 bp, Homo sapiens
tttggcaatggatttgcactgg

SEQ ID NO: 3060 - DNA, 22 bp, Homo sapiens
ttccctgccgaactctatcaaa

SEQ ID NO: 3061 - DNA, 21 bp, Homo sapiens
ctgacctattaattgagagag

SEQ ID NO: 3062 - DNA, 22 bp, Homo sapiens
gcgcaagcgcctttgagatagg

SEQ ID NO: 3063 - DNA, 22 bp, Homo sapiens
aatgcaattggagggatttggc

SEQ ID NO: 3064 - DNA, 22 bp, Homo sapiens
tccagtctcagctaatttgtga

SEQ ID NO: 3065 - DNA, 21 bp, Homo sapiens
tgaggtagtaggttgtacttg

SEQ ID NO: 3066 - DNA, 22 bp, Homo sapiens
ctgaccagcaggccagtggatt

SEQ ID NO: 3067 - DNA, 20 bp, Homo sapiens
gactatttgtagaggcccta

SEQ ID NO: 3068 - DNA, 22 bp, Homo sapiens
aagtgatacggagaagcaggct

SEQ ID NO: 3069 - DNA, 22 bp, Homo sapiens
tcattagactgaaaagaaaccc

SEQ ID NO: 3070 - DNA, 21 bp, Homo sapiens
atcatggaggaaattccacat

SEQ ID NO: 3071 - DNA, 22 bp, Homo sapiens
cgccgctttctgggctcgctca

SEQ ID NO: 3072 - DNA, 23 bp, Homo sapiens
cgtgcggcggcggcggcggcatc

SEQ ID NO: 3073 - DNA, 20 bp, Homo sapiens
tagcaccatttggaatcaaa

SEQ ID NO: 3074 - DNA, 21 bp, Homo sapiens
agctgtggaaagtggatgctg

SEQ ID NO: 3075 - DNA, 20 bp, Homo sapiens
gcattggtggttcagttttt

SEQ ID NO: 3076 - DNA, 22 bp, Homo sapiens
ttgttcaaatccagataaggct

SEQ ID NO: 3077 - DNA, 21 bp, Homo sapiens
ctgtggtgaattaacctcttg

SEQ ID NO: 3078 - DNA, 22 bp, Homo sapiens
tcatggtgtttcacatgactgt

SEQ ID NO: 3079 - DNA, 23 bp, Homo sapiens
tggggtagtagtttgtgctgcag

SEQ ID NO: 3080 - DNA, 22 bp, Homo sapiens
tgctaagtttagttttctattg

SEQ ID NO: 3081 - DNA, 22 bp, Homo sapiens
tatcagaattcatatctataaa

SEQ ID NO: 3082 - DNA, 23 bp, Homo sapiens
gtcaccatagctgggctcattgg

SEQ ID NO: 3083 - DNA, 20 bp, Homo sapiens
tcccacatggtctagcgtcc

SEQ ID NO: 3084 - DNA, 23 bp, Homo sapiens
tcttaatatgctgtgatgggcca

SEQ ID NO: 3085 - DNA, 20 bp, Homo sapiens
gatcgatgtggtgacatcat

SEQ ID NO: 3086 - DNA, 21 bp, Homo sapiens
tgataccatctgaatagccac

SEQ ID NO: 3087 - DNA, 23 bp, Homo sapiens
aggagtctacaaattctacacat

SEQ ID NO: 3088 - DNA, 22 bp, Homo sapiens
tgctgtgggaagcagcatggca

SEQ ID NO: 3089 - DNA, 23 bp, Homo sapiens
cacctgaaggcactgtactcgct

SEQ ID NO: 3090 - DNA, 23 bp, Homo sapiens
tgtggtttattgcagttttaata

SEQ ID NO: 3091 - DNA, 21 bp, Homo sapiens
ctagctgcgagaatgctgcca

SEQ ID NO: 3092 - DNA, 20 bp, Homo sapiens
gctactgtgcatttctaacc

SEQ ID NO: 3093 - DNA, 24 bp, Homo sapiens
agatatatgtcctataacagcatc

SEQ ID NO: 3094 - DNA, 23 bp, Homo sapiens
ggacctgcagccagatatctaga

SEQ ID NO: 3095 - DNA, 20 bp, Homo sapiens
tgagatgaagacagtgctgg

SEQ ID NO: 3096 - DNA, 20 bp, Homo sapiens
ttcatatctaatttaaaggg

SEQ ID NO: 3097 - DNA, 22 bp, Homo sapiens
ctctaaccagggtggcatgatc

SEQ ID NO: 3098 - DNA, 22 bp, Homo sapiens
cccggagggcgaggcccggagg

SEQ ID NO: 3099 - DNA, 22 bp, Homo sapiens
ccaaatgctgctttggtcctgt

SEQ ID NO: 3100 - DNA, 20 bp, Homo sapiens
tagagtagtagtttgtagtt

SEQ ID NO: 3101 - DNA, 21 bp, Homo sapiens
agcagctactcacagtctctg

SEQ ID NO: 3102 - DNA, 22 bp, Homo sapiens
tcttcatctgagatgatgttgg

SEQ ID NO: 3103 - DNA, 22 bp, Homo sapiens
cccaatggcaaggtactgatgg

SEQ ID NO: 3104 - DNA, 22 bp, Homo sapiens
accacagggtagccaacagttt

SEQ ID NO: 3105 - DNA, 22 bp, Homo sapiens
acttgaccctttgagggctttc

SEQ ID NO: 3106 - DNA, 23 bp, Homo sapiens
caggaataggagtatcgtggctt

SEQ ID NO: 3107 - DNA, 22 bp, Homo sapiens
ttagctttactgctgcccgttg

SEQ ID NO: 3108 - DNA, 22 bp, Homo sapiens
tgagtcagtgtcaaatatccag

SEQ ID NO: 3109 - DNA, 23 bp, Homo sapiens
tcagggtgtttctgtacctcact

SEQ ID NO: 3110 - DNA, 22 bp, Homo sapiens
acgtcgttacctaatatgagtg

SEQ ID NO: 3111 - DNA, 23 bp, Homo sapiens
aataatgctgcttaaacttgtga

SEQ ID NO: 3112 - DNA, 20 bp, Homo sapiens
gtccagttttcccatgataa

SEQ ID NO: 3113 - DNA, 21 bp, Homo sapiens
attttgccattgaaagctctg

SEQ ID NO: 3114 - DNA, 21 bp, Homo sapiens
aggtaatatgtctggctagag

SEQ ID NO: 3115 - DNA, 20 bp, Homo sapiens
cagctgtgcagaaaaaaaaa

SEQ ID NO: 3116 - DNA, 20 bp, Homo sapiens
ataccgccttgtccatctgc

SEQ ID NO: 3117 - DNA, 23 bp, Homo sapiens
gtgtgactttcagcaggacactt

SEQ ID NO: 3118 - DNA, 20 bp, Homo sapiens
actccactcctgggcaacgt

SEQ ID NO: 3119 - DNA, 21 bp, Homo sapiens
atgccaacaacccagtaacaa

SEQ ID NO: 3120 - DNA, 23 bp, Homo sapiens
tagtggtaacagtttacaaaaca

SEQ ID NO: 3121 - DNA, 23 bp, Homo sapiens
gttttttaccttttttcttcttc

SEQ ID NO: 3122 - DNA, 23 bp, Homo sapiens
tccatgttaggtacgtgggtcag

SEQ ID NO: 3123 - DNA, 21 bp, Homo sapiens
ccaataatgaaaactacatat

SEQ ID NO: 3124 - DNA, 22 bp, Homo sapiens
tcgaatccgagtcacagcacca

SEQ ID NO: 3125 - DNA, 23 bp, Homo sapiens
tagctggtaatgaaatcctgtgg

SEQ ID NO: 3126 - DNA, 22 bp, Homo sapiens
taggaagctggaacatgtggtg

SEQ ID NO: 3127 - DNA, 21 bp, Homo sapiens
cgccaccatctaggtagcacc

SEQ ID NO: 3128 - DNA, 22 bp, Homo sapiens
tagcttatcatcagtaacactg

SEQ ID NO: 3129 - DNA, 22 bp, Homo sapiens
ctatagggcaggtatcttgttt

SEQ ID NO: 3130 - DNA, 20 bp, Homo sapiens
atagttgctcaggtataacc

SEQ ID NO: 3131 - DNA, 20 bp, Homo sapiens
agtcaaggccttaactttgg

SEQ ID NO: 3132 - DNA, 20 bp, Homo sapiens
ataagagcaaatattataag

SEQ ID NO: 3133 - DNA, 21 bp, Homo sapiens
cttacaggctacagagaacac

SEQ ID NO: 3134 - DNA, 22 bp, Homo sapiens
agatgtacattctttataaggc

SEQ ID NO: 3135 - DNA, 22 bp, Homo sapiens
agctaagggaggactgcagcca

SEQ ID NO: 3136 - DNA, 22 bp, Homo sapiens
tgacagtaatgacttcccttgc

SEQ ID NO: 3137 - DNA, 21 bp, Homo sapiens
gaggtcaaaagggtccaattt

SEQ ID NO: 3138 - DNA, 20 bp, Homo sapiens
tcttttctgtggggggtggt

SEQ ID NO: 3139 - DNA, 21 bp, Homo sapiens
tgagtgtgtgtgtgtcagtgt

SEQ ID NO: 3140 - DNA, 20 bp, Homo sapiens
gaatgccgtggaggtggtaa

SEQ ID NO: 3141 - DNA, 20 bp, Homo sapiens
ctgactcgcaggccagggtt

SEQ ID NO: 3142 - DNA, 23 bp, Homo sapiens
tgtcagaactgctttatggggtt

SEQ ID NO: 3143 - DNA, 22 bp, Homo sapiens
tctgaccacctgggcgtcccaa

SEQ ID NO: 3144 - DNA, 21 bp, Homo sapiens
tcttgagccctttgaaggctg

SEQ ID NO: 3145 - DNA, 20 bp, Homo sapiens
gagcaagctgttcttccctc

SEQ ID NO: 3146 - DNA, 23 bp, Homo sapiens
ccgacacaggtgtggttttagag

SEQ ID NO: 3147 - DNA, 23 bp, Homo sapiens
aggtatcctcccactttagcctc

SEQ ID NO: 3148 - DNA, 23 bp, Homo sapiens
ttgttttatatatattatctatt

SEQ ID NO: 3149 - DNA, 22 bp, Homo sapiens
ctaggcaaacagtttatgattg

SEQ ID NO: 3150 - DNA, 20 bp, Homo sapiens
gagaagcggctgtgcaccca

SEQ ID NO: 3151 - DNA, 23 bp, Homo sapiens
tgtcgtttaggtaacaggtgaga

SEQ ID NO: 3152 - DNA, 20 bp, Homo sapiens
tataggctcagactgaagtt

SEQ ID NO: 3153 - DNA, 21 bp, Homo sapiens
cctccaaatttccttcttgtc

SEQ ID NO: 3154 - DNA, 20 bp, Homo sapiens
ccaatacggagcagtactgc

SEQ ID NO: 3155 - DNA, 22 bp, Homo sapiens
atcacgttgcctccagcgcttg

SEQ ID NO: 3156 - DNA, 24 bp, Homo sapiens
ccgggtcggagttagctcaagcgg

SEQ ID NO: 3157 - DNA, 21 bp, Homo sapiens
gccccactcgcgggcccagtc

SEQ ID NO: 3158 - DNA, 20 bp, Homo sapiens
aacttgtaacgctatttgta

SEQ ID NO: 3159 - DNA, 20 bp, Homo sapiens
agcatttcctacttcaaagg

SEQ ID NO: 3160 - DNA, 20 bp, Homo sapiens
agcggtcctgacacatgagc

SEQ ID NO: 3161 - DNA, 22 bp, Homo sapiens
ttgactgggctgtgtttcccca

SEQ ID NO: 3162 - DNA, 20 bp, Homo sapiens
gtcggaattagaggagattg

SEQ ID NO: 3163 - DNA, 23 bp, Homo sapiens
cagtatggcacatgcctttatct

SEQ ID NO: 3164 - DNA, 22 bp, Homo sapiens
taactaactgagagatactgta

SEQ ID NO: 3165 - DNA, 22 bp, Homo sapiens
tgtatctttcagtttatgggac

SEQ ID NO: 3166 - DNA, 22 bp, Homo sapiens
gccctgagacctcagtccacaa

SEQ ID NO: 3167 - DNA, 23 bp, Homo sapiens
gccgcagtgtccgcgaacagcag

SEQ ID NO: 3168 - DNA, 24 bp, Homo sapiens
gcggcggcggcggcgcgcccccgc

SEQ ID NO: 3169 - DNA, 21 bp, Homo sapiens
aggcttctacctggcttagct

SEQ ID NO: 3170 - DNA, 20 bp, Homo sapiens
gtctacttcaaattcctccc

SEQ ID NO: 3171 - DNA, 21 bp, Homo sapiens
aagagcaccaccaggagtatc

SEQ ID NO: 3172 - DNA, 21 bp, Homo sapiens
agcagcccacaccatcccttg

SEQ ID NO: 3173 - DNA, 23 bp, Homo sapiens
taccccaggatgccagcatagtt

SEQ ID NO: 3174 - DNA, 23 bp, Homo sapiens
ctccagataagggtccttaggag

SEQ ID NO: 3175 - DNA, 20 bp, Homo sapiens
agactgcacgtccgattgac

SEQ ID NO: 3176 - DNA, 23 bp, Homo sapiens
agcataggctttgtttcctccac

SEQ ID NO: 3177 - DNA, 24 bp, Homo sapiens
tccctgagaccagacatctcagaa

SEQ ID NO: 3178 - DNA, 20 bp, Homo sapiens
ccgcgaggggggcccaagtt

SEQ ID NO: 3179 - DNA, 21 bp, Homo sapiens
cccaggtccccagtgcgcccc

SEQ ID NO: 3180 - DNA, 22 bp, Homo sapiens
tagctgctgctgatgaagtgct

SEQ ID NO: 3181 - DNA, 21 bp, Homo sapiens
caatgagcgaaagcttttacc

SEQ ID NO: 3182 - DNA, 21 bp, Homo sapiens
tgagatgaagcacgtgcaacg

SEQ ID NO: 3183 - DNA, 21 bp, Homo sapiens
ctgacctatgaatcaaaggac

SEQ ID NO: 3184 - DNA, 22 bp, Homo sapiens
gaagtctctgggatcaggctgg

SEQ ID NO: 3185 - DNA, 20 bp, Homo sapiens
atttttctgtggggggtggg

SEQ ID NO: 3186 - DNA, 22 bp, Homo sapiens
tgtcagtttggatttatgggtt

SEQ ID NO: 3187 - DNA, 21 bp, Homo sapiens
tgaaggtattatacagcagtg

SEQ ID NO: 3188 - DNA, 23 bp, Homo sapiens
gggccacgctccagttgtattca

SEQ ID NO: 3189 - DNA, 23 bp, Homo sapiens
ggtagttatggtgatggtgttgt

SEQ ID NO: 3190 - DNA, 22 bp, Homo sapiens
aatgtaaatccatgcagtctgg

SEQ ID NO: 3191 - DNA, 23 bp, Homo sapiens
ttcacagttcagcctaaggcaaa

SEQ ID NO: 3192 - DNA, 21 bp, Homo sapiens
tagctttagtctgactctcat

SEQ ID NO: 3193 - DNA, 23 bp, Homo sapiens
cattgccactttaaacactacct

SEQ ID NO: 3194 - DNA, 20 bp, Homo sapiens
atccctgaagactgtggttt

SEQ ID NO: 3195 - DNA, 22 bp, Homo sapiens
ccagggtagtagccatttgact

SEQ ID NO: 3196 - DNA, 23 bp, Homo sapiens
gatgatgaacagtttatggggtt

SEQ ID NO: 3197 - DNA, 21 bp, Homo sapiens
gcatggcagctaaaaccccaa

SEQ ID NO: 3198 - DNA, 21 bp, Homo sapiens
agccatcaacttggtctatca

SEQ ID NO: 3199 - DNA, 21 bp, Homo sapiens
tgatagaccaagttgatggct

SEQ ID NO: 3200 - DNA, 23 bp, Homo sapiens
gtgtacataggtagaatgacttc

SEQ ID NO: 3201 - DNA, 22 bp, Homo sapiens
attaataatggtaatagtagtt

SEQ ID NO: 3202 - DNA, 22 bp, Homo sapiens
agagagagatgggaaatagaac

SEQ ID NO: 3203 - DNA, 23 bp, Homo sapiens
atgcagcacagaccctcaaaacc

SEQ ID NO: 3204 - DNA, 20 bp, Homo sapiens
acatctatggcagcatcaac

SEQ ID NO: 3205 - DNA, 22 bp, Homo sapiens
ggagctggtgagttatggggtt

SEQ ID NO: 3206 - DNA, 23 bp, Homo sapiens
agcagcattgcacaggaagcacc

SEQ ID NO: 3207 - DNA, 22 bp, Homo sapiens
cccagggcgcaccaccggcccg

SEQ ID NO: 3208 - DNA, 21 bp, Homo sapiens
tacctggttgatcctgccagc

SEQ ID NO: 3209 - DNA, 20 bp, Homo sapiens
ggggaacgctgtgctgtagg

SEQ ID NO: 3210 - DNA, 23 bp, Homo sapiens
tgtggcttttcattcctaagagt

SEQ ID NO: 3211 - DNA, 20 bp, Homo sapiens
atatgtaacggtccctgtgt

SEQ ID NO: 3212 - DNA, 21 bp, Homo sapiens
cctctggtaaaggaagaaatg

SEQ ID NO: 3213 - DNA, 22 bp, Homo sapiens
cagcagcaaggacgtgaggttt

SEQ ID NO: 3214 - DNA, 23 bp, Homo sapiens
tggctcagaagagcaggactgtc

SEQ ID NO: 3215 - DNA, 20 bp, Homo sapiens
ggttccagctgtgctattta

SEQ ID NO: 3216 - DNA, 20 bp, Homo sapiens
agggactctgggatgtacag

SEQ ID NO: 3217 - DNA, 20 bp, Homo sapiens
cctaggtagaaggcctttga

SEQ ID NO: 3218 - DNA, 20 bp, Homo sapiens
ggtggatgaaaaaataaagc

SEQ ID NO: 3219 - DNA, 20 bp, Homo sapiens
aagtgtcactagcacaaggc

SEQ ID NO: 3220 - DNA, 21 bp, Homo sapiens
aggttaaatggtttatccagt

SEQ ID NO: 3221 - DNA, 24 bp, Homo sapiens
gaactagcgtttcaattgagtgtc

SEQ ID NO: 3222 - DNA, 24 bp, Homo sapiens
taagtagatacttttcttgctata

SEQ ID NO: 3223 - DNA, 22 bp, Homo sapiens
acaacagtgccaacctcacagg

SEQ ID NO: 3224 - DNA, 23 bp, Homo sapiens
tggctcagggactaaggtactga

SEQ ID NO: 3225 - DNA, 20 bp, Homo sapiens
tctccatcatccaagatcta

SEQ ID NO: 3226 - DNA, 20 bp, Homo sapiens
ggcgcgccccccccacccaa

SEQ ID NO: 3227 - DNA, 24 bp, Homo sapiens
aggcccaccccagatatactgaat

SEQ ID NO: 3228 - DNA, 22 bp, Homo sapiens
gcttgattttagtgaaggcttt

SEQ ID NO: 3229 - DNA, 21 bp, Homo sapiens
gctacaattcaacccacttca

SEQ ID NO: 3230 - DNA, 22 bp, Homo sapiens
tccttagcagaggaagaagcta

SEQ ID NO: 3231 - DNA, 20 bp, Homo sapiens
taaaatatgctcttgtttgt

SEQ ID NO: 3232 - DNA, 22 bp, Homo sapiens
gagaaaccaacttgtgttgaca

SEQ ID NO: 3233 - DNA, 22 bp, Homo sapiens
tgtcagttatgcaaaatggggt

SEQ ID NO: 3234 - DNA, 21 bp, Homo sapiens
attccgcaaatagtccaggca

SEQ ID NO: 3235 - DNA, 22 bp, Homo sapiens
caagtttttgtcaaatatgggt

SEQ ID NO: 3236 - DNA, 20 bp, Homo sapiens
gcggggctgcacgcgcgctt

SEQ ID NO: 3237 - DNA, 20 bp, Homo sapiens
tctctcattaggtttataaa

SEQ ID NO: 3238 - DNA, 22 bp, Homo sapiens
gtcctcaaaagggtggaatttt

SEQ ID NO: 3239 - DNA, 20 bp, Homo sapiens
caacctccgagcagatgcca

SEQ ID NO: 3240 - DNA, 21 bp, Homo sapiens
gtactgggtagtttctggggt

SEQ ID NO: 3241 - DNA, 21 bp, Homo sapiens
gatggattagggaggtgttcg

SEQ ID NO: 3242 - DNA, 20 bp, Homo sapiens
ccttccaattacacagcagt

SEQ ID NO: 3243 - DNA, 23 bp, Homo sapiens
gcttctgtttcccaaaggctttc

SEQ ID NO: 3244 - DNA, 22 bp, Homo sapiens
tccttaggggaaaaagaacaag

SEQ ID NO: 3245 - DNA, 20 bp, Homo sapiens
ctcttcctaatggatatcct

SEQ ID NO: 3246 - DNA, 20 bp, Homo sapiens
gctgtaacccactttctttt

SEQ ID NO: 3247 - DNA, 23 bp, Homo sapiens
gtccagccctggtgaaggctttg

SEQ ID NO: 3248 - DNA, 20 bp, Homo sapiens
tagtgttggggtcttagtca

SEQ ID NO: 3249 - DNA, 23 bp, Homo sapiens
tatcagttcactgggcacaacaa

SEQ ID NO: 3250 - DNA, 20 bp, Homo sapiens
cgtggcattgcactccggcc

SEQ ID NO: 3251 - DNA, 22 bp, Homo sapiens
ctcctgactccaggtcctgact

SEQ ID NO: 3252 - DNA, 20 bp, Homo sapiens
aatcagaggctattgttttg

SEQ ID NO: 3253 - DNA, 21 bp, Homo sapiens
cccctaatgaaaactgcatat

SEQ ID NO: 3254 - DNA, 22 bp, Homo sapiens
ttgcttatctctgaagcattga

SEQ ID NO: 3255 - DNA, 23 bp, Homo sapiens
ggtgattattctggcccatgtta

SEQ ID NO: 3256 - DNA, 22 bp, Homo sapiens
cacagtttcagtttatggggtt

SEQ ID NO: 3257 - DNA, 24 bp, Homo sapiens
atcacattagtgaggatttccatt

SEQ ID NO: 3258 - DNA, 22 bp, Homo sapiens
tttttcatttccaggataggtc

SEQ ID NO: 3259 - DNA, 22 bp, Homo sapiens
tatatggtaaacttttgtcaca

SEQ ID NO: 3260 - DNA, 23 bp, Homo sapiens
tgtcagtaactcaaataagtgta

SEQ ID NO: 3261 - DNA, 22 bp, Homo sapiens
ggtagtatcggtctgatggaac

SEQ ID NO: 3262 - DNA, 22 bp, Homo sapiens
tcagagtttgtcaaatattttc

SEQ ID NO: 3263 - DNA, 20 bp, Homo sapiens
ctctacaaaaaaattaaatg

SEQ ID NO: 3264 - DNA, 20 bp, Homo sapiens
tttttagtaaagagccaata

SEQ ID NO: 3265 - DNA, 23 bp, Homo sapiens
acagctcccacagggtaccccac

SEQ ID NO: 3266 - DNA, 20 bp, Homo sapiens
tggtaaggctttcccctcac

SEQ ID NO: 3267 - DNA, 23 bp, Homo sapiens
agcagccccaggtgaaggagcat

SEQ ID NO: 3268 - DNA, 24 bp, Homo sapiens
ggcggcgggcggcgggcggcgggg

SEQ ID NO: 3269 - DNA, 24 bp, Homo sapiens
ggcttctttacagtgctgccttgt

SEQ ID NO: 3270 - DNA, 20 bp, Homo sapiens
aggctctatcgccacctagt

SEQ ID NO: 3271 - DNA, 22 bp, Homo sapiens
actgaggacgacctatggggtt

SEQ ID NO: 3272 - DNA, 21 bp, Homo sapiens
gtccagttttcccaggatgag

SEQ ID NO: 3273 - DNA, 22 bp, Homo sapiens
gtcataggctggttggaaatgc

SEQ ID NO: 3274 - DNA, 21 bp, Homo sapiens
cctgagtaatccagaggaatc

SEQ ID NO: 3275 - DNA, 22 bp, Homo sapiens
atacacttgcctccagccaggt

SEQ ID NO: 3276 - DNA, 20 bp, Homo sapiens
ggtatcggctattgcagcct

SEQ ID NO: 3277 - DNA, 20 bp, Homo sapiens
aaacctctttacagtgactg

SEQ ID NO: 3278 - DNA, 23 bp, Homo sapiens
gcttgacaaagccaggttaggga

SEQ ID NO: 3279 - DNA, 20 bp, Homo sapiens
ggctcattggtgaaatggag

SEQ ID NO: 3280 - DNA, 24 bp, Homo sapiens
tgtgactccgatgtgacattttgg

SEQ ID NO: 3281 - DNA, 22 bp, Homo sapiens
gactttaaagtcaaatacccca

SEQ ID NO: 3282 - DNA, 22 bp, Homo sapiens
gatgatggtgacgtatggatgg

SEQ ID NO: 3283 - DNA, 22 bp, Homo sapiens
cagactgccgagtcctacccca

SEQ ID NO: 3284 - DNA, 23 bp, Homo sapiens
ttgtacctagatacatttgtcag

SEQ ID NO: 3285 - DNA, 20 bp, Homo sapiens
ctccaggatctacaggtgct

SEQ ID NO: 3286 - DNA, 20 bp, Homo sapiens
cagccaagcaacttagtatt

SEQ ID NO: 3287 - DNA, 22 bp, Homo sapiens
tgtcgtgctgtcaaataaacgt

SEQ ID NO: 3288 - DNA, 21 bp, Homo sapiens
tgctgggtttagaccgtgcac

SEQ ID NO: 3289 - DNA, 23 bp, Homo sapiens
caactgtaggcactgtacttctg

SEQ ID NO: 3290 - DNA, 20 bp, Homo sapiens
aagtggatacttaacttggt

SEQ ID NO: 3291 - DNA, 20 bp, Homo sapiens
tcagtgcactgtgaggtcac

SEQ ID NO: 3292 - DNA, 24 bp, Homo sapiens
cgcgtggaagcgcggcgcctcgcc

SEQ ID NO: 3293 - DNA, 20 bp, Homo sapiens
gccagagcccggctagcgtg

SEQ ID NO: 3294 - DNA, 22 bp, Homo sapiens
attgtgacagaccattgtgatg

SEQ ID NO: 3295 - DNA, 23 bp, Homo sapiens
caacggaatcccaaagccctctg

SEQ ID NO: 3296 - DNA, 22 bp, Homo sapiens
catccagaaggaatgaagtcaa

SEQ ID NO: 3297 - DNA, 20 bp, Homo sapiens
tgacagtgtgcacctaatgc

SEQ ID NO: 3298 - DNA, 22 bp, Homo sapiens
atcctgctgccagcctaacacc

SEQ ID NO: 3299 - DNA, 22 bp, Homo sapiens
tgaggcttgaaacaaagcagct

SEQ ID NO: 3300 - DNA, 23 bp, Homo sapiens
agacctgaacagactgagggatg

SEQ ID NO: 3301 - DNA, 23 bp, Homo sapiens
cactggtgtgctgggcaaaaacc

SEQ ID NO: 3302 - DNA, 21 bp, Homo sapiens
gcataatgctaattattacgc

SEQ ID NO: 3303 - DNA, 21 bp, Homo sapiens
tagggctatggaggtggttga

SEQ ID NO: 3304 - DNA, 20 bp, Homo sapiens
aggcaagatgctggcaaact

SEQ ID NO: 3305 - DNA, 23 bp, Homo sapiens
aggcttatcactgtgatggtgac

SEQ ID NO: 3306 - DNA, 22 bp, Homo sapiens
tagcagccatgcaaaatgggca

SEQ ID NO: 3307 - DNA, 22 bp, Homo sapiens
aggtactctccctttagtgatc

SEQ ID NO: 3308 - DNA, 22 bp, Homo sapiens
tctacttagtcaggctattgtt

SEQ ID NO: 3309 - DNA, 22 bp, Homo sapiens
agcagcccaagttgtaccttgg

SEQ ID NO: 3310 - DNA, 22 bp, Homo sapiens
ccccggggagcgcggcgggccg

SEQ ID NO: 3311 - DNA, 20 bp, Homo sapiens
ggcgtggagccgggcgtggt

SEQ ID NO: 3312 - DNA, 22 bp, Homo sapiens
gggagctctgtagcatcgtggc

SEQ ID NO: 3313 - DNA, 22 bp, Homo sapiens
tctccccaccctgtgcacagtg

SEQ ID NO: 3314 - DNA, 23 bp, Homo sapiens
ttcctgtagtctggctacttgca

SEQ ID NO: 3315 - DNA, 20 bp, Homo sapiens
ccccccactgcgcccggact

SEQ ID NO: 3316 - DNA, 22 bp, Homo sapiens
tggttcagggactactctgtga

SEQ ID NO: 3317 - DNA, 22 bp, Homo sapiens
ctgccatctggtgccagccttt

SEQ ID NO: 3318 - DNA, 20 bp, Homo sapiens
agcgatcatgctgtcatagc

SEQ ID NO: 3319 - DNA, 21 bp, Homo sapiens
agctactggaagagacagggc

SEQ ID NO: 3320 - DNA, 22 bp, Homo sapiens
tagaggcgactcagagctccac

SEQ ID NO: 3321 - DNA, 20 bp, Homo sapiens
ttcacagtggcatttaaggc

SEQ ID NO: 3322 - DNA, 23 bp, Homo sapiens
tcagttgccactgggatggggtg

SEQ ID NO: 3323 - DNA, 23 bp, Homo sapiens
tccccagtacctctgtttaaaga

SEQ ID NO: 3324 - DNA, 20 bp, Homo sapiens
ttcagacggtctgactacat

SEQ ID NO: 3325 - DNA, 20 bp, Homo sapiens
agtgcggcatctccacgaaa

SEQ ID NO: 3326 - DNA, 21 bp, Homo sapiens
ggggggtctgtattgcccagt

SEQ ID NO: 3327 - DNA, 21 bp, Homo sapiens
cggcagagcactggccgctcc

SEQ ID NO: 3328 - DNA, 22 bp, Homo sapiens
cagcagcactgcagcgctggcg

SEQ ID NO: 3329 - DNA, 20 bp, Homo sapiens
agatgtgcttgcagtaaggc

SEQ ID NO: 3330 - DNA, 22 bp, Homo sapiens
aggactgggcatggtatggggt

SEQ ID NO: 3331 - DNA, 23 bp, Homo sapiens
gtccatcgccacccacacttttt

SEQ ID NO: 3332 - DNA, 23 bp, Homo sapiens
agcagcaaacatgtatactttat

SEQ ID NO: 3333 - DNA, 22 bp, Homo sapiens
aaggaataggagtgtcctggtc

SEQ ID NO: 3334 - DNA, 20 bp, Homo sapiens
agcctacaccactgcagcag

SEQ ID NO: 3335 - DNA, 20 bp, Homo sapiens
cgtcgatgaagaactcaatc

SEQ ID NO: 3336 - DNA, 24 bp, Homo sapiens
gggctgcggacaagctcgcagtgg

SEQ ID NO: 3337 - DNA, 22 bp, Homo sapiens
atcacaatgcgaggagcccttg

SEQ ID NO: 3338 - DNA, 20 bp, Homo sapiens
gagcccagcgccgaccctct

SEQ ID NO: 3339 - DNA, 23 bp, Homo sapiens
tctgtggttttgaaatcacataa

SEQ ID NO: 3340 - DNA, 23 bp, Homo sapiens
gatggccacgggccaacagcaga

SEQ ID NO: 3341 - DNA, 20 bp, Homo sapiens
aaatgtagaagttgcaactg

SEQ ID NO: 3342 - DNA, 22 bp, Homo sapiens
tagctgcctgatcgtgcaccag

SEQ ID NO: 3343 - DNA, 23 bp, Homo sapiens
cccgcccctccgcgcccccttcc

SEQ ID NO: 3344 - DNA, 20 bp, Homo sapiens
ccgcgagggcgggccccggg

SEQ ID NO: 3345 - DNA, 22 bp, Homo sapiens
cagaacagatcaaactgcagtt

SEQ ID NO: 3346 - DNA, 22 bp, Homo sapiens
atcacattgggtctgattttcc

SEQ ID NO: 3347 - DNA, 22 bp, Homo sapiens
accccagagaaagccagtgtga

SEQ ID NO: 3348 - DNA, 20 bp, Homo sapiens
gccggcgcgcccccgccccc

SEQ ID NO: 3349 - DNA, 22 bp, Homo sapiens
ttcaagtaatccataggctttt

SEQ ID NO: 3350 - DNA, 22 bp, Homo sapiens
atgcacgtgctgaaagccgagg

SEQ ID NO: 3351 - DNA, 22 bp, Homo sapiens
cagcttatcagacagatgactg

SEQ ID NO: 3352 - DNA, 21 bp, Homo sapiens
cgcgacccgctccgtttcacg

SEQ ID NO: 3353 - DNA, 20 bp, Homo sapiens
actttacttacattcttgag

SEQ ID NO: 3354 - DNA, 22 bp, Homo sapiens
gcatggccacttgggcgcaatg

SEQ ID NO: 3355 - DNA, 21 bp, Homo sapiens
ccatcacacaggctcacacga

SEQ ID NO: 3356 - DNA, 23 bp, Homo sapiens
aagctttaactaccatacaaaca

SEQ ID NO: 3357 - DNA, 22 bp, Homo sapiens
tagtagtaatccaggaatcaga

SEQ ID NO: 3358 - DNA, 20 bp, Homo sapiens
agcatcaagcacgcaaatct

SEQ ID NO: 3359 - DNA, 20 bp, Homo sapiens
atatcatctgagctgagaac

SEQ ID NO: 3360 - DNA, 21 bp, Homo sapiens
ttcacattgccggggaccctt

SEQ ID NO: 3361 - DNA, 20 bp, Homo sapiens
ctgataacgccaaggtggca

SEQ ID NO: 3362 - DNA, 23 bp, Homo sapiens
tgacctgcattctctctcttagg

SEQ ID NO: 3363 - DNA, 22 bp, Homo sapiens
ggcagcattagactcatagcaa

SEQ ID NO: 3364 - DNA, 22 bp, Homo sapiens
gtggatgatgatgcctctgaca

SEQ ID NO: 3365 - DNA, 20 bp, Homo sapiens
ccccttgcctctcgggcttt

SEQ ID NO: 3366 - DNA, 22 bp, Homo sapiens
gtcttgcttaggctgatctcga

SEQ ID NO: 3367 - DNA, 23 bp, Homo sapiens
gcttctggggaaacttcaggaag

SEQ ID NO: 3368 - DNA, 24 bp, Homo sapiens
cctctgaaaaagcctcctacatag

SEQ ID NO: 3369 - DNA, 22 bp, Homo sapiens
gcccaggtggtgaaatgcttca

SEQ ID NO: 3370 - DNA, 22 bp, Homo sapiens
tgtattgtgagacattctcttc

SEQ ID NO: 3371 - DNA, 22 bp, Homo sapiens
aatatatttgcaaattatttct

SEQ ID NO: 3372 - DNA, 23 bp, Homo sapiens
tgctgacttttctttatttttga

SEQ ID NO: 3373 - DNA, 22 bp, Homo sapiens
tagcagctgtagtattgaatgt

SEQ ID NO: 3374 - DNA, 21 bp, Homo sapiens
aaaaatggagcttaggtttgg

SEQ ID NO: 3375 - DNA, 22 bp, Homo sapiens
acaggcatccgaatttgaaact

SEQ ID NO: 3376 - DNA, 22 bp, Homo sapiens
atccagtccctttgaaagcgtt

SEQ ID NO: 3377 - DNA, 22 bp, Homo sapiens
ggccagaaagaggtccttaggg

SEQ ID NO: 3378 - DNA, 22 bp, Homo sapiens
gtagtgtttcctactactcact

SEQ ID NO: 3379 - DNA, 20 bp, Homo sapiens
gagcccacccagggacgcca

SEQ ID NO: 3380 - DNA, 20 bp, Homo sapiens
agccctatctgagggaaccc

SEQ ID NO: 3381 - DNA, 22 bp, Homo sapiens
gtctgtttgtgttttaggggtt

SEQ ID NO: 3382 - DNA, 22 bp, Homo sapiens
taaacttgctcagctagcaaat

SEQ ID NO: 3383 - DNA, 21 bp, Homo sapiens
ggcaagtactgtgataacaga

SEQ ID NO: 3384 - DNA, 20 bp, Homo sapiens
tgaactggggaaacatccag

SEQ ID NO: 3385 - DNA, 21 bp, Homo sapiens
ctgaattgccaacttccaatg

SEQ ID NO: 3386 - DNA, 24 bp, Homo sapiens
cgcccgccgcgcgcgggaggtaag

SEQ ID NO: 3387 - DNA, 22 bp, Homo sapiens
agggcatatcgagtcagaatct

SEQ ID NO: 3388 - DNA, 20 bp, Homo sapiens
aggccagcacttcacttcaa

SEQ ID NO: 3389 - DNA, 20 bp, Homo sapiens
acacagcactctgcaaatac

SEQ ID NO: 3390 - DNA, 20 bp, Homo sapiens
ctctatcaaagcctccagaa

SEQ ID NO: 3391 - DNA, 22 bp, Homo sapiens
atcacattgttgaaataataac

SEQ ID NO: 3392 - DNA, 21 bp, Homo sapiens
aagtctgcccttgactttctc

SEQ ID NO: 3393 - DNA, 21 bp, Homo sapiens
tcccaggtttcggcaccaaga

SEQ ID NO: 3394 - DNA, 23 bp, Homo sapiens
cagcttatcagacacatgaggtt

SEQ ID NO: 3395 - DNA, 20 bp, Homo sapiens
agggcccaaataatgttaca

SEQ ID NO: 3396 - DNA, 22 bp, Homo sapiens
tagtgcatttcagaatatgtag

SEQ ID NO: 3397 - DNA, 22 bp, Homo sapiens
tgacatggcagcagggagattt

SEQ ID NO: 3398 - DNA, 22 bp, Homo sapiens
tctgagtaaagactgatagcaa

SEQ ID NO: 3399 - DNA, 22 bp, Homo sapiens
aagcttatcactgactccaaag

SEQ ID NO: 3400 - DNA, 20 bp, Homo sapiens
ccccggtgctcttgttaagc

SEQ ID NO: 3401 - DNA, 22 bp, Homo sapiens
ccttgtaagcagtaggtcgtga

SEQ ID NO: 3402 - DNA, 20 bp, Homo sapiens
tggttcattcaaatttctgt

SEQ ID NO: 3403 - DNA, 21 bp, Homo sapiens
tctttagtttccacaactgtc

SEQ ID NO: 3404 - DNA, 20 bp, Homo sapiens
ccccccactgctattagggc

SEQ ID NO: 3405 - DNA, 20 bp, Homo sapiens
tccgagtcttcagcaggaac

SEQ ID NO: 3406 - DNA, 20 bp, Homo sapiens
agagcacagctattttgatc

SEQ ID NO: 3407 - DNA, 20 bp, Homo sapiens
agagatgaagcactgaggac

SEQ ID NO: 3408 - DNA, 23 bp, Homo sapiens
gctagtatcagaccaatgttctt

SEQ ID NO: 3409 - DNA, 20 bp, Homo sapiens
cttatcagactgattttatc

SEQ ID NO: 3410 - DNA, 20 bp, Homo sapiens
tgggagtacatttgcaccta

SEQ ID NO: 3411 - DNA, 20 bp, Homo sapiens
cttctcctcgtgttttggtt

SEQ ID NO: 3412 - DNA, 20 bp, Homo sapiens
ctttccaattacacagctta

SEQ ID NO: 3413 - DNA, 23 bp, Homo sapiens
ttgttcattttcagagcgaaagg

SEQ ID NO: 3414 - DNA, 20 bp, Homo sapiens
tgagatgaagtgtcagtctg

SEQ ID NO: 3415 - DNA, 22 bp, Homo sapiens
gaaatggtagtctgactcagtt

SEQ ID NO: 3416 - DNA, 21 bp, Homo sapiens
ggctacatctgagatgaccca

SEQ ID NO: 3417 - DNA, 23 bp, Homo sapiens
tgtaaacccatcaaataaaacat

SEQ ID NO: 3418 - DNA, 22 bp, Homo sapiens
tgtcatgggtgatgtatgggga

SEQ ID NO: 3419 - DNA, 21 bp, Homo sapiens
ctccacccgccctcccctccc

SEQ ID NO: 3420 - DNA, 24 bp, Homo sapiens
cacacgaagggacgggcatttatc

SEQ ID NO: 3421 - DNA, 21 bp, Homo sapiens
gcttctggggaaactttgctg

SEQ ID NO: 3422 - DNA, 20 bp, Homo sapiens
acagtagtctgcacacccac

SEQ ID NO: 3423 - DNA, 20 bp, Homo sapiens
gatatgttgccaccgcactc

SEQ ID NO: 3424 - DNA, 22 bp, Homo sapiens
acagcagcgagagaaagtactg

SEQ ID NO: 3425 - DNA, 22 bp, Homo sapiens
cctcatgatagtatgtgaccct

SEQ ID NO: 3426 - DNA, 22 bp, Homo sapiens
tatagttctgagctgacattga

SEQ ID NO: 3427 - DNA, 20 bp, Homo sapiens
agagggatctgcatttttgt

SEQ ID NO: 3428 - DNA, 20 bp, Homo sapiens
tagggtgtgcgtgttttttt

SEQ ID NO: 3429 - DNA, 20 bp, Homo sapiens
aggcgatcacgtagattttg

SEQ ID NO: 3430 - DNA, 21 bp, Homo sapiens
gcataatgcttgcataagaat

SEQ ID NO: 3431 - DNA, 23 bp, Homo sapiens
taaaggcgagcatcacgtccatc

SEQ ID NO: 3432 - DNA, 20 bp, Homo sapiens
ccccatgagatgatatgcgc

SEQ ID NO: 3433 - DNA, 20 bp, Homo sapiens
tcccagagtgacctaatttt

SEQ ID NO: 3434 - DNA, 23 bp, Homo sapiens
tgaggtagtagatggtacagatt

SEQ ID NO: 3435 - DNA, 21 bp, Homo sapiens
gccccgccggggtcccgggat

SEQ ID NO: 3436 - DNA, 24 bp, Homo sapiens
tgcgtcctaggcccccggctctac

SEQ ID NO: 3437 - DNA, 22 bp, Homo sapiens
cctcaggttcagactaaacaca

SEQ ID NO: 3438 - DNA, 21 bp, Homo sapiens
acctggtgaccctgtatggtt

SEQ ID NO: 3439 - DNA, 21 bp, Homo sapiens
gggcagaggcggggggccggg

SEQ ID NO: 3440 - DNA, 20 bp, Homo sapiens
ctgctccacaactgcgcgca

SEQ ID NO: 3441 - DNA, 22 bp, Homo sapiens
ctttcagagtctcgcaggttga

SEQ ID NO: 3442 - DNA, 22 bp, Homo sapiens
gctaggcctgagtcagcatagg

SEQ ID NO: 3443 - DNA, 20 bp, Homo sapiens
ggaagataggaagttgaggg

SEQ ID NO: 3444 - DNA, 20 bp, Homo sapiens
cagcagcaattcagtggctc

SEQ ID NO: 3445 - DNA, 22 bp, Homo sapiens
actacaatatcagggctaaggc

SEQ ID NO: 3446 - DNA, 22 bp, Homo sapiens
gtttcacctgttcgtgcacacg

SEQ ID NO: 3447 - DNA, 20 bp, Homo sapiens
tttggccctgctaaagtact

SEQ ID NO: 3448 - DNA, 21 bp, Homo sapiens
acttgcccctgtgttggtgcc

SEQ ID NO: 3449 - DNA, 21 bp, Homo sapiens
cccctcctccccgcgccccag

SEQ ID NO: 3450 - DNA, 23 bp, Homo sapiens
ctgacctaaaggcaagtgcattt

SEQ ID NO: 3451 - DNA, 22 bp, Homo sapiens
catgcgtagctttccatatatg

SEQ ID NO: 3452 - DNA, 20 bp, Homo sapiens
acacctcttatgtcactgct

SEQ ID NO: 3453 - DNA, 20 bp, Homo sapiens
tcttggtctatattgcccag

SEQ ID NO: 3454 - DNA, 23 bp, Homo sapiens
aatagcacaggatacccagcaga

SEQ ID NO: 3455 - DNA, 21 bp, Homo sapiens
gtggaagggaaatgtaaatga

SEQ ID NO: 3456 - DNA, 21 bp, Homo sapiens
ctatgatgtaagtacaaacag

SEQ ID NO: 3457 - DNA, 21 bp, Homo sapiens
atgcaatgtgacgggcctgca

SEQ ID NO: 3458 - DNA, 24 bp, Homo sapiens
ggggccatagctcagctgtgagga

SEQ ID NO: 3459 - DNA, 24 bp, Homo sapiens
gtgctgacccctgcaattttccac

SEQ ID NO: 3460 - DNA, 20 bp, Homo sapiens
atttatataggcaaatccgt

SEQ ID NO: 3461 - DNA, 21 bp, Homo sapiens
aacagctctaaaatgaacatg

SEQ ID NO: 3462 - DNA, 20 bp, Homo sapiens
cccagccctgctccctgcat

SEQ ID NO: 3463 - DNA, 21 bp, Homo sapiens
cccagtgttcagactgcctcc

SEQ ID NO: 3464 - DNA, 22 bp, Homo sapiens
gcccggagagctgggagccaga

SEQ ID NO: 3465 - DNA, 20 bp, Homo sapiens
ccctcagagggcgcaccacg

SEQ ID NO: 3466 - DNA, 23 bp, Homo sapiens
aggacttgtctcaggtcacccag

SEQ ID NO: 3467 - DNA, 22 bp, Homo sapiens
gacctgagacaagtcctgtccc

SEQ ID NO: 3468 - DNA, 20 bp, Homo sapiens
ggcggagcgctgagaagtcc

SEQ ID NO: 3469 - DNA, 21 bp, Homo sapiens
catgcagagaagataaaaagc

SEQ ID NO: 3470 - DNA, 20 bp, Homo sapiens
aagcaagatgctggctaact

SEQ ID NO: 3471 - DNA, 22 bp, Homo sapiens
gggcaacatccatgtagactag

SEQ ID NO: 3472 - DNA, 21 bp, Homo sapiens
cctcataatccccgcagctct

SEQ ID NO: 3473 - DNA, 20 bp, Homo sapiens
gagtaccctgatgagatcga

SEQ ID NO: 3474 - DNA, 23 bp, Homo sapiens
acagcaggcacacacaggcatgg

SEQ ID NO: 3475 - DNA, 21 bp, Homo sapiens
tcctcccggggctcagcctgt

SEQ ID NO: 3476 - DNA, 24 bp, Homo sapiens
cggaagctctttctctgccttcac

SEQ ID NO: 3477 - DNA, 23 bp, Homo sapiens
tctcattccactggtatggggtg

SEQ ID NO: 3478 - DNA, 21 bp, Homo sapiens
gagcccaagctaaagctttgg

SEQ ID NO: 3479 - DNA, 20 bp, Homo sapiens
ttgctcagttcagcagtgac

SEQ ID NO: 3480 - DNA, 23 bp, Homo sapiens
cctgaaacaccgttgtttaaaga

SEQ ID NO: 3481 - DNA, 24 bp, Homo sapiens
cccttgtccttttgccctttgatg

SEQ ID NO: 3482 - DNA, 20 bp, Homo sapiens
accctaatgctctgtggctt

SEQ ID NO: 3483 - DNA, 21 bp, Homo sapiens
ccactcccgtgtgtccttgta

SEQ ID NO: 3484 - DNA, 23 bp, Homo sapiens
aattctgtagctgtctttaggtc

SEQ ID NO: 3485 - DNA, 22 bp, Homo sapiens
aaatggagcatcaaagcggatc

SEQ ID NO: 3486 - DNA, 21 bp, Homo sapiens
agcagtgttactcagcaagtt

SEQ ID NO: 3487 - DNA, 22 bp, Homo sapiens
cattattacttttatgtatatg

SEQ ID NO: 3488 - DNA, 20 bp, Homo sapiens
gcagcagttgagtgcaaact

SEQ ID NO: 3489 - DNA, 20 bp, Homo sapiens
aggcaactctggtggagtga

SEQ ID NO: 3490 - DNA, 21 bp, Homo sapiens
atgacctatcttatgacagtt

SEQ ID NO: 3491 - DNA, 20 bp, Homo sapiens
tcaccccataagtgttcatc

SEQ ID NO: 3492 - DNA, 23 bp, Homo sapiens
tataatttcactggtatggggac

SEQ ID NO: 3493 - DNA, 20 bp, Homo sapiens
gacttttaacacaggaacca

SEQ ID NO: 3494 - DNA, 22 bp, Homo sapiens
tagcaccatttgacatagttgg

SEQ ID NO: 3495 - DNA, 23 bp, Homo sapiens
tgctaccctttgcatgaaactga

SEQ ID NO: 3496 - DNA, 20 bp, Homo sapiens
cgactcttctatttcctagt

SEQ ID NO: 3497 - DNA, 20 bp, Homo sapiens
attagtggggtatggtgttg

SEQ ID NO: 3498 - DNA, 22 bp, Homo sapiens
gtctcttcatcaaacagtgacc

SEQ ID NO: 3499 - DNA, 22 bp, Homo sapiens
tgacagtttagacttatttttc

SEQ ID NO: 3500 - DNA, 21 bp, Homo sapiens
cagcaaaactagtacctgaat

SEQ ID NO: 3501 - DNA, 22 bp, Homo sapiens
agacatgccgaactaatagcaa

SEQ ID NO: 3502 - DNA, 22 bp, Homo sapiens
ctcttgtgtttctgtactgaca

SEQ ID NO: 3503 - DNA, 22 bp, Homo sapiens
tgtagtgggtctgcataggtga

SEQ ID NO: 3504 - DNA, 22 bp, Homo sapiens
agactaaacatggtatgtttgg

SEQ ID NO: 3505 - DNA, 20 bp, Homo sapiens
aagcttctgcatatggttgg

SEQ ID NO: 3506 - DNA, 21 bp, Homo sapiens
cacgaggccctgggctgggaa

SEQ ID NO: 3507 - DNA, 20 bp, Homo sapiens
tgaatgccagcaggctggac

SEQ ID NO: 3508 - DNA, 21 bp, Homo sapiens
tgtggaatggcccctatctgg

SEQ ID NO: 3509 - DNA, 23 bp, Homo sapiens
ttgcaattcactgggcgtttgag

SEQ ID NO: 3510 - DNA, 20 bp, Homo sapiens
aagaacatcctgatcttgaa

SEQ ID NO: 3511 - DNA, 20 bp, Homo sapiens
tcccaggttgattacaatgt

SEQ ID NO: 3512 - DNA, 21 bp, Homo sapiens
cagataatgctttgtgcatat

SEQ ID NO: 3513 - DNA, 20 bp, Homo sapiens
cctatctgagggggaccctt

SEQ ID NO: 3514 - DNA, 23 bp, Homo sapiens
tggctcagggactcaggagtgcc

SEQ ID NO: 3515 - DNA, 22 bp, Homo sapiens
tagcttatcaatgactaaccaa

SEQ ID NO: 3516 - DNA, 21 bp, Homo sapiens
acagcaggcacatcactggat

SEQ ID NO: 3517 - DNA, 21 bp, Homo sapiens
agtgacacatgttatgtaagt

SEQ ID NO: 3518 - DNA, 22 bp, Homo sapiens
aatgacggtaactgctaagcca

SEQ ID NO: 3519 - DNA, 20 bp, Homo sapiens
cactggataaggccagcagg

SEQ ID NO: 3520 - DNA, 21 bp, Homo sapiens
atatgccaagactggctaatt

SEQ ID NO: 3521 - DNA, 22 bp, Homo sapiens
ttgaactaatctgaatactttg

SEQ ID NO: 3522 - DNA, 22 bp, Homo sapiens
gagattccatgaacatgtgaca

SEQ ID NO: 3523 - DNA, 23 bp, Homo sapiens
agtgcaccctcgcatgcacagtt

SEQ ID NO: 3524 - DNA, 21 bp, Homo sapiens
tgatattactcccaattgcgc

SEQ ID NO: 3525 - DNA, 21 bp, Homo sapiens
ccagtgcgggccatatcattt

SEQ ID NO: 3526 - DNA, 23 bp, Homo sapiens
taggaatatgagtgtcatacaat

SEQ ID NO: 3527 - DNA, 20 bp, Homo sapiens
gaacttcactcagtttattg

SEQ ID NO: 3528 - DNA, 20 bp, Homo sapiens
cagaagacaccagtatagca

SEQ ID NO: 3529 - DNA, 22 bp, Homo sapiens
tgaaggcgactcagtatgggtc

SEQ ID NO: 3530 - DNA, 24 bp, Homo sapiens
cctgaacaaatgcagatgaaagtg

SEQ ID NO: 3531 - DNA, 21 bp, Homo sapiens
tctgcatcagaggcaattttg

SEQ ID NO: 3532 - DNA, 22 bp, Homo sapiens
tagcttagcatcagtcatggta

SEQ ID NO: 3533 - DNA, 21 bp, Homo sapiens
tgttgagaatttgtttacgaa

SEQ ID NO: 3534 - DNA, 20 bp, Homo sapiens
tgcggctgtacacaaaagga

SEQ ID NO: 3535 - DNA, 22 bp, Homo sapiens
tgtcagtttgaggggcaaaagt

SEQ ID NO: 3536 - DNA, 23 bp, Homo sapiens
atcccacttctgacaccatccgt

SEQ ID NO: 3537 - DNA, 21 bp, Homo sapiens
agctcgtgcatgtaccagtga

SEQ ID NO: 3538 - DNA, 20 bp, Homo sapiens
atagtaattttcttgctgtg

SEQ ID NO: 3539 - DNA, 21 bp, Homo sapiens
aagcaccagttgattagccaa

SEQ ID NO: 3540 - DNA, 20 bp, Homo sapiens
ggatccgctgagtcagacca

SEQ ID NO: 3541 - DNA, 24 bp, Homo sapiens
ttacataagtaagtttattacata

SEQ ID NO: 3542 - DNA, 20 bp, Homo sapiens
agtggcataagaataacagc

SEQ ID NO: 3543 - DNA, 23 bp, Homo sapiens
tgggtcagggacttgaagtgttg

SEQ ID NO: 3544 - DNA, 21 bp, Homo sapiens
cctacatgttcattatgcata

SEQ ID NO: 3545 - DNA, 22 bp, Homo sapiens
cactggttcactggtatgtttt

SEQ ID NO: 3546 - DNA, 22 bp, Homo sapiens
ttagtctttttcacatgactgt

SEQ ID NO: 3547 - DNA, 22 bp, Homo sapiens
accatggcactcatgcccacgc

SEQ ID NO: 3548 - DNA, 20 bp, Homo sapiens
gggcaaattacccaatccct

SEQ ID NO: 3549 - DNA, 21 bp, Homo sapiens
ggagatgaagtaagtgctaga

SEQ ID NO: 3550 - DNA, 22 bp, Homo sapiens
tgtttaaccttttgcctattgg

SEQ ID NO: 3551 - DNA, 20 bp, Homo sapiens
agcaggattgcgtgaggcta

SEQ ID NO: 3552 - DNA, 23 bp, Homo sapiens
cccctttgatgaatcttctgatg

SEQ ID NO: 3553 - DNA, 20 bp, Homo sapiens
ctctcccttcacttgctcca

SEQ ID NO: 3554 - DNA, 21 bp, Homo sapiens
agcaggtaacatgtctcactc

SEQ ID NO: 3555 - DNA, 22 bp, Homo sapiens
tagcttatcactgactatgtta

SEQ ID NO: 3556 - DNA, 22 bp, Homo sapiens
tcgatttacatcattatggttt

SEQ ID NO: 3557 - DNA, 23 bp, Homo sapiens
gcacatgatgctattttctgact

SEQ ID NO: 3558 - DNA, 20 bp, Homo sapiens
tgcctcttaatgcactaatt

SEQ ID NO: 3559 - DNA, 24 bp, Homo sapiens
caggagtaaaggtcacgcttgcta

SEQ ID NO: 3560 - DNA, 23 bp, Homo sapiens
atatcaatcagtgtgatgaatca

SEQ ID NO: 3561 - DNA, 20 bp, Homo sapiens
ctgacctatcttaagaccag

SEQ ID NO: 3562 - DNA, 22 bp, Homo sapiens
tataatcacttcgcaacagcag

SEQ ID NO: 3563 - DNA, 20 bp, Homo sapiens
gagcggtcgggcggcggggg

SEQ ID NO: 3564 - DNA, 20 bp, Homo sapiens
aatgttatacccaggaaaat

SEQ ID NO: 3565 - DNA, 22 bp, Homo sapiens
gccgcgcgcctcccgcaggacc

SEQ ID NO: 3566 - DNA, 21 bp, Homo sapiens
tgctgtgtccaccaacccatc

SEQ ID NO: 3567 - DNA, 23 bp, Homo sapiens
tggctcagttcacgtggaacaat

SEQ ID NO: 3568 - DNA, 22 bp, Homo sapiens
aagtcaggtaacttgatttcca

SEQ ID NO: 3569 - DNA, 22 bp, Homo sapiens
tatatggttgagtaataacata

SEQ ID NO: 3570 - DNA, 22 bp, Homo sapiens
tgagtcatttctgttataaatc

SEQ ID NO: 3571 - DNA, 22 bp, Homo sapiens
atcacatcattaggctattggt

SEQ ID NO: 3572 - DNA, 22 bp, Homo sapiens
gtccaggtttcccaggaagcct

SEQ ID NO: 3573 - DNA, 22 bp, Homo sapiens
cacaatattgctaggcaacact

SEQ ID NO: 3574 - DNA, 22 bp, Homo sapiens
gtccagttttcccagatcaaaa

SEQ ID NO: 3575 - DNA, 23 bp, Homo sapiens
aggaacatgcagctcatgatatc

SEQ ID NO: 3576 - DNA, 20 bp, Homo sapiens
ttggggcagctacactcaac

SEQ ID NO: 3577 - DNA, 22 bp, Homo sapiens
gagactgggcaacttatgaaag

SEQ ID NO: 3578 - DNA, 23 bp, Homo sapiens
gaccgtatgtctcacttccaggt

SEQ ID NO: 3579 - DNA, 23 bp, Homo sapiens
cccaaccagcggccgagatgtag

SEQ ID NO: 3580 - DNA, 20 bp, Homo sapiens
tggagttttaatgggtacag

SEQ ID NO: 3581 - DNA, 22 bp, Homo sapiens
taccacagggtagacagcgcct

SEQ ID NO: 3582 - DNA, 23 bp, Homo sapiens
cacaagtattacagctgccaccc

SEQ ID NO: 3583 - DNA, 20 bp, Homo sapiens
atgttataaactagggttgc

SEQ ID NO: 3584 - DNA, 24 bp, Homo sapiens
attgtgctgcctgggattaccatc

SEQ ID NO: 3585 - DNA, 22 bp, Homo sapiens
aggctgactgctcgcaggtggc

SEQ ID NO: 3586 - DNA, 23 bp, Homo sapiens
atttgcgatctatatctgccttt

SEQ ID NO: 3587 - DNA, 20 bp, Homo sapiens
cagacctatgaatttacagc

SEQ ID NO: 3588 - DNA, 21 bp, Homo sapiens
tttttatttagaattatttgc

SEQ ID NO: 3589 - DNA, 21 bp, Homo sapiens
tccacctataggccagtggtt

SEQ ID NO: 3590 - DNA, 22 bp, Homo sapiens
tagcttataagactgatcacct

SEQ ID NO: 3591 - DNA, 21 bp, Homo sapiens
cccagggccctggcggagatc

SEQ ID NO: 3592 - DNA, 21 bp, Homo sapiens
tccctggcatctccaccaata

SEQ ID NO: 3593 - DNA, 21 bp, Homo sapiens
taggagcctgaaacttccgaa

SEQ ID NO: 3594 - DNA, 20 bp, Homo sapiens
tggagcaggggagcagatat

SEQ ID NO: 3595 - DNA, 22 bp, Homo sapiens
agtgagtttgagttgcgttttc

SEQ ID NO: 3596 - DNA, 20 bp, Homo sapiens
tagcttatcagtgactgact

SEQ ID NO: 3597 - DNA, 21 bp, Homo sapiens
gctaaaactctgaaatcggtt

SEQ ID NO: 3598 - DNA, 21 bp, Homo sapiens
acttctggggaaacttcctga

SEQ ID NO: 3599 - DNA, 22 bp, Homo sapiens
aagtgtgcatcagaagcctcat

SEQ ID NO: 3600 - DNA, 23 bp, Homo sapiens
gggaatgggtaagaagcaattag

SEQ ID NO: 3601 - DNA, 22 bp, Homo sapiens
agcagagtagagcagttggaag

SEQ ID NO: 3602 - DNA, 21 bp, Homo sapiens
atcacattgggtcccggactt

SEQ ID NO: 3603 - DNA, 23 bp, Homo sapiens
gcttgattttaaacttctaggct

SEQ ID NO: 3604 - DNA, 20 bp, Homo sapiens
aggcgagagactttcttgac

SEQ ID NO: 3605 - DNA, 22 bp, Homo sapiens
tgaggttcatccaagttgttga

SEQ ID NO: 3606 - DNA, 20 bp, Homo sapiens
cttggctagtagaaagcact

SEQ ID NO: 3607 - DNA, 22 bp, Homo sapiens
tgagactctaaaggagaatcaa

SEQ ID NO: 3608 - DNA, 20 bp, Homo sapiens
atgcaatgtctgcataagga

SEQ ID NO: 3609 - DNA, 21 bp, Homo sapiens
ctggacttggagtctcttcca

SEQ ID NO: 3610 - DNA, 23 bp, Homo sapiens
atatcaataatgcattcgaccca

SEQ ID NO: 3611 - DNA, 20 bp, Homo sapiens
cttctgattagaattcagcc

SEQ ID NO: 3612 - DNA, 20 bp, Homo sapiens
ggggggaggtggggggtggt

SEQ ID NO: 3613 - DNA, 22 bp, Homo sapiens
tctcctgcatccaggacgaatg

SEQ ID NO: 3614 - DNA, 24 bp, Homo sapiens
atcacattgcctccctaaaagtta

SEQ ID NO: 3615 - DNA, 22 bp, Homo sapiens
cagtacccctcattatggggtt

SEQ ID NO: 3616 - DNA, 22 bp, Homo sapiens
ccatgtgactaagatacgaact

SEQ ID NO: 3617 - DNA, 22 bp, Homo sapiens
gttagtctcaaagctgaaacaa

SEQ ID NO: 3618 - DNA, 21 bp, Homo sapiens
tagcagcatagctatgatgtt

SEQ ID NO: 3619 - DNA, 20 bp, Homo sapiens
gtgaagtaagatgtagaggt

SEQ ID NO: 3620 - DNA, 22 bp, Homo sapiens
tctagtgcactcaaataacata

SEQ ID NO: 3621 - DNA, 21 bp, Homo sapiens
ttcacagtgggattcaaagcc

SEQ ID NO: 3622 - DNA, 21 bp, Homo sapiens
ccacatctcagggccctgtac

SEQ ID NO: 3623 - DNA, 22 bp, Homo sapiens
tatcgatgtatcatggtttaca

SEQ ID NO: 3624 - DNA, 20 bp, Homo sapiens
ttcacagtggctaagagcca

SEQ ID NO: 3625 - DNA, 21 bp, Homo sapiens
tactggattgaattgatgcca

SEQ ID NO: 3626 - DNA, 22 bp, Homo sapiens
tcaaatccggtctttctggttg

SEQ ID NO: 3627 - DNA, 20 bp, Homo sapiens
ctcccgcctaccaccaaagg

SEQ ID NO: 3628 - DNA, 21 bp, Homo sapiens
tagctggtaagtattagcacc

SEQ ID NO: 3629 - DNA, 22 bp, Homo sapiens
aagcttatactctgagcttcag

SEQ ID NO: 3630 - DNA, 20 bp, Homo sapiens
ctgacctatgaattagaaac

SEQ ID NO: 3631 - DNA, 23 bp, Homo sapiens
ataaaataactacactacttgac

SEQ ID NO: 3632 - DNA, 24 bp, Homo sapiens
gtggccttaggcaaatcacttcat

SEQ ID NO: 3633 - DNA, 20 bp, Homo sapiens
ccctcctccccgcgccccgc

SEQ ID NO: 3634 - DNA, 21 bp, Homo sapiens
gcttccaattagtggatgaaa

SEQ ID NO: 3635 - DNA, 21 bp, Homo sapiens
tgcattcccctagtggactat

SEQ ID NO: 3636 - DNA, 21 bp, Homo sapiens
aacatctctctttagaacatg

SEQ ID NO: 3637 - DNA, 22 bp, Homo sapiens
ttcaacccatcaaaatggggtt

SEQ ID NO: 3638 - DNA, 22 bp, Homo sapiens
tagaagtgtccttgtattgaca

SEQ ID NO: 3639 - DNA, 21 bp, Homo sapiens
tcagtgcactacagagtggtg

SEQ ID NO: 3640 - DNA, 23 bp, Homo sapiens
atcgtaggcactcaatatttgat

SEQ ID NO: 3641 - DNA, 22 bp, Homo sapiens
tcattagactgaattcttgctt

SEQ ID NO: 3642 - DNA, 22 bp, Homo sapiens
taacactgtctggtagtaagca

SEQ ID NO: 3643 - DNA, 22 bp, Homo sapiens
tggcttatcagactctgcttct

SEQ ID NO: 3644 - DNA, 23 bp, Homo sapiens
gctgaagctgagtgaagtaggag

SEQ ID NO: 3645 - DNA, 22 bp, Homo sapiens
aactggatacttaactgtgtgg

SEQ ID NO: 3646 - DNA, 21 bp, Homo sapiens
tagttggcctatccactatgt

SEQ ID NO: 3647 - DNA, 24 bp, Homo sapiens
ctctcgctccctccccacccccgc

SEQ ID NO: 3648 - DNA, 23 bp, Homo sapiens
cgctcacagacacacaccccaca

SEQ ID NO: 3649 - DNA, 21 bp, Homo sapiens
tagcagcaatcagggctacac

SEQ ID NO: 3650 - DNA, 21 bp, Homo sapiens
ctgttcagaggctattgtagc

SEQ ID NO: 3651 - DNA, 22 bp, Homo sapiens
tagcacgtaaactgtagtgtga

SEQ ID NO: 3652 - DNA, 22 bp, Homo sapiens
taggacttttcccaggtatcct

SEQ ID NO: 3653 - DNA, 22 bp, Homo sapiens
aacatagaaggtgattaaggcc

SEQ ID NO: 3654 - DNA, 20 bp, Homo sapiens
tccccggcagtgccacacgc

SEQ ID NO: 3655 - DNA, 20 bp, Homo sapiens
gaatgaggtacatgggagaa

SEQ ID NO: 3656 - DNA, 22 bp, Homo sapiens
atttctgatgcctagtccacag

SEQ ID NO: 3657 - DNA, 20 bp, Homo sapiens
gcacccttagctcagtccat

SEQ ID NO: 3658 - DNA, 23 bp, Homo sapiens
taatccattgagttatacaactg

SEQ ID NO: 3659 - DNA, 22 bp, Homo sapiens
ctcagagccaggtcagtaggct

SEQ ID NO: 3660 - DNA, 21 bp, Homo sapiens
cttaaatgtctgcctaatgct

SEQ ID NO: 3661 - DNA, 20 bp, Homo sapiens
gcaatctcccagggtgagtc

SEQ ID NO: 3662 - DNA, 20 bp, Homo sapiens
gtatctgaatcagcaggaca

SEQ ID NO: 3663 - DNA, 22 bp, Homo sapiens
caacatggctggccttccatgc

SEQ ID NO: 3664 - DNA, 22 bp, Homo sapiens
acatacaatctctgtagccaat

SEQ ID NO: 3665 - DNA, 20 bp, Homo sapiens
cctcatcagaggctactgtt

SEQ ID NO: 3666 - DNA, 21 bp, Homo sapiens
agtggctcttaaattccagca

SEQ ID NO: 3667 - DNA, 20 bp, Homo sapiens
attatgaatgtgagctctgg

SEQ ID NO: 3668 - DNA, 22 bp, Homo sapiens
tgagagagggaacagttttcag

SEQ ID NO: 3669 - DNA, 22 bp, Homo sapiens
ttcgtggtattgaaatcaatga

SEQ ID NO: 3670 - DNA, 22 bp, Homo sapiens
agctactctgctcgcttacact

SEQ ID NO: 3671 - DNA, 21 bp, Homo sapiens
ctgacattctctaatattaaa

SEQ ID NO: 3672 - DNA, 20 bp, Homo sapiens
atttttttaacacttttatg

SEQ ID NO: 3673 - DNA, 20 bp, Homo sapiens
tccctttattcccacaaccc

SEQ ID NO: 3674 - DNA, 21 bp, Homo sapiens
ctcattgttggtatttgtggt

SEQ ID NO: 3675 - DNA, 22 bp, Homo sapiens
taatttattaggaatttcccaa

SEQ ID NO: 3676 - DNA, 22 bp, Homo sapiens
gattgtggggtaagcattggag

SEQ ID NO: 3677 - DNA, 20 bp, Homo sapiens
atattgctggtgatcaccat

SEQ ID NO: 3678 - DNA, 23 bp, Homo sapiens
tggctagaggaagcaggacactg

SEQ ID NO: 3679 - DNA, 22 bp, Homo sapiens
atgacctatgaatgtaaagaca

SEQ ID NO: 3680 - DNA, 24 bp, Homo sapiens
atagaaaaagattgggcaagggga

SEQ ID NO: 3681 - DNA, 20 bp, Homo sapiens
gtagtgggttatcagaacac

SEQ ID NO: 3682 - DNA, 20 bp, Homo sapiens
tcccgaggcctctccagaag

SEQ ID NO: 3683 - DNA, 20 bp, Homo sapiens
tttgccttagggtttagcaa

SEQ ID NO: 3684 - DNA, 23 bp, Homo sapiens
atagtgctgctgagagccaggta

SEQ ID NO: 3685 - DNA, 22 bp, Homo sapiens
catgccttagggttttctttga

SEQ ID NO: 3686 - DNA, 23 bp, Homo sapiens
cttagctgtgtccatagacaatc

SEQ ID NO: 3687 - DNA, 23 bp, Homo sapiens
agcagctaacacacttggtatgt

SEQ ID NO: 3688 - DNA, 22 bp, Homo sapiens
ctgaatctctcttttcccatct

SEQ ID NO: 3689 - DNA, 22 bp, Homo sapiens
cccgcgccccgctccccgcccc

SEQ ID NO: 3690 - DNA, 20 bp, Homo sapiens
atgaagtattatgagaacct

SEQ ID NO: 3691 - DNA, 23 bp, Homo sapiens
aacacatttctgggactttattg

SEQ ID NO: 3692 - DNA, 20 bp, Homo sapiens
gggataatcacatgtgtcta

SEQ ID NO: 3693 - DNA, 20 bp, Homo sapiens
atgaaattaaccatacaaac

SEQ ID NO: 3694 - DNA, 23 bp, Homo sapiens
tagcatcatttgaaatcaggtaa

SEQ ID NO: 3695 - DNA, 22 bp, Homo sapiens
tagcttatactctggatgccag

SEQ ID NO: 3696 - DNA, 20 bp, Homo sapiens
cccttgcctctcggcgcccc

SEQ ID NO: 3697 - DNA, 22 bp, Homo sapiens
tcagtgcactgtgaggtcagtg

SEQ ID NO: 3698 - DNA, 21 bp, Homo sapiens
taatactgcctggtaacatca

SEQ ID NO: 3699 - DNA, 23 bp, Homo sapiens
tatatatacacttttataaaact

SEQ ID NO: 3700 - DNA, 22 bp, Homo sapiens
tttggcaatggaaatctgagtt

SEQ ID NO: 3701 - DNA, 24 bp, Homo sapiens
gatgggcgtggtggctcatgtttt

SEQ ID NO: 3702 - DNA, 22 bp, Homo sapiens
tagcatacgctctttatacaat

SEQ ID NO: 3703 - DNA, 22 bp, Homo sapiens
aagtgtagtaacccagccaggt

SEQ ID NO: 3704 - DNA, 22 bp, Homo sapiens
tgaggacggctcagtcactcaa

SEQ ID NO: 3705 - DNA, 23 bp, Homo sapiens
tccatgctaagagcataacaagc

SEQ ID NO: 3706 - DNA, 22 bp, Homo sapiens
tagcttatcatcacaggtgcag

SEQ ID NO: 3707 - DNA, 22 bp, Homo sapiens
tgtactgtagtcattccttttg

SEQ ID NO: 3708 - DNA, 22 bp, Homo sapiens
gaaagtttaccctacaggtgtc

SEQ ID NO: 3709 - DNA, 21 bp, Homo sapiens
agtccctgttcgggcgccact

SEQ ID NO: 3710 - DNA, 20 bp, Homo sapiens
cacttcatgggtcccgtgtg

SEQ ID NO: 3711 - DNA, 21 bp, Homo sapiens
gtgatgcccttcagcacagtg

SEQ ID NO: 3712 - DNA, 22 bp, Homo sapiens
agcatcgctgaaagtcagccct

SEQ ID NO: 3713 - DNA, 20 bp, Homo sapiens
catattcacacagtatatac

SEQ ID NO: 3714 - DNA, 20 bp, Homo sapiens
agctgggcttttccatcacg

SEQ ID NO: 3715 - DNA, 22 bp, Homo sapiens
gatgcaataggatatgaatgat

SEQ ID NO: 3716 - DNA, 22 bp, Homo sapiens
gctgtgtggctgtcctatcttc

SEQ ID NO: 3717 - DNA, 23 bp, Homo sapiens
gaggtctgggctgtagtgcgcta

SEQ ID NO: 3718 - DNA, 20 bp, Homo sapiens
ggcgcagggccgttatcagt

SEQ ID NO: 3719 - DNA, 21 bp, Homo sapiens
acctcagaaggtctcagaaat

SEQ ID NO: 3720 - DNA, 22 bp, Homo sapiens
tagagggaacagtttatggggt

SEQ ID NO: 3721 - DNA, 20 bp, Homo sapiens
acaaccatgcacactacaga

SEQ ID NO: 3722 - DNA, 22 bp, Homo sapiens
tgagtctttgtcaaatacaggt

SEQ ID NO: 3723 - DNA, 21 bp, Homo sapiens
cgaggtgaagctttagaggaa

SEQ ID NO: 3724 - DNA, 21 bp, Homo sapiens
aagtgtaacccagggataagc

SEQ ID NO: 3725 - DNA, 20 bp, Homo sapiens
atgacctatgaattcatgat

SEQ ID NO: 3726 - DNA, 22 bp, Homo sapiens
aactggtacccttgtacactgt

SEQ ID NO: 3727 - DNA, 21 bp, Homo sapiens
accctgaggccagagtgaaaa

SEQ ID NO: 3728 - DNA, 22 bp, Homo sapiens
tagctgctcaggatgtaacaca

SEQ ID NO: 3729 - DNA, 22 bp, Homo sapiens
ccgcctccgccccccggcccca

SEQ ID NO: 3730 - DNA, 20 bp, Homo sapiens
gcaggggtggttcagtggtg

SEQ ID NO: 3731 - DNA, 20 bp, Homo sapiens
tccttaatgctctgtggttt

SEQ ID NO: 3732 - DNA, 21 bp, Homo sapiens
gactggatactgccagctgat

SEQ ID NO: 3733 - DNA, 22 bp, Homo sapiens
atattatcaatgtagtgtatag

SEQ ID NO: 3734 - DNA, 21 bp, Homo sapiens
tcgtacctgagaatctgacag

SEQ ID NO: 3735 - DNA, 20 bp, Homo sapiens
gcattgatggtagtcaccat

SEQ ID NO: 3736 - DNA, 20 bp, Homo sapiens
cccgtccgtccgtccgtcct

SEQ ID NO: 3737 - DNA, 20 bp, Homo sapiens
tatccatttctacaccttgt

SEQ ID NO: 3738 - DNA, 23 bp, Homo sapiens
agcagcacctcgcatggctggag

SEQ ID NO: 3739 - DNA, 22 bp, Homo sapiens
ctttatttgaaaaccatatatg

SEQ ID NO: 3740 - DNA, 22 bp, Homo sapiens
cagtctgggtgacttatgaata

SEQ ID NO: 3741 - DNA, 22 bp, Homo sapiens
cacttgccctggtttatggggt

SEQ ID NO: 3742 - DNA, 22 bp, Homo sapiens
ttacagtaatccagtagaaatt

SEQ ID NO: 3743 - DNA, 22 bp, Homo sapiens
gtctttcgagtgaagacagaac

SEQ ID NO: 3744 - DNA, 22 bp, Homo sapiens
aagcagcatgctgcaactggtg

SEQ ID NO: 3745 - DNA, 23 bp, Homo sapiens
atgcagcatatacagatatggct

SEQ ID NO: 3746 - DNA, 22 bp, Homo sapiens
gtttcagagtttctcaccacag

SEQ ID NO: 3747 - DNA, 22 bp, Homo sapiens
aaatacctagttttggctcaat

SEQ ID NO: 3748 - DNA, 21 bp, Homo sapiens
cccagtgaagtcactccctgt

SEQ ID NO: 3749 - DNA, 20 bp, Homo sapiens
tgccccgtccgtccgtccgt

SEQ ID NO: 3750 - DNA, 22 bp, Homo sapiens
tccctggtaactgagtgtggct

SEQ ID NO: 3751 - DNA, 23 bp, Homo sapiens
cataatgtctttatgccagcaga

SEQ ID NO: 3752 - DNA, 21 bp, Homo sapiens
gtcagtttgtcgttatgggga

SEQ ID NO: 3753 - DNA, 23 bp, Homo sapiens
gggattaaatgatccttaaaggc

SEQ ID NO: 3754 - DNA, 20 bp, Homo sapiens
tcacatatatatgaaaaatc

SEQ ID NO: 3755 - DNA, 22 bp, Homo sapiens
gagctttagtccccatgaaacc

SEQ ID NO: 3756 - DNA, 20 bp, Homo sapiens
gctgcaattcaaggtgttgg

SEQ ID NO: 3757 - DNA, 23 bp, Homo sapiens
agcagcaaacagtgagggaatga

SEQ ID NO: 3758 - DNA, 20 bp, Homo sapiens
gctggagaaatgtcactgct

SEQ ID NO: 3759 - DNA, 23 bp, Homo sapiens
ctactgtttgatgtcttaatctg

SEQ ID NO: 3760 - DNA, 20 bp, Homo sapiens
tggtcacctagatactgccc

SEQ ID NO: 3761 - DNA, 21 bp, Homo sapiens
gtaataatgcccaccgcatat

SEQ ID NO: 3762 - DNA, 22 bp, Homo sapiens
gagctgtgatgaactctgagca

SEQ ID NO: 3763 - DNA, 22 bp, Homo sapiens
cagctcagttcagcagaaacac

SEQ ID NO: 3764 - DNA, 20 bp, Homo sapiens
gtgcaagaatttggtggtga

SEQ ID NO: 3765 - DNA, 22 bp, Homo sapiens
tgatagctagccatggtttaca

SEQ ID NO: 3766 - DNA, 21 bp, Homo sapiens
tctgagtaatccaggaagtct

SEQ ID NO: 3767 - DNA, 20 bp, Homo sapiens
gtccagttttcccacggaaa

SEQ ID NO: 3768 - DNA, 23 bp, Homo sapiens
gtgagagtttgagtttcaccctg

SEQ ID NO: 3769 - DNA, 23 bp, Homo sapiens
aagaaaccaacttcatggtcact

SEQ ID NO: 3770 - DNA, 22 bp, Homo sapiens
atcacatcattgaactccagac

SEQ ID NO: 3771 - DNA, 23 bp, Homo sapiens
tggcctcattcagtgaaggtgag

SEQ ID NO: 3772 - DNA, 23 bp, Homo sapiens
atcattatcagctgagcacagtg

SEQ ID NO: 3773 - DNA, 21 bp, Homo sapiens
acagtaggagtaacacaggtt

SEQ ID NO: 3774 - DNA, 22 bp, Homo sapiens
ctcagtctcaggattcttgcat

SEQ ID NO: 3775 - DNA, 22 bp, Homo sapiens
acagcaggccactacaggctcc

SEQ ID NO: 3776 - DNA, 21 bp, Homo sapiens
tagcaccatttgaaaataatt

SEQ ID NO: 3777 - DNA, 22 bp, Homo sapiens
gggtggtggccgggcagagcgg

SEQ ID NO: 3778 - DNA, 22 bp, Homo sapiens
tagcagcactagatgctcatag

SEQ ID NO: 3779 - DNA, 20 bp, Homo sapiens
tcaatagttctgagttgaga

SEQ ID NO: 3780 - DNA, 22 bp, Homo sapiens
tccagcggcaacggcagtagtt

SEQ ID NO: 3781 - DNA, 24 bp, Homo sapiens
attttctctgtttattgcacaagt

SEQ ID NO: 3782 - DNA, 23 bp, Homo sapiens
ctaaggtattagcagttgaactc

SEQ ID NO: 3783 - DNA, 22 bp, Homo sapiens
ttcatcattcttgaagcaagcc

SEQ ID NO: 3784 - DNA, 23 bp, Homo sapiens
tagaggctcagatcagctggttg

SEQ ID NO: 3785 - DNA, 21 bp, Homo sapiens
agttcttctcactacctaggc

SEQ ID NO: 3786 - DNA, 22 bp, Homo sapiens
tgtcagtggtagtttatgggaa

SEQ ID NO: 3787 - DNA, 24 bp, Homo sapiens
caaggacaaggaagggttcctgcg

SEQ ID NO: 3788 - DNA, 22 bp, Homo sapiens
gtcacattgccagggatcagaa

SEQ ID NO: 3789 - DNA, 20 bp, Homo sapiens
ccagcgggtgctcttatctg

SEQ ID NO: 3790 - DNA, 23 bp, Homo sapiens
taggggccaactgtttgatttct

SEQ ID NO: 3791 - DNA, 20 bp, Homo sapiens
ccagtttttataaaaggctt

SEQ ID NO: 3792 - DNA, 21 bp, Homo sapiens
aggactgggaacacttctgag

SEQ ID NO: 3793 - DNA, 20 bp, Homo sapiens
atgacctaacttaactctgt

SEQ ID NO: 3794 - DNA, 21 bp, Homo sapiens
ctgaggataaggccattgaaa

SEQ ID NO: 3795 - DNA, 21 bp, Homo sapiens
tgaggtagcgagcacatttca

SEQ ID NO: 3796 - DNA, 20 bp, Homo sapiens
ttacctatgaattggcagat

SEQ ID NO: 3797 - DNA, 21 bp, Homo sapiens
acgccagcatctaatgggact

SEQ ID NO: 3798 - DNA, 20 bp, Homo sapiens
tccccggcacctcctgtgcc

SEQ ID NO: 3799 - DNA, 22 bp, Homo sapiens
tgcaatccccctattttatgga

SEQ ID NO: 3800 - DNA, 23 bp, Homo sapiens
accctatttgtcactataggcag

SEQ ID NO: 3801 - DNA, 22 bp, Homo sapiens
acagcaggcacagacagatggg

SEQ ID NO: 3802 - DNA, 22 bp, Homo sapiens
acagcaggctgagcacttacca

SEQ ID NO: 3803 - DNA, 22 bp, Homo sapiens
cttctgcagggactagacattg

SEQ ID NO: 3804 - DNA, 22 bp, Homo sapiens
accttacccactgttatggctg

SEQ ID NO: 3805 - DNA, 22 bp, Homo sapiens
tagccatatggtatactgagtt

SEQ ID NO: 3806 - DNA, 20 bp, Homo sapiens
cctgtttagcaacccaagca

SEQ ID NO: 3807 - DNA, 22 bp, Homo sapiens
ggctggtccgatccattgtaca

SEQ ID NO: 3808 - DNA, 22 bp, Homo sapiens
gagcaggtgccggtgcaactgg

SEQ ID NO: 3809 - DNA, 22 bp, Homo sapiens
aagtgtacattcttctaaagac

SEQ ID NO: 3810 - DNA, 20 bp, Homo sapiens
agcagggagatggagcacat

SEQ ID NO: 3811 - DNA, 23 bp, Homo sapiens
gtccagccccttcaggtatcctc

SEQ ID NO: 3812 - DNA, 22 bp, Homo sapiens
gtccagtttttccaccttgggg

SEQ ID NO: 3813 - DNA, 20 bp, Homo sapiens
gctggaatagctcagttggc

SEQ ID NO: 3814 - DNA, 20 bp, Homo sapiens
cccataaagtaggggatctg

SEQ ID NO: 3815 - DNA, 22 bp, Homo sapiens
tggcagggtctttctcaactgt

SEQ ID NO: 3816 - DNA, 21 bp, Homo sapiens
tatgcatcaagaatataacag

SEQ ID NO: 3817 - DNA, 20 bp, Homo sapiens
ctttgcaggtagaaggcctc

SEQ ID NO: 3818 - DNA, 21 bp, Homo sapiens
gcccttgtaatgacagctgca

SEQ ID NO: 3819 - DNA, 22 bp, Homo sapiens
agctgcaaatgatttatgaaac

SEQ ID NO: 3820 - DNA, 22 bp, Homo sapiens
aaaaatgcttaggcttgaaagt

SEQ ID NO: 3821 - DNA, 22 bp, Homo sapiens
acaggacccactggtatgggga

SEQ ID NO: 3822 - DNA, 20 bp, Homo sapiens
gcagagcgatatatatatct

SEQ ID NO: 3823 - DNA, 23 bp, Homo sapiens
gtgctcagggactgagagctggt

SEQ ID NO: 3824 - DNA, 20 bp, Homo sapiens
gcatggcacctgcatatgat

SEQ ID NO: 3825 - DNA, 23 bp, Homo sapiens
caaagtgctgcactgccaagtac

SEQ ID NO: 3826 - DNA, 22 bp, Homo sapiens
tagcaccatttctttattcatt

SEQ ID NO: 3827 - DNA, 20 bp, Homo sapiens
accgtcttgcatgtttattt

SEQ ID NO: 3828 - DNA, 21 bp, Homo sapiens
gtccagttttcccagaaaact

SEQ ID NO: 3829 - DNA, 21 bp, Homo sapiens
ttcactgcccctgagataact

SEQ ID NO: 3830 - DNA, 22 bp, Homo sapiens
tgtcagttacagtttagttttc

SEQ ID NO: 3831 - DNA, 20 bp, Homo sapiens
catgctgagaatcgcttagg

SEQ ID NO: 3832 - DNA, 22 bp, Homo sapiens
tactgacccactggatgtgggt

SEQ ID NO: 3833 - DNA, 20 bp, Homo sapiens
tctccaatgctcttgttgct

SEQ ID NO: 3834 - DNA, 22 bp, Homo sapiens
tgggatgaagcactgtagacag

SEQ ID NO: 3835 - DNA, 22 bp, Homo sapiens
tggctcttggagatgactgtga

SEQ ID NO: 3836 - DNA, 22 bp, Homo sapiens
tcagactttgcttctactattg

SEQ ID NO: 3837 - DNA, 20 bp, Homo sapiens
gatgatgcctgcactacgat

SEQ ID NO: 3838 - DNA, 20 bp, Homo sapiens
ctccggcgggtgcggggtct

SEQ ID NO: 3839 - DNA, 23 bp, Homo sapiens
aaggcagggccctcgctccccaa

SEQ ID NO: 3840 - DNA, 22 bp, Homo sapiens
gcgccggtgaccgcaacagcac

SEQ ID NO: 3841 - DNA, 20 bp, Homo sapiens
gagtccagttgggtcctgtt

SEQ ID NO: 3842 - DNA, 20 bp, Homo sapiens
agaacagaaatctccagtaa

SEQ ID NO: 3843 - DNA, 20 bp, Homo sapiens
cccccgctccccgtcccccc

SEQ ID NO: 3844 - DNA, 22 bp, Homo sapiens
ttccttttttagtgactgggcc

SEQ ID NO: 3845 - DNA, 22 bp, Homo sapiens
acagcaggcacttcactgcagg

SEQ ID NO: 3846 - DNA, 22 bp, Homo sapiens
tgaggtagtagtggtggctctg

SEQ ID NO: 3847 - DNA, 24 bp, Homo sapiens
gggcccggccgccgccgccatcag

SEQ ID NO: 3848 - DNA, 23 bp, Homo sapiens
ctataacaattaaatgagataaa

SEQ ID NO: 3849 - DNA, 23 bp, Homo sapiens
gcttctggggaggaggaatccct

SEQ ID NO: 3850 - DNA, 23 bp, Homo sapiens
gatgacgctgtcacaatacccca

SEQ ID NO: 3851 - DNA, 22 bp, Homo sapiens
atcactgaacttgagatagatc

SEQ ID NO: 3852 - DNA, 22 bp, Homo sapiens
accgactctgtctaacttgtga

SEQ ID NO: 3853 - DNA, 23 bp, Homo sapiens
gccgggcagcttccgtttccaac

SEQ ID NO: 3854 - DNA, 20 bp, Homo sapiens
tctaactgcaagaacaacca

SEQ ID NO: 3855 - DNA, 21 bp, Homo sapiens
cgccgcgcatccaggtacgcg

SEQ ID NO: 3856 - DNA, 22 bp, Homo sapiens
atcacattgttgatctaaagca

SEQ ID NO: 3857 - DNA, 21 bp, Homo sapiens
gacctgatgctgctggccacg

SEQ ID NO: 3858 - DNA, 21 bp, Homo sapiens
cagctccaggccccctgcaac

SEQ ID NO: 3859 - DNA, 20 bp, Homo sapiens
gcccacgccccgctccccac

SEQ ID NO: 3860 - DNA, 20 bp, Homo sapiens
cagagctcctacagtcctag

SEQ ID NO: 3861 - DNA, 22 bp, Homo sapiens
tgggaactggagatcttcacag

SEQ ID NO: 3862 - DNA, 23 bp, Homo sapiens
aagtcgtcctgccagggtcgcac

SEQ ID NO: 3863 - DNA, 20 bp, Homo sapiens
cacgcctttccccctcctcc

SEQ ID NO: 3864 - DNA, 22 bp, Homo sapiens
cttcccctcctcccgcccaccc

SEQ ID NO: 3865 - DNA, 22 bp, Homo sapiens
ccatggctgctgccgcccagca

SEQ ID NO: 3866 - DNA, 22 bp, Homo sapiens
gcaggttccacaacccagccgt

SEQ ID NO: 3867 - DNA, 21 bp, Homo sapiens
gctgtgccatttccctgcgga

SEQ ID NO: 3868 - DNA, 20 bp, Homo sapiens
ctgctctcaatgattttgga

SEQ ID NO: 3869 - DNA, 21 bp, Homo sapiens
cattctgttattccgcaaata

SEQ ID NO: 3870 - DNA, 23 bp, Homo sapiens
gggaccaacatcaaatacaaaca

SEQ ID NO: 3871 - DNA, 21 bp, Homo sapiens
tagcagcacataatggtttga

SEQ ID NO: 3872 - DNA, 22 bp, Homo sapiens
cagtcacctggttcccaaggtt

SEQ ID NO: 3873 - DNA, 20 bp, Homo sapiens
ctccaggaacgttgcaccac

SEQ ID NO: 3874 - DNA, 21 bp, Homo sapiens
ggcctacggcttgagatagag

SEQ ID NO: 3875 - DNA, 22 bp, Homo sapiens
ccccgcaagagggccgcccgct

SEQ ID NO: 3876 - DNA, 21 bp, Homo sapiens
gttttattaaaactaataaaa

SEQ ID NO: 3877 - DNA, 22 bp, Homo sapiens
catcatgtccactctacagcca

SEQ ID NO: 3878 - DNA, 23 bp, Homo sapiens
aactagaatattattattttttt

SEQ ID NO: 3879 - DNA, 20 bp, Homo sapiens
tcccaccgctgccacctcct

SEQ ID NO: 3880 - DNA, 23 bp, Homo sapiens
aaccctgtgaggagtttccagtc

SEQ ID NO: 3881 - DNA, 23 bp, Homo sapiens
aatagcatttcaggtgctcactc

SEQ ID NO: 3882 - DNA, 21 bp, Homo sapiens
gtccagttttcccggagggaa

SEQ ID NO: 3883 - DNA, 20 bp, Homo sapiens
acaccctcccgtgacagtgt

SEQ ID NO: 3884 - DNA, 21 bp, Homo sapiens
gcattagttctgagctgagtt

SEQ ID NO: 3885 - DNA, 21 bp, Homo sapiens
aaaataatcttttggtactat

SEQ ID NO: 3886 - DNA, 21 bp, Homo sapiens
tgagaactgaattccattgag

SEQ ID NO: 3887 - DNA, 21 bp, Homo sapiens
tagcaccatctctggctttaa

SEQ ID NO: 3888 - DNA, 22 bp, Homo sapiens
tgaggtagtactattatatcac

SEQ ID NO: 3889 - DNA, 21 bp, Homo sapiens
ccgcgccggcctccaccctaa

SEQ ID NO: 3890 - DNA, 23 bp, Homo sapiens
agcagcaaacatgtccatcagtc

SEQ ID NO: 3891 - DNA, 21 bp, Homo sapiens
aacatggaggaaattccatta

SEQ ID NO: 3892 - DNA, 23 bp, Homo sapiens
tagagtatcatcatgatcccatt

SEQ ID NO: 3893 - DNA, 23 bp, Homo sapiens
gctgtgccactgaactataggtt

SEQ ID NO: 3894 - DNA, 22 bp, Homo sapiens
tgagagctgctcaagtgtggtt

SEQ ID NO: 3895 - DNA, 20 bp, Homo sapiens
cgtcctcctcctcccccttc

SEQ ID NO: 3896 - DNA, 23 bp, Homo sapiens
tagcaggtgccagggcctgtgtt

SEQ ID NO: 3897 - DNA, 20 bp, Homo sapiens
gtatagttctgagctggtgg

SEQ ID NO: 3898 - DNA, 20 bp, Homo sapiens
tagtgctagaatttgattta

SEQ ID NO: 3899 - DNA, 22 bp, Homo sapiens
acaatgaatgtgagtgaatggc

SEQ ID NO: 3900 - DNA, 23 bp, Homo sapiens
cgcagtatccgtgacatgaacga

SEQ ID NO: 3901 - DNA, 21 bp, Homo sapiens
gcctgataaatctaaactgca

SEQ ID NO: 3902 - DNA, 20 bp, Homo sapiens
tctggttattgttagctgta

SEQ ID NO: 3903 - DNA, 22 bp, Homo sapiens
ttctgattttattatgtgagtg

SEQ ID NO: 3904 - DNA, 22 bp, Homo sapiens
tgtactggctgacttatgggat

SEQ ID NO: 3905 - DNA, 23 bp, Homo sapiens
cttggggtgcagagttctttaaa

SEQ ID NO: 3906 - DNA, 20 bp, Homo sapiens
cgtgttgattacgtgatgat

SEQ ID NO: 3907 - DNA, 22 bp, Homo sapiens
ttagttgccactggtatgttca

SEQ ID NO: 3908 - DNA, 22 bp, Homo sapiens
taaatgctagggatcaggacag

SEQ ID NO: 3909 - DNA, 20 bp, Homo sapiens
ctgagccttaacatatataa

SEQ ID NO: 3910 - DNA, 24 bp, Homo sapiens
tattgcatttgtaaatattcaaat

SEQ ID NO: 3911 - DNA, 22 bp, Homo sapiens
acagtccggaggagaagaaact

SEQ ID NO: 3912 - DNA, 24 bp, Homo sapiens
tctttcttttgttttatatttcta

SEQ ID NO: 3913 - DNA, 23 bp, Homo sapiens
tagaggactgtcaacgcaccaat

SEQ ID NO: 3914 - DNA, 24 bp, Homo sapiens
tggagggctgagtcagcagcattg

SEQ ID NO: 3915 - DNA, 22 bp, Homo sapiens
atcctgaaacctgatgatgcac

SEQ ID NO: 3916 - DNA, 21 bp, Homo sapiens
gcttatgtctagttttggctc

SEQ ID NO: 3917 - DNA, 22 bp, Homo sapiens
tgtagactttccttgcattttg

SEQ ID NO: 3918 - DNA, 23 bp, Homo sapiens
ggcagcattgcgtgattctccag

SEQ ID NO: 3919 - DNA, 20 bp, Homo sapiens
acatctaatgcaaagtcttc

SEQ ID NO: 3920 - DNA, 22 bp, Homo sapiens
aagtgtttgctgttataaaaca

SEQ ID NO: 3921 - DNA, 21 bp, Homo sapiens
aacatagaggagaggaacatg

SEQ ID NO: 3922 - DNA, 20 bp, Homo sapiens
tctcaaagcggcctaagctg

SEQ ID NO: 3923 - DNA, 20 bp, Homo sapiens
agcatgctgagagctaggaa

SEQ ID NO: 3924 - DNA, 21 bp, Homo sapiens
tcaaggagctcacagtaaagt

SEQ ID NO: 3925 - DNA, 22 bp, Homo sapiens
atactggcactggataccttgg

SEQ ID NO: 3926 - DNA, 21 bp, Homo sapiens
atgcatcagaggctagtgtga

SEQ ID NO: 3927 - DNA, 20 bp, Homo sapiens
cccataaaggctccctctaa

SEQ ID NO: 3928 - DNA, 20 bp, Homo sapiens
ctcaagtaatccagtcgcgt

SEQ ID NO: 3929 - DNA, 22 bp, Homo sapiens
gacctgatgctgctgcaccaac

SEQ ID NO: 3930 - DNA, 22 bp, Homo sapiens
atctgtatgccatttcgtgaac

SEQ ID NO: 3931 - DNA, 20 bp, Homo sapiens
gagatgatatatatatgaat

SEQ ID NO: 3932 - DNA, 22 bp, Homo sapiens
acatccacgaagcagagactag

SEQ ID NO: 3933 - DNA, 22 bp, Homo sapiens
actggacttggagtctctcggc

SEQ ID NO: 3934 - DNA, 20 bp, Homo sapiens
gcatttgatattagggtttt

SEQ ID NO: 3935 - DNA, 22 bp, Homo sapiens
tgaggttcatcgtttgtatctg

SEQ ID NO: 3936 - DNA, 20 bp, Homo sapiens
gagaatatattataagataa

SEQ ID NO: 3937 - DNA, 20 bp, Homo sapiens
aaaataatggattaagctta

SEQ ID NO: 3938 - DNA, 22 bp, Homo sapiens
tctcagtggtgaggatacaaac

SEQ ID NO: 3939 - DNA, 21 bp, Homo sapiens
tagcagaaatgctttatacat

SEQ ID NO: 3940 - DNA, 22 bp, Homo sapiens
gatatacttatcaaaaataaaa

SEQ ID NO: 3941 - DNA, 20 bp, Homo sapiens
gccgaggccctgaactgttc

SEQ ID NO: 3942 - DNA, 24 bp, Homo sapiens
ggttgcagagggaaggagaggtgg

SEQ ID NO: 3943 - DNA, 21 bp, Homo sapiens
cccgctccggggacagtgttc

SEQ ID NO: 3944 - DNA, 20 bp, Homo sapiens
tgcccgcgtagaggtgtgtg

SEQ ID NO: 3945 - DNA, 20 bp, Homo sapiens
gccgtgcacaatcagtttag

SEQ ID NO: 3946 - DNA, 23 bp, Homo sapiens
tgatctaaacagttcccaaaagt

SEQ ID NO: 3947 - DNA, 20 bp, Homo sapiens
ggttcgaatcctgtctctgc

SEQ ID NO: 3948 - DNA, 23 bp, Homo sapiens
tgatctatcatcagtcaaggtca

SEQ ID NO: 3949 - DNA, 22 bp, Homo sapiens
gtgactgggactgggcgtggtg

SEQ ID NO: 3950 - DNA, 22 bp, Homo sapiens
ctgaccttggaattgacagggt

SEQ ID NO: 3951 - DNA, 20 bp, Homo sapiens
gcacctgccacgtctcggcc

SEQ ID NO: 3952 - DNA, 21 bp, Homo sapiens
ctgtaaatctaatggttccca

SEQ ID NO: 3953 - DNA, 21 bp, Homo sapiens
acggagcccggagccggaggc

SEQ ID NO: 3954 - DNA, 23 bp, Homo sapiens
tagcagccccttgagttctaaaa

SEQ ID NO: 3955 - DNA, 21 bp, Homo sapiens
cccgccctcccttcccccacc

SEQ ID NO: 3956 - DNA, 23 bp, Homo sapiens
agaagacccctttgaaggcattt

SEQ ID NO: 3957 - DNA, 20 bp, Homo sapiens
gcctccgttgccctcggctc

SEQ ID NO: 3958 - DNA, 23 bp, Homo sapiens
gaggccgctgagtggatgggtct

SEQ ID NO: 3959 - DNA, 23 bp, Homo sapiens
atagtttgttttttgaggtgggg

SEQ ID NO: 3960 - DNA, 22 bp, Homo sapiens
atcatgccactgaggatttggt

SEQ ID NO: 3961 - DNA, 23 bp, Homo sapiens
tggctcagctcagctccttggac

SEQ ID NO: 3962 - DNA, 22 bp, Homo sapiens
tagcagtgtgtcacaatggcca

SEQ ID NO: 3963 - DNA, 20 bp, Homo sapiens
ggggctctggccccaagccc

SEQ ID NO: 3964 - DNA, 22 bp, Homo sapiens
ccagtagtctgcagattggttt

SEQ ID NO: 3965 - DNA, 21 bp, Homo sapiens
tgagatgaaggtgaatagctc

SEQ ID NO: 3966 - DNA, 22 bp, Homo sapiens
tcgtgcaatggtatactgatgg

SEQ ID NO: 3967 - DNA, 23 bp, Homo sapiens
gccatgatgacagtatttctgag

SEQ ID NO: 3968 - DNA, 20 bp, Homo sapiens
gaccctatagcccaggcttt

SEQ ID NO: 3969 - DNA, 21 bp, Homo sapiens
cttccacagcaccttatggta

SEQ ID NO: 3970 - DNA, 21 bp, Homo sapiens
catgaattgtcaaatacccca

SEQ ID NO: 3971 - DNA, 22 bp, Homo sapiens
ctcagaggcttaacaatcctcc

SEQ ID NO: 3972 - DNA, 23 bp, Homo sapiens
gtcactggggaaactgttaaaag

SEQ ID NO: 3973 - DNA, 22 bp, Homo sapiens
aacaatggcaacagcagcctgg

SEQ ID NO: 3974 - DNA, 20 bp, Homo sapiens
cctccaggaacggtgcctcc

SEQ ID NO: 3975 - DNA, 21 bp, Homo sapiens
ggcgagctcagggaggaaatc

SEQ ID NO: 3976 - DNA, 20 bp, Homo sapiens
cattattacttttgatcctc

SEQ ID NO: 3977 - DNA, 24 bp, Homo sapiens
ggactgggatgcagactctgtata

SEQ ID NO: 3978 - DNA, 20 bp, Homo sapiens
ttaagcattattatttggat

SEQ ID NO: 3979 - DNA, 23 bp, Homo sapiens
aagtttatcctcagctacaactg

SEQ ID NO: 3980 - DNA, 20 bp, Homo sapiens
cgcagcaggtctccatccac

SEQ ID NO: 3981 - DNA, 20 bp, Homo sapiens
tgaggcaggatgtcactgtc

SEQ ID NO: 3982 - DNA, 21 bp, Homo sapiens
gacttgttctctgacctcatc

SEQ ID NO: 3983 - DNA, 22 bp, Homo sapiens
tgaggatcatgaaaaatggaac

SEQ ID NO: 3984 - DNA, 22 bp, Homo sapiens
tctcccgctgagttgatgggtc

SEQ ID NO: 3985 - DNA, 22 bp, Homo sapiens
ttggactctgggatttccacat

SEQ ID NO: 3986 - DNA, 21 bp, Homo sapiens
ccctcattctctaatattggg

SEQ ID NO: 3987 - DNA, 22 bp, Homo sapiens
acgctgagaccctacaaacact

SEQ ID NO: 3988 - DNA, 21 bp, Homo sapiens
gtacagatcaaactcctcaat

SEQ ID NO: 3989 - DNA, 21 bp, Homo sapiens
ggcggcggcgggggtgtgtcc

SEQ ID NO: 3990 - DNA, 21 bp, Homo sapiens
gagcttatcaagtcagcctag

SEQ ID NO: 3991 - DNA, 20 bp, Homo sapiens
gtccagttttcccagaacta

SEQ ID NO: 3992 - DNA, 20 bp, Homo sapiens
gactcttagctgcgaggtaa

SEQ ID NO: 3993 - DNA, 20 bp, Homo sapiens
tttcaactcatatttaaacc

SEQ ID NO: 3994 - DNA, 22 bp, Homo sapiens
ttcacagcttagaagttggcgt

SEQ ID NO: 3995 - DNA, 21 bp, Homo sapiens
tgaggtagtggtttgtaaagt

SEQ ID NO: 3996 - DNA, 23 bp, Homo sapiens
atgaagttgtctgggcgtggtgg

SEQ ID NO: 3997 - DNA, 22 bp, Homo sapiens
tcatcagaggggatcaggtgag

SEQ ID NO: 3998 - DNA, 22 bp, Homo sapiens
tgagtgcccgagccatatagca

SEQ ID NO: 3999 - DNA, 20 bp, Homo sapiens
ccacccccaccccacgtcac

SEQ ID NO: 4000 - DNA, 20 bp, Homo sapiens
ccctaaattagctatgtaag

SEQ ID NO: 4001 - DNA, 22 bp, Homo sapiens
tgtcagttcactggtatccttg

SEQ ID NO: 4002 - DNA, 20 bp, Homo sapiens
acattagtctgcacatggct

SEQ ID NO: 4003 - DNA, 23 bp, Homo sapiens
acactatagtggtgttacttaca

SEQ ID NO: 4004 - DNA, 22 bp, Homo sapiens
tgaaagtaatctgaagcgaaac

SEQ ID NO: 4005 - DNA, 21 bp, Homo sapiens
gcgagagggtggggaggaggg

SEQ ID NO: 4006 - DNA, 22 bp, Homo sapiens
cgcccagggcggcagcgcggca

SEQ ID NO: 4007 - DNA, 21 bp, Homo sapiens
ggggggagtgggggggtgtgg

SEQ ID NO: 4008 - DNA, 20 bp, Homo sapiens
acaaaagacaccccccacca

SEQ ID NO: 4009 - DNA, 23 bp, Homo sapiens
ccgcttgctgcatcacgtctgct

SEQ ID NO: 4010 - DNA, 22 bp, Homo sapiens
ttggagtccctgatgaaggcag

SEQ ID NO: 4011 - DNA, 20 bp, Homo sapiens
accgccgaggaaaaccgtgt

SEQ ID NO: 4012 - DNA, 22 bp, Homo sapiens
tccctgagacaagcacagtgtc

SEQ ID NO: 4013 - DNA, 20 bp, Homo sapiens
tgaggtagtaggtttctgtt

SEQ ID NO: 4014 - DNA, 22 bp, Homo sapiens
tttggcaatggtaatagtgacc

SEQ ID NO: 4015 - DNA, 23 bp, Homo sapiens
gtccagtgggcccaggggctttt

SEQ ID NO: 4016 - DNA, 23 bp, Homo sapiens
ccctatggctggtttatggggcc

SEQ ID NO: 4017 - DNA, 22 bp, Homo sapiens
tagtagggcagtagtgggtaag

SEQ ID NO: 4018 - DNA, 22 bp, Homo sapiens
gagctcagttcagcagaggtga

SEQ ID NO: 4019 - DNA, 23 bp, Homo sapiens
agctacattgtatgctgctggta

SEQ ID NO: 4020 - DNA, 22 bp, Homo sapiens
atgctgctgctgcagtaaccaa

SEQ ID NO: 4021 - DNA, 22 bp, Homo sapiens
tccccagagaaataacttggtc

SEQ ID NO: 4022 - DNA, 21 bp, Homo sapiens
tgagatgggatgtttccgctc

SEQ ID NO: 4023 - DNA, 24 bp, Homo sapiens
acaccatctgacggtttaggagag

SEQ ID NO: 4024 - DNA, 20 bp, Homo sapiens
aaccttgggaagtatatttc

SEQ ID NO: 4025 - DNA, 21 bp, Homo sapiens
taatactgcctgcatttatga

SEQ ID NO: 4026 - DNA, 20 bp, Homo sapiens
agacctgtgatcctagcact

SEQ ID NO: 4027 - DNA, 22 bp, Homo sapiens
tactgcaatgtcaaatgtttgt

SEQ ID NO: 4028 - DNA, 20 bp, Homo sapiens
tggatttttggagcaggaac

SEQ ID NO: 4029 - DNA, 22 bp, Homo sapiens
tgcatcattaggtgatatcatc

SEQ ID NO: 4030 - DNA, 20 bp, Homo sapiens
gtaactggggaaacctcccc

SEQ ID NO: 4031 - DNA, 20 bp, Homo sapiens
agggctcatacctttcaggg

SEQ ID NO: 4032 - DNA, 22 bp, Homo sapiens
aggagtctcaaaacctccacag

SEQ ID NO: 4033 - DNA, 23 bp, Homo sapiens
tagcttgctgagtgtctgggagt

SEQ ID NO: 4034 - DNA, 20 bp, Homo sapiens
ctcggggccaccgcgcgcca

SEQ ID NO: 4035 - DNA, 20 bp, Homo sapiens
actggacttggagttgagga

SEQ ID NO: 4036 - DNA, 21 bp, Homo sapiens
caggcccgctcccacattgtg

SEQ ID NO: 4037 - DNA, 23 bp, Homo sapiens
tttaggcatgctggctacttctg

SEQ ID NO: 4038 - DNA, 22 bp, Homo sapiens
gcactgccattagggattgaac

SEQ ID NO: 4039 - DNA, 21 bp, Homo sapiens
ctagaggaagtaaatcaggta

SEQ ID NO: 4040 - DNA, 20 bp, Homo sapiens
gcagagctggccgagtgggc

SEQ ID NO: 4041 - DNA, 21 bp, Homo sapiens
tagcccaagctaagatccagg

SEQ ID NO: 4042 - DNA, 21 bp, Homo sapiens
ccggctggatctaagagaggc

SEQ ID NO: 4043 - DNA, 22 bp, Homo sapiens
aagacattgccagggattcaag

SEQ ID NO: 4044 - DNA, 22 bp, Homo sapiens
atatttgcattgaaagccaggt

SEQ ID NO: 4045 - DNA, 22 bp, Homo sapiens
aaaccacatggtatacttctgg

SEQ ID NO: 4046 - DNA, 20 bp, Homo sapiens
tcatacagggctcccttccc

SEQ ID NO: 4047 - DNA, 22 bp, Homo sapiens
agaggtttatggttgccgctgc

SEQ ID NO: 4048 - DNA, 20 bp, Homo sapiens
cctatgaatgtgagctctca

SEQ ID NO: 4049 - DNA, 23 bp, Homo sapiens
gtcctcactctggtctccgaaga

SEQ ID NO: 4050 - DNA, 23 bp, Homo sapiens
agcagcattgccaccgcagccac

SEQ ID NO: 4051 - DNA, 23 bp, Homo sapiens
tagcaccatccagaatctcacat

SEQ ID NO: 4052 - DNA, 20 bp, Homo sapiens
ctcttgtgcgggataatgtc

SEQ ID NO: 4053 - DNA, 22 bp, Homo sapiens
aggtctggcaagcatgactacc

SEQ ID NO: 4054 - DNA, 22 bp, Homo sapiens
ttctgattgcagtttatggttg

SEQ ID NO: 4055 - DNA, 23 bp, Homo sapiens
gacatttcgatcgccttgaggcc

SEQ ID NO: 4056 - DNA, 21 bp, Homo sapiens
gcggcggcggggggagaaaga

SEQ ID NO: 4057 - DNA, 22 bp, Homo sapiens
tagctttctgagatgaacacag

SEQ ID NO: 4058 - DNA, 23 bp, Homo sapiens
atcgaatatctcatgatcttctg

SEQ ID NO: 4059 - DNA, 22 bp, Homo sapiens
ttctcagatctgattagcacca

SEQ ID NO: 4060 - DNA, 20 bp, Homo sapiens
tgaggcaataacaggtcttt

SEQ ID NO: 4061 - DNA, 22 bp, Homo sapiens
ttactaaacagttgctttttgg

SEQ ID NO: 4062 - DNA, 21 bp, Homo sapiens
ctcttgctgctcggtgcctag

SEQ ID NO: 4063 - DNA, 22 bp, Homo sapiens
tggagagaggaatgacctctga

SEQ ID NO: 4064 - DNA, 20 bp, Homo sapiens
tccgtgagctattttgatcc

SEQ ID NO: 4065 - DNA, 23 bp, Homo sapiens
aggactggacagtttatggggtg

SEQ ID NO: 4066 - DNA, 23 bp, Homo sapiens
tccaacataataaatatcaatag

SEQ ID NO: 4067 - DNA, 22 bp, Homo sapiens
cccttgaactggcagagtcaac

SEQ ID NO: 4068 - DNA, 20 bp, Homo sapiens
ggagcaacagcattaggacg

SEQ ID NO: 4069 - DNA, 21 bp, Homo sapiens
ttcacagtggctaagcagagc

SEQ ID NO: 4070 - DNA, 23 bp, Homo sapiens
aataaaacctttgcaacagcaga

SEQ ID NO: 4071 - DNA, 20 bp, Homo sapiens
taggaaatgctcttgttgat

SEQ ID NO: 4072 - DNA, 21 bp, Homo sapiens
tgagtactagcactgtagcca

SEQ ID NO: 4073 - DNA, 22 bp, Homo sapiens
aaactaggcacacatgactcaa

SEQ ID NO: 4074 - DNA, 24 bp, Homo sapiens
ttgagcaatagatacgttccagta

SEQ ID NO: 4075 - DNA, 23 bp, Homo sapiens
taattatgaggtatggtgatctc

SEQ ID NO: 4076 - DNA, 24 bp, Homo sapiens
cgggcccgggggaggtcacctgca

SEQ ID NO: 4077 - DNA, 22 bp, Homo sapiens
atcacagctaactttcggaggt

SEQ ID NO: 4078 - DNA, 23 bp, Homo sapiens
gagtgtgatgttggggacatgcc

SEQ ID NO: 4079 - DNA, 20 bp, Homo sapiens
gtaaaaggatgagctgttta

SEQ ID NO: 4080 - DNA, 22 bp, Homo sapiens
cggaagacccgctcccccgggc

SEQ ID NO: 4081 - DNA, 22 bp, Homo sapiens
tttgtgactttattgcacagaa

SEQ ID NO: 4082 - DNA, 22 bp, Homo sapiens
tttgttattcttgagataggct

SEQ ID NO: 4083 - DNA, 20 bp, Homo sapiens
gtgggagtgttttttgtgtg

SEQ ID NO: 4084 - DNA, 20 bp, Homo sapiens
atctacgaccaagctcaaaa

SEQ ID NO: 4085 - DNA, 21 bp, Homo sapiens
gtgcagtactgtgatgtgact

SEQ ID NO: 4086 - DNA, 22 bp, Homo sapiens
gactggataaggccaggcgcgg

SEQ ID NO: 4087 - DNA, 20 bp, Homo sapiens
ctccccactgctgggcccag

SEQ ID NO: 4088 - DNA, 20 bp, Homo sapiens
tgggtcagttcagcaagaac

SEQ ID NO: 4089 - DNA, 23 bp, Homo sapiens
cccagttgggctcagcctggcct

SEQ ID NO: 4090 - DNA, 21 bp, Homo sapiens
tcatatgtcctactgtgcaga

SEQ ID NO: 4091 - DNA, 22 bp, Homo sapiens
tgctcactttcagcagctgtga

SEQ ID NO: 4092 - DNA, 22 bp, Homo sapiens
tctcgaggcttcacatggtcac

SEQ ID NO: 4093 - DNA, 22 bp, Homo sapiens
tagcaccagttgaaataaacag

SEQ ID NO: 4094 - DNA, 20 bp, Homo sapiens
tggtatttcatctggatgga

SEQ ID NO: 4095 - DNA, 22 bp, Homo sapiens
tatcttatcactgactgcatct

SEQ ID NO: 4096 - DNA, 21 bp, Homo sapiens
tagaaaccaggaacatggagt

SEQ ID NO: 4097 - DNA, 24 bp, Homo sapiens
ggtgcttcacgcggaaatacacgt

SEQ ID NO: 4098 - DNA, 24 bp, Homo sapiens
cggccgcccccggggcggggctac

SEQ ID NO: 4099 - DNA, 21 bp, Homo sapiens
aggacagacactggcatagct

SEQ ID NO: 4100 - DNA, 21 bp, Homo sapiens
atcatcggtaactttcataaa

SEQ ID NO: 4101 - DNA, 20 bp, Homo sapiens
catgctggaggctattgtct

SEQ ID NO: 4102 - DNA, 20 bp, Homo sapiens
tgacctatgagcactgtgtt

SEQ ID NO: 4103 - DNA, 22 bp, Homo sapiens
ctctttccattcctgcaactgt

SEQ ID NO: 4104 - DNA, 22 bp, Homo sapiens
tgatctcatctgatgctaacat

SEQ ID NO: 4105 - DNA, 21 bp, Homo sapiens
gttgatgatgatgttctgaaa

SEQ ID NO: 4106 - DNA, 21 bp, Homo sapiens
tggctgtgatgagtgaaatgg

SEQ ID NO: 4107 - DNA, 24 bp, Homo sapiens
actagcaaggcgctgcagtagaga

SEQ ID NO: 4108 - DNA, 22 bp, Homo sapiens
tgctacaacactgggcgggtat

SEQ ID NO: 4109 - DNA, 21 bp, Homo sapiens
tctcttagatctatgatatca

SEQ ID NO: 4110 - DNA, 23 bp, Homo sapiens
aataatagtggataccgtccagt

SEQ ID NO: 4111 - DNA, 21 bp, Homo sapiens
tatgaccatcacatgctgact

SEQ ID NO: 4112 - DNA, 23 bp, Homo sapiens
ttgatggggacatgcatgtctgg

SEQ ID NO: 4113 - DNA, 23 bp, Homo sapiens
gcttggtttctccaggaatcaga

SEQ ID NO: 4114 - DNA, 22 bp, Homo sapiens
atcccagggttaacatggtctg

SEQ ID NO: 4115 - DNA, 22 bp, Homo sapiens
gctccaaacagttataccaaca

SEQ ID NO: 4116 - DNA, 20 bp, Homo sapiens
tttggcccttagaaagcact

SEQ ID NO: 4117 - DNA, 22 bp, Homo sapiens
aaagtcaatgtgtttgactcaa

SEQ ID NO: 4118 - DNA, 24 bp, Homo sapiens
cccccacagtagccggcttcatgg

SEQ ID NO: 4119 - DNA, 24 bp, Homo sapiens
acagcaaataaaagcctgatccag

SEQ ID NO: 4120 - DNA, 20 bp, Homo sapiens
ttacatgttagccagcagta

SEQ ID NO: 4121 - DNA, 22 bp, Homo sapiens
atcacatgattgacacggtcca

SEQ ID NO: 4122 - DNA, 21 bp, Homo sapiens
tagcaccatctgatatatcat

SEQ ID NO: 4123 - DNA, 22 bp, Homo sapiens
aagttgtatattagcatgagtt

SEQ ID NO: 4124 - DNA, 22 bp, Homo sapiens
gtgagctgagtacaattgggta

SEQ ID NO: 4125 - DNA, 20 bp, Homo sapiens
cttttcataggagatatgtc

SEQ ID NO: 4126 - DNA, 21 bp, Homo sapiens
acttccaggaaattgtgtggt

SEQ ID NO: 4127 - DNA, 22 bp, Homo sapiens
gaaagtatagtctagtggggtt

SEQ ID NO: 4128 - DNA, 23 bp, Homo sapiens
ttattttttaacttttttcttcg

SEQ ID NO: 4129 - DNA, 22 bp, Homo sapiens
atcacattgctgaactccattg

SEQ ID NO: 4130 - DNA, 22 bp, Homo sapiens
tatatgtatttctttaggcaat

SEQ ID NO: 4131 - DNA, 20 bp, Homo sapiens
cggcggcggcggcgactctg

SEQ ID NO: 4132 - DNA, 23 bp, Homo sapiens
atcagatagtgacccgcaagctg

SEQ ID NO: 4133 - DNA, 20 bp, Homo sapiens
ggccagttttcccaaaaatc

SEQ ID NO: 4134 - DNA, 22 bp, Homo sapiens
tatacttgctcaggatcccaat

SEQ ID NO: 4135 - DNA, 23 bp, Homo sapiens
tgctggtttgttgggtgggggtt

SEQ ID NO: 4136 - DNA, 20 bp, Homo sapiens
gttagtccaggagaaggtgg

SEQ ID NO: 4137 - DNA, 21 bp, Homo sapiens
tgagatgaagtgtcagggttt

SEQ ID NO: 4138 - DNA, 22 bp, Homo sapiens
aatctgagctgggtttagacta

SEQ ID NO: 4139 - DNA, 22 bp, Homo sapiens
ttcagacttggactgatagggt

SEQ ID NO: 4140 - DNA, 23 bp, Homo sapiens
cactggtttgctgggattttgca

SEQ ID NO: 4141 - DNA, 21 bp, Homo sapiens
agactgggtagtttataattg

SEQ ID NO: 4142 - DNA, 21 bp, Homo sapiens
ggcacggacaggattgacatt

SEQ ID NO: 4143 - DNA, 20 bp, Homo sapiens
cacagcataagaataactgt

SEQ ID NO: 4144 - DNA, 20 bp, Homo sapiens
tctggttggctctaccaatt

SEQ ID NO: 4145 - DNA, 22 bp, Homo sapiens
tgagacaggatgtcactgctct

SEQ ID NO: 4146 - DNA, 22 bp, Homo sapiens
tagtgataatccaggataacct

SEQ ID NO: 4147 - DNA, 20 bp, Homo sapiens
ccccggggaggggacgcccg

SEQ ID NO: 4148 - DNA, 20 bp, Homo sapiens
agagggcacctagcgcccag

SEQ ID NO: 4149 - DNA, 21 bp, Homo sapiens
ttacagtactgtgattcagtc

SEQ ID NO: 4150 - DNA, 20 bp, Homo sapiens
taaatgttcaccagtgaggc

SEQ ID NO: 4151 - DNA, 20 bp, Homo sapiens
catgctgagagctattctca

SEQ ID NO: 4152 - DNA, 21 bp, Homo sapiens
caagagagcccgccacgcgct

SEQ ID NO: 4153 - DNA, 21 bp, Homo sapiens
agttcttcagtggctgatggc

SEQ ID NO: 4154 - DNA, 20 bp, Homo sapiens
ccacatccaagcttccttcc

SEQ ID NO: 4155 - DNA, 20 bp, Homo sapiens
gatcccaagctaaatcccaa

SEQ ID NO: 4156 - DNA, 22 bp, Homo sapiens
catcatgggtgacccctgggat

SEQ ID NO: 4157 - DNA, 22 bp, Homo sapiens
atcgtgccattgaacgccagcc

SEQ ID NO: 4158 - DNA, 21 bp, Homo sapiens
ggtgagctctcgctggccatg

SEQ ID NO: 4159 - DNA, 22 bp, Homo sapiens
atcactggtttgacttaatcca

SEQ ID NO: 4160 - DNA, 21 bp, Homo sapiens
gaagatgtagatatgatgtgg

SEQ ID NO: 4161 - DNA, 20 bp, Homo sapiens
tccagacggcttgaaggatc

SEQ ID NO: 4162 - DNA, 22 bp, Homo sapiens
gtcctatcaacaactacatgag

SEQ ID NO: 4163 - DNA, 20 bp, Homo sapiens
cccagccctgcggggtacag

SEQ ID NO: 4164 - DNA, 23 bp, Homo sapiens
tagtcaactgcactgtacttgct

SEQ ID NO: 4165 - DNA, 22 bp, Homo sapiens
cactagttaacttttatggggt

SEQ ID NO: 4166 - DNA, 20 bp, Homo sapiens
gaggtcaaaagggtgaggct

SEQ ID NO: 4167 - DNA, 23 bp, Homo sapiens
tatcactggtctggtatgtttgg

SEQ ID NO: 4168 - DNA, 20 bp, Homo sapiens
tagcggtttggcctgttacc

SEQ ID NO: 4169 - DNA, 21 bp, Homo sapiens
gctttcataatcagaggtaaa

SEQ ID NO: 4170 - DNA, 20 bp, Homo sapiens
gagccattgactatgatgaa

SEQ ID NO: 4171 - DNA, 21 bp, Homo sapiens
tagccatgcaagaacaacttt

SEQ ID NO: 4172 - DNA, 21 bp, Homo sapiens
atatttaatactcttctctga

SEQ ID NO: 4173 - DNA, 22 bp, Homo sapiens
atatattatctctgctcggtaa

SEQ ID NO: 4174 - DNA, 22 bp, Homo sapiens
tcaagtgagtaagccaggtgct

SEQ ID NO: 4175 - DNA, 24 bp, Homo sapiens
tcacagtctcccgtggaggcgtgg

SEQ ID NO: 4176 - DNA, 22 bp, Homo sapiens
cattattatccccatcgtatag

SEQ ID NO: 4177 - DNA, 22 bp, Homo sapiens
aaaggcattttgcatgagagtt

SEQ ID NO: 4178 - DNA, 22 bp, Homo sapiens
attaatatgtgcacttcttcca

SEQ ID NO: 4179 - DNA, 22 bp, Homo sapiens
tccccactgcattgcccacagt

SEQ ID NO: 4180 - DNA, 23 bp, Homo sapiens
ttttaagaaaatgaagaaaaaag

SEQ ID NO: 4181 - DNA, 20 bp, Homo sapiens
tccctctcggcgccccctcg

SEQ ID NO: 4182 - DNA, 20 bp, Homo sapiens
cgattccccgagccctctcc

SEQ ID NO: 4183 - DNA, 20 bp, Homo sapiens
ccatggcacatgcctaaggt

SEQ ID NO: 4184 - DNA, 21 bp, Homo sapiens
cattattagatttggttacat

SEQ ID NO: 4185 - DNA, 21 bp, Homo sapiens
tgacctacaggcactgcctaa

SEQ ID NO: 4186 - DNA, 23 bp, Homo sapiens
agttttgtgttctaaagatttgt

SEQ ID NO: 4187 - DNA, 21 bp, Homo sapiens
aggcataggtctgcaaacaaa

SEQ ID NO: 4188 - DNA, 22 bp, Homo sapiens
aatagcttaccatgcagtctaa

SEQ ID NO: 4189 - DNA, 21 bp, Homo sapiens
tcacagtggcgcctggaacac

SEQ ID NO: 4190 - DNA, 20 bp, Homo sapiens
aactgcaatggtaatgacag

SEQ ID NO: 4191 - DNA, 22 bp, Homo sapiens
gtccagttttcctgacttgacc

SEQ ID NO: 4192 - DNA, 22 bp, Homo sapiens
aatcatgccttattactgagtt

SEQ ID NO: 4193 - DNA, 22 bp, Homo sapiens
agacagtttaggtttatgccca

SEQ ID NO: 4194 - DNA, 20 bp, Homo sapiens
ttattagttagctttaagag

SEQ ID NO: 4195 - DNA, 22 bp, Homo sapiens
tgatgattgcattgtgttgaca

SEQ ID NO: 4196 - DNA, 20 bp, Homo sapiens
gggctgcatggcttcaaatc

SEQ ID NO: 4197 - DNA, 22 bp, Homo sapiens
tgtactgggtgacctatgaaat

SEQ ID NO: 4198 - DNA, 20 bp, Homo sapiens
gactcttctgccagctttct

SEQ ID NO: 4199 - DNA, 24 bp, Homo sapiens
acctcagagcccttgctgtctgtc

SEQ ID NO: 4200 - DNA, 20 bp, Homo sapiens
accatcccccaggagacagc

SEQ ID NO: 4201 - DNA, 22 bp, Homo sapiens
aaaggcaatggtaaatcactga

SEQ ID NO: 4202 - DNA, 21 bp, Homo sapiens
atcgatgtggtgaccatattg

SEQ ID NO: 4203 - DNA, 22 bp, Homo sapiens
tattgcactttgaaatcaactg

SEQ ID NO: 4204 - DNA, 21 bp, Homo sapiens
ctgagaagcattgatccaggg

SEQ ID NO: 4205 - DNA, 22 bp, Homo sapiens
tccatgtttaattgcatacaac

SEQ ID NO: 4206 - DNA, 20 bp, Homo sapiens
accctactgatgatgtcaac

SEQ ID NO: 4207 - DNA, 22 bp, Homo sapiens
tagttcattaggtcctatggat

SEQ ID NO: 4208 - DNA, 22 bp, Homo sapiens
tgatgaccctgagccgcaaaac

SEQ ID NO: 4209 - DNA, 20 bp, Homo sapiens
ggcggcggcggggggagagg

SEQ ID NO: 4210 - DNA, 22 bp, Homo sapiens
acttgtaatttgacctaatggt

SEQ ID NO: 4211 - DNA, 21 bp, Homo sapiens
ccatggcacagtaataaaata

SEQ ID NO: 4212 - DNA, 22 bp, Homo sapiens
accaatggcaaatgtcagagtt

SEQ ID NO: 4213 - DNA, 22 bp, Homo sapiens
ccctccccgccccgcgccctcg

SEQ ID NO: 4214 - DNA, 22 bp, Homo sapiens
tatttccgctagactggaggtg

SEQ ID NO: 4215 - DNA, 22 bp, Homo sapiens
accagtgttcagagatggagtt

SEQ ID NO: 4216 - DNA, 22 bp, Homo sapiens
atgttacatggtagcagagacc

SEQ ID NO: 4217 - DNA, 21 bp, Homo sapiens
cactataagactgttgcatta

SEQ ID NO: 4218 - DNA, 22 bp, Homo sapiens
tgaccttaatcactaggcatag

SEQ ID NO: 4219 - DNA, 22 bp, Homo sapiens
agagatgaagcactgattgatg

SEQ ID NO: 4220 - DNA, 22 bp, Homo sapiens
acagcaggcacagatgacactc

SEQ ID NO: 4221 - DNA, 22 bp, Homo sapiens
gacctgatgctgagtttttgct

SEQ ID NO: 4222 - DNA, 21 bp, Homo sapiens
tgatctatcaagtacagggtc

SEQ ID NO: 4223 - DNA, 20 bp, Homo sapiens
tccttaatgctcttgtggtc

SEQ ID NO: 4224 - DNA, 22 bp, Homo sapiens
actacattgccagggatcctgg

SEQ ID NO: 4225 - DNA, 21 bp, Homo sapiens
ggagagggtagtttatggggt

SEQ ID NO: 4226 - DNA, 22 bp, Homo sapiens
tagctggtcttgaaatcctggc

SEQ ID NO: 4227 - DNA, 20 bp, Homo sapiens
tgtctcctcgaaaaaaaatc

SEQ ID NO: 4228 - DNA, 22 bp, Homo sapiens
tcctgtctgctaccactgttgg

SEQ ID NO: 4229 - DNA, 20 bp, Homo sapiens
cccgaggccctgaatcaaac

SEQ ID NO: 4230 - DNA, 23 bp, Homo sapiens
cccagtgttcagacttcctgaga

SEQ ID NO: 4231 - DNA, 22 bp, Homo sapiens
tagcacccaccagggctgacac

SEQ ID NO: 4232 - DNA, 23 bp, Homo sapiens
ccacgccccctcccctcctcccg

SEQ ID NO: 4233 - DNA, 23 bp, Homo sapiens
caggagttttcccacctgctttc

SEQ ID NO: 4234 - DNA, 23 bp, Homo sapiens
ctacacatatgttccaggggcca

SEQ ID NO: 4235 - DNA, 20 bp, Homo sapiens
tattaaagttgctgcagctc

SEQ ID NO: 4236 - DNA, 20 bp, Homo sapiens
gcccacccccgcggagggcg

SEQ ID NO: 4237 - DNA, 21 bp, Homo sapiens
aaccatctggcacctacaggg

SEQ ID NO: 4238 - DNA, 20 bp, Homo sapiens
ttcacagtggctaacagtac

SEQ ID NO: 4239 - DNA, 20 bp, Homo sapiens
tctggccgtagaggtggtaa

SEQ ID NO: 4240 - DNA, 20 bp, Homo sapiens
ccccattgccatatccactc

SEQ ID NO: 4241 - DNA, 23 bp, Homo sapiens
aatggcacgatcagatttacact

SEQ ID NO: 4242 - DNA, 20 bp, Homo sapiens
tgccccatagccaagcaagc

SEQ ID NO: 4243 - DNA, 21 bp, Homo sapiens
cagtcaaacagtttatctaca

SEQ ID NO: 4244 - DNA, 20 bp, Homo sapiens
agcaatgatgatgactgaca

SEQ ID NO: 4245 - DNA, 23 bp, Homo sapiens
agcagcaatggtgatagtctggg

SEQ ID NO: 4246 - DNA, 20 bp, Homo sapiens
agcttgctgagaatcgccag

SEQ ID NO: 4247 - DNA, 20 bp, Homo sapiens
gtggccaaatggtccaaaac

SEQ ID NO: 4248 - DNA, 22 bp, Homo sapiens
tgagtcattagtgaatcaaatg

SEQ ID NO: 4249 - DNA, 20 bp, Homo sapiens
gtccagttttcccaaggccc

SEQ ID NO: 4250 - DNA, 20 bp, Homo sapiens
tggctcagcctgataaagga

SEQ ID NO: 4251 - DNA, 22 bp, Homo sapiens
tagcaccatttgattatttcag

SEQ ID NO: 4252 - DNA, 23 bp, Homo sapiens
gtctaggctttttcgttttatgc

SEQ ID NO: 4253 - DNA, 22 bp, Homo sapiens
tgagatgaagctgacatcaagg

SEQ ID NO: 4254 - DNA, 22 bp, Homo sapiens
taaatgctcaaagcgtcctctc

SEQ ID NO: 4255 - DNA, 22 bp, Homo sapiens
attgtgctgccaccgatccttg

SEQ ID NO: 4256 - DNA, 21 bp, Homo sapiens
gctattgaagccttgctatcc

SEQ ID NO: 4257 - DNA, 20 bp, Homo sapiens
agatcacacaactgcgctac

SEQ ID NO: 4258 - DNA, 24 bp, Homo sapiens
agaagcattaggctctatcatcta

SEQ ID NO: 4259 - DNA, 21 bp, Homo sapiens
gtacagtactgtgatgatagc

SEQ ID NO: 4260 - DNA, 20 bp, Homo sapiens
gttgtaattgatcctcagga

SEQ ID NO: 4261 - DNA, 21 bp, Homo sapiens
cgatccagccgtactcgtcca

SEQ ID NO: 4262 - DNA, 21 bp, Homo sapiens
tgagaacttcgtgactaggca

SEQ ID NO: 4263 - DNA, 20 bp, Homo sapiens
cttgcagtgatgcaggttcg

SEQ ID NO: 4264 - DNA, 22 bp, Homo sapiens
caggaatacagacactgtaact

SEQ ID NO: 4265 - DNA, 24 bp, Homo sapiens
tggagactgggagcaaagtgtcaa

SEQ ID NO: 4266 - DNA, 20 bp, Homo sapiens
atcacaggtaagaaagtctt

SEQ ID NO: 4267 - DNA, 20 bp, Homo sapiens
cccagcaaggctccagcacg

SEQ ID NO: 4268 - DNA, 23 bp, Homo sapiens
gttataatgccgaggttgtgagt

SEQ ID NO: 4269 - DNA, 23 bp, Homo sapiens
tctcttattgagttgtgttttgt

SEQ ID NO: 4270 - DNA, 23 bp, Homo sapiens
gtcctcaaaagggtccccgacat

SEQ ID NO: 4271 - DNA, 20 bp, Homo sapiens
tccctgtcctccaagagctt

SEQ ID NO: 4272 - DNA, 22 bp, Homo sapiens
ctgaatgcctaggctcaggtgt

SEQ ID NO: 4273 - DNA, 20 bp, Homo sapiens
gacaaccaccaagtcaccag

SEQ ID NO: 4274 - DNA, 23 bp, Homo sapiens
agcagcaccagccaggaaaggga

SEQ ID NO: 4275 - DNA, 22 bp, Homo sapiens
catgcaatcatcattattatgc

SEQ ID NO: 4276 - DNA, 21 bp, Homo sapiens
tcggctgtgtatctctgtgcc

SEQ ID NO: 4277 - DNA, 22 bp, Homo sapiens
ccacagcgtggcacagtcgcct

SEQ ID NO: 4278 - DNA, 22 bp, Homo sapiens
taccagaacatattttcatggt

SEQ ID NO: 4279 - DNA, 23 bp, Homo sapiens
attctccttgccactgtccactg

SEQ ID NO: 4280 - DNA, 22 bp, Homo sapiens
ctctgacctctgaccctctagc

SEQ ID NO: 4281 - DNA, 24 bp, Homo sapiens
ccctcacccttccttcttcccagg

SEQ ID NO: 4282 - DNA, 22 bp, Homo sapiens
tcacagttcactgggcgtttct

SEQ ID NO: 4283 - DNA, 22 bp, Homo sapiens
tctcccaacccttgatggatga

SEQ ID NO: 4284 - DNA, 24 bp, Homo sapiens
atgcaagaggtggcttttcatggt

SEQ ID NO: 4285 - DNA, 21 bp, Homo sapiens
atgtgctataggccagtggtt

SEQ ID NO: 4286 - DNA, 21 bp, Homo sapiens
gtccagtgggaaactgaagct

SEQ ID NO: 4287 - DNA, 21 bp, Homo sapiens
agcagcattgtacagtatact

SEQ ID NO: 4288 - DNA, 23 bp, Homo sapiens
tgaccagctgagtcagcagcagt

SEQ ID NO: 4289 - DNA, 22 bp, Homo sapiens
taagaatatgagttgatgttga

SEQ ID NO: 4290 - DNA, 20 bp, Homo sapiens
atgttcattgtgtgataatt

SEQ ID NO: 4291 - DNA, 20 bp, Homo sapiens
attatgaattgtctagagag

SEQ ID NO: 4292 - DNA, 21 bp, Homo sapiens
tccacacaagtctgatggtta

SEQ ID NO: 4293 - DNA, 22 bp, Homo sapiens
ctgacatgagacagaaaggaca

SEQ ID NO: 4294 - DNA, 23 bp, Homo sapiens
cgcagtgttgagtgtcgtccagt

SEQ ID NO: 4295 - DNA, 21 bp, Homo sapiens
tacctggttgatcctgacagt

SEQ ID NO: 4296 - DNA, 20 bp, Homo sapiens
acaaggtatcacgctgtgtg

SEQ ID NO: 4297 - DNA, 24 bp, Homo sapiens
cggctggtccgagtgcagtggtgt

SEQ ID NO: 4298 - DNA, 20 bp, Homo sapiens
cagcacctgaaggtccacac

SEQ ID NO: 4299 - DNA, 20 bp, Homo sapiens
cgggggtgttggcgcatgcc

SEQ ID NO: 4300 - DNA, 20 bp, Homo sapiens
caccaccttgtgatgcttgg

SEQ ID NO: 4301 - DNA, 22 bp, Homo sapiens
agaatgaaacgcatatgcatgt

SEQ ID NO: 4302 - DNA, 20 bp, Homo sapiens
catactgatgatgtctgagc

SEQ ID NO: 4303 - DNA, 20 bp, Homo sapiens
ctgcaatgagcattattata

SEQ ID NO: 4304 - DNA, 23 bp, Homo sapiens
cgcgcgtgtgtgtgtatgatgga

SEQ ID NO: 4305 - DNA, 22 bp, Homo sapiens
agctcagggtgggccccatggt

SEQ ID NO: 4306 - DNA, 20 bp, Homo sapiens
cccagtgtgactcagcagtg

SEQ ID NO: 4307 - DNA, 23 bp, Homo sapiens
agccttccgtatgtcttagcgtc

SEQ ID NO: 4308 - DNA, 21 bp, Homo sapiens
cacatatatccatgcatgcat

SEQ ID NO: 4309 - DNA, 24 bp, Homo sapiens
gtatggtccaggaaggtggggacc

SEQ ID NO: 4310 - DNA, 23 bp, Homo sapiens
ggcgctcccgctctcccacccct

SEQ ID NO: 4311 - DNA, 21 bp, Homo sapiens
gagtcaaacagaaagacccca

SEQ ID NO: 4312 - DNA, 20 bp, Homo sapiens
tacctttagctcttgttggg

SEQ ID NO: 4313 - DNA, 20 bp, Homo sapiens
ccctcattctctaatatccc

SEQ ID NO: 4314 - DNA, 20 bp, Homo sapiens
tcccgggtttcggcaccaat

SEQ ID NO: 4315 - DNA, 22 bp, Homo sapiens
tcagcacccactgggatgggca

SEQ ID NO: 4316 - DNA, 22 bp, Homo sapiens
tctcctgcatctgacgtgctct

SEQ ID NO: 4317 - DNA, 22 bp, Homo sapiens
tagcttcagtctttgcaaccag

SEQ ID NO: 4318 - DNA, 20 bp, Homo sapiens
tccccggcatctcagtggtg

SEQ ID NO: 4319 - DNA, 21 bp, Homo sapiens
tctggacgcgagctgggcatc

SEQ ID NO: 4320 - DNA, 23 bp, Homo sapiens
cccacccctgctccccgcgcccc

SEQ ID NO: 4321 - DNA, 20 bp, Homo sapiens
aaatcgatagcccgggtggt

SEQ ID NO: 4322 - DNA, 21 bp, Homo sapiens
ctgatacattcttccagcaac

SEQ ID NO: 4323 - DNA, 23 bp, Homo sapiens
tgtgcaaatctatatggaactga

SEQ ID NO: 4324 - DNA, 20 bp, Homo sapiens
taatattacacagtatagca

SEQ ID NO: 4325 - DNA, 21 bp, Homo sapiens
ttcagcagtcaaaggaggcgt

SEQ ID NO: 4326 - DNA, 23 bp, Homo sapiens
tggctcaccctctatcagtgtca

SEQ ID NO: 4327 - DNA, 22 bp, Homo sapiens
cggctgtgcagacaactggggg

SEQ ID NO: 4328 - DNA, 24 bp, Homo sapiens
ttcaagtaatcctttagagatcta

SEQ ID NO: 4329 - DNA, 22 bp, Homo sapiens
agctttggtttccacgtttgta

SEQ ID NO: 4330 - DNA, 21 bp, Homo sapiens
agaccgttaccatgactggcg

SEQ ID NO: 4331 - DNA, 22 bp, Homo sapiens
tttcttttgcggcagcccgtga

SEQ ID NO: 4332 - DNA, 20 bp, Homo sapiens
aacgctgcagcatgaagatg

SEQ ID NO: 4333 - DNA, 20 bp, Homo sapiens
cgtctcctcgtggggccgtg

SEQ ID NO: 4334 - DNA, 21 bp, Homo sapiens
tagcttgcacctttgcaactg

SEQ ID NO: 4335 - DNA, 22 bp, Homo sapiens
gaaactccattaggggacgttg

SEQ ID NO: 4336 - DNA, 21 bp, Homo sapiens
tgggctttctgttttttgttg

SEQ ID NO: 4337 - DNA, 20 bp, Homo sapiens
tcccgtggatcattttgatg

SEQ ID NO: 4338 - DNA, 21 bp, Homo sapiens
agcataatgaaaaccatcata

SEQ ID NO: 4339 - DNA, 20 bp, Homo sapiens
gggcaggcaggcattactgc

SEQ ID NO: 4340 - DNA, 20 bp, Homo sapiens
cccagtgttcaggtgtggac

SEQ ID NO: 4341 - DNA, 21 bp, Homo sapiens
ccgcccgtccccgccccgccc

SEQ ID NO: 4342 - DNA, 20 bp, Homo sapiens
ccaccccgcgccctctggga

SEQ ID NO: 4343 - DNA, 20 bp, Homo sapiens
tagctgttttgcgggtgtca

SEQ ID NO: 4344 - DNA, 22 bp, Homo sapiens
atcacatgctcagggcgccatg

SEQ ID NO: 4345 - DNA, 22 bp, Homo sapiens
tgtctcaaactctgcatccact

SEQ ID NO: 4346 - DNA, 20 bp, Homo sapiens
cacctgtagtggatgtggtg

SEQ ID NO: 4347 - DNA, 21 bp, Homo sapiens
gcccggggagcccgcgcccgt

SEQ ID NO: 4348 - DNA, 21 bp, Homo sapiens
cctctgggcccggaagagtca

SEQ ID NO: 4349 - DNA, 22 bp, Homo sapiens
tccctgagacactagctacact

SEQ ID NO: 4350 - DNA, 22 bp, Homo sapiens
tcattcccctcatcttccacca

SEQ ID NO: 4351 - DNA, 23 bp, Homo sapiens
agcagccccttgcatggctgtgc

SEQ ID NO: 4352 - DNA, 22 bp, Homo sapiens
tctaaaccaaattgtaggtaca

SEQ ID NO: 4353 - DNA, 23 bp, Homo sapiens
attattaacgattatggtgataa

SEQ ID NO: 4354 - DNA, 20 bp, Homo sapiens
gacataagttgaaaaggctg

SEQ ID NO: 4355 - DNA, 20 bp, Homo sapiens
taacccacttgatgatactg

SEQ ID NO: 4356 - DNA, 20 bp, Homo sapiens
attattttgtttcataagca

SEQ ID NO: 4357 - DNA, 21 bp, Homo sapiens
tatacaactttaggggattgg

SEQ ID NO: 4358 - DNA, 22 bp, Homo sapiens
aaaggctgacatgtattggtta

SEQ ID NO: 4359 - DNA, 20 bp, Homo sapiens
tgaggtagtagtttgttaaa

SEQ ID NO: 4360 - DNA, 23 bp, Homo sapiens
tagcttagctctgcgatgccagt

SEQ ID NO: 4361 - DNA, 23 bp, Homo sapiens
aatgatgccagcactaatctatt

SEQ ID NO: 4362 - DNA, 22 bp, Homo sapiens
accctgagtatctatgaacact

SEQ ID NO: 4363 - DNA, 21 bp, Homo sapiens
tcatggtgcttttagtcacta

SEQ ID NO: 4364 - DNA, 20 bp, Homo sapiens
tacgttggattgtagtgggt

SEQ ID NO: 4365 - DNA, 21 bp, Homo sapiens
agctacattagagtatggcca

SEQ ID NO: 4366 - DNA, 21 bp, Homo sapiens
accgcacccggcccggacacc

SEQ ID NO: 4367 - DNA, 20 bp, Homo sapiens
tgctgttttgatttgttggt

SEQ ID NO: 4368 - DNA, 22 bp, Homo sapiens
cgatgttgtctgaagccatggc

SEQ ID NO: 4369 - DNA, 21 bp, Homo sapiens
cctgcgaccccaaggggcaac

SEQ ID NO: 4370 - DNA, 20 bp, Homo sapiens
cctagctgagatagcggtgt

SEQ ID NO: 4371 - DNA, 21 bp, Homo sapiens
ttcgaggcccagcccgtgctg

SEQ ID NO: 4372 - DNA, 20 bp, Homo sapiens
ggcgcggcaggggccggcgg

SEQ ID NO: 4373 - DNA, 20 bp, Homo sapiens
gccaggttggcgagactggt

SEQ ID NO: 4374 - DNA, 20 bp, Homo sapiens
gatgatgccacgtgagacat

SEQ ID NO: 4375 - DNA, 23 bp, Homo sapiens
tagctcatttctggaatggggca

SEQ ID NO: 4376 - DNA, 23 bp, Homo sapiens
ggaactgggagggtccataggga

SEQ ID NO: 4377 - DNA, 20 bp, Homo sapiens
atacgactcttaggccaaat

SEQ ID NO: 4378 - DNA, 23 bp, Homo sapiens
agtcagatgtgccaatcccccaa

SEQ ID NO: 4379 - DNA, 20 bp, Homo sapiens
gcagcattaattaacattgc

SEQ ID NO: 4380 - DNA, 24 bp, Homo sapiens
tgctgaggctaacgggtcagttgg

SEQ ID NO: 4381 - DNA, 22 bp, Homo sapiens
atcacatgattgaaatgggaat

SEQ ID NO: 4382 - DNA, 22 bp, Homo sapiens
ctcctgaccaatgtcagcatgt

SEQ ID NO: 4383 - DNA, 23 bp, Homo sapiens
cgactcttagcggttggatcagt

SEQ ID NO: 4384 - DNA, 22 bp, Homo sapiens
tagctgcagtctgcaatggccc

SEQ ID NO: 4385 - DNA, 22 bp, Homo sapiens
tcgaggagctcacagctcaggc

SEQ ID NO: 4386 - DNA, 20 bp, Homo sapiens
ggcggcgggggtgtgtgtgg

SEQ ID NO: 4387 - DNA, 20 bp, Homo sapiens
gctgagagctattgttgctg

SEQ ID NO: 4388 - DNA, 20 bp, Homo sapiens
ggacttgccaactcttggca

SEQ ID NO: 4389 - DNA, 21 bp, Homo sapiens
tagcaccatctgatatggttt

SEQ ID NO: 4390 - DNA, 23 bp, Homo sapiens
tagtcatacaaaggtggttttgg

SEQ ID NO: 4391 - DNA, 21 bp, Homo sapiens
ccccccgttcccccctcaaaa

SEQ ID NO: 4392 - DNA, 21 bp, Homo sapiens
ctcacacaataggtagctcta

SEQ ID NO: 4393 - DNA, 21 bp, Homo sapiens
gcctatcgataaaaggaaagc

SEQ ID NO: 4394 - DNA, 20 bp, Homo sapiens
agcagcaggtgcgtccacgc

SEQ ID NO: 4395 - DNA, 22 bp, Homo sapiens
agtaccgtgctatttaggttac

SEQ ID NO: 4396 - DNA, 22 bp, Homo sapiens
agggactctgggatcaggagta

SEQ ID NO: 4397 - DNA, 22 bp, Homo sapiens
tctgagtaaaggtcagctcaga

SEQ ID NO: 4398 - DNA, 23 bp, Homo sapiens
cactctgttcagtagcactggtt

SEQ ID NO: 4399 - DNA, 20 bp, Homo sapiens
tgcccctcacaaaaaacaac

SEQ ID NO: 4400 - DNA, 20 bp, Homo sapiens
ccgcccccggggcccgccac

SEQ ID NO: 4401 - DNA, 22 bp, Homo sapiens
tagcatacacgtgcacaacgtg

SEQ ID NO: 4402 - DNA, 21 bp, Homo sapiens
acatctgttgacttagaaact

SEQ ID NO: 4403 - DNA, 23 bp, Homo sapiens
tgtgcaaatccatggttcagact

SEQ ID NO: 4404 - DNA, 23 bp, Homo sapiens
ttccttatcgctgtgatggggac

SEQ ID NO: 4405 - DNA, 22 bp, Homo sapiens
cttctgaatcctgttagcagct

SEQ ID NO: 4406 - DNA, 23 bp, Homo sapiens
tgtgcaggctcgcacatgttcac

SEQ ID NO: 4407 - DNA, 23 bp, Homo sapiens
tgtcagcatcataacccccagtg

SEQ ID NO: 4408 - DNA, 20 bp, Homo sapiens
gcattatttctaaccgggga

SEQ ID NO: 4409 - DNA, 21 bp, Homo sapiens
cgcggcgcctcgcctcccggc

SEQ ID NO: 4410 - DNA, 24 bp, Homo sapiens
ggggccggggcttcgagctggccc

SEQ ID NO: 4411 - DNA, 20 bp, Homo sapiens
cccacgcctcctcccctccc

SEQ ID NO: 4412 - DNA, 23 bp, Homo sapiens
ggctggtttgggtttatgtttgg

SEQ ID NO: 4413 - DNA, 21 bp, Homo sapiens
cccccccagtagcccggccgg

SEQ ID NO: 4414 - DNA, 22 bp, Homo sapiens
cccctgctcaaagccattggtc

SEQ ID NO: 4415 - DNA, 20 bp, Homo sapiens
tgtgctcacactcctcagac

SEQ ID NO: 4416 - DNA, 21 bp, Homo sapiens
tctgccctgcttctccctagg

SEQ ID NO: 4417 - DNA, 23 bp, Homo sapiens
tgggtcctcaaacatggttggaa

SEQ ID NO: 4418 - DNA, 22 bp, Homo sapiens
tctcaaccacagttgggttttg

SEQ ID NO: 4419 - DNA, 22 bp, Homo sapiens
ttcaaataatcctcctatcttg

SEQ ID NO: 4420 - DNA, 22 bp, Homo sapiens
tagcttatactcacaaagaact

SEQ ID NO: 4421 - DNA, 21 bp, Homo sapiens
taccacagggtagaacaggag

SEQ ID NO: 4422 - DNA, 23 bp, Homo sapiens
tagcttatgtctgaagcaggcag

SEQ ID NO: 4423 - DNA, 20 bp, Homo sapiens
ccggcgcctagcagccggct

SEQ ID NO: 4424 - DNA, 24 bp, Homo sapiens
taataattgctttatggtctatag

SEQ ID NO: 4425 - DNA, 23 bp, Homo sapiens
gcattgtgttggactgaaccttg

SEQ ID NO: 4426 - DNA, 23 bp, Homo sapiens
taagtgacagaccattgctgcca

SEQ ID NO: 4427 - DNA, 22 bp, Homo sapiens
tagctttaagtcccagaaaagc

SEQ ID NO: 4428 - DNA, 20 bp, Homo sapiens
gtgattagtccgaggtcacc

SEQ ID NO: 4429 - DNA, 23 bp, Homo sapiens
tggcttatcagaagtcgtgagaa

SEQ ID NO: 4430 - DNA, 22 bp, Homo sapiens
agctacatgtctgggccccata

SEQ ID NO: 4431 - DNA, 21 bp, Homo sapiens
atccatgggcaggttgttcat

SEQ ID NO: 4432 - DNA, 21 bp, Homo sapiens
tgaagaaacagaggtgacaac

SEQ ID NO: 4433 - DNA, 23 bp, Homo sapiens
taccttatcatcacagcacactg

SEQ ID NO: 4434 - DNA, 21 bp, Homo sapiens
tagcaatgtctgccatgcata

SEQ ID NO: 4435 - DNA, 21 bp, Homo sapiens
tagcagcatctgaggctaacc

SEQ ID NO: 4436 - DNA, 20 bp, Homo sapiens
ttacactgttagccaggatg

SEQ ID NO: 4437 - DNA, 20 bp, Homo sapiens
ggcagctgctatacaagcta

SEQ ID NO: 4438 - DNA, 20 bp, Homo sapiens
tttcaacttatattgcttgt

SEQ ID NO: 4439 - DNA, 23 bp, Homo sapiens
tcagcatttctttacagtgttat

SEQ ID NO: 4440 - DNA, 22 bp, Homo sapiens
caagcttctttatatatttggc

SEQ ID NO: 4441 - DNA, 20 bp, Homo sapiens
tatatttacaactgcggtat

SEQ ID NO: 4442 - DNA, 23 bp, Homo sapiens
tagcttaagtctctgatgacatt

SEQ ID NO: 4443 - DNA, 22 bp, Homo sapiens
ctacatgggtcccaggaataaa

SEQ ID NO: 4444 - DNA, 22 bp, Homo sapiens
tagcaccatgactaactaattc

SEQ ID NO: 4445 - DNA, 21 bp, Homo sapiens
tgatcatagtagcctggaatg

SEQ ID NO: 4446 - DNA, 22 bp, Homo sapiens
tattgcacttgtcccacggtct

SEQ ID NO: 4447 - DNA, 22 bp, Homo sapiens
acagtagctcatgggccaaaac

SEQ ID NO: 4448 - DNA, 24 bp, Homo sapiens
tataaagtatgaggccatgcagga

SEQ ID NO: 4449 - DNA, 22 bp, Homo sapiens
ggcagttacagtggcgtgggtt

SEQ ID NO: 4450 - DNA, 22 bp, Homo sapiens
tagcttatcaagttgcaaaact

SEQ ID NO: 4451 - DNA, 22 bp, Homo sapiens
gctactacatgccatccacata

SEQ ID NO: 4452 - DNA, 20 bp, Homo sapiens
aaggaaggcagcagatattt

SEQ ID NO: 4453 - DNA, 20 bp, Homo sapiens
ggccatatctagcagaagag

SEQ ID NO: 4454 - DNA, 23 bp, Homo sapiens
ttcacattggctcctaagtaccc

SEQ ID NO: 4455 - DNA, 21 bp, Homo sapiens
gtcaccagctactgaaggtga

SEQ ID NO: 4456 - DNA, 23 bp, Homo sapiens
ccttcacaagtctgatggtcaat

SEQ ID NO: 4457 - DNA, 23 bp, Homo sapiens
gtcatcaaaagggaggaaaccct

SEQ ID NO: 4458 - DNA, 20 bp, Homo sapiens
atatagtgtggtctatagca

SEQ ID NO: 4459 - DNA, 22 bp, Homo sapiens
atcgtgccattgaaatccagct

SEQ ID NO: 4460 - DNA, 23 bp, Homo sapiens
tgctcagggtgcacttgctatgc

SEQ ID NO: 4461 - DNA, 24 bp, Homo sapiens
ctctgattgtcccgcaacagcaga

SEQ ID NO: 4462 - DNA, 20 bp, Homo sapiens
cgtacagtcaaaataacgtg

SEQ ID NO: 4463 - DNA, 20 bp, Homo sapiens
gcaagttggtatcctgcccc

SEQ ID NO: 4464 - DNA, 22 bp, Homo sapiens
ctgtgcaatgttgccctggcat

SEQ ID NO: 4465 - DNA, 22 bp, Homo sapiens
tggaaactgcctacatggtcac

SEQ ID NO: 4466 - DNA, 22 bp, Homo sapiens
ttagaagatctgtgaagaaact

SEQ ID NO: 4467 - DNA, 22 bp, Homo sapiens
cccaagtaatccagcttactag

SEQ ID NO: 4468 - DNA, 21 bp, Homo sapiens
cttactctgctcaatcgctag

SEQ ID NO: 4469 - DNA, 20 bp, Homo sapiens
catctgcataaagaccagac

SEQ ID NO: 4470 - DNA, 22 bp, Homo sapiens
cagctggctgagggatggggtg

SEQ ID NO: 4471 - DNA, 23 bp, Homo sapiens
ataggttagataggtgatacaga

SEQ ID NO: 4472 - DNA, 21 bp, Homo sapiens
aggatggggtgggataggatc

SEQ ID NO: 4473 - DNA, 22 bp, Homo sapiens
tcaggctcagtcccctccatga

SEQ ID NO: 4474 - DNA, 21 bp, Homo sapiens
atatctggatattggcttccc

SEQ ID NO: 4475 - DNA, 24 bp, Homo sapiens
tggtagagagttcatatctggccc

SEQ ID NO: 4476 - DNA, 20 bp, Homo sapiens
cccggccccgtccgccccgc

SEQ ID NO: 4477 - DNA, 22 bp, Homo sapiens
ggaggataatttgagatgagcc

SEQ ID NO: 4478 - DNA, 23 bp, Homo sapiens
tcctgtactgagctgccccgagc

SEQ ID NO: 4479 - DNA, 20 bp, Homo sapiens
gtggactctggatggcggtc

SEQ ID NO: 4480 - DNA, 21 bp, Homo sapiens
gggtgcgagaggtccatgatg

SEQ ID NO: 4481 - DNA, 20 bp, Homo sapiens
gccggcgcgccccccccccc

SEQ ID NO: 4482 - DNA, 23 bp, Homo sapiens
catcacaggtctgggcgtgggga

SEQ ID NO: 4483 - DNA, 23 bp, Homo sapiens
tggcaagctgagttgcgtggtcg

SEQ ID NO: 4484 - DNA, 22 bp, Homo sapiens
ctctggagcaggccagtgacat

SEQ ID NO: 4485 - DNA, 22 bp, Homo sapiens
aatggggccataaggtggtgtg

SEQ ID NO: 4486 - DNA, 21 bp, Homo sapiens
tgcagcatacatgtcccaact

SEQ ID NO: 4487 - DNA, 22 bp, Homo sapiens
aggggacaggctctgtttaatt

SEQ ID NO: 4488 - DNA, 20 bp, Homo sapiens
ggctgatcagcagtttagta

SEQ ID NO: 4489 - DNA, 22 bp, Homo sapiens
tcgtttaattagatcctagttg

SEQ ID NO: 4490 - DNA, 21 bp, Homo sapiens
aacccgtaggcttagagggct

SEQ ID NO: 4491 - DNA, 22 bp, Homo sapiens
acatcgactcatagtaaccctg

SEQ ID NO: 4492 - DNA, 23 bp, Homo sapiens
cttccactgctaaatttgactgg

SEQ ID NO: 4493 - DNA, 21 bp, Homo sapiens
ggtggattgatctttgtgtca

SEQ ID NO: 4494 - DNA, 20 bp, Homo sapiens
cttcgtaagagattataaag

SEQ ID NO: 4495 - DNA, 22 bp, Homo sapiens
tccagtctcaaagctgtgtgct

SEQ ID NO: 4496 - DNA, 20 bp, Homo sapiens
gctcgagtggcggagtggat

SEQ ID NO: 4497 - DNA, 22 bp, Homo sapiens
ggagctgggactggatacccca

SEQ ID NO: 4498 - DNA, 23 bp, Homo sapiens
agcagcaaacagtggccatccag

SEQ ID NO: 4499 - DNA, 21 bp, Homo sapiens
ctcttgctgctgccatatagg

SEQ ID NO: 4500 - DNA, 20 bp, Homo sapiens
taggaatacagacacgcacc

SEQ ID NO: 4501 - DNA, 23 bp, Homo sapiens
tgggacatcatgtctgcagcttc

SEQ ID NO: 4502 - DNA, 23 bp, Homo sapiens
gtctgcaaacagaaatagtttgg

SEQ ID NO: 4503 - DNA, 22 bp, Homo sapiens
tgactccaccccacccttccag

SEQ ID NO: 4504 - DNA, 22 bp, Homo sapiens
tccctgaagccctacaggctga

SEQ ID NO: 4505 - DNA, 21 bp, Homo sapiens
aaggagctcacagtctactgt

SEQ ID NO: 4506 - DNA, 22 bp, Homo sapiens
atcagatcatcagcagcatcac

SEQ ID NO: 4507 - DNA, 20 bp, Homo sapiens
cctaataagagattataaaa

SEQ ID NO: 4508 - DNA, 22 bp, Homo sapiens
taaagtagaccctagtctgtgt

SEQ ID NO: 4509 - DNA, 20 bp, Homo sapiens
gttggccagtagaaagcaca

SEQ ID NO: 4510 - DNA, 23 bp, Homo sapiens
tgtaggtgcttccagtctggagc

SEQ ID NO: 4511 - DNA, 20 bp, Homo sapiens
cccctcacaaaaaacactgc

SEQ ID NO: 4512 - DNA, 22 bp, Homo sapiens
tctcctgcatccagtcagagct

SEQ ID NO: 4513 - DNA, 20 bp, Homo sapiens
aaaataccacttgcacaaat

SEQ ID NO: 4514 - DNA, 21 bp, Homo sapiens
taggaacattacacagcactc

SEQ ID NO: 4515 - DNA, 22 bp, Homo sapiens
tttcagggcaagaatgcaagtg

SEQ ID NO: 4516 - DNA, 22 bp, Homo sapiens
tcgaggctgaagtgatctgaga

SEQ ID NO: 4517 - DNA, 20 bp, Homo sapiens
cggccgccctcggggcccag

SEQ ID NO: 4518 - DNA, 22 bp, Homo sapiens
gcataccactgagtcagtcaga

SEQ ID NO: 4519 - DNA, 20 bp, Homo sapiens
ggatgacttgtggatagaag

SEQ ID NO: 4520 - DNA, 20 bp, Homo sapiens
ctccagaacaggtgattgag

SEQ ID NO: 4521 - DNA, 23 bp, Homo sapiens
tttagctgagtgtccatatttta

SEQ ID NO: 4522 - DNA, 20 bp, Homo sapiens
accctgctcgctgcaccatg

SEQ ID NO: 4523 - DNA, 21 bp, Homo sapiens
tccgctgcagcccctcgacgt

SEQ ID NO: 4524 - DNA, 20 bp, Homo sapiens
ctctgtcctgagagatgatc

SEQ ID NO: 4525 - DNA, 21 bp, Homo sapiens
gtgccactacactccaagtgg

SEQ ID NO: 4526 - DNA, 22 bp, Homo sapiens
ggcctaaaaaggcgggagccca

SEQ ID NO: 4527 - DNA, 20 bp, Homo sapiens
cccatattctagaagatgtc

SEQ ID NO: 4528 - DNA, 23 bp, Homo sapiens
agaagcattgtctgaaactatct

SEQ ID NO: 4529 - DNA, 22 bp, Homo sapiens
tgagagagtactaacgcgcttg

SEQ ID NO: 4530 - DNA, 22 bp, Homo sapiens
tgagacaacagaaatgttttgt

SEQ ID NO: 4531 - DNA, 22 bp, Homo sapiens
gacctgatgctgctggaatgct

SEQ ID NO: 4532 - DNA, 24 bp, Homo sapiens
tctgtgatgaaaatgtttctgaag

SEQ ID NO: 4533 - DNA, 20 bp, Homo sapiens
cgtatttgactatctagatc

SEQ ID NO: 4534 - DNA, 23 bp, Homo sapiens
atagtacccactgttatagccat

SEQ ID NO: 4535 - DNA, 20 bp, Homo sapiens
gatgttgttatattgcttga

SEQ ID NO: 4536 - DNA, 20 bp, Homo sapiens
cttttaatgttcttgtcatt

SEQ ID NO: 4537 - DNA, 22 bp, Homo sapiens
gggaatgataacggcagtcacc

SEQ ID NO: 4538 - DNA, 21 bp, Homo sapiens
aagtatttgagtttatggatg

SEQ ID NO: 4539 - DNA, 20 bp, Homo sapiens
tgatgttgcccagggttttg

SEQ ID NO: 4540 - DNA, 20 bp, Homo sapiens
gctcatcagacgtgttccat

SEQ ID NO: 4541 - DNA, 22 bp, Homo sapiens
agcagcattgtatgaaagccag

SEQ ID NO: 4542 - DNA, 22 bp, Homo sapiens
actcagttgtgacttatggggt

SEQ ID NO: 4543 - DNA, 21 bp, Homo sapiens
gccacagtgagttgcagatgc

SEQ ID NO: 4544 - DNA, 22 bp, Homo sapiens
tgtcagtgaaagtttatgggga

SEQ ID NO: 4545 - DNA, 22 bp, Homo sapiens
ctagctcttctcctgggcacca

SEQ ID NO: 4546 - DNA, 22 bp, Homo sapiens
caataccatctgactaattggc

SEQ ID NO: 4547 - DNA, 22 bp, Homo sapiens
tgagtcaaatctgaaccaaaat

SEQ ID NO: 4548 - DNA, 21 bp, Homo sapiens
cctgacaaaattcatccttga

SEQ ID NO: 4549 - DNA, 23 bp, Homo sapiens
tatgttacaagtaaattacatat

SEQ ID NO: 4550 - DNA, 20 bp, Homo sapiens
tggctcagttcagcagaagt

SEQ ID NO: 4551 - DNA, 20 bp, Homo sapiens
agctacattgtctgcaaggt

SEQ ID NO: 4552 - DNA, 22 bp, Homo sapiens
cactagaactggtttataagag

SEQ ID NO: 4553 - DNA, 21 bp, Homo sapiens
tgaagtatacctccaccataa

SEQ ID NO: 4554 - DNA, 22 bp, Homo sapiens
aagcttatcctctcagctgtga

SEQ ID NO: 4555 - DNA, 20 bp, Homo sapiens
cgcccgccgcgccgggagca

SEQ ID NO: 4556 - DNA, 24 bp, Homo sapiens
atacactgcttcacttgactagcc

SEQ ID NO: 4557 - DNA, 22 bp, Homo sapiens
ctctttttgggccaccaactgt

SEQ ID NO: 4558 - DNA, 20 bp, Homo sapiens
gaattggtggttactgttgg

SEQ ID NO: 4559 - DNA, 20 bp, Homo sapiens
cggctgagtttgattttggg

SEQ ID NO: 4560 - DNA, 22 bp, Homo sapiens
tgtaggtgggaagcagcataac

SEQ ID NO: 4561 - DNA, 23 bp, Homo sapiens
gttcgggtattcctaaggctcta

SEQ ID NO: 4562 - DNA, 20 bp, Homo sapiens
tgggcaaatccatacaaaac

SEQ ID NO: 4563 - DNA, 22 bp, Homo sapiens
tagctgatgtcttcatggggtt

SEQ ID NO: 4564 - DNA, 23 bp, Homo sapiens
atacttattgctgtgatgatgaa

SEQ ID NO: 4565 - DNA, 23 bp, Homo sapiens
tagcaccatttctggctgagtgg

SEQ ID NO: 4566 - DNA, 22 bp, Homo sapiens
agcaaatttaaataatatgttg

SEQ ID NO: 4567 - DNA, 20 bp, Homo sapiens
tccccggcaaagaacacccc

SEQ ID NO: 4568 - DNA, 23 bp, Homo sapiens
ctgaggctggaggatcgcttaaa

SEQ ID NO: 4569 - DNA, 20 bp, Homo sapiens
gctcccgggattggtttcac

SEQ ID NO: 4570 - DNA, 21 bp, Homo sapiens
agtaaatgagataatacgtat

SEQ ID NO: 4571 - DNA, 23 bp, Homo sapiens
gggatcgtgtcactgcagcactt

SEQ ID NO: 4572 - DNA, 22 bp, Homo sapiens
gttgccttatttgggctaaatc

SEQ ID NO: 4573 - DNA, 23 bp, Homo sapiens
tgggatgggtgacaatacttgta

SEQ ID NO: 4574 - DNA, 20 bp, Homo sapiens
caaggtagagagccgcggcc

SEQ ID NO: 4575 - DNA, 20 bp, Homo sapiens
tctccatcatccaatgcatc

SEQ ID NO: 4576 - DNA, 22 bp, Homo sapiens
tgaggactgctgggtctgtgtc

SEQ ID NO: 4577 - DNA, 22 bp, Homo sapiens
tgctggtgatcagtggtccaca

SEQ ID NO: 4578 - DNA, 22 bp, Homo sapiens
ttacagtaatccagtcacttgt

SEQ ID NO: 4579 - DNA, 20 bp, Homo sapiens
gttttacattaactgttgcc

SEQ ID NO: 4580 - DNA, 22 bp, Homo sapiens
gtttaccaggagatttaagtca

SEQ ID NO: 4581 - DNA, 21 bp, Homo sapiens
ggtgctccttctctccattgc

SEQ ID NO: 4582 - DNA, 20 bp, Homo sapiens
gtcatctcttaaggtaggtg

SEQ ID NO: 4583 - DNA, 24 bp, Homo sapiens
tgagtgtgtgtgtgtgagtgtgaa

SEQ ID NO: 4584 - DNA, 23 bp, Homo sapiens
accctgtaggcagacatgatatc

SEQ ID NO: 4585 - DNA, 20 bp, Homo sapiens
caggatgctataggataaaa

SEQ ID NO: 4586 - DNA, 22 bp, Homo sapiens
tagctttggtctgtgatgttga

SEQ ID NO: 4587 - DNA, 20 bp, Homo sapiens
tcattggtaacctgacaaga

SEQ ID NO: 4588 - DNA, 23 bp, Homo sapiens
agctagtaaagagtgacttgaac

SEQ ID NO: 4589 - DNA, 22 bp, Homo sapiens
gctcaaggttgaacatggtcac

SEQ ID NO: 4590 - DNA, 21 bp, Homo sapiens
tgccttgtaatgcactggtaa

SEQ ID NO: 4591 - DNA, 22 bp, Homo sapiens
gcaatcatgagcttagatttgt

SEQ ID NO: 4592 - DNA, 22 bp, Homo sapiens
ggaactggggagggaaggcttc

SEQ ID NO: 4593 - DNA, 22 bp, Homo sapiens
agttctgggctctagtgcgcta

SEQ ID NO: 4594 - DNA, 22 bp, Homo sapiens
ggttcagatgggatctccacag

SEQ ID NO: 4595 - DNA, 22 bp, Homo sapiens
cagtgcaatgatagttcactgc

SEQ ID NO: 4596 - DNA, 22 bp, Homo sapiens
tgtactcccagaccctacccca

SEQ ID NO: 4597 - DNA, 20 bp, Homo sapiens
tatcagttgttcatggagga

SEQ ID NO: 4598 - DNA, 21 bp, Homo sapiens
ctgacctatgaatgtttgatc

SEQ ID NO: 4599 - DNA, 22 bp, Homo sapiens
tattgcacacactttataagta

SEQ ID NO: 4600 - DNA, 22 bp, Homo sapiens
tagcttatgtctgtaataccag

SEQ ID NO: 4601 - DNA, 21 bp, Homo sapiens
tgatgattgagtttatggtat

SEQ ID NO: 4602 - DNA, 21 bp, Homo sapiens
gtccagttttcccagcaacac

SEQ ID NO: 4603 - DNA, 23 bp, Homo sapiens
tagcacctatgctttatgacatg

SEQ ID NO: 4604 - DNA, 20 bp, Homo sapiens
tttagctaagcacagatcta

SEQ ID NO: 4605 - DNA, 20 bp, Homo sapiens
agtgatgccacgtgaccgct

SEQ ID NO: 4606 - DNA, 23 bp, Homo sapiens
tggtaaaatagcgtacttgtcaa

SEQ ID NO: 4607 - DNA, 20 bp, Homo sapiens
tagcaccatttgatgctttg

SEQ ID NO: 4608 - DNA, 22 bp, Homo sapiens
gcatggcacagatttacttatg

SEQ ID NO: 4609 - DNA, 23 bp, Homo sapiens
aacagtgggtgacaatattttgt

SEQ ID NO: 4610 - DNA, 22 bp, Homo sapiens
gtattagtgaaatacgtgatgc

SEQ ID NO: 4611 - DNA, 22 bp, Homo sapiens
aaaaggttaatgcatacagggc

SEQ ID NO: 4612 - DNA, 21 bp, Homo sapiens
acattaaaataaggattggct

SEQ ID NO: 4613 - DNA, 21 bp, Homo sapiens
atgccaggatttataagaagc

SEQ ID NO: 4614 - DNA, 23 bp, Homo sapiens
agcagcattgggtgaggctattc

SEQ ID NO: 4615 - DNA, 20 bp, Homo sapiens
gcaagtctcctcattgatct

SEQ ID NO: 4616 - DNA, 23 bp, Homo sapiens
tcttgattttctgtccttaggga

SEQ ID NO: 4617 - DNA, 22 bp, Homo sapiens
tgaggataatagctgatatctt

SEQ ID NO: 4618 - DNA, 21 bp, Homo sapiens
taatactgctcatgctctacc

SEQ ID NO: 4619 - DNA, 22 bp, Homo sapiens
agtaagctccctttgaagtcag

SEQ ID NO: 4620 - DNA, 22 bp, Homo sapiens
tggaagactagtgattgaatgt

SEQ ID NO: 4621 - DNA, 23 bp, Homo sapiens
ttccagttttggatcaggctttc

SEQ ID NO: 4622 - DNA, 23 bp, Homo sapiens
tgtgcaaatccatgaaaagctct

SEQ ID NO: 4623 - DNA, 21 bp, Homo sapiens
ctgtggatagggccagtgacc

SEQ ID NO: 4624 - DNA, 21 bp, Homo sapiens
tagcaggtgctgggcgttggc

SEQ ID NO: 4625 - DNA, 21 bp, Homo sapiens
tcagtgcagatgtcttggaaa

SEQ ID NO: 4626 - DNA, 22 bp, Homo sapiens
tctaggcgactcagtagcccag

SEQ ID NO: 4627 - DNA, 24 bp, Homo sapiens
cagtagccagcagcgacctggggc

SEQ ID NO: 4628 - DNA, 21 bp, Homo sapiens
aaatttcggttgggaattaaa

SEQ ID NO: 4629 - DNA, 20 bp, Homo sapiens
aggcaagatgctggtatcat

SEQ ID NO: 4630 - DNA, 21 bp, Homo sapiens
agtgacacatgttattgatgg

SEQ ID NO: 4631 - DNA, 21 bp, Homo sapiens
agcagctcctacactgagagg

SEQ ID NO: 4632 - DNA, 23 bp, Homo sapiens
gaggtcatggaggtcattaggga

SEQ ID NO: 4633 - DNA, 22 bp, Homo sapiens
tcagtgcactacagattacgtg

SEQ ID NO: 4634 - DNA, 20 bp, Homo sapiens
cagcatcagaggctactgtg

SEQ ID NO: 4635 - DNA, 24 bp, Homo sapiens
ccttttgttttgtactttactata

SEQ ID NO: 4636 - DNA, 22 bp, Homo sapiens
ttcaagtaagaactgaaagcca

SEQ ID NO: 4637 - DNA, 22 bp, Homo sapiens
cgtgagctcctgggctcaatga

SEQ ID NO: 4638 - DNA, 21 bp, Homo sapiens
ggaactggggcccaggaatgt

SEQ ID NO: 4639 - DNA, 20 bp, Homo sapiens
atcccacgaagtcacaaaga

SEQ ID NO: 4640 - DNA, 24 bp, Homo sapiens
gacatgatgagatttcactctgac

SEQ ID NO: 4641 - DNA, 22 bp, Homo sapiens
ctagatctagacagatctagat

SEQ ID NO: 4642 - DNA, 22 bp, Homo sapiens
gcttcagatgggatcaggtgga

SEQ ID NO: 4643 - DNA, 23 bp, Homo sapiens
agcagcattgtcacttcagtgtc

SEQ ID NO: 4644 - DNA, 23 bp, Homo sapiens
tatgtgccattagggcttcttgc

SEQ ID NO: 4645 - DNA, 20 bp, Homo sapiens
aacagccatcatattccaga

SEQ ID NO: 4646 - DNA, 22 bp, Homo sapiens
agcagcaccacagagccagact

SEQ ID NO: 4647 - DNA, 20 bp, Homo sapiens
aatcccaaaaaaaatctgtg

SEQ ID NO: 4648 - DNA, 20 bp, Homo sapiens
cactggatacttaaccacct

SEQ ID NO: 4649 - DNA, 20 bp, Homo sapiens
gggcaattacccttcaggct

SEQ ID NO: 4650 - DNA, 23 bp, Homo sapiens
gcttctgaaagtgtccttaggga

SEQ ID NO: 4651 - DNA, 21 bp, Homo sapiens
acgaatcagacgtgcggttga

SEQ ID NO: 4652 - DNA, 20 bp, Homo sapiens
caaataatgaaaaccattgt

SEQ ID NO: 4653 - DNA, 22 bp, Homo sapiens
gaaatcagctagactgatggct

SEQ ID NO: 4654 - DNA, 21 bp, Homo sapiens
ctttgcaaacgaggaattccc

SEQ ID NO: 4655 - DNA, 20 bp, Homo sapiens
gactagcagcagtgtttcaa

SEQ ID NO: 4656 - DNA, 23 bp, Homo sapiens
taatgttttgtctttatgacacc

SEQ ID NO: 4657 - DNA, 20 bp, Homo sapiens
agggcccagctaatgttgct

SEQ ID NO: 4658 - DNA, 23 bp, Homo sapiens
gtttccgactcagcaggacactg

SEQ ID NO: 4659 - DNA, 23 bp, Homo sapiens
tggcttatgtctgtgatcccagt

SEQ ID NO: 4660 - DNA, 20 bp, Homo sapiens
gatgatgccaccactggcta

SEQ ID NO: 4661 - DNA, 20 bp, Homo sapiens
accttaccaggccttgaaag

SEQ ID NO: 4662 - DNA, 22 bp, Homo sapiens
tctcttttcctcctcctcctcc

SEQ ID NO: 4663 - DNA, 21 bp, Homo sapiens
cagctacaccacctactaggt

SEQ ID NO: 4664 - DNA, 22 bp, Homo sapiens
tgatctgactcagcaggaaggt

SEQ ID NO: 4665 - DNA, 21 bp, Homo sapiens
atgcagcactcatataggtat

SEQ ID NO: 4666 - DNA, 22 bp, Homo sapiens
gactgcaagtggtttatgggta

SEQ ID NO: 4667 - DNA, 20 bp, Homo sapiens
gcattggtggttcagtggtt

SEQ ID NO: 4668 - DNA, 22 bp, Homo sapiens
ttagctttccctacttgttttg

SEQ ID NO: 4669 - DNA, 23 bp, Homo sapiens
agctggtggtgaaaatattttgt

SEQ ID NO: 4670 - DNA, 22 bp, Homo sapiens
cccaatggccacccgctttcaa

SEQ ID NO: 4671 - DNA, 22 bp, Homo sapiens
tatgcacgactcattatatgca

SEQ ID NO: 4672 - DNA, 22 bp, Homo sapiens
cagaatttacaatgggatatgc

SEQ ID NO: 4673 - DNA, 21 bp, Homo sapiens
tgccatcaacttggtcaaggc

SEQ ID NO: 4674 - DNA, 20 bp, Homo sapiens
gagcaccatttgaggctgcc

SEQ ID NO: 4675 - DNA, 22 bp, Homo sapiens
aatcatgtttgagcatgcagtg

SEQ ID NO: 4676 - DNA, 23 bp, Homo sapiens
gcttagcacctccaggataggga

SEQ ID NO: 4677 - DNA, 20 bp, Homo sapiens
cggccctggcggagcgcctt

SEQ ID NO: 4678 - DNA, 20 bp, Homo sapiens
cagaggtcctacagtgcaga

SEQ ID NO: 4679 - DNA, 20 bp, Homo sapiens
ctactggggtatttatgggt

SEQ ID NO: 4680 - DNA, 21 bp, Homo sapiens
ctctctttctctccctgtgtc

SEQ ID NO: 4681 - DNA, 22 bp, Homo sapiens
tagcttctcagtgactgcaact

SEQ ID NO: 4682 - DNA, 23 bp, Homo sapiens
agcaggtgctagtgaggctgcag

SEQ ID NO: 4683 - DNA, 20 bp, Homo sapiens
tccctgttcgggcgccacta

SEQ ID NO: 4684 - DNA, 20 bp, Homo sapiens
gagcttatcactggtatttt

SEQ ID NO: 4685 - DNA, 22 bp, Homo sapiens
tatactacatgcccctaaatat

SEQ ID NO: 4686 - DNA, 20 bp, Homo sapiens
caaaggcatcactagtggtt

SEQ ID NO: 4687 - DNA, 22 bp, Homo sapiens
agaagtgctgtgttcagtggtt

SEQ ID NO: 4688 - DNA, 22 bp, Homo sapiens
acagcaggctggagtgaatggt

SEQ ID NO: 4689 - DNA, 22 bp, Homo sapiens
gtccagtgcctttgaagtgttt

SEQ ID NO: 4690 - DNA, 22 bp, Homo sapiens
ctatatggactgctgtttgttt

SEQ ID NO: 4691 - DNA, 23 bp, Homo sapiens
caaagtgccctttgaaggctttc

SEQ ID NO: 4692 - DNA, 22 bp, Homo sapiens
ttcacttctcttgactatctag

SEQ ID NO: 4693 - DNA, 22 bp, Homo sapiens
aatggcaatggtaatatggaca

SEQ ID NO: 4694 - DNA, 20 bp, Homo sapiens
tggctcagttcagcatttca

SEQ ID NO: 4695 - DNA, 24 bp, Homo sapiens
tcataagacatttatggactactc

SEQ ID NO: 4696 - DNA, 20 bp, Homo sapiens
aaagcacttgcggttttaag

SEQ ID NO: 4697 - DNA, 22 bp, Homo sapiens
tatagactgagtatgaagcacc

SEQ ID NO: 4698 - DNA, 22 bp, Homo sapiens
cctgagtattccagtctcttga

SEQ ID NO: 4699 - DNA, 21 bp, Homo sapiens
gctcccaagctaaaacctcaa

SEQ ID NO: 4700 - DNA, 20 bp, Homo sapiens
ggtggttgttgtcagtggtg

SEQ ID NO: 4701 - DNA, 20 bp, Homo sapiens
gagccaacaacccagtggtg

SEQ ID NO: 4702 - DNA, 21 bp, Homo sapiens
cttctaaaggctccctacaat

SEQ ID NO: 4703 - DNA, 23 bp, Homo sapiens
tatagcaagtgcacaatgaatac

SEQ ID NO: 4704 - DNA, 20 bp, Homo sapiens
atttagttctgagctgggtg

SEQ ID NO: 4705 - DNA, 22 bp, Homo sapiens
catcgcttaggcaaaagcagct

SEQ ID NO: 4706 - DNA, 21 bp, Homo sapiens
ggccttgggtaagttagtcac

SEQ ID NO: 4707 - DNA, 23 bp, Homo sapiens
atgccagtatctgcttctgggga

SEQ ID NO: 4708 - DNA, 22 bp, Homo sapiens
tgctggttttgcaaatgttttt

SEQ ID NO: 4709 - DNA, 22 bp, Homo sapiens
catatcttttttaaaaaatgtc

SEQ ID NO: 4710 - DNA, 22 bp, Homo sapiens
atgtgtacattgaaagccatgt

SEQ ID NO: 4711 - DNA, 22 bp, Homo sapiens
accaagaatcccaaatatgatc

SEQ ID NO: 4712 - DNA, 22 bp, Homo sapiens
gtctcaaacagaaatgaaaaca

SEQ ID NO: 4713 - DNA, 22 bp, Homo sapiens
ccagccttacagtttatttttg

SEQ ID NO: 4714 - DNA, 22 bp, Homo sapiens
cccccgggccccgcgtcctccc

SEQ ID NO: 4715 - DNA, 21 bp, Homo sapiens
atatgttgctcaggtagctat

SEQ ID NO: 4716 - DNA, 22 bp, Homo sapiens
tgaggtagtagtggtgtgagcc

SEQ ID NO: 4717 - DNA, 22 bp, Homo sapiens
catagtctcaaagctgccacag

SEQ ID NO: 4718 - DNA, 21 bp, Homo sapiens
ggcctcccttcccccgccgcc

SEQ ID NO: 4719 - DNA, 23 bp, Homo sapiens
tagcttgctgctgacttaatgac

SEQ ID NO: 4720 - DNA, 22 bp, Homo sapiens
tcgagcccactgtcttaaccac

SEQ ID NO: 4721 - DNA, 23 bp, Homo sapiens
gtgcattttctttgaaggctttc

SEQ ID NO: 4722 - DNA, 22 bp, Homo sapiens
tagttcattagactgatagaca

SEQ ID NO: 4723 - DNA, 20 bp, Homo sapiens
ccaaatatgttcggcaatag

SEQ ID NO: 4724 - DNA, 20 bp, Homo sapiens
ctagggataaggccagtgat

SEQ ID NO: 4725 - DNA, 23 bp, Homo sapiens
aattgagaactccacttgtcaag

SEQ ID NO: 4726 - DNA, 23 bp, Homo sapiens
tcagtgcacatgtcaacttttcg

SEQ ID NO: 4727 - DNA, 22 bp, Homo sapiens
aaaagtctagactaatccacat

SEQ ID NO: 4728 - DNA, 20 bp, Homo sapiens
tccccgtactggccaccagg

SEQ ID NO: 4729 - DNA, 23 bp, Homo sapiens
tgtcacaaagataaattggggtt

SEQ ID NO: 4730 - DNA, 23 bp, Homo sapiens
cattgcacttactctaactcacc

SEQ ID NO: 4731 - DNA, 22 bp, Homo sapiens
ttcttgctgccattgacatcca

SEQ ID NO: 4732 - DNA, 22 bp, Homo sapiens
tagacactggtagacgctgcag

SEQ ID NO: 4733 - DNA, 20 bp, Homo sapiens
ctgccagaccatcttcagaa

SEQ ID NO: 4734 - DNA, 21 bp, Homo sapiens
ggtggaaatggtgcataccac

SEQ ID NO: 4735 - DNA, 22 bp, Homo sapiens
cagcagctatttggggatgatc

SEQ ID NO: 4736 - DNA, 23 bp, Homo sapiens
aaggagctcacagtctattgggg

SEQ ID NO: 4737 - DNA, 21 bp, Homo sapiens
gtttccatagtggctgtgtta

SEQ ID NO: 4738 - DNA, 20 bp, Homo sapiens
aggcactatgctggcataga

SEQ ID NO: 4739 - DNA, 22 bp, Homo sapiens
ctatgccatctctttataaggc

SEQ ID NO: 4740 - DNA, 21 bp, Homo sapiens
actggacttggagtcaggaga

SEQ ID NO: 4741 - DNA, 21 bp, Homo sapiens
tgaggtagatccaacatggcc

SEQ ID NO: 4742 - DNA, 20 bp, Homo sapiens
tcacgttacagacgagcaaa

SEQ ID NO: 4743 - DNA, 23 bp, Homo sapiens
tagcttactgagtgagcaaatcc

SEQ ID NO: 4744 - DNA, 24 bp, Homo sapiens
aagtgaaacacgggctctatattg

SEQ ID NO: 4745 - DNA, 22 bp, Homo sapiens
agatctgcaagtgcaggtgtga

SEQ ID NO: 4746 - DNA, 24 bp, Homo sapiens
caacagggctgggggcaggtcaca

SEQ ID NO: 4747 - DNA, 22 bp, Homo sapiens
tgtagtgttaggatgattattg

SEQ ID NO: 4748 - DNA, 20 bp, Homo sapiens
aactggcttcaatctacttg

SEQ ID NO: 4749 - DNA, 20 bp, Homo sapiens
tatattcacacagtatatat

SEQ ID NO: 4750 - DNA, 23 bp, Homo sapiens
gagctcaaacagtgtatgaaacc

SEQ ID NO: 4751 - DNA, 20 bp, Homo sapiens
cagtaatatggcaggaacag

SEQ ID NO: 4752 - DNA, 20 bp, Homo sapiens
cggcggcgtccgcactgaga

SEQ ID NO: 4753 - DNA, 22 bp, Homo sapiens
ctcctacggcttgactatcctc

SEQ ID NO: 4754 - DNA, 22 bp, Homo sapiens
tagtctatgaatgtcactattg

SEQ ID NO: 4755 - DNA, 22 bp, Homo sapiens
aggtgcaatggtttatcaagct

SEQ ID NO: 4756 - DNA, 22 bp, Homo sapiens
taagctgcacagtttatggtat

SEQ ID NO: 4757 - DNA, 22 bp, Homo sapiens
tggagactggactactaggtac

SEQ ID NO: 4758 - DNA, 23 bp, Homo sapiens
agcagcatttgcaagttaccgtc

SEQ ID NO: 4759 - DNA, 23 bp, Homo sapiens
ggaatgtttgggtgggggtggaa

SEQ ID NO: 4760 - DNA, 20 bp, Homo sapiens
ttttaaacaagattattatg

SEQ ID NO: 4761 - DNA, 21 bp, Homo sapiens
gggaaggaaactaaaataatg

SEQ ID NO: 4762 - DNA, 20 bp, Homo sapiens
gctagataactttcgactct

SEQ ID NO: 4763 - DNA, 23 bp, Homo sapiens
ctgcagccactcaactacaatat

SEQ ID NO: 4764 - DNA, 23 bp, Homo sapiens
agcttgcaccagttaagtccttg

SEQ ID NO: 4765 - DNA, 22 bp, Homo sapiens
tcgatcccaggtttcggcacca

SEQ ID NO: 4766 - DNA, 22 bp, Homo sapiens
ctggaattaatggtgatgatta

SEQ ID NO: 4767 - DNA, 20 bp, Homo sapiens
tagctcagcctgatgaagag

SEQ ID NO: 4768 - DNA, 21 bp, Homo sapiens
gcatggctgctattgctaaaa

SEQ ID NO: 4769 - DNA, 23 bp, Homo sapiens
gagaggcgactcatgatggatac

SEQ ID NO: 4770 - DNA, 20 bp, Homo sapiens
tgggctctgtacctgactca

SEQ ID NO: 4771 - DNA, 21 bp, Homo sapiens
tcgggctggggcgcacctatt

SEQ ID NO: 4772 - DNA, 21 bp, Homo sapiens
aggcagagcactggctgctgg

SEQ ID NO: 4773 - DNA, 20 bp, Homo sapiens
actgattggtacccatcgcc

SEQ ID NO: 4774 - DNA, 21 bp, Homo sapiens
tccccagcacctccacccggg

SEQ ID NO: 4775 - DNA, 22 bp, Homo sapiens
ctgtgcgttgtcactgccagcc

SEQ ID NO: 4776 - DNA, 22 bp, Homo sapiens
tgcatggcactgaatacccacg

SEQ ID NO: 4777 - DNA, 22 bp, Homo sapiens
aagttactaccaaatggagacc

SEQ ID NO: 4778 - DNA, 21 bp, Homo sapiens
caacctggtaacgggagcatg

SEQ ID NO: 4779 - DNA, 22 bp, Homo sapiens
tggagagaagggcagttcctgt

SEQ ID NO: 4780 - DNA, 21 bp, Homo sapiens
aatctgggcccggatgaactg

SEQ ID NO: 4781 - DNA, 22 bp, Homo sapiens
tgtcagttttccaaagaggttg

SEQ ID NO: 4782 - DNA, 20 bp, Homo sapiens
cccgccgtagatgtccggga

SEQ ID NO: 4783 - DNA, 20 bp, Homo sapiens
gctggggaataaatggggct

SEQ ID NO: 4784 - DNA, 24 bp, Homo sapiens
ctgactataatcaatgaggcatat

SEQ ID NO: 4785 - DNA, 20 bp, Homo sapiens
gggtccccggtagctctttg

SEQ ID NO: 4786 - DNA, 20 bp, Homo sapiens
gtcagctgggagagcacctg

SEQ ID NO: 4787 - DNA, 22 bp, Homo sapiens
ccagacccggaggaagaacggg

SEQ ID NO: 4788 - DNA, 22 bp, Homo sapiens
gtgagctggggttgctggcagc

SEQ ID NO: 4789 - DNA, 22 bp, Homo sapiens
ttgcttacgaagcacatcagct

SEQ ID NO: 4790 - DNA, 20 bp, Homo sapiens
aggggaagcctctcggcgcc

SEQ ID NO: 4791 - DNA, 22 bp, Homo sapiens
ctgtgcgtgtgacaggacgtca

SEQ ID NO: 4792 - DNA, 20 bp, Homo sapiens
cccccgccgccctcttgggt

SEQ ID NO: 4793 - DNA, 20 bp, Homo sapiens
aagggcaccaccaggagacc

SEQ ID NO: 4794 - DNA, 20 bp, Homo sapiens
cacaacagataatcgcttta

SEQ ID NO: 4795 - DNA, 20 bp, Homo sapiens
gagtggacgggagcggtggg

SEQ ID NO: 4796 - DNA, 21 bp, Homo sapiens
gagaaagctcacaagaggctg

SEQ ID NO: 4797 - DNA, 21 bp, Homo sapiens
gcccgccgcgccgcctcttgc

SEQ ID NO: 4798 - DNA, 23 bp, Homo sapiens
ttataccgactcagtcgtctcca

SEQ ID NO: 4799 - DNA, 21 bp, Homo sapiens
gactgagcgtggccaggtcgg

SEQ ID NO: 4800 - DNA, 21 bp, Homo sapiens
cctcccccgcccgcccccgca

SEQ ID NO: 4801 - DNA, 20 bp, Homo sapiens
cccagccctgctccctaccc

SEQ ID NO: 4802 - DNA, 23 bp, Homo sapiens
ggcctcaagacaagtttcctgca

SEQ ID NO: 4803 - DNA, 20 bp, Homo sapiens
gccgaggtgaagctttcact

SEQ ID NO: 4804 - DNA, 22 bp, Homo sapiens
tccctgagaccctcgtttacag

SEQ ID NO: 4805 - DNA, 23 bp, Homo sapiens
gctctcttggtgcttaaccatgc

SEQ ID NO: 4806 - DNA, 20 bp, Homo sapiens
gcccccccggtgtcccccgc

SEQ ID NO: 4807 - DNA, 21 bp, Homo sapiens
tcggctcatcgcatcctccac

SEQ ID NO: 4808 - DNA, 22 bp, Homo sapiens
tgtgcaaatccatacaggtgtg

SEQ ID NO: 4809 - DNA, 21 bp, Homo sapiens
ctccctccctcccaggaatcc

SEQ ID NO: 4810 - DNA, 20 bp, Homo sapiens
actttgcgaggttaacaaga

SEQ ID NO: 4811 - DNA, 21 bp, Homo sapiens
cgatgttgcccaggagcagtg

SEQ ID NO: 4812 - DNA, 23 bp, Homo sapiens
cacatgaatctatgcatgtctgc

SEQ ID NO: 4813 - DNA, 23 bp, Homo sapiens
gagcagttttcccagggaaccct

SEQ ID NO: 4814 - DNA, 20 bp, Homo sapiens
atccgagtcacggcacgaaa

SEQ ID NO: 4815 - DNA, 22 bp, Homo sapiens
ggagtgctgctattggctagtt

SEQ ID NO: 4816 - DNA, 22 bp, Homo sapiens
tagctccacctgatgggaacag

SEQ ID NO: 4817 - DNA, 22 bp, Homo sapiens
cggcggcggcggcggcaccatc

SEQ ID NO: 4818 - DNA, 21 bp, Homo sapiens
aaaaatggcaaggtactgaac

SEQ ID NO: 4819 - DNA, 23 bp, Homo sapiens
tacccattgcatatgccacccac

SEQ ID NO: 4820 - DNA, 21 bp, Homo sapiens
tctcagtaaaacaattctgag

SEQ ID NO: 4821 - DNA, 20 bp, Homo sapiens
aagataatcacatgggggaa

SEQ ID NO: 4822 - DNA, 20 bp, Homo sapiens
gctcataaagtgactgttaa

SEQ ID NO: 4823 - DNA, 20 bp, Homo sapiens
gcctatttgtagcttatttt

SEQ ID NO: 4824 - DNA, 22 bp, Homo sapiens
tagtgaaaacagtttatttttg

SEQ ID NO: 4825 - DNA, 20 bp, Homo sapiens
gagcttatcagactgtttag

SEQ ID NO: 4826 - DNA, 23 bp, Homo sapiens
tcggttatcatggtaccgatgct

SEQ ID NO: 4827 - DNA, 22 bp, Homo sapiens
aactggcttctaggactttata

SEQ ID NO: 4828 - DNA, 23 bp, Homo sapiens
tggactgggtgatttataaagaa

SEQ ID NO: 4829 - DNA, 20 bp, Homo sapiens
tacctgctaaatagcccgct

SEQ ID NO: 4830 - DNA, 20 bp, Homo sapiens
gctgctactaatcaggctcc

SEQ ID NO: 4831 - DNA, 23 bp, Homo sapiens
ttgcttatcaaactgatgccctg

SEQ ID NO: 4832 - DNA, 22 bp, Homo sapiens
ttggtggtaaactttagtttca

SEQ ID NO: 4833 - DNA, 20 bp, Homo sapiens
ggagggcttcgcaaatgaaa

SEQ ID NO: 4834 - DNA, 23 bp, Homo sapiens
agcagcattgtacatttgattgg

SEQ ID NO: 4835 - DNA, 21 bp, Homo sapiens
tacctggttgatttcatggcc

SEQ ID NO: 4836 - DNA, 22 bp, Homo sapiens
gctctacaacactattgtctgt

SEQ ID NO: 4837 - DNA, 22 bp, Homo sapiens
cctgagattctaacaagctgtc

SEQ ID NO: 4838 - DNA, 21 bp, Homo sapiens
caataatgctccctacagcag

SEQ ID NO: 4839 - DNA, 21 bp, Homo sapiens
cattattacttttggtgctag

SEQ ID NO: 4840 - DNA, 21 bp, Homo sapiens
catgctgagaatcacagaagc

SEQ ID NO: 4841 - DNA, 20 bp, Homo sapiens
gttatacatgtggcttcaaa

SEQ ID NO: 4842 - DNA, 20 bp, Homo sapiens
gaaaattacaaggacaactt

SEQ ID NO: 4843 - DNA, 20 bp, Homo sapiens
gtcccacctgggatactacc

SEQ ID NO: 4844 - DNA, 22 bp, Homo sapiens
ttgcaccatctgaggctaaggc

SEQ ID NO: 4845 - DNA, 24 bp, Homo sapiens
gagatagagagagaatagaaaata

SEQ ID NO: 4846 - DNA, 22 bp, Homo sapiens
aagcttatcagtgactactcta

SEQ ID NO: 4847 - DNA, 23 bp, Homo sapiens
aggattgccacgtgctgctgcat

SEQ ID NO: 4848 - DNA, 23 bp, Homo sapiens
agcaggtaacatgtcttagcttt

SEQ ID NO: 4849 - DNA, 22 bp, Homo sapiens
tagcttatcagagtgattctgg

SEQ ID NO: 4850 - DNA, 22 bp, Homo sapiens
atataaatgtctaaatatgtat

SEQ ID NO: 4851 - DNA, 20 bp, Homo sapiens
cttttaatgagaggtggtaa

SEQ ID NO: 4852 - DNA, 20 bp, Homo sapiens
ctaacctataggcctgtgat

SEQ ID NO: 4853 - DNA, 20 bp, Homo sapiens
actcttgaagaaccacatag

SEQ ID NO: 4854 - DNA, 22 bp, Homo sapiens
aggctgagcacctgcaggtgag

SEQ ID NO: 4855 - DNA, 21 bp, Homo sapiens
gccaaggcctacttcttgtgt

SEQ ID NO: 4856 - DNA, 21 bp, Homo sapiens
cagacttatccatgcatgcat

SEQ ID NO: 4857 - DNA, 20 bp, Homo sapiens
gcagggtggtggtgaagaac

SEQ ID NO: 4858 - DNA, 23 bp, Homo sapiens
acagacatcactgtgacaaccac

SEQ ID NO: 4859 - DNA, 21 bp, Homo sapiens
tataccaagctaaacaggttt

SEQ ID NO: 4860 - DNA, 22 bp, Homo sapiens
gagcagtggcacaaatacccca

SEQ ID NO: 4861 - DNA, 22 bp, Homo sapiens
ttcactgccgaaagctatggcc

SEQ ID NO: 4862 - DNA, 21 bp, Homo sapiens
tctcccaacaaggtatgtcag

SEQ ID NO: 4863 - DNA, 21 bp, Homo sapiens
cctgccttaacaataacgacc

SEQ ID NO: 4864 - DNA, 23 bp, Homo sapiens
gtggtaaagtggttaataccttc

SEQ ID NO: 4865 - DNA, 20 bp, Homo sapiens
tccaccatctgattattgcc

SEQ ID NO: 4866 - DNA, 24 bp, Homo sapiens
taacggacagatacggggcagaca

SEQ ID NO: 4867 - DNA, 23 bp, Homo sapiens
actgccttttgatgaccgggacg

SEQ ID NO: 4868 - DNA, 22 bp, Homo sapiens
aaatagttctgagctgggcata

SEQ ID NO: 4869 - DNA, 22 bp, Homo sapiens
gatcgtctcaaagatgaacact

SEQ ID NO: 4870 - DNA, 20 bp, Homo sapiens
ttttaaaagagggaataaat

SEQ ID NO: 4871 - DNA, 20 bp, Homo sapiens
gaagtgttgtgttcagtggg

SEQ ID NO: 4872 - DNA, 22 bp, Homo sapiens
atcgtgccattgaactacaggc

SEQ ID NO: 4873 - DNA, 21 bp, Homo sapiens
gtagctgagagctgccacctt

SEQ ID NO: 4874 - DNA, 23 bp, Homo sapiens
gtgggacccctttgccttaggga

SEQ ID NO: 4875 - DNA, 22 bp, Homo sapiens
ttctagtaatccagatatctct

SEQ ID NO: 4876 - DNA, 23 bp, Homo sapiens
tcaactacatgggctatgtttaa

SEQ ID NO: 4877 - DNA, 20 bp, Homo sapiens
atatctccagggtccttata

SEQ ID NO: 4878 - DNA, 21 bp, Homo sapiens
caggtcaaaagggtttctaaa

SEQ ID NO: 4879 - DNA, 24 bp, Homo sapiens
cccgccccacccgcgccgcgccgc

SEQ ID NO: 4880 - DNA, 22 bp, Homo sapiens
gatggaaacagaaatacccact

SEQ ID NO: 4881 - DNA, 22 bp, Homo sapiens
gtgaccaaatattttatgtttg

SEQ ID NO: 4882 - DNA, 22 bp, Homo sapiens
atacaattattgatctaaaggt

SEQ ID NO: 4883 - DNA, 23 bp, Homo sapiens
agcagcaaacattgaggctgcag

SEQ ID NO: 4884 - DNA, 22 bp, Homo sapiens
tgtcaacttgtcaaattcattg

SEQ ID NO: 4885 - DNA, 20 bp, Homo sapiens
ccaggaggaagagaggtaaa

SEQ ID NO: 4886 - DNA, 22 bp, Homo sapiens
tgagatgaagcaccaatgggga

SEQ ID NO: 4887 - DNA, 20 bp, Homo sapiens
agaagtgttgtgttcagtga

SEQ ID NO: 4888 - DNA, 21 bp, Homo sapiens
agcggctgtaccacaccagca

SEQ ID NO: 4889 - DNA, 20 bp, Homo sapiens
accgcattctctaatatcag

SEQ ID NO: 4890 - DNA, 21 bp, Homo sapiens
gtatggcacagtaaattacta

SEQ ID NO: 4891 - DNA, 22 bp, Homo sapiens
ataggactgggaacatggtcac

SEQ ID NO: 4892 - DNA, 22 bp, Homo sapiens
gcagcttgctaatgccgcacag

SEQ ID NO: 4893 - DNA, 22 bp, Homo sapiens
atgacctattttaactatctgg

SEQ ID NO: 4894 - DNA, 22 bp, Homo sapiens
tccatgatctgccatatcaatc

SEQ ID NO: 4895 - DNA, 21 bp, Homo sapiens
atgcaatgtctgcccgcccca

SEQ ID NO: 4896 - DNA, 22 bp, Homo sapiens
caaagttctgggatcaggtgtg

SEQ ID NO: 4897 - DNA, 21 bp, Homo sapiens
gctggcgctctcgcagtggcc

SEQ ID NO: 4898 - DNA, 20 bp, Homo sapiens
tgatgatggcctgcacggag

SEQ ID NO: 4899 - DNA, 23 bp, Homo sapiens
ccagttctcaggccagtgacttt

SEQ ID NO: 4900 - DNA, 23 bp, Homo sapiens
gccctgtagtatagcatgatgcc

SEQ ID NO: 4901 - DNA, 22 bp, Homo sapiens
caggcggcaggggttgcagtga

SEQ ID NO: 4902 - DNA, 22 bp, Homo sapiens
tcggttcccggcccatgccagt

SEQ ID NO: 4903 - DNA, 22 bp, Homo sapiens
ggagtcaaatccaggcattttg

SEQ ID NO: 4904 - DNA, 22 bp, Homo sapiens
gagcagcaatgcaatattggaa

SEQ ID NO: 4905 - DNA, 21 bp, Homo sapiens
ctgacatcagcactctgataa

SEQ ID NO: 4906 - DNA, 22 bp, Homo sapiens
atatgatgtataatggtttaca

SEQ ID NO: 4907 - DNA, 22 bp, Homo sapiens
cacatgtttgccagcaggctga

SEQ ID NO: 4908 - DNA, 24 bp, Homo sapiens
ggctggtccgagtgcagtggtatt

SEQ ID NO: 4909 - DNA, 22 bp, Homo sapiens
tagctcgcgtctgtgatcccag

SEQ ID NO: 4910 - DNA, 21 bp, Homo sapiens
ctccaaggtgaacagctctgt

SEQ ID NO: 4911 - DNA, 22 bp, Homo sapiens
tataggcgactcacagtatggg

SEQ ID NO: 4912 - DNA, 23 bp, Homo sapiens
agagctgacctgatgaaggtgag

SEQ ID NO: 4913 - DNA, 22 bp, Homo sapiens
gtagaagagagtgaggagctcg

SEQ ID NO: 4914 - DNA, 20 bp, Homo sapiens
atccctccgtggttaccatc

SEQ ID NO: 4915 - DNA, 23 bp, Homo sapiens
gtatatacaggtatggtgatgag

SEQ ID NO: 4916 - DNA, 20 bp, Homo sapiens
ccggatgctagcttccgggt

SEQ ID NO: 4917 - DNA, 20 bp, Homo sapiens
ccccgcgcgcgccgctcgtc

SEQ ID NO: 4918 - DNA, 22 bp, Homo sapiens
cagaacctgctgggcgggctgg

SEQ ID NO: 4919 - DNA, 23 bp, Homo sapiens
tatgatattttacagatgaatca

SEQ ID NO: 4920 - DNA, 22 bp, Homo sapiens
tgaggcggcggcggcagcgacc

SEQ ID NO: 4921 - DNA, 21 bp, Homo sapiens
agatcgtgtcactgcagcact

SEQ ID NO: 4922 - DNA, 23 bp, Homo sapiens
gagcgaggaaagggtaggcgctg

SEQ ID NO: 4923 - DNA, 23 bp, Homo sapiens
tagcagtgcccaggtagagtgta

SEQ ID NO: 4924 - DNA, 20 bp, Homo sapiens
gagggcgcgcgggtcggttc

SEQ ID NO: 4925 - DNA, 23 bp, Homo sapiens
acagcaggctcagacaggcagga

SEQ ID NO: 4926 - DNA, 23 bp, Homo sapiens
gtgttgaattacgatgcagtcga

SEQ ID NO: 4927 - DNA, 22 bp, Homo sapiens
atcacatgcggtcatcgggagc

SEQ ID NO: 4928 - DNA, 22 bp, Homo sapiens
ttgttcattgaactaggctata

SEQ ID NO: 4929 - DNA, 20 bp, Homo sapiens
atggacggctgatgcggtct

SEQ ID NO: 4930 - DNA, 21 bp, Homo sapiens
gactgacaaacattgagaccc

SEQ ID NO: 4931 - DNA, 22 bp, Homo sapiens
cagagcaaagcactgtaaactt

SEQ ID NO: 4932 - DNA, 23 bp, Homo sapiens
agaactggagaggtccttaggga

SEQ ID NO: 4933 - DNA, 23 bp, Homo sapiens
gagcttgctgagacatacaacac

SEQ ID NO: 4934 - DNA, 24 bp, Homo sapiens
acttttgttttgtactctactcta

SEQ ID NO: 4935 - DNA, 21 bp, Homo sapiens
ctgacctatgaatcagtactg

SEQ ID NO: 4936 - DNA, 22 bp, Homo sapiens
ttgatgtatgagtttatgtgca

SEQ ID NO: 4937 - DNA, 20 bp, Homo sapiens
cttctacatgccctattgga

SEQ ID NO: 4938 - DNA, 22 bp, Homo sapiens
atcacattgggtcctccttcca

SEQ ID NO: 4939 - DNA, 23 bp, Homo sapiens
tgtcagtttactgggctgagacc

SEQ ID NO: 4940 - DNA, 20 bp, Homo sapiens
tgtgcaaatttgcatgcaga

SEQ ID NO: 4941 - DNA, 22 bp, Homo sapiens
tgattcagtagattgcgcgacg

SEQ ID NO: 4942 - DNA, 23 bp, Homo sapiens
gtgcttcacgcggaaatacacgc

SEQ ID NO: 4943 - DNA, 22 bp, Homo sapiens
tagcttatcttcattatggggt

SEQ ID NO: 4944 - DNA, 23 bp, Homo sapiens
agtgcaaatccatgcatttgcac

SEQ ID NO: 4945 - DNA, 21 bp, Homo sapiens
tgccaactgtggtgggtgggg

SEQ ID NO: 4946 - DNA, 20 bp, Homo sapiens
cctattgtgtactgcgcatg

SEQ ID NO: 4947 - DNA, 22 bp, Homo sapiens
tagcttatgtctgacttgtgga

SEQ ID NO: 4948 - DNA, 20 bp, Homo sapiens
tagagcagccatatcgtcaa

SEQ ID NO: 4949 - DNA, 23 bp, Homo sapiens
tctcccaagtaggtgcaactaca

SEQ ID NO: 4950 - DNA, 23 bp, Homo sapiens
cactggtttgctgggctgaagcc

SEQ ID NO: 4951 - DNA, 22 bp, Homo sapiens
tgtcagttcactccagcaaaac

SEQ ID NO: 4952 - DNA, 22 bp, Homo sapiens
cactgactcactggggcaaaac

SEQ ID NO: 4953 - DNA, 22 bp, Homo sapiens
gagctggagagtcaatcgtgta

SEQ ID NO: 4954 - DNA, 22 bp, Homo sapiens
tctggctggaggcagggctggt

SEQ ID NO: 4955 - DNA, 20 bp, Homo sapiens
gctgtgccattgaagtgtca

SEQ ID NO: 4956 - DNA, 22 bp, Homo sapiens
tatacagtagactcattatgga

SEQ ID NO: 4957 - DNA, 20 bp, Homo sapiens
actccatgatgttgtgaatt

SEQ ID NO: 4958 - DNA, 21 bp, Homo sapiens
acatggcactcgccattacgg

SEQ ID NO: 4959 - DNA, 22 bp, Homo sapiens
acagtagtctggtgatgtgtgc

SEQ ID NO: 4960 - DNA, 20 bp, Homo sapiens
ggccaacttagatgcagtgt

SEQ ID NO: 4961 - DNA, 21 bp, Homo sapiens
tagcttgctgagtcagtggaa

SEQ ID NO: 4962 - DNA, 22 bp, Homo sapiens
cattttgagtataagcttgact

SEQ ID NO: 4963 - DNA, 20 bp, Homo sapiens
gtccagttttcccacgtgcg

SEQ ID NO: 4964 - DNA, 22 bp, Homo sapiens
tagcttatcttcacaggtttga

SEQ ID NO: 4965 - DNA, 20 bp, Homo sapiens
aagctagggcagtagtgggg

SEQ ID NO: 4966 - DNA, 22 bp, Homo sapiens
ttgcacatttgcttagggaccc

SEQ ID NO: 4967 - DNA, 24 bp, Homo sapiens
aggtctaactggttggggctactc

SEQ ID NO: 4968 - DNA, 20 bp, Homo sapiens
taatcttaactgttagtgga

SEQ ID NO: 4969 - DNA, 20 bp, Homo sapiens
ctgtgttgctatgggttatc

SEQ ID NO: 4970 - DNA, 22 bp, Homo sapiens
tagtccttagggtccctactga

SEQ ID NO: 4971 - DNA, 21 bp, Homo sapiens
aatgatgtccaatgtctcttt

SEQ ID NO: 4972 - DNA, 22 bp, Homo sapiens
atctgtatgggtcagatccttg

SEQ ID NO: 4973 - DNA, 22 bp, Homo sapiens
ttgactgggtctgggatgggga

SEQ ID NO: 4974 - DNA, 24 bp, Homo sapiens
cctcctcctgggaaaggtcctttc

SEQ ID NO: 4975 - DNA, 21 bp, Homo sapiens
atccctaggctcccaggtatg

SEQ ID NO: 4976 - DNA, 22 bp, Homo sapiens
tcagtacccactccctacccca

SEQ ID NO: 4977 - DNA, 23 bp, Homo sapiens
gtttgacacctttgaaggtggga

SEQ ID NO: 4978 - DNA, 22 bp, Homo sapiens
cctcatcagacgtgattatggc

SEQ ID NO: 4979 - DNA, 20 bp, Homo sapiens
gttccagttttccctggaat

SEQ ID NO: 4980 - DNA, 22 bp, Homo sapiens
gacaatggcaacagcatctcaa

SEQ ID NO: 4981 - DNA, 20 bp, Homo sapiens
ctgtgactcttagcggagga

SEQ ID NO: 4982 - DNA, 22 bp, Homo sapiens
aagttacgcgatagctatctaa

SEQ ID NO: 4983 - DNA, 21 bp, Homo sapiens
cctgcagtggctaagttccag

SEQ ID NO: 4984 - DNA, 22 bp, Homo sapiens
tctgccattagactgataggtt

SEQ ID NO: 4985 - DNA, 21 bp, Homo sapiens
cgtcccgctccggggacagtg

SEQ ID NO: 4986 - DNA, 22 bp, Homo sapiens
tgtgcaagtccatgcaaccagg

SEQ ID NO: 4987 - DNA, 22 bp, Homo sapiens
ggctggtccagcgggcgtgggt

SEQ ID NO: 4988 - DNA, 20 bp, Homo sapiens
cgcggcggggcgcgggagac

SEQ ID NO: 4989 - DNA, 21 bp, Homo sapiens
atgacctattaattggcataa

SEQ ID NO: 4990 - DNA, 23 bp, Homo sapiens
caaagtgcaatgtctgcagacat

SEQ ID NO: 4991 - DNA, 21 bp, Homo sapiens
ctgacctaaaggcgtcaccaa

SEQ ID NO: 4992 - DNA, 22 bp, Homo sapiens
tcagtcgtgtgacctactttgt

SEQ ID NO: 4993 - DNA, 20 bp, Homo sapiens
tgtttgcatggaggtggtct

SEQ ID NO: 4994 - DNA, 23 bp, Homo sapiens
ttagaagctgagtagatgttgac

SEQ ID NO: 4995 - DNA, 21 bp, Homo sapiens
ggctaaggtgggctgggcaga

SEQ ID NO: 4996 - DNA, 22 bp, Homo sapiens
caacattgatgctactctgagt

SEQ ID NO: 4997 - DNA, 20 bp, Homo sapiens
tgaagacagattagatgtat

SEQ ID NO: 4998 - DNA, 22 bp, Homo sapiens
ttacgcaacccggtgcatgaca

SEQ ID NO: 4999 - DNA, 20 bp, Homo sapiens
ttaggtaccattaaagtaga

SEQ ID NO: 5000 - DNA, 22 bp, Homo sapiens
agagggtgcccttgtacactgt

SEQ ID NO: 5001 - DNA, 21 bp, Homo sapiens
gggagaggaaatgttcgataa

SEQ ID NO: 5002 - DNA, 20 bp, Homo sapiens
tgtgcaaaagatacgtcact

SEQ ID NO: 5003 - DNA, 21 bp, Homo sapiens
ctgtgcgtgtgacagctgtct

SEQ ID NO: 5004 - DNA, 23 bp, Homo sapiens
acagcagatccatgcatggtcaa

SEQ ID NO: 5005 - DNA, 21 bp, Homo sapiens
aacccgtggacggtgtgacgc

SEQ ID NO: 5006 - DNA, 20 bp, Homo sapiens
aaaccttaacatcattgact

SEQ ID NO: 5007 - DNA, 22 bp, Homo sapiens
gcagcccccggcacctctgttg

SEQ ID NO: 5008 - DNA, 20 bp, Homo sapiens
tgcatggcactcacttactg

SEQ ID NO: 5009 - DNA, 22 bp, Homo sapiens
gtcttgctgctggggacactgg

SEQ ID NO: 5010 - DNA, 20 bp, Homo sapiens
ttggaggccaagtctggatc

SEQ ID NO: 5011 - DNA, 24 bp, Homo sapiens
gccctgtggactcagttctggtca

SEQ ID NO: 5012 - DNA, 21 bp, Homo sapiens
tgctgccccactgggcgtggg

SEQ ID NO: 5013 - DNA, 21 bp, Homo sapiens
cgccttggccggcactgctcc

SEQ ID NO: 5014 - DNA, 21 bp, Homo sapiens
acaggacttaggtttatggtg

SEQ ID NO: 5015 - DNA, 22 bp, Homo sapiens
atattagtctgcacattgtggc

SEQ ID NO: 5016 - DNA, 20 bp, Homo sapiens
tggcttatcagactgggaag

SEQ ID NO: 5017 - DNA, 20 bp, Homo sapiens
aaaacaaatgatttcgactc

SEQ ID NO: 5018 - DNA, 20 bp, Homo sapiens
aacagcataagaataaacat

SEQ ID NO: 5019 - DNA, 22 bp, Homo sapiens
cagcagcactgccctgctgcgc

SEQ ID NO: 5020 - DNA, 21 bp, Homo sapiens
aggcttcattagttagcgatg

SEQ ID NO: 5021 - DNA, 22 bp, Homo sapiens
atcacatgtgactttataagac

SEQ ID NO: 5022 - DNA, 24 bp, Homo sapiens
taccaatgatgttaactcctgaga

SEQ ID NO: 5023 - DNA, 22 bp, Homo sapiens
aaaagcatctaggctgcttgtg

SEQ ID NO: 5024 - DNA, 22 bp, Homo sapiens
gtcatcattagcagagagaatc

SEQ ID NO: 5025 - DNA, 22 bp, Homo sapiens
ctgaatctctaggggcttcaat

SEQ ID NO: 5026 - DNA, 20 bp, Homo sapiens
gctgaacagcctctgatgca

SEQ ID NO: 5027 - DNA, 22 bp, Homo sapiens
tccactattaggtcagcaggct

SEQ ID NO: 5028 - DNA, 22 bp, Homo sapiens
aaaccgtttggtaattcctcaa

SEQ ID NO: 5029 - DNA, 23 bp, Homo sapiens
cagtggttacaggtgcatgccac

SEQ ID NO: 5030 - DNA, 20 bp, Homo sapiens
ccctgccctatagggatgtc

SEQ ID NO: 5031 - DNA, 22 bp, Homo sapiens
tgacaccatctgcatagccagc

SEQ ID NO: 5032 - DNA, 22 bp, Homo sapiens
ttagcaatgtctgctatagata

SEQ ID NO: 5033 - DNA, 23 bp, Homo sapiens
gtgagtaagactggcctattctc

SEQ ID NO: 5034 - DNA, 20 bp, Homo sapiens
atgagatgatatatatatgt

SEQ ID NO: 5035 - DNA, 24 bp, Homo sapiens
tgatttgcctctaacagagacttg

SEQ ID NO: 5036 - DNA, 20 bp, Homo sapiens
atcccactcgactgtgttta

SEQ ID NO: 5037 - DNA, 22 bp, Homo sapiens
ttccaacttattagaaatatgt

SEQ ID NO: 5038 - DNA, 20 bp, Homo sapiens
tccctgagaccctaggaaca

SEQ ID NO: 5039 - DNA, 22 bp, Homo sapiens
tttcacaacacttttatttttg

SEQ ID NO: 5040 - DNA, 20 bp, Homo sapiens
cctcccttcctaacatgttg

SEQ ID NO: 5041 - DNA, 22 bp, Homo sapiens
acatatacatctatacatgtgg

SEQ ID NO: 5042 - DNA, 23 bp, Homo sapiens
tagcttatcatacctgcaaacca

SEQ ID NO: 5043 - DNA, 21 bp, Homo sapiens
atcacattgggtcctctgcac

SEQ ID NO: 5044 - DNA, 23 bp, Homo sapiens
acttaactgtcaatagagggttg

SEQ ID NO: 5045 - DNA, 22 bp, Homo sapiens
catactactgctgcaaccatga

SEQ ID NO: 5046 - DNA, 20 bp, Homo sapiens
gctgctgccatagttccttc

SEQ ID NO: 5047 - DNA, 21 bp, Homo sapiens
cattccataacatgagcaggt

SEQ ID NO: 5048 - DNA, 22 bp, Homo sapiens
ttatgttgcccaggtaaccaat

SEQ ID NO: 5049 - DNA, 20 bp, Homo sapiens
ctgcacaatcctgggctgga

SEQ ID NO: 5050 - DNA, 21 bp, Homo sapiens
tccccagtacgaggtccatct

SEQ ID NO: 5051 - DNA, 22 bp, Homo sapiens
gttctcaacacaaatattttgc

SEQ ID NO: 5052 - DNA, 22 bp, Homo sapiens
tctagtagactctcatattggc

SEQ ID NO: 5053 - DNA, 22 bp, Homo sapiens
aatattatcactgcagcatgta

SEQ ID NO: 5054 - DNA, 21 bp, Homo sapiens
gggaggttgacctgtacattg

SEQ ID NO: 5055 - DNA, 20 bp, Homo sapiens
atgcaatgtctgccacccag

SEQ ID NO: 5056 - DNA, 23 bp, Homo sapiens
ctggctatatgtccataatttta

SEQ ID NO: 5057 - DNA, 22 bp, Homo sapiens
ttctcaggaccctatgaacact

SEQ ID NO: 5058 - DNA, 21 bp, Homo sapiens
tagtcaatgtcaaaaacccca

SEQ ID NO: 5059 - DNA, 21 bp, Homo sapiens
caactccaaatttttcatttg

SEQ ID NO: 5060 - DNA, 20 bp, Homo sapiens
attatttgtggtcatatata

SEQ ID NO: 5061 - DNA, 23 bp, Homo sapiens
tctgaatagtctgactatttggt

SEQ ID NO: 5062 - DNA, 23 bp, Homo sapiens
tgtcaggaatctgggcgtgggtt

SEQ ID NO: 5063 - DNA, 21 bp, Homo sapiens
aagtaatctgagactgtttgt

SEQ ID NO: 5064 - DNA, 22 bp, Homo sapiens
cgtaatactaaatattcagcca

SEQ ID NO: 5065 - DNA, 20 bp, Homo sapiens
ctgagaagatggggggggcc

SEQ ID NO: 5066 - DNA, 22 bp, Homo sapiens
ttataggggtccatctccacca

SEQ ID NO: 5067 - DNA, 20 bp, Homo sapiens
gtggggggcccaagtcagtg

SEQ ID NO: 5068 - DNA, 22 bp, Homo sapiens
acagcaggcacagccaggcctc

SEQ ID NO: 5069 - DNA, 21 bp, Homo sapiens
tccgctgggggcggggagggg

SEQ ID NO: 5070 - DNA, 24 bp, Homo sapiens
catgacatccgcagtgcagtgctg

SEQ ID NO: 5071 - DNA, 20 bp, Homo sapiens
agcctggtccacatgaggag

SEQ ID NO: 5072 - DNA, 22 bp, Homo sapiens
tggctcagttcagctggaagca

SEQ ID NO: 5073 - DNA, 22 bp, Homo sapiens
tctgagtaatcactgaatcatc

SEQ ID NO: 5074 - DNA, 20 bp, Homo sapiens
tctcttctctcactcagatc

SEQ ID NO: 5075 - DNA, 22 bp, Homo sapiens
tatactacatgtgtatacatat

SEQ ID NO: 5076 - DNA, 21 bp, Homo sapiens
ttcacctgttagcctaagttg

SEQ ID NO: 5077 - DNA, 22 bp, Homo sapiens
aaacatggaaacttagcagact

SEQ ID NO: 5078 - DNA, 20 bp, Homo sapiens
tatattatcaccaaacctac

SEQ ID NO: 5079 - DNA, 20 bp, Homo sapiens
atttaaataagggtgttggt

SEQ ID NO: 5080 - DNA, 20 bp, Homo sapiens
atcgcaattaccagggcagg

SEQ ID NO: 5081 - DNA, 20 bp, Homo sapiens
atcatagaggctaatgtgct

SEQ ID NO: 5082 - DNA, 21 bp, Homo sapiens
ggtggctgtctagagatagtt

SEQ ID NO: 5083 - DNA, 23 bp, Homo sapiens
tggctcagactctacccttgtca

SEQ ID NO: 5084 - DNA, 23 bp, Homo sapiens
tcagatgctgagtcccctgggtt

SEQ ID NO: 5085 - DNA, 22 bp, Homo sapiens
tggatacttcactcaggatctc

SEQ ID NO: 5086 - DNA, 22 bp, Homo sapiens
aagcttatcaggagtctgttga

SEQ ID NO: 5087 - DNA, 23 bp, Homo sapiens
tagcaccattactttagttgtga

SEQ ID NO: 5088 - DNA, 21 bp, Homo sapiens
acaatttattcaacaccatta

SEQ ID NO: 5089 - DNA, 23 bp, Homo sapiens
ataactgaaagggtccttatttc

SEQ ID NO: 5090 - DNA, 20 bp, Homo sapiens
cccacaagctattttgatct

SEQ ID NO: 5091 - DNA, 22 bp, Homo sapiens
tgtcaggggactggggcaaatg

SEQ ID NO: 5092 - DNA, 24 bp, Homo sapiens
tcaccagcactgttggggaagatg

SEQ ID NO: 5093 - DNA, 22 bp, Homo sapiens
tcaggataccctgtgcacagtg

SEQ ID NO: 5094 - DNA, 23 bp, Homo sapiens
cagatgccacagtttatggggcc

SEQ ID NO: 5095 - DNA, 20 bp, Homo sapiens
aagacaacaaactggctgtg

SEQ ID NO: 5096 - DNA, 20 bp, Homo sapiens
tgctgaggaaaagaaacatc

SEQ ID NO: 5097 - DNA, 22 bp, Homo sapiens
ccgctggccgaggcactgccga

SEQ ID NO: 5098 - DNA, 20 bp, Homo sapiens
caggcgattcctccaccctg

SEQ ID NO: 5099 - DNA, 20 bp, Homo sapiens
atttaatcgatctgagatga

SEQ ID NO: 5100 - DNA, 22 bp, Homo sapiens
aaaatatttgcccattatttct

SEQ ID NO: 5101 - DNA, 22 bp, Homo sapiens
acagcggcagtcaccgcatcga

SEQ ID NO: 5102 - DNA, 24 bp, Homo sapiens
tctgacctccatttctcacccaca

SEQ ID NO: 5103 - DNA, 21 bp, Homo sapiens
atattggagtctagtttgccc

SEQ ID NO: 5104 - DNA, 20 bp, Homo sapiens
ccctcaggatagctggcaca

SEQ ID NO: 5105 - DNA, 22 bp, Homo sapiens
attgcattaggtaggatttcca

SEQ ID NO: 5106 - DNA, 22 bp, Homo sapiens
aagatgctgcttggcatatcaa

SEQ ID NO: 5107 - DNA, 23 bp, Homo sapiens
aagcttatcagagtgtacttgaa

SEQ ID NO: 5108 - DNA, 22 bp, Homo sapiens
agggattctcaagccaggtcag

SEQ ID NO: 5109 - DNA, 22 bp, Homo sapiens
tgttccagccactgtcgtcctg

SEQ ID NO: 5110 - DNA, 22 bp, Homo sapiens
tggagagccaggcagccttcag

SEQ ID NO: 5111 - DNA, 22 bp, Homo sapiens
tgtccgtccgtcctcctcctcc

SEQ ID NO: 5112 - DNA, 21 bp, Homo sapiens
ctcactgatcaatgaatgcaa

SEQ ID NO: 5113 - DNA, 22 bp, Homo sapiens
ttcacagtggctcctggaacac

SEQ ID NO: 5114 - DNA, 21 bp, Homo sapiens
tcatcccagcgaggcctccga

SEQ ID NO: 5115 - DNA, 22 bp, Homo sapiens
tccctgtctggagtgctctgag

SEQ ID NO: 5116 - DNA, 21 bp, Homo sapiens
tcagtcataaggccaatgatt

SEQ ID NO: 5117 - DNA, 23 bp, Homo sapiens
taataatagtagctgttgttgac

SEQ ID NO: 5118 - DNA, 22 bp, Homo sapiens
ttgaccaccactcccgccccca

SEQ ID NO: 5119 - DNA, 21 bp, Homo sapiens
ttacactgttagcccaaggcc

SEQ ID NO: 5120 - DNA, 22 bp, Homo sapiens
tgtgcaaatacatgcatttgat

SEQ ID NO: 5121 - DNA, 22 bp, Homo sapiens
tggactcccttgtgtttcccca

SEQ ID NO: 5122 - DNA, 21 bp, Homo sapiens
cattccagccgcgtgattgac

SEQ ID NO: 5123 - DNA, 21 bp, Homo sapiens
ctgacctagtggccacactaa

SEQ ID NO: 5124 - DNA, 20 bp, Homo sapiens
tcacgccattgcgctttagc

SEQ ID NO: 5125 - DNA, 22 bp, Homo sapiens
cagaactcatccccacatagtt

SEQ ID NO: 5126 - DNA, 20 bp, Homo sapiens
ggctggtggtataacgcctg

SEQ ID NO: 5127 - DNA, 22 bp, Homo sapiens
atcacatgcggtcaaataaggc

SEQ ID NO: 5128 - DNA, 22 bp, Homo sapiens
accccagcttaggaaacagggt

SEQ ID NO: 5129 - DNA, 22 bp, Homo sapiens
gtctgtgggctgggtgcactgg

SEQ ID NO: 5130 - DNA, 22 bp, Homo sapiens
tgctctgaaagctgtcctgttc

SEQ ID NO: 5131 - DNA, 24 bp, Homo sapiens
gacagtgatgacagcctggctgag

SEQ ID NO: 5132 - DNA, 20 bp, Homo sapiens
ggcagagcagttttaagaac

SEQ ID NO: 5133 - DNA, 20 bp, Homo sapiens
gggacatgtggcgtaaaggg

SEQ ID NO: 5134 - DNA, 21 bp, Homo sapiens
ctcggggggggcccgggcatc

SEQ ID NO: 5135 - DNA, 20 bp, Homo sapiens
cttttaatcatcttgccatt

SEQ ID NO: 5136 - DNA, 23 bp, Homo sapiens
ccatggcgactctgctgcgccct

SEQ ID NO: 5137 - DNA, 24 bp, Homo sapiens
caggctccagcaggctcctgggta

SEQ ID NO: 5138 - DNA, 21 bp, Homo sapiens
aaatgagaataaggggccggg

SEQ ID NO: 5139 - DNA, 23 bp, Homo sapiens
ctcaagtaatccgagaatcgctt

SEQ ID NO: 5140 - DNA, 24 bp, Homo sapiens
ggcctgtgatgggaatctgaggca

SEQ ID NO: 5141 - DNA, 21 bp, Homo sapiens
agaaatgcttgaatccaggtg

SEQ ID NO: 5142 - DNA, 23 bp, Homo sapiens
agcagcaggtgccagggctccag

SEQ ID NO: 5143 - DNA, 22 bp, Homo sapiens
ggggctggagcgtcgggccagg

SEQ ID NO: 5144 - DNA, 21 bp, Homo sapiens
ctactgggctgctgcattctc

SEQ ID NO: 5145 - DNA, 22 bp, Homo sapiens
ccgccccacaaataccactaca

SEQ ID NO: 5146 - DNA, 23 bp, Homo sapiens
atctgtagtaaagggtaacttcc

SEQ ID NO: 5147 - DNA, 22 bp, Homo sapiens
tgagatgcgatgtcaccatttc

SEQ ID NO: 5148 - DNA, 20 bp, Homo sapiens
ctgacctgcaggccaggggt

SEQ ID NO: 5149 - DNA, 23 bp, Homo sapiens
cccagtgttcactgatggatgaa

SEQ ID NO: 5150 - DNA, 21 bp, Homo sapiens
gagttgaacgagggcgttttg

SEQ ID NO: 5151 - DNA, 23 bp, Homo sapiens
gtccagtgttcctgactgaggtc

SEQ ID NO: 5152 - DNA, 20 bp, Homo sapiens
gccggcgggagccccgcgct

SEQ ID NO: 5153 - DNA, 22 bp, Homo sapiens
tagcttgagtctgtgaggttga

SEQ ID NO: 5154 - DNA, 24 bp, Homo sapiens
cgcggcgcaagcggagccggcccg

SEQ ID NO: 5155 - DNA, 22 bp, Homo sapiens
tagcaggtgcttttatggggcc

SEQ ID NO: 5156 - DNA, 20 bp, Homo sapiens
gtatctggagtctagtctgg

SEQ ID NO: 5157 - DNA, 20 bp, Homo sapiens
ccgcgcgcgccgctcgcccc

SEQ ID NO: 5158 - DNA, 21 bp, Homo sapiens
ttcctcattaagtcctatcct

SEQ ID NO: 5159 - DNA, 21 bp, Homo sapiens
tgagggctgctgggtttctgt

SEQ ID NO: 5160 - DNA, 22 bp, Homo sapiens
tgctgcacggtctttataaacg

SEQ ID NO: 5161 - DNA, 22 bp, Homo sapiens
cccagtgttcagaagcaaagta

SEQ ID NO: 5162 - DNA, 21 bp, Homo sapiens
gtcagaaatctggtatgggtc

SEQ ID NO: 5163 - DNA, 23 bp, Homo sapiens
gtcactgggtcccaggaaccact

SEQ ID NO: 5164 - DNA, 23 bp, Homo sapiens
ccgcgatgacttttgcatcaacc

SEQ ID NO: 5165 - DNA, 21 bp, Homo sapiens
caggcggcaggggttggtatc

SEQ ID NO: 5166 - DNA, 22 bp, Homo sapiens
gtccctggggaaacttcccacg

SEQ ID NO: 5167 - DNA, 22 bp, Homo sapiens
gtcactttgagtttatgggcaa

SEQ ID NO: 5168 - DNA, 23 bp, Homo sapiens
tgaactgtttcccaggaacacct

SEQ ID NO: 5169 - DNA, 23 bp, Homo sapiens
tgccctgactcagcaggaacaga

SEQ ID NO: 5170 - DNA, 22 bp, Homo sapiens
tagcagctgcacccacgtgacg

SEQ ID NO: 5171 - DNA, 21 bp, Homo sapiens
ccccccactgcgcccgccccc

SEQ ID NO: 5172 - DNA, 21 bp, Homo sapiens
tccgagacgcgacctcaggag

SEQ ID NO: 5173 - DNA, 21 bp, Homo sapiens
ctttagccagcaggctgactt

SEQ ID NO: 5174 - DNA, 23 bp, Homo sapiens
cgcgcgcggggcggggggcgggg

SEQ ID NO: 5175 - DNA, 21 bp, Homo sapiens
tgagggctgctgggtgcctgg

SEQ ID NO: 5176 - DNA, 20 bp, Homo sapiens
cggtggcggcggcggcgcgc

SEQ ID NO: 5177 - DNA, 21 bp, Homo sapiens
aagtgacggcctctctatcca

SEQ ID NO: 5178 - DNA, 21 bp, Homo sapiens
tctcctggtttccagcaactc

SEQ ID NO: 5179 - DNA, 21 bp, Homo sapiens
gttatcctgtcttcttcacca

SEQ ID NO: 5180 - DNA, 20 bp, Homo sapiens
ggacatgtggatgcagcttc

SEQ ID NO: 5181 - DNA, 20 bp, Homo sapiens
gttactggggaaacctccaa

SEQ ID NO: 5182 - DNA, 22 bp, Homo sapiens
ggaccacctcactcccggcttc

SEQ ID NO: 5183 - DNA, 23 bp, Homo sapiens
ctctctctctcccccgctcccca

SEQ ID NO: 5184 - DNA, 22 bp, Homo sapiens
ttacactgttataagttttgca

SEQ ID NO: 5185 - DNA, 21 bp, Homo sapiens
ggcgtgtgcacacgcagccag

SEQ ID NO: 5186 - DNA, 20 bp, Homo sapiens
cctggccctgctccctaact

SEQ ID NO: 5187 - DNA, 23 bp, Homo sapiens
atctcggccactgtgcgttttgt

SEQ ID NO: 5188 - DNA, 22 bp, Homo sapiens
tccctgtcaccctagtccaaca

SEQ ID NO: 5189 - DNA, 22 bp, Homo sapiens
tgtctcaaaagagcatgggttc

SEQ ID NO: 5190 - DNA, 20 bp, Homo sapiens
agtaaggtcagctaagaagc

SEQ ID NO: 5191 - DNA, 22 bp, Homo sapiens
cccgactcacaagccaggtgtc

SEQ ID NO: 5192 - DNA, 23 bp, Homo sapiens
agtggcatgggctttggctggca

SEQ ID NO: 5193 - DNA, 20 bp, Homo sapiens
cccacccctcccggcgcatc

SEQ ID NO: 5194 - DNA, 22 bp, Homo sapiens
ttcactgctgtcaacgcaaaac

SEQ ID NO: 5195 - DNA, 24 bp, Homo sapiens
cgcgaggggcccggccccgcccgg

SEQ ID NO: 5196 - DNA, 22 bp, Homo sapiens
tggacactgaccaggacccccc

SEQ ID NO: 5197 - DNA, 22 bp, Homo sapiens
tatcagtggtgaggggcaaaac

SEQ ID NO: 5198 - DNA, 20 bp, Homo sapiens
cggcgcgaccgctctccagg

SEQ ID NO: 5199 - DNA, 20 bp, Homo sapiens
ctgctggaaaggcggccgcc

SEQ ID NO: 5200 - DNA, 22 bp, Homo sapiens
tgaggtgtgctgggtgcactgg

SEQ ID NO: 5201 - DNA, 22 bp, Homo sapiens
tgctcagggcaggagacgcggc

SEQ ID NO: 5202 - DNA, 24 bp, Homo sapiens
gccctgatgatgcccactcctgag

SEQ ID NO: 5203 - DNA, 22 bp, Homo sapiens
aggaatggcaaccatgaactgt

SEQ ID NO: 5204 - DNA, 20 bp, Homo sapiens
cggggagcccgccgggcatc

SEQ ID NO: 5205 - DNA, 20 bp, Homo sapiens
ctcgcccgccgcgccggggc

SEQ ID NO: 5206 - DNA, 21 bp, Homo sapiens
cgctccccgtcctcccaccct

SEQ ID NO: 5207 - DNA, 20 bp, Homo sapiens
acctcagggtcagcttgccg

SEQ ID NO: 5208 - DNA, 20 bp, Homo sapiens
gggggcctgtgcctgtcctc

SEQ ID NO: 5209 - DNA, 21 bp, Homo sapiens
ggtaccgtgctgccatatgcg

SEQ ID NO: 5210 - DNA, 20 bp, Homo sapiens
gtccagttttccccttcacc

SEQ ID NO: 5211 - DNA, 22 bp, Homo sapiens
agagtcattaggaggattcttg

SEQ ID NO: 5212 - DNA, 22 bp, Homo sapiens
taggaaatcagacactgcaaag

SEQ ID NO: 5213 - DNA, 22 bp, Homo sapiens
ttacgtaatccagggatactag

SEQ ID NO: 5214 - DNA, 22 bp, Homo sapiens
tcctcgtcctacagtgttaaag

SEQ ID NO: 5215 - DNA, 23 bp, Homo sapiens
agcagcattgcgtgacgccaatc

SEQ ID NO: 5216 - DNA, 21 bp, Homo sapiens
tgagagtcctacagtgcacag

SEQ ID NO: 5217 - DNA, 20 bp, Homo sapiens
cgcgggtcgcggctaagggc

SEQ ID NO: 5218 - DNA, 21 bp, Homo sapiens
agcagtgccacgtgaagtcac

SEQ ID NO: 5219 - DNA, 20 bp, Homo sapiens
tagcagcaatgcccagccag

SEQ ID NO: 5220 - DNA, 23 bp, Homo sapiens
ttcgttttactcacagcaaatca

SEQ ID NO: 5221 - DNA, 22 bp, Homo sapiens
cactgacccactggcatggttg

SEQ ID NO: 5222 - DNA, 22 bp, Homo sapiens
gactgatggcagtttatgtttg

SEQ ID NO: 5223 - DNA, 23 bp, Homo sapiens
gacctggtggtctgacaacagaa

SEQ ID NO: 5224 - DNA, 20 bp, Homo sapiens
tcccccaaacacagcctcag

SEQ ID NO: 5225 - DNA, 21 bp, Homo sapiens
ttcagacccccacttcgcttg

SEQ ID NO: 5226 - DNA, 22 bp, Homo sapiens
tggctgtgggaagcagctgcaa

SEQ ID NO: 5227 - DNA, 22 bp, Homo sapiens
tgtcatgggtgatttgcaaacc

SEQ ID NO: 5228 - DNA, 23 bp, Homo sapiens
gctactggaagggtcaggctttg

SEQ ID NO: 5229 - DNA, 23 bp, Homo sapiens
agcagcattgtatgaaagtgtat

SEQ ID NO: 5230 - DNA, 23 bp, Homo sapiens
tgtgcattagatacgtgaagatt

SEQ ID NO: 5231 - DNA, 22 bp, Homo sapiens
gtgacgtttgtcaacatgggtg

SEQ ID NO: 5232 - DNA, 21 bp, Homo sapiens
tattggctgagtaagctcata

SEQ ID NO: 5233 - DNA, 22 bp, Homo sapiens
actgtcattaggtcagcaagtt

SEQ ID NO: 5234 - DNA, 22 bp, Homo sapiens
tatatggatccatgcgattgat

SEQ ID NO: 5235 - DNA, 21 bp, Homo sapiens
cgagggcctttccagcaactg

SEQ ID NO: 5236 - DNA, 22 bp, Homo sapiens
gccctttgtcgctccgcttcca

SEQ ID NO: 5237 - DNA, 22 bp, Homo sapiens
tcttaaccacagtgtacactgt

SEQ ID NO: 5238 - DNA, 21 bp, Homo sapiens
aagggactagtctttaaaact

SEQ ID NO: 5239 - DNA, 20 bp, Homo sapiens
gaaagtctcaaagcacagtg

SEQ ID NO: 5240 - DNA, 20 bp, Homo sapiens
ggctggtccgagtgcagagt

SEQ ID NO: 5241 - DNA, 20 bp, Homo sapiens
agcagcatcatatgatggtt

SEQ ID NO: 5242 - DNA, 22 bp, Homo sapiens
atcacattgccaaaagcaaagt

SEQ ID NO: 5243 - DNA, 22 bp, Homo sapiens
aaataacagcagtgttaatccc

SEQ ID NO: 5244 - DNA, 23 bp, Homo sapiens
gtcatcaaaagggtccttaaaag

SEQ ID NO: 5245 - DNA, 20 bp, Homo sapiens
agtcaagcgtccgctccctg

SEQ ID NO: 5246 - DNA, 22 bp, Homo sapiens
gggtaggatcagattcacaaga

SEQ ID NO: 5247 - DNA, 22 bp, Homo sapiens
tgagatgggatgagtgccacag

SEQ ID NO: 5248 - DNA, 21 bp, Homo sapiens
catgagtactgtgagcactga

SEQ ID NO: 5249 - DNA, 20 bp, Homo sapiens
tagcaatggcattttattga

SEQ ID NO: 5250 - DNA, 22 bp, Homo sapiens
ttcatcattaggtcctgctcaa

SEQ ID NO: 5251 - DNA, 22 bp, Homo sapiens
actcacaggcagttcatggggt

SEQ ID NO: 5252 - DNA, 20 bp, Homo sapiens
gaggccatgattaagagctc

SEQ ID NO: 5253 - DNA, 20 bp, Homo sapiens
taatagcagcccaagtagac

SEQ ID NO: 5254 - DNA, 20 bp, Homo sapiens
cgcttatgatgaaagaggtt

SEQ ID NO: 5255 - DNA, 20 bp, Homo sapiens
gaaaatgtaattgacaacca

SEQ ID NO: 5256 - DNA, 20 bp, Homo sapiens
agtattcaacttttctaggc

SEQ ID NO: 5257 - DNA, 21 bp, Homo sapiens
actcatcagagcacttaccaa

SEQ ID NO: 5258 - DNA, 21 bp, Homo sapiens
agagggttgacttgtaccagc

SEQ ID NO: 5259 - DNA, 21 bp, Homo sapiens
agctagaatttgatttaattc

SEQ ID NO: 5260 - DNA, 21 bp, Homo sapiens
gtcatggagaggggctacatg

SEQ ID NO: 5261 - DNA, 22 bp, Homo sapiens
tgtcatggcactggtatgagtt

SEQ ID NO: 5262 - DNA, 23 bp, Homo sapiens
ggcgcccacccccgcgcccggct

SEQ ID NO: 5263 - DNA, 20 bp, Homo sapiens
ttagaaatatgttgttaatg

SEQ ID NO: 5264 - DNA, 22 bp, Homo sapiens
ggcacacagctgacacaggtgt

SEQ ID NO: 5265 - DNA, 20 bp, Homo sapiens
gtggacggtgtgagtacgct

SEQ ID NO: 5266 - DNA, 23 bp, Homo sapiens
tgtcagtggttcaaataccctca

SEQ ID NO: 5267 - DNA, 23 bp, Homo sapiens
caatgatgccaccttgggaatta

SEQ ID NO: 5268 - DNA, 20 bp, Homo sapiens
gcctctttttgccaccaatc

SEQ ID NO: 5269 - DNA, 22 bp, Homo sapiens
tgcaatcttggccccctgcaac

SEQ ID NO: 5270 - DNA, 20 bp, Homo sapiens
cctggatgatctattccatt

SEQ ID NO: 5271 - DNA, 21 bp, Homo sapiens
gggcatccgccattactgagt

SEQ ID NO: 5272 - DNA, 21 bp, Homo sapiens
atcacattgggtccctgatct

SEQ ID NO: 5273 - DNA, 23 bp, Homo sapiens
gttagactggacttcttcacatg

SEQ ID NO: 5274 - DNA, 22 bp, Homo sapiens
atgacgactcatgatggtgtta

SEQ ID NO: 5275 - DNA, 23 bp, Homo sapiens
atactacccactgttctctatga

SEQ ID NO: 5276 - DNA, 20 bp, Homo sapiens
gtcaggatgattagatagca

SEQ ID NO: 5277 - DNA, 22 bp, Homo sapiens
tcaagttctgggatacttgtgc

SEQ ID NO: 5278 - DNA, 20 bp, Homo sapiens
gaaagtctcaaagccactcc

SEQ ID NO: 5279 - DNA, 24 bp, Homo sapiens
tgtaaggtcatagagataatagcg

SEQ ID NO: 5280 - DNA, 21 bp, Homo sapiens
ttcactgcccttgagatgtca

SEQ ID NO: 5281 - DNA, 23 bp, Homo sapiens
aagtcaaatccatgcaactgacc

SEQ ID NO: 5282 - DNA, 20 bp, Homo sapiens
ggggatttagctcagtgatc

SEQ ID NO: 5283 - DNA, 24 bp, Homo sapiens
cttcctcagaaactctcccttgtg

SEQ ID NO: 5284 - DNA, 23 bp, Homo sapiens
ctgaatctcacttttatttagcc

SEQ ID NO: 5285 - DNA, 22 bp, Homo sapiens
tgttctgccctctactatcacc

SEQ ID NO: 5286 - DNA, 21 bp, Homo sapiens
ccccaggtggtgaaattgccc

SEQ ID NO: 5287 - DNA, 22 bp, Homo sapiens
attgtgggtaagaaagccgttg

SEQ ID NO: 5288 - DNA, 24 bp, Homo sapiens
ccgtccgtccgtccgtccgtcctc

SEQ ID NO: 5289 - DNA, 20 bp, Homo sapiens
gtcttaatattataagataa

SEQ ID NO: 5290 - DNA, 20 bp, Homo sapiens
gtgaactatgcctgggacct

SEQ ID NO: 5291 - DNA, 22 bp, Homo sapiens
ttgcaatttgagtttatgtgtg

SEQ ID NO: 5292 - DNA, 20 bp, Homo sapiens
gctggacgaggcgccggcgc

SEQ ID NO: 5293 - DNA, 20 bp, Homo sapiens
gagtactactttgatgggaa

SEQ ID NO: 5294 - DNA, 22 bp, Homo sapiens
tggagtagatctatgtatagcc

SEQ ID NO: 5295 - DNA, 20 bp, Homo sapiens
ctgccggaggaggaaacccc

SEQ ID NO: 5296 - DNA, 23 bp, Homo sapiens
cccagtgttcagacttgctctta

SEQ ID NO: 5297 - DNA, 22 bp, Homo sapiens
ggtgcaagttgaaaaggctttg

SEQ ID NO: 5298 - DNA, 22 bp, Homo sapiens
catgcctttctacatctcaaga

SEQ ID NO: 5299 - DNA, 23 bp, Homo sapiens
tactctaaactgaaatgttttgg

SEQ ID NO: 5300 - DNA, 20 bp, Homo sapiens
agaccaactatccaaccttc

SEQ ID NO: 5301 - DNA, 22 bp, Homo sapiens
acaccttggtacttgtccatta

SEQ ID NO: 5302 - DNA, 22 bp, Homo sapiens
gctgtcggtacagggatttcca

SEQ ID NO: 5303 - DNA, 23 bp, Homo sapiens
atacttataactgtgatgatgac

SEQ ID NO: 5304 - DNA, 20 bp, Homo sapiens
gtgccatgttggactgttcg

SEQ ID NO: 5305 - DNA, 23 bp, Homo sapiens
tagcctatcatactgatgttagt

SEQ ID NO: 5306 - DNA, 23 bp, Homo sapiens
atcccaggacataatggaggttc

SEQ ID NO: 5307 - DNA, 22 bp, Homo sapiens
cgatgtcatctcttccattggc

SEQ ID NO: 5308 - DNA, 20 bp, Homo sapiens
cattattacttttgagacgg

SEQ ID NO: 5309 - DNA, 22 bp, Homo sapiens
tagcttgcgtctgtgatcccag

SEQ ID NO: 5310 - DNA, 21 bp, Homo sapiens
ctacatcagctgagctgggga

SEQ ID NO: 5311 - DNA, 21 bp, Homo sapiens
gtccagtttttccagcttaga

SEQ ID NO: 5312 - DNA, 21 bp, Homo sapiens
cttatcagactgatgctgaaa

SEQ ID NO: 5313 - DNA, 22 bp, Homo sapiens
tgactcataaggacaggagtgt

SEQ ID NO: 5314 - DNA, 22 bp, Homo sapiens
ccacctccccatacctgcaggt

SEQ ID NO: 5315 - DNA, 23 bp, Homo sapiens
gtccagttttccctaattgttta

SEQ ID NO: 5316 - DNA, 22 bp, Homo sapiens
agcagcattggacaggtcatct

SEQ ID NO: 5317 - DNA, 23 bp, Homo sapiens
gtttgactttcccaagaatcccc

SEQ ID NO: 5318 - DNA, 23 bp, Homo sapiens
tggcttattgtcaacatgttgtg

SEQ ID NO: 5319 - DNA, 21 bp, Homo sapiens
cgatgttgctctcttagacaa

SEQ ID NO: 5320 - DNA, 22 bp, Homo sapiens
tggagcagggagatggaaacct

SEQ ID NO: 5321 - DNA, 20 bp, Homo sapiens
aataatcacatgttgtgggg

SEQ ID NO: 5322 - DNA, 20 bp, Homo sapiens
aatcaacttatatttaggtt

SEQ ID NO: 5323 - DNA, 21 bp, Homo sapiens
tgtaacagcaacaggtagcca

SEQ ID NO: 5324 - DNA, 22 bp, Homo sapiens
gtttctgattcagcaggactga

SEQ ID NO: 5325 - DNA, 22 bp, Homo sapiens
gatcgtgccactgggcgaaacc

SEQ ID NO: 5326 - DNA, 23 bp, Homo sapiens
tcctgacaatgatttatttttgc

SEQ ID NO: 5327 - DNA, 20 bp, Homo sapiens
cttacttgtggtcatattgt

SEQ ID NO: 5328 - DNA, 20 bp, Homo sapiens
gctacaactacacctacatg

SEQ ID NO: 5329 - DNA, 23 bp, Homo sapiens
tgctgacttactgggcattggtt

SEQ ID NO: 5330 - DNA, 22 bp, Homo sapiens
tatactgtctcagggctcctta

SEQ ID NO: 5331 - DNA, 20 bp, Homo sapiens
ctaaggataatgcactccag

SEQ ID NO: 5332 - DNA, 20 bp, Homo sapiens
taaggtgttaagaatgaatg

SEQ ID NO: 5333 - DNA, 21 bp, Homo sapiens
ctttattagaaggttgcagat

SEQ ID NO: 5334 - DNA, 22 bp, Homo sapiens
tattgcacttgaaaattttcaa

SEQ ID NO: 5335 - DNA, 20 bp, Homo sapiens
atatccgcagcagcagaggt

SEQ ID NO: 5336 - DNA, 21 bp, Homo sapiens
tagctggctgagtcagccagt

SEQ ID NO: 5337 - DNA, 22 bp, Homo sapiens
agctacattacttggtgccaaa

SEQ ID NO: 5338 - DNA, 20 bp, Homo sapiens
cgcccacccccgcggggccc

SEQ ID NO: 5339 - DNA, 22 bp, Homo sapiens
aaacacgtcggtccttaacttg

SEQ ID NO: 5340 - DNA, 22 bp, Homo sapiens
tgcgccttcacttgctgccact

SEQ ID NO: 5341 - DNA, 22 bp, Homo sapiens
ggagactctgggatgtcctcag

SEQ ID NO: 5342 - DNA, 20 bp, Homo sapiens
ccccaacagtatggtaaatc

SEQ ID NO: 5343 - DNA, 22 bp, Homo sapiens
atgtacgctgagtgtcgtttag

SEQ ID NO: 5344 - DNA, 23 bp, Homo sapiens
tcgcagatgagactgatgttgac

SEQ ID NO: 5345 - DNA, 20 bp, Homo sapiens
caggctggacgaggcgcatc

SEQ ID NO: 5346 - DNA, 22 bp, Homo sapiens
tgagatgaagcaccagcaagcc

SEQ ID NO: 5347 - DNA, 21 bp, Homo sapiens
ttcaactgtgctaacaaggca

SEQ ID NO: 5348 - DNA, 23 bp, Homo sapiens
gagctcagttcagcagctgtgag

SEQ ID NO: 5349 - DNA, 21 bp, Homo sapiens
ttcatggaggaaaatcctgca

SEQ ID NO: 5350 - DNA, 23 bp, Homo sapiens
tgggagagttcagctcctgtggt

SEQ ID NO: 5351 - DNA, 21 bp, Homo sapiens
ccagggtggagccgccgcagt

SEQ ID NO: 5352 - DNA, 20 bp, Homo sapiens
tccctgtctggagccatgtc

SEQ ID NO: 5353 - DNA, 22 bp, Homo sapiens
tgcctgagaccctacactttga

SEQ ID NO: 5354 - DNA, 20 bp, Homo sapiens
gactgtacagcactctagat

SEQ ID NO: 5355 - DNA, 21 bp, Homo sapiens
atatatatgagatatatacgc

SEQ ID NO: 5356 - DNA, 23 bp, Homo sapiens
gagtccgctgagtacatgccagt

SEQ ID NO: 5357 - DNA, 20 bp, Homo sapiens
cctcttgcccataatgctac

SEQ ID NO: 5358 - DNA, 20 bp, Homo sapiens
attatttgtggtcacattgt

SEQ ID NO: 5359 - DNA, 23 bp, Homo sapiens
gctagataaagaacttaatcaag

SEQ ID NO: 5360 - DNA, 22 bp, Homo sapiens
tgaatcattaggtcaggagttc

SEQ ID NO: 5361 - DNA, 23 bp, Homo sapiens
atatcaaattcttaaaagtgaca

SEQ ID NO: 5362 - DNA, 22 bp, Homo sapiens
cagcagtgggtctttataaaat

SEQ ID NO: 5363 - DNA, 23 bp, Homo sapiens
agcagcacctaacagcgtgggca

SEQ ID NO: 5364 - DNA, 23 bp, Homo sapiens
gtaactgcaagggtccttatggg

SEQ ID NO: 5365 - DNA, 20 bp, Homo sapiens
tatatatgtgtgcatatcgt

SEQ ID NO: 5366 - DNA, 22 bp, Homo sapiens
atgactggtgagaaatacccca

SEQ ID NO: 5367 - DNA, 22 bp, Homo sapiens
atgatatgatatatatatgaat

SEQ ID NO: 5368 - DNA, 22 bp, Homo sapiens
cagtgcaatcaaggaagggtga

SEQ ID NO: 5369 - DNA, 22 bp, Homo sapiens
tatactacatatgtataacata

SEQ ID NO: 5370 - DNA, 22 bp, Homo sapiens
agaatagggaaacaaagcagct

SEQ ID NO: 5371 - DNA, 21 bp, Homo sapiens
gagtctagtgtacatatagaa

SEQ ID NO: 5372 - DNA, 20 bp, Homo sapiens
tgtaacagcagtcttctgtt

SEQ ID NO: 5373 - DNA, 22 bp, Homo sapiens
gcattccagtcgatgataaatc

SEQ ID NO: 5374 - DNA, 21 bp, Homo sapiens
atggatcagaaaggaagagaa

SEQ ID NO: 5375 - DNA, 23 bp, Homo sapiens
attaatatcatcatctagggtgt

SEQ ID NO: 5376 - DNA, 21 bp, Homo sapiens
ccactttatatgaagttcttg

SEQ ID NO: 5377 - DNA, 22 bp, Homo sapiens
tttgtcattaagaggatagaaa

SEQ ID NO: 5378 - DNA, 24 bp, Homo sapiens
aaataattgctaataacactatct

SEQ ID NO: 5379 - DNA, 23 bp, Homo sapiens
tcagtacagtgctgtaacaccgt

SEQ ID NO: 5380 - DNA, 21 bp, Homo sapiens
cactgctgagtacagccaaag

SEQ ID NO: 5381 - DNA, 23 bp, Homo sapiens
tgtcagtttgtcaaattctttca

SEQ ID NO: 5382 - DNA, 21 bp, Homo sapiens
aagaaaatctttagataattg

SEQ ID NO: 5383 - DNA, 21 bp, Homo sapiens
atcctgccgactatgccaatc

SEQ ID NO: 5384 - DNA, 21 bp, Homo sapiens
ctagaacgccggcactgtctt

SEQ ID NO: 5385 - DNA, 22 bp, Homo sapiens
tgtctcaaactctggctcccca

SEQ ID NO: 5386 - DNA, 20 bp, Homo sapiens
cctgtgggccgggcctgtga

SEQ ID NO: 5387 - DNA, 21 bp, Homo sapiens
ttatgcaaaccctggctgact

SEQ ID NO: 5388 - DNA, 23 bp, Homo sapiens
tgtatgggcttgcatgcctgagt

SEQ ID NO: 5389 - DNA, 21 bp, Homo sapiens
tggctcagttcaccaggagaa

SEQ ID NO: 5390 - DNA, 21 bp, Homo sapiens
cgtccgtgtcgctctcgctgg

SEQ ID NO: 5391 - DNA, 20 bp, Homo sapiens
aaatgatccttgggaaacca

SEQ ID NO: 5392 - DNA, 22 bp, Homo sapiens
cccagtgcctgagtctgggctt

SEQ ID NO: 5393 - DNA, 21 bp, Homo sapiens
agcagcattgtacagaacttc

SEQ ID NO: 5394 - DNA, 23 bp, Homo sapiens
attttacttattttttacttttt

SEQ ID NO: 5395 - DNA, 22 bp, Homo sapiens
tctggaaggcttctgatagatt

SEQ ID NO: 5396 - DNA, 22 bp, Homo sapiens
tgaatgggcttgggcgtttgtt

SEQ ID NO: 5397 - DNA, 22 bp, Homo sapiens
tgaggtagtagtggttatgagt

SEQ ID NO: 5398 - DNA, 20 bp, Homo sapiens
cccgccggggtcggccccca

SEQ ID NO: 5399 - DNA, 22 bp, Homo sapiens
gccctgagacttctttacacag

SEQ ID NO: 5400 - DNA, 20 bp, Homo sapiens
gaagaatctgacatatgttc

SEQ ID NO: 5401 - DNA, 20 bp, Homo sapiens
cacatgggcttgcatgtcag

SEQ ID NO: 5402 - DNA, 20 bp, Homo sapiens
cttcgccacatctaatatcc

SEQ ID NO: 5403 - DNA, 22 bp, Homo sapiens
cagtagaggcttgaaatagata

SEQ ID NO: 5404 - DNA, 20 bp, Homo sapiens
ccgcccgtccccgcccccac

SEQ ID NO: 5405 - DNA, 21 bp, Homo sapiens
agcagcaaactacaggtatgg

SEQ ID NO: 5406 - DNA, 20 bp, Homo sapiens
gtcacattgccaggaatatg

SEQ ID NO: 5407 - DNA, 21 bp, Homo sapiens
aatgattagaggtcttaggat

SEQ ID NO: 5408 - DNA, 22 bp, Homo sapiens
gggaagggcacctagcaggact

SEQ ID NO: 5409 - DNA, 22 bp, Homo sapiens
cccagtgtttctcagcgtgtgg

SEQ ID NO: 5410 - DNA, 20 bp, Homo sapiens
gcattgtggttcagtggatc

SEQ ID NO: 5411 - DNA, 20 bp, Homo sapiens
tcagaatagtctgactactg

SEQ ID NO: 5412 - DNA, 20 bp, Homo sapiens
tggctcagttcagcatggct

SEQ ID NO: 5413 - DNA, 23 bp, Homo sapiens
ctaaatctgacttttctttgttt

SEQ ID NO: 5414 - DNA, 24 bp, Homo sapiens
gagttaaaatattttaaatcctat

SEQ ID NO: 5415 - DNA, 22 bp, Homo sapiens
atcatggcaggagcctaaaggc

SEQ ID NO: 5416 - DNA, 20 bp, Homo sapiens
gcctatttgtagaggcaagt

SEQ ID NO: 5417 - DNA, 22 bp, Homo sapiens
tggcagtgtcttagctagttga

SEQ ID NO: 5418 - DNA, 21 bp, Homo sapiens
gtactcatggtgctatactga

SEQ ID NO: 5419 - DNA, 22 bp, Homo sapiens
cctggacgatgtgaatatctgg

SEQ ID NO: 5420 - DNA, 20 bp, Homo sapiens
caactgttcttccaccttct

SEQ ID NO: 5421 - DNA, 24 bp, Homo sapiens
ctggtgatgaatattatatctgac

SEQ ID NO: 5422 - DNA, 20 bp, Homo sapiens
cacagcataagaataagagg

SEQ ID NO: 5423 - DNA, 22 bp, Homo sapiens
gaaagagagtttcctagttcag

SEQ ID NO: 5424 - DNA, 23 bp, Homo sapiens
gagggcaaagcctgaaggctttc

SEQ ID NO: 5425 - DNA, 21 bp, Homo sapiens
gaagatgttttgggccttacc

SEQ ID NO: 5426 - DNA, 24 bp, Homo sapiens
ttgtgatgggtttatcaggacata

SEQ ID NO: 5427 - DNA, 21 bp, Homo sapiens
ctccttgcggcagtagcaggg

SEQ ID NO: 5428 - DNA, 21 bp, Homo sapiens
accatcatcgtggcaactaac

SEQ ID NO: 5429 - DNA, 20 bp, Homo sapiens
ttcacagtggctaaagtgtt

SEQ ID NO: 5430 - DNA, 20 bp, Homo sapiens
cagcgccacaactgcgcgca

SEQ ID NO: 5431 - DNA, 22 bp, Homo sapiens
cctggcctctcccacccctcct

SEQ ID NO: 5432 - DNA, 20 bp, Homo sapiens
ggcgcctgggcgaggcccct

SEQ ID NO: 5433 - DNA, 22 bp, Homo sapiens
aggtaagggaagtgggatgatc

SEQ ID NO: 5434 - DNA, 22 bp, Homo sapiens
tagcttgccaaggactatccaa

SEQ ID NO: 5435 - DNA, 23 bp, Homo sapiens
aggcaagatgctggcattcagct

SEQ ID NO: 5436 - DNA, 22 bp, Homo sapiens
cttaccgtgctgttgcctggct

SEQ ID NO: 5437 - DNA, 20 bp, Homo sapiens
agaggccctgctccctacag

SEQ ID NO: 5438 - DNA, 22 bp, Homo sapiens
cagcaccactcagagctgaccg

SEQ ID NO: 5439 - DNA, 21 bp, Homo sapiens
aagtgtttgtgggttaactga

SEQ ID NO: 5440 - DNA, 21 bp, Homo sapiens
ctaaaaaaaattaaaatgaat

SEQ ID NO: 5441 - DNA, 22 bp, Homo sapiens
ggcaacattgtatcccaacaca

SEQ ID NO: 5442 - DNA, 20 bp, Homo sapiens
attagggatagggagatttg

SEQ ID NO: 5443 - DNA, 22 bp, Homo sapiens
aagctgccagccaggaggtgat

SEQ ID NO: 5444 - DNA, 22 bp, Homo sapiens
tgaggagaatgaaaatattttg

SEQ ID NO: 5445 - DNA, 20 bp, Homo sapiens
actttagaccaaagaaggaa

SEQ ID NO: 5446 - DNA, 20 bp, Homo sapiens
ctggaagctgaattgacagt

SEQ ID NO: 5447 - DNA, 23 bp, Homo sapiens
tgagtcaagcagtttatgccacc

SEQ ID NO: 5448 - DNA, 21 bp, Homo sapiens
ttcacagtggagcctgcaata

SEQ ID NO: 5449 - DNA, 23 bp, Homo sapiens
ttgctagtctgtgaaatatttta

SEQ ID NO: 5450 - DNA, 20 bp, Homo sapiens
catgtattgccatatcagtt

SEQ ID NO: 5451 - DNA, 22 bp, Homo sapiens
cgaaggtgggcaggtcgtcggc

SEQ ID NO: 5452 - DNA, 20 bp, Homo sapiens
gtgctagtggttcagtggta

SEQ ID NO: 5453 - DNA, 21 bp, Homo sapiens
tgtaaacatccttgacagata

SEQ ID NO: 5454 - DNA, 23 bp, Homo sapiens
cgctgaccacgacccgcacccac

SEQ ID NO: 5455 - DNA, 20 bp, Homo sapiens
cctagaaaagcttctagtgt

SEQ ID NO: 5456 - DNA, 22 bp, Homo sapiens
cagtccagtagttcgcaaggtt

SEQ ID NO: 5457 - DNA, 22 bp, Homo sapiens
tatgcaataggtagcattacta

SEQ ID NO: 5458 - DNA, 23 bp, Homo sapiens
atctgcaatgtctttatttccaa

SEQ ID NO: 5459 - DNA, 23 bp, Homo sapiens
ccatgatgtgagtttatcaatgg

SEQ ID NO: 5460 - DNA, 22 bp, Homo sapiens
gacccgaattagaaataccacc

SEQ ID NO: 5461 - DNA, 22 bp, Homo sapiens
agctacattttcaaataaaaac

SEQ ID NO: 5462 - DNA, 20 bp, Homo sapiens
gcagaggagctgaaaaataa

SEQ ID NO: 5463 - DNA, 20 bp, Homo sapiens
cccagccctgctccctgtgg

SEQ ID NO: 5464 - DNA, 23 bp, Homo sapiens
gtcagcaaacagtggcgtgttgg

SEQ ID NO: 5465 - DNA, 22 bp, Homo sapiens
tggctcagtgcagacttgaact

SEQ ID NO: 5466 - DNA, 22 bp, Homo sapiens
tccataataccatatgtgagct

SEQ ID NO: 5467 - DNA, 20 bp, Homo sapiens
cagggcatcgatcctgcccg

SEQ ID NO: 5468 - DNA, 22 bp, Homo sapiens
aacacatgtgcagggcgggaac

SEQ ID NO: 5469 - DNA, 24 bp, Homo sapiens
agaggtgagtggttgggtcaagca

SEQ ID NO: 5470 - DNA, 22 bp, Homo sapiens
agttctctctgctacaggacag

SEQ ID NO: 5471 - DNA, 23 bp, Homo sapiens
ctggctgcctccagctgctgcct

SEQ ID NO: 5472 - DNA, 22 bp, Homo sapiens
ttcaagtaattctcctatctcc

SEQ ID NO: 5473 - DNA, 20 bp, Homo sapiens
cagctcatcagactgatggg

SEQ ID NO: 5474 - DNA, 21 bp, Homo sapiens
agacagaaatgccccgggctg

SEQ ID NO: 5475 - DNA, 22 bp, Homo sapiens
gcaaatatctagtagctccact

SEQ ID NO: 5476 - DNA, 20 bp, Homo sapiens
accacgaggaagagaggagg

SEQ ID NO: 5477 - DNA, 22 bp, Homo sapiens
tgtcagtttgtgtttatgtgtg

SEQ ID NO: 5478 - DNA, 23 bp, Homo sapiens
gtgtgtggcttgcatgggtgagt

SEQ ID NO: 5479 - DNA, 22 bp, Homo sapiens
tgagtcaggcagggtatatttt

SEQ ID NO: 5480 - DNA, 21 bp, Homo sapiens
tagcaccagagtcggcttatt

SEQ ID NO: 5481 - DNA, 23 bp, Homo sapiens
tgggcaaatccatgacaaactga

SEQ ID NO: 5482 - DNA, 22 bp, Homo sapiens
ttgcagtaacagaaatattttg

SEQ ID NO: 5483 - DNA, 20 bp, Homo sapiens
gacttctacaccatgtgttc

SEQ ID NO: 5484 - DNA, 22 bp, Homo sapiens
tgtcgagttcagaaatacaaac

SEQ ID NO: 5485 - DNA, 22 bp, Homo sapiens
cagtgcaatgaatgggaaatgg

SEQ ID NO: 5486 - DNA, 22 bp, Homo sapiens
atcataggctttgtcctaagct

SEQ ID NO: 5487 - DNA, 23 bp, Homo sapiens
aaaaatctgtggcacatgtttgt

SEQ ID NO: 5488 - DNA, 20 bp, Homo sapiens
cagtctccgataataagaga

SEQ ID NO: 5489 - DNA, 22 bp, Homo sapiens
gcgtgccaggcagggcatttgg

SEQ ID NO: 5490 - DNA, 22 bp, Homo sapiens
tgctgcaccacagggcgtttgg

SEQ ID NO: 5491 - DNA, 20 bp, Homo sapiens
ttctctcggggccacggggg

SEQ ID NO: 5492 - DNA, 20 bp, Homo sapiens
gtccagtgggaaactcttgc

SEQ ID NO: 5493 - DNA, 20 bp, Homo sapiens
agagggcccctgtaaaacta

SEQ ID NO: 5494 - DNA, 20 bp, Homo sapiens
acacctgagacaagtcttgt

SEQ ID NO: 5495 - DNA, 23 bp, Homo sapiens
cctagtaggtgctcagtaaacac

SEQ ID NO: 5496 - DNA, 20 bp, Homo sapiens
cccgacctcagatcagatgg

SEQ ID NO: 5497 - DNA, 23 bp, Homo sapiens
aacattcacaatcaggttgtctg

SEQ ID NO: 5498 - DNA, 22 bp, Homo sapiens
aggtcgtttccatatgactcaa

SEQ ID NO: 5499 - DNA, 23 bp, Homo sapiens
tgtcaacccagatttatgtttaa

SEQ ID NO: 5500 - DNA, 24 bp, Homo sapiens
agcttctttacagtgttgccttgt

SEQ ID NO: 5501 - DNA, 22 bp, Homo sapiens
tgaggttcagagttgtatagct

SEQ ID NO: 5502 - DNA, 20 bp, Homo sapiens
gtcttttacttcttttttct

SEQ ID NO: 5503 - DNA, 24 bp, Homo sapiens
gtgagctgttaaatctggcagcat

SEQ ID NO: 5504 - DNA, 20 bp, Homo sapiens
catgccttagggtaaagcct

SEQ ID NO: 5505 - DNA, 20 bp, Homo sapiens
atgctggtggttcagtaacc

SEQ ID NO: 5506 - DNA, 21 bp, Homo sapiens
gcagcagtgtgatacatgaag

SEQ ID NO: 5507 - DNA, 22 bp, Homo sapiens
aaagtacctggtaatgcagaca

SEQ ID NO: 5508 - DNA, 20 bp, Homo sapiens
tagcacgtgggctttcactg

SEQ ID NO: 5509 - DNA, 23 bp, Homo sapiens
tagtagtagtctgactactcctg

SEQ ID NO: 5510 - DNA, 22 bp, Homo sapiens
tcgaggagctcacagtcaaatc

SEQ ID NO: 5511 - DNA, 21 bp, Homo sapiens
ttcaagtaatccaggctccta

SEQ ID NO: 5512 - DNA, 21 bp, Homo sapiens
gcggctggacgaggcgcagtg

SEQ ID NO: 5513 - DNA, 20 bp, Homo sapiens
gcgccgcggagcctcggagg

SEQ ID NO: 5514 - DNA, 21 bp, Homo sapiens
tgagacctgctgggcgtttca

SEQ ID NO: 5515 - DNA, 21 bp, Homo sapiens
ccccgccctacaaaaaattac

SEQ ID NO: 5516 - DNA, 20 bp, Homo sapiens
tagtttatcagcatgatgtt

SEQ ID NO: 5517 - DNA, 20 bp, Homo sapiens
gactttacaagctattttca

SEQ ID NO: 5518 - DNA, 21 bp, Homo sapiens
tgtcaattacagtttatgttt

SEQ ID NO: 5519 - DNA, 22 bp, Homo sapiens
aagtgcaatgatgggtccatgc

SEQ ID NO: 5520 - DNA, 22 bp, Homo sapiens
tcaaatcccactcctgacacca

SEQ ID NO: 5521 - DNA, 20 bp, Homo sapiens
atcccactcctgacaccgtg

SEQ ID NO: 5522 - DNA, 22 bp, Homo sapiens
caagccagcttacccctactag

SEQ ID NO: 5523 - DNA, 21 bp, Homo sapiens
tgtaaacatcctacactgatt

SEQ ID NO: 5524 - DNA, 20 bp, Homo sapiens
cccgccgctcgctccctccg

SEQ ID NO: 5525 - DNA, 22 bp, Homo sapiens
agcttcattaggtcaatagatc

SEQ ID NO: 5526 - DNA, 22 bp, Homo sapiens
cactgctgagtacaaacaaaat

SEQ ID NO: 5527 - DNA, 21 bp, Homo sapiens
actgcactatctgacttattg

SEQ ID NO: 5528 - DNA, 22 bp, Homo sapiens
tctcccttgggccaacttgaca

SEQ ID NO: 5529 - DNA, 20 bp, Homo sapiens
gccccgtccgccccccgcct

SEQ ID NO: 5530 - DNA, 22 bp, Homo sapiens
agctcagatctttcaaatgttg

SEQ ID NO: 5531 - DNA, 20 bp, Homo sapiens
gtatatttgtagaggcggag

SEQ ID NO: 5532 - DNA, 23 bp, Homo sapiens
tagcttatcactttgaacttctg

SEQ ID NO: 5533 - DNA, 23 bp, Homo sapiens
agctaacggtgacagagctgcct

SEQ ID NO: 5534 - DNA, 21 bp, Homo sapiens
ctcgctacaccactgcagccg

SEQ ID NO: 5535 - DNA, 22 bp, Homo sapiens
tgagaaccaaaggtcgatgaca

SEQ ID NO: 5536 - DNA, 21 bp, Homo sapiens
tttggcaattcattactgagt

SEQ ID NO: 5537 - DNA, 20 bp, Homo sapiens
cccccaggatagctggcgct

SEQ ID NO: 5538 - DNA, 20 bp, Homo sapiens
gagcccagcgccgagtcgtg

SEQ ID NO: 5539 - DNA, 20 bp, Homo sapiens
cagcatctacatactagcag

SEQ ID NO: 5540 - DNA, 21 bp, Homo sapiens
atgtggagaggcactgagtgt

SEQ ID NO: 5541 - DNA, 20 bp, Homo sapiens
gtggttaaggctttggaatc

SEQ ID NO: 5542 - DNA, 22 bp, Homo sapiens
gcattgctggttcagtggtgtc

SEQ ID NO: 5543 - DNA, 23 bp, Homo sapiens
tatttcagaagtatgaagcactg

SEQ ID NO: 5544 - DNA, 20 bp, Homo sapiens
aaaaaataacatactgggcc

SEQ ID NO: 5545 - DNA, 20 bp, Homo sapiens
gtgaatgatgagtactgaca

SEQ ID NO: 5546 - DNA, 23 bp, Homo sapiens
gtccagtgatgtgagatctgaga

SEQ ID NO: 5547 - DNA, 21 bp, Homo sapiens
ggaggaaaagaaactaacatt

SEQ ID NO: 5548 - DNA, 22 bp, Homo sapiens
tccccagagtttcccaggttgg

SEQ ID NO: 5549 - DNA, 20 bp, Homo sapiens
actagactggactattccct

SEQ ID NO: 5550 - DNA, 21 bp, Homo sapiens
ctgtgcgtgtgacagccccag

SEQ ID NO: 5551 - DNA, 22 bp, Homo sapiens
tccgagagagaagcggggtgtc

SEQ ID NO: 5552 - DNA, 20 bp, Homo sapiens
gcaggttgttggactgggct

SEQ ID NO: 5553 - DNA, 23 bp, Homo sapiens
acagcctggtagaaataacagtg

SEQ ID NO: 5554 - DNA, 21 bp, Homo sapiens
ctatcactcaggctgagtagc

SEQ ID NO: 5555 - DNA, 22 bp, Homo sapiens
aaaaatgctcgaatcactaaac

SEQ ID NO: 5556 - DNA, 20 bp, Homo sapiens
cagacctatgaatggacagg

SEQ ID NO: 5557 - DNA, 23 bp, Homo sapiens
gaagccagtctctgatgcccacc

SEQ ID NO: 5558 - DNA, 22 bp, Homo sapiens
tcagtgcactacagaaaagaca

SEQ ID NO: 5559 - DNA, 20 bp, Homo sapiens
attgatcctgccattagatc

SEQ ID NO: 5560 - DNA, 20 bp, Homo sapiens
gttctcagaggctcggtgga

SEQ ID NO: 5561 - DNA, 23 bp, Homo sapiens
cctcatgatgacctaatggagac

SEQ ID NO: 5562 - DNA, 20 bp, Homo sapiens
cgattccgagagaaaggcct

SEQ ID NO: 5563 - DNA, 22 bp, Homo sapiens
tagcttatcagacacgaatttg

SEQ ID NO: 5564 - DNA, 23 bp, Homo sapiens
tccctgccctccaggagctcaaa

SEQ ID NO: 5565 - DNA, 21 bp, Homo sapiens
tgccctacgcctgcaccccag

SEQ ID NO: 5566 - DNA, 22 bp, Homo sapiens
tctagagctggagcagccacag

SEQ ID NO: 5567 - DNA, 22 bp, Homo sapiens
aagcgaacgccgcatgttgtca

SEQ ID NO: 5568 - DNA, 23 bp, Homo sapiens
tagcaatgcagactgatgttctg

SEQ ID NO: 5569 - DNA, 22 bp, Homo sapiens
tgatctatcagagcagcatctc

SEQ ID NO: 5570 - DNA, 21 bp, Homo sapiens
atgtggagaaatgtcatcaac

SEQ ID NO: 5571 - DNA, 22 bp, Homo sapiens
atcagtagaaactcaattgact

SEQ ID NO: 5572 - DNA, 22 bp, Homo sapiens
tccagtcctgggattaggtgtc

SEQ ID NO: 5573 - DNA, 24 bp, Homo sapiens
cactatcaagctgtcacataccca

SEQ ID NO: 5574 - DNA, 21 bp, Homo sapiens
ataaacaaaaattaagaggct

SEQ ID NO: 5575 - DNA, 20 bp, Homo sapiens
tgatatacaggactgcacgt

SEQ ID NO: 5576 - DNA, 23 bp, Homo sapiens
tagcacatcaagttgatgtttgt

SEQ ID NO: 5577 - DNA, 23 bp, Homo sapiens
tatattatctctcactaccactg

SEQ ID NO: 5578 - DNA, 21 bp, Homo sapiens
tgacatggcagcacccttcct

SEQ ID NO: 5579 - DNA, 21 bp, Homo sapiens
ctagaaccaaaggtgcaagac

SEQ ID NO: 5580 - DNA, 21 bp, Homo sapiens
agctttggtggaacatgaaga

SEQ ID NO: 5581 - DNA, 22 bp, Homo sapiens
tcacacctgaaacagacttcag

SEQ ID NO: 5582 - DNA, 21 bp, Homo sapiens
cagcagcaacctgctggggta

SEQ ID NO: 5583 - DNA, 20 bp, Homo sapiens
atctaatgctgtcatatact

SEQ ID NO: 5584 - DNA, 22 bp, Homo sapiens
ctcacaggggctaagttccgca

SEQ ID NO: 5585 - DNA, 20 bp, Homo sapiens
tgctctgattcagcaggaag

SEQ ID NO: 5586 - DNA, 20 bp, Homo sapiens
gcattggtggtccagtccag

SEQ ID NO: 5587 - DNA, 21 bp, Homo sapiens
ctcgatgctagagggaaagac

SEQ ID NO: 5588 - DNA, 20 bp, Homo sapiens
atttgtgggggcggggaatc

SEQ ID NO: 5589 - DNA, 24 bp, Homo sapiens
tctgtagatgctggcatagctcgc

SEQ ID NO: 5590 - DNA, 22 bp, Homo sapiens
tctcttctagacagaagactgc

SEQ ID NO: 5591 - DNA, 20 bp, Homo sapiens
cgtggacgtgtgtctacttt

SEQ ID NO: 5592 - DNA, 22 bp, Homo sapiens
acacccaatggtaatggctatt

SEQ ID NO: 5593 - DNA, 22 bp, Homo sapiens
atcgcttgctcagggctatggc

SEQ ID NO: 5594 - DNA, 24 bp, Homo sapiens
tcaccgcggtcttttcctcccact

SEQ ID NO: 5595 - DNA, 22 bp, Homo sapiens
atcgtatgtgctgcttgctaca

SEQ ID NO: 5596 - DNA, 20 bp, Homo sapiens
ttggaatagtctgacttgct

SEQ ID NO: 5597 - DNA, 21 bp, Homo sapiens
tgaggtagtagtttgacttag

SEQ ID NO: 5598 - DNA, 21 bp, Homo sapiens
ttatagtagaatgatttaaac

SEQ ID NO: 5599 - DNA, 22 bp, Homo sapiens
ctcgtgccatactttcggacca

SEQ ID NO: 5600 - DNA, 20 bp, Homo sapiens
atggacggatatacttccta

SEQ ID NO: 5601 - DNA, 20 bp, Homo sapiens
taaatgctagctcagtgccc

SEQ ID NO: 5602 - DNA, 20 bp, Homo sapiens
gggcggcgggggggtgtggg

SEQ ID NO: 5603 - DNA, 22 bp, Homo sapiens
tctaggtagcttgactagaacc

SEQ ID NO: 5604 - DNA, 21 bp, Homo sapiens
ctgacctatgagccagcagct

SEQ ID NO: 5605 - DNA, 23 bp, Homo sapiens
cagtgcaagctgcggtgacctcc

SEQ ID NO: 5606 - DNA, 21 bp, Homo sapiens
cagataatgaaaacatacata

SEQ ID NO: 5607 - DNA, 22 bp, Homo sapiens
cagcttattaggtcagcaggct

SEQ ID NO: 5608 - DNA, 22 bp, Homo sapiens
tccctgtctgactacttcacag

SEQ ID NO: 5609 - DNA, 23 bp, Homo sapiens
taagcttttctatgggcaaagtt

SEQ ID NO: 5610 - DNA, 22 bp, Homo sapiens
tagcttgtgcttttgatgtcaa

SEQ ID NO: 5611 - DNA, 22 bp, Homo sapiens
tgctgccagtctccttcagaca

SEQ ID NO: 5612 - DNA, 22 bp, Homo sapiens
tgagaatatgagaactatagtt

SEQ ID NO: 5613 - DNA, 22 bp, Homo sapiens
acatggtttgagtttatgtggt

SEQ ID NO: 5614 - DNA, 22 bp, Homo sapiens
tggaatggtggtaatgacctgg

SEQ ID NO: 5615 - DNA, 20 bp, Homo sapiens
tccttctacaaaaaagccaa

SEQ ID NO: 5616 - DNA, 22 bp, Homo sapiens
tgagggctgctgggtgcagtac

SEQ ID NO: 5617 - DNA, 20 bp, Homo sapiens
ctgaacagcctctggcaatc

SEQ ID NO: 5618 - DNA, 20 bp, Homo sapiens
gtccaacccctttgacagct

SEQ ID NO: 5619 - DNA, 21 bp, Homo sapiens
tccttcataggtggcctggaa

SEQ ID NO: 5620 - DNA, 20 bp, Homo sapiens
gagcgctggagtctaggtgg

SEQ ID NO: 5621 - DNA, 23 bp, Homo sapiens
agctacatctgatcccacccact

SEQ ID NO: 5622 - DNA, 21 bp, Homo sapiens
aggaatggcccatgcagtctg

SEQ ID NO: 5623 - DNA, 22 bp, Homo sapiens
tgtaggtgggaagcataatact

SEQ ID NO: 5624 - DNA, 22 bp, Homo sapiens
aggctatgatcctcagttgtgt

SEQ ID NO: 5625 - DNA, 20 bp, Homo sapiens
ccagtttcagttgtagaaat

SEQ ID NO: 5626 - DNA, 21 bp, Homo sapiens
tctacaactgaaactggcagt

SEQ ID NO: 5627 - DNA, 20 bp, Homo sapiens
tgagatgatcgtgacattct

SEQ ID NO: 5628 - DNA, 23 bp, Homo sapiens
aagctcagcctgacaggagtgag

SEQ ID NO: 5629 - DNA, 22 bp, Homo sapiens
tagcttatctctgcccgtccag

SEQ ID NO: 5630 - DNA, 22 bp, Homo sapiens
aaacataatttgaatgcagacc

SEQ ID NO: 5631 - DNA, 22 bp, Homo sapiens
tagaggtttttccacgttgaca

SEQ ID NO: 5632 - DNA, 22 bp, Homo sapiens
tagcttatcagatcagggggtg

SEQ ID NO: 5633 - DNA, 22 bp, Homo sapiens
ctgactggcactggggcaaaca

SEQ ID NO: 5634 - DNA, 21 bp, Homo sapiens
tttcactgttagcctaagggg

SEQ ID NO: 5635 - DNA, 20 bp, Homo sapiens
ggaatcaaaagggtccttat

SEQ ID NO: 5636 - DNA, 22 bp, Homo sapiens
ctagcaatgtatgggcgttgcg

SEQ ID NO: 5637 - DNA, 20 bp, Homo sapiens
tttcacgtgttacatggagg

SEQ ID NO: 5638 - DNA, 21 bp, Homo sapiens
cctctgggccctcttcttgac

SEQ ID NO: 5639 - DNA, 20 bp, Homo sapiens
aaagcatcatccaatgtatc

SEQ ID NO: 5640 - DNA, 23 bp, Homo sapiens
tcagctgccctgatgacttgtca

SEQ ID NO: 5641 - DNA, 23 bp, Homo sapiens
taatccgcaaagttgatgccagt

SEQ ID NO: 5642 - DNA, 23 bp, Homo sapiens
agcagcagtgtgtgaggctatga

SEQ ID NO: 5643 - DNA, 23 bp, Homo sapiens
atatatatgtaaaactaatatat

SEQ ID NO: 5644 - DNA, 23 bp, Homo sapiens
gtccagttttaacaggaattttc

SEQ ID NO: 5645 - DNA, 22 bp, Homo sapiens
tcaagtctcaaggccaggttga

SEQ ID NO: 5646 - DNA, 21 bp, Homo sapiens
cgcgggctcgcacgaaagatc

SEQ ID NO: 5647 - DNA, 22 bp, Homo sapiens
atacacgttccaggagcccttt

SEQ ID NO: 5648 - DNA, 22 bp, Homo sapiens
aataatcacgggattgtgatga

SEQ ID NO: 5649 - DNA, 21 bp, Homo sapiens
ttaatggctgagtaatattgc

SEQ ID NO: 5650 - DNA, 22 bp, Homo sapiens
tagtctccgataaaatcgcaga

SEQ ID NO: 5651 - DNA, 24 bp, Homo sapiens
cggggtcgggcacctgccacactc

SEQ ID NO: 5652 - DNA, 21 bp, Homo sapiens
gccacctgtggtgggtggggg

SEQ ID NO: 5653 - DNA, 20 bp, Homo sapiens
tccctgagaccctacaggcc

SEQ ID NO: 5654 - DNA, 22 bp, Homo sapiens
ttcagataatccaggatgggca

SEQ ID NO: 5655 - DNA, 20 bp, Homo sapiens
gcaaattgttggactgttga

SEQ ID NO: 5656 - DNA, 24 bp, Homo sapiens
accctggtaacttgataatggcca

SEQ ID NO: 5657 - DNA, 23 bp, Homo sapiens
gaatctgaggcagcagggcactg

SEQ ID NO: 5658 - DNA, 23 bp, Homo sapiens
tgtcagtttctattttaaaagtt

SEQ ID NO: 5659 - DNA, 21 bp, Homo sapiens
agttcgcttttctttgtgatc

SEQ ID NO: 5660 - DNA, 21 bp, Homo sapiens
tgccgcatgatttcacgtata

SEQ ID NO: 5661 - DNA, 22 bp, Homo sapiens
tcctttgcaaagatgcacagtg

SEQ ID NO: 5662 - DNA, 23 bp, Homo sapiens
atcgcccgacgcacagcacagaa

SEQ ID NO: 5663 - DNA, 23 bp, Homo sapiens
tagcttactgatgtgatgaattg

SEQ ID NO: 5664 - DNA, 21 bp, Homo sapiens
cagcagcacactgtggactgc

SEQ ID NO: 5665 - DNA, 20 bp, Homo sapiens
ggtgagaatcgccacctggg

SEQ ID NO: 5666 - DNA, 22 bp, Homo sapiens
gtccagccctcccaggaggaca

SEQ ID NO: 5667 - DNA, 20 bp, Homo sapiens
cgtcagtaatccaggcgtgg

SEQ ID NO: 5668 - DNA, 20 bp, Homo sapiens
tggagcaggggagcacactc

SEQ ID NO: 5669 - DNA, 21 bp, Homo sapiens
caggcggcaggggtacaggcg

SEQ ID NO: 5670 - DNA, 20 bp, Homo sapiens
ccgggccgaggaggtggtag

SEQ ID NO: 5671 - DNA, 20 bp, Homo sapiens
gtcccggagcgaggagacca

SEQ ID NO: 5672 - DNA, 20 bp, Homo sapiens
cccccggtgtgggaaccagc

SEQ ID NO: 5673 - DNA, 20 bp, Homo sapiens
gccgcctgtggtcatgcgca

SEQ ID NO: 5674 - DNA, 22 bp, Homo sapiens
tggtccatcctaatccctgccg

SEQ ID NO: 5675 - DNA, 20 bp, Homo sapiens
tcccggggccgagcctcgct

SEQ ID NO: 5676 - DNA, 23 bp, Homo sapiens
ttccttgctgctgacacaggtac

SEQ ID NO: 5677 - DNA, 20 bp, Homo sapiens
ccgtcctcccccctcccccg

SEQ ID NO: 5678 - DNA, 20 bp, Homo sapiens
cccttctgagccacatgtgc

SEQ ID NO: 5679 - DNA, 20 bp, Homo sapiens
aggggtcatggaggtggcgg

SEQ ID NO: 5680 - DNA, 20 bp, Homo sapiens
cgtgttattggcaggaacat

SEQ ID NO: 5681 - DNA, 20 bp, Homo sapiens
tccccggctggaggtgggag

SEQ ID NO: 5682 - DNA, 20 bp, Homo sapiens
gccccgacggggagccaaga

SEQ ID NO: 5683 - DNA, 23 bp, Homo sapiens
gccgcgggtgtctccctcccagg

SEQ ID NO: 5684 - DNA, 22 bp, Homo sapiens
agctacaggactcagcagacaa

SEQ ID NO: 5685 - DNA, 24 bp, Homo sapiens
gtgtgtagctgcactgtgtgtgcg

SEQ ID NO: 5686 - DNA, 23 bp, Homo sapiens
ggggcctcagctcagctggagcc

SEQ ID NO: 5687 - DNA, 21 bp, Homo sapiens
ttcacagtggcttccaaggcc

SEQ ID NO: 5688 - DNA, 23 bp, Homo sapiens
agcagacgcaccacttcgatggc

SEQ ID NO: 5689 - DNA, 20 bp, Homo sapiens
gtgtgcagccccagtggtcc

SEQ ID NO: 5690 - DNA, 21 bp, Homo sapiens
ctgtacctcctttgaggtgca

SEQ ID NO: 5691 - DNA, 22 bp, Homo sapiens
ttagtcattaggttttatggga

SEQ ID NO: 5692 - DNA, 20 bp, Homo sapiens
accgttattcccacaaatag

SEQ ID NO: 5693 - DNA, 22 bp, Homo sapiens
ttgagatagtagttgcgtttga

SEQ ID NO: 5694 - DNA, 23 bp, Homo sapiens
caggctgataacccccaagttag

SEQ ID NO: 5695 - DNA, 24 bp, Homo sapiens
tttcctcctcccctctttccacag

SEQ ID NO: 5696 - DNA, 22 bp, Homo sapiens
actccatcatccaacagattat

SEQ ID NO: 5697 - DNA, 20 bp, Homo sapiens
cgcgccgtcgggcccggctc

SEQ ID NO: 5698 - DNA, 20 bp, Homo sapiens
agaggtagtaggttgaaagt

SEQ ID NO: 5699 - DNA, 20 bp, Homo sapiens
tcccaggtttcggcaccaga

SEQ ID NO: 5700 - DNA, 20 bp, Homo sapiens
ccactaagagtatgcagatt

SEQ ID NO: 5701 - DNA, 22 bp, Homo sapiens
tgacagtaatccaggccaggcg

SEQ ID NO: 5702 - DNA, 21 bp, Homo sapiens
ttgcaatgagcattattaccc

SEQ ID NO: 5703 - DNA, 20 bp, Homo sapiens
cctggtcctcgctctttcag

SEQ ID NO: 5704 - DNA, 23 bp, Homo sapiens
gaggtcatttcttgaagggaaga

SEQ ID NO: 5705 - DNA, 23 bp, Homo sapiens
agatctgattcagcaggaatgac

SEQ ID NO: 5706 - DNA, 22 bp, Homo sapiens
gcattgcaccagactgtttcct

SEQ ID NO: 5707 - DNA, 20 bp, Homo sapiens
gtgttcttgaatgctatact

SEQ ID NO: 5708 - DNA, 20 bp, Homo sapiens
attacctgatctattgctgc

SEQ ID NO: 5709 - DNA, 20 bp, Homo sapiens
tactcacaggttgctaagtg

SEQ ID NO: 5710 - DNA, 20 bp, Homo sapiens
cccgatatcatcttgatact

SEQ ID NO: 5711 - DNA, 21 bp, Homo sapiens
cagcaccatccaggatcagct

SEQ ID NO: 5712 - DNA, 23 bp, Homo sapiens
acctagaatttgatttacactgc

SEQ ID NO: 5713 - DNA, 22 bp, Homo sapiens
tgactgtgtagtttatggttgg

SEQ ID NO: 5714 - DNA, 20 bp, Homo sapiens
tgtaaccaccaagtcaccag

SEQ ID NO: 5715 - DNA, 22 bp, Homo sapiens
ttgcagtaatccaggctaggga

SEQ ID NO: 5716 - DNA, 21 bp, Homo sapiens
catgcaatgattccctttaca

SEQ ID NO: 5717 - DNA, 22 bp, Homo sapiens
gtccagtgggaccaggaataga

SEQ ID NO: 5718 - DNA, 20 bp, Homo sapiens
ttcttaccatttctaattac

SEQ ID NO: 5719 - DNA, 20 bp, Homo sapiens
cttagtgttgagctgttggg

SEQ ID NO: 5720 - DNA, 21 bp, Homo sapiens
ggcggcgggagaagaaaactc

SEQ ID NO: 5721 - DNA, 22 bp, Homo sapiens
gcttctggggaaacttccctca

SEQ ID NO: 5722 - DNA, 22 bp, Homo sapiens
atcctggctggagcacggtgtc

SEQ ID NO: 5723 - DNA, 21 bp, Homo sapiens
cattccccggcatctcctgct

SEQ ID NO: 5724 - DNA, 20 bp, Homo sapiens
cccctatctgaggggccaag

SEQ ID NO: 5725 - DNA, 23 bp, Homo sapiens
gatggcaggcacagaagtgaggg

SEQ ID NO: 5726 - DNA, 21 bp, Homo sapiens
gtatcgtggagtcctagctgg

SEQ ID NO: 5727 - DNA, 22 bp, Homo sapiens
tgtcagtggactgctatgtttg

SEQ ID NO: 5728 - DNA, 22 bp, Homo sapiens
tctctgaagaactgtaagattg

SEQ ID NO: 5729 - DNA, 20 bp, Homo sapiens
aaggagctcacagtctatga

SEQ ID NO: 5730 - DNA, 20 bp, Homo sapiens
gggcaccatcgccccagctt

SEQ ID NO: 5731 - DNA, 23 bp, Homo sapiens
ttcaagtaatcctctcgcttcag

SEQ ID NO: 5732 - DNA, 21 bp, Homo sapiens
aggaaagatgtcaatatagct

SEQ ID NO: 5733 - DNA, 22 bp, Homo sapiens
tagccaagcaactttagccaat

SEQ ID NO: 5734 - DNA, 20 bp, Homo sapiens
ccaacagggacgcgagccgg

SEQ ID NO: 5735 - DNA, 20 bp, Homo sapiens
cctggcctcatctttcgtga

SEQ ID NO: 5736 - DNA, 22 bp, Homo sapiens
ttgctggctctcagtcttggtc

SEQ ID NO: 5737 - DNA, 23 bp, Homo sapiens
tggctcataagagtgaaaacagt

SEQ ID NO: 5738 - DNA, 22 bp, Homo sapiens
ggaactggggaaactgaattgc

SEQ ID NO: 5739 - DNA, 22 bp, Homo sapiens
cagacacccactgggctgggca

SEQ ID NO: 5740 - DNA, 20 bp, Homo sapiens
ggatagaggtcccaggaatg

SEQ ID NO: 5741 - DNA, 22 bp, Homo sapiens
tagcaggtagcagggctgagcg

SEQ ID NO: 5742 - DNA, 22 bp, Homo sapiens
ctggtatgtggacaggctgaga

SEQ ID NO: 5743 - DNA, 23 bp, Homo sapiens
agcagtattgcacagggatatgt

SEQ ID NO: 5744 - DNA, 21 bp, Homo sapiens
tagcaccatctgacatatata

SEQ ID NO: 5745 - DNA, 22 bp, Homo sapiens
tctaggtagtctgactccaaag

SEQ ID NO: 5746 - DNA, 20 bp, Homo sapiens
gggaccaggctctgcagtgg

SEQ ID NO: 5747 - DNA, 22 bp, Homo sapiens
ttgttcaaatccaggatctacc

SEQ ID NO: 5748 - DNA, 23 bp, Homo sapiens
tcatactgcctggtaatagctag

SEQ ID NO: 5749 - DNA, 23 bp, Homo sapiens
tagcttattgagtcaatggttca

SEQ ID NO: 5750 - DNA, 20 bp, Homo sapiens
tctccaactgcaactcctga

SEQ ID NO: 5751 - DNA, 20 bp, Homo sapiens
taatcagtaattttaatgcg

SEQ ID NO: 5752 - DNA, 20 bp, Homo sapiens
cccagtgtttagcagcatgg

SEQ ID NO: 5753 - DNA, 23 bp, Homo sapiens
aagctcatcatcatgatcccagt

SEQ ID NO: 5754 - DNA, 23 bp, Homo sapiens
tagctttatctcatgagtggtca

SEQ ID NO: 5755 - DNA, 22 bp, Homo sapiens
agcagcattgtacaaggaaagg

SEQ ID NO: 5756 - DNA, 22 bp, Homo sapiens
cctcttggtttccagcaactgt

SEQ ID NO: 5757 - DNA, 21 bp, Homo sapiens
tagcttactgaggactcatct

SEQ ID NO: 5758 - DNA, 23 bp, Homo sapiens
tactctgccactaggcctgggaa

SEQ ID NO: 5759 - DNA, 21 bp, Homo sapiens
cccacgggatagaacctgtct

SEQ ID NO: 5760 - DNA, 20 bp, Homo sapiens
tgactcagttcagcagagga

SEQ ID NO: 5761 - DNA, 24 bp, Homo sapiens
ctcgttagtagtaactcgttagta

SEQ ID NO: 5762 - DNA, 22 bp, Homo sapiens
aaaggcaatggtagactgtcag

SEQ ID NO: 5763 - DNA, 20 bp, Homo sapiens
gcacacatgttttgggcttc

SEQ ID NO: 5764 - DNA, 20 bp, Homo sapiens
tccgagtcacggcaccaagt

SEQ ID NO: 5765 - DNA, 21 bp, Homo sapiens
gtccagttttcccagcatcgt

SEQ ID NO: 5766 - DNA, 23 bp, Homo sapiens
tagctatatctcatctacaacat

SEQ ID NO: 5767 - DNA, 20 bp, Homo sapiens
gggatctatccatgggcagt

SEQ ID NO: 5768 - DNA, 22 bp, Homo sapiens
gcttcagttgggtatgcgtaca

SEQ ID NO: 5769 - DNA, 22 bp, Homo sapiens
tagctgcatctctgtagcagtg

SEQ ID NO: 5770 - DNA, 23 bp, Homo sapiens
tagctgtagtttccatactgttt

SEQ ID NO: 5771 - DNA, 22 bp, Homo sapiens
tagcaccatctctggcatttat

SEQ ID NO: 5772 - DNA, 22 bp, Homo sapiens
tagtgatcatagtaccaaatta

SEQ ID NO: 5773 - DNA, 20 bp, Homo sapiens
caaatctgctatcatagctg

SEQ ID NO: 5774 - DNA, 23 bp, Homo sapiens
tatgatatcaatgtgatgatgac

SEQ ID NO: 5775 - DNA, 22 bp, Homo sapiens
tagcaccatctagtaaatgtta

SEQ ID NO: 5776 - DNA, 22 bp, Homo sapiens
gtcagacacagtttgcaaacat

SEQ ID NO: 5777 - DNA, 22 bp, Homo sapiens
tgagtcatcacttttatgtttc

SEQ ID NO: 5778 - DNA, 23 bp, Homo sapiens
caaggtatctgtagtgcaggaga

SEQ ID NO: 5779 - DNA, 22 bp, Homo sapiens
agactgccattggcctaacttg

SEQ ID NO: 5780 - DNA, 21 bp, Homo sapiens
atacacgacggctttcaactc

SEQ ID NO: 5781 - DNA, 21 bp, Homo sapiens
tgagtagtctgcactagtgaa

SEQ ID NO: 5782 - DNA, 22 bp, Homo sapiens
atacatactacaggtggccttg

SEQ ID NO: 5783 - DNA, 23 bp, Homo sapiens
aaagaatagtctgtgatgaagca

SEQ ID NO: 5784 - DNA, 21 bp, Homo sapiens
atatagatgtggcttcaaatc

SEQ ID NO: 5785 - DNA, 21 bp, Homo sapiens
atagttcacaagctaaggctc

SEQ ID NO: 5786 - DNA, 21 bp, Homo sapiens
ctattgattgatttagtttta

SEQ ID NO: 5787 - DNA, 20 bp, Homo sapiens
agcagggtctactctacttg

SEQ ID NO: 5788 - DNA, 22 bp, Homo sapiens
tccctgagacaagctggctact

SEQ ID NO: 5789 - DNA, 22 bp, Homo sapiens
tagcaggaaaactggctatcag

SEQ ID NO: 5790 - DNA, 22 bp, Homo sapiens
agatgcaatggtggcagtctgg

SEQ ID NO: 5791 - DNA, 22 bp, Homo sapiens
tgtgctgggctcagcgcccctg

SEQ ID NO: 5792 - DNA, 20 bp, Homo sapiens
tggagcaggggagcaaggcc

SEQ ID NO: 5793 - DNA, 20 bp, Homo sapiens
aaaaaacagtagccgctcag

SEQ ID NO: 5794 - DNA, 24 bp, Homo sapiens
agtaaggttgatctgataagggta

SEQ ID NO: 5795 - DNA, 24 bp, Homo sapiens
ccactttgaccgacggggctgcgg

SEQ ID NO: 5796 - DNA, 21 bp, Homo sapiens
atgcaatgtggtaaaggcagc

SEQ ID NO: 5797 - DNA, 23 bp, Homo sapiens
tcagtcaaagtcatcgctaaacc

SEQ ID NO: 5798 - DNA, 22 bp, Homo sapiens
attactacatagatgaccatgt

SEQ ID NO: 5799 - DNA, 22 bp, Homo sapiens
taggaatatgagacagtaatga

SEQ ID NO: 5800 - DNA, 20 bp, Homo sapiens
atactcttatatcacctagt

SEQ ID NO: 5801 - DNA, 22 bp, Homo sapiens
gctactacatgcaattaacagc

SEQ ID NO: 5802 - DNA, 22 bp, Homo sapiens
agtttagtatgttattattgtc

SEQ ID NO: 5803 - DNA, 22 bp, Homo sapiens
aatgatgcctgcactggcatga

SEQ ID NO: 5804 - DNA, 24 bp, Homo sapiens
gggatctgaggagaagtttgcttg

SEQ ID NO: 5805 - DNA, 22 bp, Homo sapiens
cctggacaatccaggataggca

SEQ ID NO: 5806 - DNA, 22 bp, Homo sapiens
tagaggtaactcagttacaaac

SEQ ID NO: 5807 - DNA, 22 bp, Homo sapiens
atgacattggtctttatttcca

SEQ ID NO: 5808 - DNA, 23 bp, Homo sapiens
tgtgcaggcttgcatgaaatcct

SEQ ID NO: 5809 - DNA, 23 bp, Homo sapiens
tgtgcacatacatgcaaacagtg

SEQ ID NO: 5810 - DNA, 23 bp, Homo sapiens
tgctgacttgagcccacccccag

SEQ ID NO: 5811 - DNA, 20 bp, Homo sapiens
aagcaccatttgaatagcga

SEQ ID NO: 5812 - DNA, 22 bp, Homo sapiens
gtcttcattaggtttatgggga

SEQ ID NO: 5813 - DNA, 21 bp, Homo sapiens
ctgacagccaggccagtgatg

SEQ ID NO: 5814 - DNA, 20 bp, Homo sapiens
gactgtacagcatcctgaaa

SEQ ID NO: 5815 - DNA, 22 bp, Homo sapiens
tggactgggtgatttattaggt

SEQ ID NO: 5816 - DNA, 21 bp, Homo sapiens
tcagcgcaatgatgctgcaat

SEQ ID NO: 5817 - DNA, 23 bp, Homo sapiens
cagtgtggatttacacaacagaa

SEQ ID NO: 5818 - DNA, 22 bp, Homo sapiens
cactagattgtgagctcctaga

SEQ ID NO: 5819 - DNA, 20 bp, Homo sapiens
ccccccactgctggcggctg

SEQ ID NO: 5820 - DNA, 20 bp, Homo sapiens
ttctctcggaattgtatcta

SEQ ID NO: 5821 - DNA, 20 bp, Homo sapiens
agcatgctgagagcttacac

SEQ ID NO: 5822 - DNA, 20 bp, Homo sapiens
ggatatagggaaaagcccct

SEQ ID NO: 5823 - DNA, 23 bp, Homo sapiens
gctagataactccagggatgttc

SEQ ID NO: 5824 - DNA, 22 bp, Homo sapiens
atcacattattgaagattagat

SEQ ID NO: 5825 - DNA, 21 bp, Homo sapiens
tttgcagtggctactggaata

SEQ ID NO: 5826 - DNA, 22 bp, Homo sapiens
ccccctctgctttattttgtca

SEQ ID NO: 5827 - DNA, 21 bp, Homo sapiens
gctagtattccagagtgaaaa

SEQ ID NO: 5828 - DNA, 22 bp, Homo sapiens
tgacactgaatcggacctgaga

SEQ ID NO: 5829 - DNA, 23 bp, Homo sapiens
ttctggtttgagaaatacaaaca

SEQ ID NO: 5830 - DNA, 22 bp, Homo sapiens
ctcagtgatgcagctcttgcag

SEQ ID NO: 5831 - DNA, 23 bp, Homo sapiens
cccctgtggactcaggttcaaag

SEQ ID NO: 5832 - DNA, 22 bp, Homo sapiens
atcagcattgttccataggtcc

SEQ ID NO: 5833 - DNA, 21 bp, Homo sapiens
ctaggtggtttccacgttcta

SEQ ID NO: 5834 - DNA, 20 bp, Homo sapiens
atgccatgttggactgccag

SEQ ID NO: 5835 - DNA, 22 bp, Homo sapiens
tgcgtcattaggtctcccttag

SEQ ID NO: 5836 - DNA, 21 bp, Homo sapiens
acacaggtggtgtccatctcc

SEQ ID NO: 5837 - DNA, 22 bp, Homo sapiens
gttggcaaatccagcagctcaa

SEQ ID NO: 5838 - DNA, 20 bp, Homo sapiens
aattttatacgcaggaacag

SEQ ID NO: 5839 - DNA, 21 bp, Homo sapiens
tgaggatacagtggtaactac

SEQ ID NO: 5840 - DNA, 20 bp, Homo sapiens
ggggggtctgctaaatttag

SEQ ID NO: 5841 - DNA, 21 bp, Homo sapiens
tttggctatggttgcagtctg

SEQ ID NO: 5842 - DNA, 21 bp, Homo sapiens
tagcaccagggtcccgtggtg

SEQ ID NO: 5843 - DNA, 24 bp, Homo sapiens
gggccatgatggtggctgagcctg

SEQ ID NO: 5844 - DNA, 22 bp, Homo sapiens
ttggaagaagaggacccgtggt

SEQ ID NO: 5845 - DNA, 22 bp, Homo sapiens
atatgttgctcaggtaatttta

SEQ ID NO: 5846 - DNA, 24 bp, Homo sapiens
tcatgtctcaaaggatgttcagtc

SEQ ID NO: 5847 - DNA, 20 bp, Homo sapiens
gctactacatggactgttat

SEQ ID NO: 5848 - DNA, 21 bp, Homo sapiens
aaaccgtagatctagtgaatg

SEQ ID NO: 5849 - DNA, 21 bp, Homo sapiens
tatgcaatgtctgcctcccag

SEQ ID NO: 5850 - DNA, 24 bp, Homo sapiens
gcagccatcctttaagagggggca

SEQ ID NO: 5851 - DNA, 22 bp, Homo sapiens
acatggcaagaccctgtttatc

SEQ ID NO: 5852 - DNA, 23 bp, Homo sapiens
tagcttatctcttcaatgggtcc

SEQ ID NO: 5853 - DNA, 20 bp, Homo sapiens
aaatgtagaataagtggatc

SEQ ID NO: 5854 - DNA, 21 bp, Homo sapiens
aaatggcagagtaataatgta

SEQ ID NO: 5855 - DNA, 22 bp, Homo sapiens
tctcagtatgtcaaatatcccc

SEQ ID NO: 5856 - DNA, 22 bp, Homo sapiens
cagacgaatgttggggcaaagg

SEQ ID NO: 5857 - DNA, 20 bp, Homo sapiens
agggaaacaaagatcacacc

SEQ ID NO: 5858 - DNA, 20 bp, Homo sapiens
ccttttagtaatactgactg

SEQ ID NO: 5859 - DNA, 20 bp, Homo sapiens
ttatggatatagggaaatca

SEQ ID NO: 5860 - DNA, 22 bp, Homo sapiens
tagcaccactcaggtgattggc

SEQ ID NO: 5861 - DNA, 21 bp, Homo sapiens
cagtcggtagagcattagatc

SEQ ID NO: 5862 - DNA, 23 bp, Homo sapiens
catgctcaaatctgtctccccaa

SEQ ID NO: 5863 - DNA, 21 bp, Homo sapiens
tgccttataatgcagatgaag

SEQ ID NO: 5864 - DNA, 22 bp, Homo sapiens
aggctgagaccctagtccagct

SEQ ID NO: 5865 - DNA, 22 bp, Homo sapiens
cggactgggcctcccgccccca

SEQ ID NO: 5866 - DNA, 21 bp, Homo sapiens
ggactcatttccagggtaggt

SEQ ID NO: 5867 - DNA, 20 bp, Homo sapiens
tggaacagcaactccagtgt

SEQ ID NO: 5868 - DNA, 22 bp, Homo sapiens
gtgacacccactgggcgtggtg

SEQ ID NO: 5869 - DNA, 20 bp, Homo sapiens
caggtcaaaagggtcctgga

SEQ ID NO: 5870 - DNA, 22 bp, Homo sapiens
gacagtggttggtggcttccag

SEQ ID NO: 5871 - DNA, 24 bp, Homo sapiens
ccggactctccgctgggcccacga

SEQ ID NO: 5872 - DNA, 21 bp, Homo sapiens
caaagtgctgcaagtacaggt

SEQ ID NO: 5873 - DNA, 20 bp, Homo sapiens
gccggcggagaggggcggga

SEQ ID NO: 5874 - DNA, 21 bp, Homo sapiens
cggcggcaggcggcagagggg

SEQ ID NO: 5875 - DNA, 22 bp, Homo sapiens
gctggtcggcctgaaagtaact

SEQ ID NO: 5876 - DNA, 24 bp, Homo sapiens
tacggggatgattttacgaactga

SEQ ID NO: 5877 - DNA, 21 bp, Homo sapiens
ttcctatgatgaggacctttt

SEQ ID NO: 5878 - DNA, 20 bp, Homo sapiens
gtgacctatgagttgacgca

SEQ ID NO: 5879 - DNA, 23 bp, Homo sapiens
cttctcatcttgttaagactcag

SEQ ID NO: 5880 - DNA, 24 bp, Homo sapiens
tctgtgaaatattttaaagactat

SEQ ID NO: 5881 - DNA, 20 bp, Homo sapiens
ggaaaggcgatctgaccagt

SEQ ID NO: 5882 - DNA, 22 bp, Homo sapiens
tcgtaggcctccaggatagtct

SEQ ID NO: 5883 - DNA, 24 bp, Homo sapiens
gcggcccgggcgggggccccggcg

SEQ ID NO: 5884 - DNA, 20 bp, Homo sapiens
tcgtaaatacgaagaacaat

SEQ ID NO: 5885 - DNA, 22 bp, Homo sapiens
tgagaccctagctcccctcagg

SEQ ID NO: 5886 - DNA, 24 bp, Homo sapiens
tccccctcacccctctcgcccagg

SEQ ID NO: 5887 - DNA, 23 bp, Homo sapiens
tgctgatcctctcccaccccaga

SEQ ID NO: 5888 - DNA, 22 bp, Homo sapiens
tctcccatcccccataccagtg

SEQ ID NO: 5889 - DNA, 22 bp, Homo sapiens
ccccggggagcggccgcccggt

SEQ ID NO: 5890 - DNA, 23 bp, Homo sapiens
aggccactcctcatgcccccagt

SEQ ID NO: 5891 - DNA, 22 bp, Homo sapiens
tcgaggagctcacagtctactg

SEQ ID NO: 5892 - DNA, 22 bp, Homo sapiens
agcatccctgctgccccctaga

SEQ ID NO: 5893 - DNA, 20 bp, Homo sapiens
gccggcgggagggggtggga

SEQ ID NO: 5894 - DNA, 23 bp, Homo sapiens
aggagcattgatgtcttagaagc

SEQ ID NO: 5895 - DNA, 21 bp, Homo sapiens
gtcatgggctcaaacacccac

SEQ ID NO: 5896 - DNA, 23 bp, Homo sapiens
taggaaatgtctggtcgtccagt

SEQ ID NO: 5897 - DNA, 20 bp, Homo sapiens
cccggcggcgacccgcgccc

SEQ ID NO: 5898 - DNA, 22 bp, Homo sapiens
ttcttcaggcttgaatacttta

SEQ ID NO: 5899 - DNA, 20 bp, Homo sapiens
cgcccacccccggcccaggc

SEQ ID NO: 5900 - DNA, 20 bp, Homo sapiens
tgcgccccgggcgggtcctc

SEQ ID NO: 5901 - DNA, 22 bp, Homo sapiens
tctccactgcctttgcaactgg

SEQ ID NO: 5902 - DNA, 22 bp, Homo sapiens
tcgcgttacgaggcagccgtgc

SEQ ID NO: 5903 - DNA, 22 bp, Homo sapiens
tctactacatgaggcatgttaa

SEQ ID NO: 5904 - DNA, 21 bp, Homo sapiens
aggggctcccgcttctggatc

SEQ ID NO: 5905 - DNA, 22 bp, Homo sapiens
ccccgaaagacccggctttacg

SEQ ID NO: 5906 - DNA, 24 bp, Homo sapiens
tttacatgctagactggtgtttct

SEQ ID NO: 5907 - DNA, 20 bp, Homo sapiens
gcgggtggatcactcggatc

SEQ ID NO: 5908 - DNA, 20 bp, Homo sapiens
tcgtaccgtgagtacagtga

SEQ ID NO: 5909 - DNA, 20 bp, Homo sapiens
ggtcctgagagatgaatagg

SEQ ID NO: 5910 - DNA, 23 bp, Homo sapiens
gcttagtgactctctgccttgct

SEQ ID NO: 5911 - DNA, 23 bp, Homo sapiens
accgatagggtttggctgtgtcc

SEQ ID NO: 5912 - DNA, 20 bp, Homo sapiens
atcccactcctctgtgtgtg

SEQ ID NO: 5913 - DNA, 22 bp, Homo sapiens
tgtctcaaacaaaagcgaaaac

SEQ ID NO: 5914 - DNA, 21 bp, Homo sapiens
cggttccggcggcgtccccca

SEQ ID NO: 5915 - DNA, 21 bp, Homo sapiens
gcgccgtcgggcccggcactc

SEQ ID NO: 5916 - DNA, 21 bp, Homo sapiens
ctgacagcgtccttgactagc

SEQ ID NO: 5917 - DNA, 23 bp, Homo sapiens
atccaggttggtcaatcagtgtt

SEQ ID NO: 5918 - DNA, 21 bp, Homo sapiens
ggcggctgcgcccgttgggtg

SEQ ID NO: 5919 - DNA, 21 bp, Homo sapiens
gatgcatcagaggctcagcag

SEQ ID NO: 5920 - DNA, 20 bp, Homo sapiens
cccagccctgctccttgtgg

SEQ ID NO: 5921 - DNA, 20 bp, Homo sapiens
gagggggcatctccaccagg

SEQ ID NO: 5922 - DNA, 22 bp, Homo sapiens
agtgagccactggtatggatgg

SEQ ID NO: 5923 - DNA, 22 bp, Homo sapiens
agcaggaggatatgcgtacagc

SEQ ID NO: 5924 - DNA, 22 bp, Homo sapiens
agctacatcagaaggcggtgcg

SEQ ID NO: 5925 - DNA, 22 bp, Homo sapiens
tagcagatgccgtagaggtgga

SEQ ID NO: 5926 - DNA, 22 bp, Homo sapiens
agatcgtaccactgcagcagct

SEQ ID NO: 5927 - DNA, 21 bp, Homo sapiens
ctgccatcaccgctgccacca

SEQ ID NO: 5928 - DNA, 20 bp, Homo sapiens
aacgagaactttgaagtcgg

SEQ ID NO: 5929 - DNA, 20 bp, Homo sapiens
aggtacgattccggagaatc

SEQ ID NO: 5930 - DNA, 22 bp, Homo sapiens
atcacatcattctgtgcccttg

SEQ ID NO: 5931 - DNA, 21 bp, Homo sapiens
agaggtgtagagtaagtgatc

SEQ ID NO: 5932 - DNA, 20 bp, Homo sapiens
gccagccctgctccttacag

SEQ ID NO: 5933 - DNA, 23 bp, Homo sapiens
ggcatttatccatgcaatcagtg

SEQ ID NO: 5934 - DNA, 23 bp, Homo sapiens
tgtagacccagaggtttaacagt

SEQ ID NO: 5935 - DNA, 24 bp, Homo sapiens
aggacccagccttcaaaattcctg

SEQ ID NO: 5936 - DNA, 22 bp, Homo sapiens
tgcctgtaatctgaatactttg

SEQ ID NO: 5937 - DNA, 24 bp, Homo sapiens
ctggctgtgcattccggagaggct

SEQ ID NO: 5938 - DNA, 22 bp, Homo sapiens
aagtgataatccaggatcctta

SEQ ID NO: 5939 - DNA, 23 bp, Homo sapiens
ttcaagtaatcctcctgctttag

SEQ ID NO: 5940 - DNA, 23 bp, Homo sapiens
acagttgttgctgggcgtggtgg

SEQ ID NO: 5941 - DNA, 20 bp, Homo sapiens
cctgtaccgtggctcctttc

SEQ ID NO: 5942 - DNA, 21 bp, Homo sapiens
ttatggtttattcaatcagtt

SEQ ID NO: 5943 - DNA, 22 bp, Homo sapiens
atcatgccgccagggagttctt

SEQ ID NO: 5944 - DNA, 21 bp, Homo sapiens
gtgagctgggttagacccaac

SEQ ID NO: 5945 - DNA, 23 bp, Homo sapiens
ttccagtgggaaactgaatcaag

SEQ ID NO: 5946 - DNA, 23 bp, Homo sapiens
agcgccgagcaatctgggggtgc

SEQ ID NO: 5947 - DNA, 22 bp, Homo sapiens
ctaaatccccctattttaaccc

SEQ ID NO: 5948 - DNA, 21 bp, Homo sapiens
ccgccgcgccggggaggggga

SEQ ID NO: 5949 - DNA, 24 bp, Homo sapiens
cgcgcgcgcccgctcccccgcccc

SEQ ID NO: 5950 - DNA, 20 bp, Homo sapiens
acccgcataatatcatctgc

SEQ ID NO: 5951 - DNA, 23 bp, Homo sapiens
cagaaaatgagagttagagcttt

SEQ ID NO: 5952 - DNA, 21 bp, Homo sapiens
ctcttgctgcttgtgctagtt

SEQ ID NO: 5953 - DNA, 21 bp, Homo sapiens
gatcgtgctcatagcacatca

SEQ ID NO: 5954 - DNA, 22 bp, Homo sapiens
gtgactgggtcaaattccccca

SEQ ID NO: 5955 - DNA, 22 bp, Homo sapiens
cagcttatcagactggagtaga

SEQ ID NO: 5956 - DNA, 22 bp, Homo sapiens
tcagtctctgtctttatgggtg

SEQ ID NO: 5957 - DNA, 21 bp, Homo sapiens
ttgtaatcagtggcaagcttt

SEQ ID NO: 5958 - DNA, 21 bp, Homo sapiens
tcacctatgaattgacaccaa

SEQ ID NO: 5959 - DNA, 21 bp, Homo sapiens
tgccctcatggaggtggtata

SEQ ID NO: 5960 - DNA, 22 bp, Homo sapiens
gtaatgcgtaagaaagccctgt

SEQ ID NO: 5961 - DNA, 22 bp, Homo sapiens
aaggctatatcattagcatcaa

SEQ ID NO: 5962 - DNA, 22 bp, Homo sapiens
agagtacccactggggcaatgc

SEQ ID NO: 5963 - DNA, 22 bp, Homo sapiens
tctgagtaatctgagaacttag

SEQ ID NO: 5964 - DNA, 22 bp, Homo sapiens
ggctccggcgggtgcgctgctg

SEQ ID NO: 5965 - DNA, 24 bp, Homo sapiens
cttctcagctcagcaggacactgg

SEQ ID NO: 5966 - DNA, 22 bp, Homo sapiens
ttttcctctgggattcttgtga

SEQ ID NO: 5967 - DNA, 22 bp, Homo sapiens
tgagtgctgccagggatgaggc

SEQ ID NO: 5968 - DNA, 23 bp, Homo sapiens
tagcttgctgctttgatgttgaa

SEQ ID NO: 5969 - DNA, 22 bp, Homo sapiens
tgtcagtaagtcaaatattttg

SEQ ID NO: 5970 - DNA, 20 bp, Homo sapiens
gtcaggatgaccgagcagtc

SEQ ID NO: 5971 - DNA, 21 bp, Homo sapiens
cccgctccccggcgcccgcgc

SEQ ID NO: 5972 - DNA, 22 bp, Homo sapiens
atctgtagtagattgatgtttt

SEQ ID NO: 5973 - DNA, 22 bp, Homo sapiens
ttcttggtaaacttgctgccac

SEQ ID NO: 5974 - DNA, 21 bp, Homo sapiens
ggtacacctgctatgacatta

SEQ ID NO: 5975 - DNA, 20 bp, Homo sapiens
atgtcatagcaggtgtaccc

SEQ ID NO: 5976 - DNA, 20 bp, Homo sapiens
cgccttggcctatgataaat

SEQ ID NO: 5977 - DNA, 23 bp, Homo sapiens
ctgtatagctttagtattttaag

SEQ ID NO: 5978 - DNA, 20 bp, Homo sapiens
gtaaatggttgtcctattta

SEQ ID NO: 5979 - DNA, 20 bp, Homo sapiens
aggcaagaaggtgcccagta

SEQ ID NO: 5980 - DNA, 20 bp, Homo sapiens
gtccttagccagcaggctgg

SEQ ID NO: 5981 - DNA, 22 bp, Homo sapiens
tatacaacctcagtaagccaat

SEQ ID NO: 5982 - DNA, 22 bp, Homo sapiens
tccctgagacaaatacttgtgt

SEQ ID NO: 5983 - DNA, 22 bp, Homo sapiens
gaatcagatgcctatgaaatga

SEQ ID NO: 5984 - DNA, 20 bp, Homo sapiens
gtccagttttcccagtaaaa

SEQ ID NO: 5985 - DNA, 22 bp, Homo sapiens
aagtgcaatggtaattcagtgg

SEQ ID NO: 5986 - DNA, 23 bp, Homo sapiens
agcagcaggtgccagcgctatgc

SEQ ID NO: 5987 - DNA, 20 bp, Homo sapiens
aatcccgactgtttgggagg

SEQ ID NO: 5988 - DNA, 21 bp, Homo sapiens
gtctctttgtcaaaataaaat

SEQ ID NO: 5989 - DNA, 20 bp, Homo sapiens
tcacagagctatcacctagt

SEQ ID NO: 5990 - DNA, 20 bp, Homo sapiens
cgcagttttacttaggccct

SEQ ID NO: 5991 - DNA, 23 bp, Homo sapiens
tagtccgtcagagactacagctg

SEQ ID NO: 5992 - DNA, 23 bp, Homo sapiens
cactctgttcagaagcacttccc

SEQ ID NO: 5993 - DNA, 20 bp, Homo sapiens
gaaaattacaagaagttgcc

SEQ ID NO: 5994 - DNA, 22 bp, Homo sapiens
tccagtctgtaagccaggtgtt

SEQ ID NO: 5995 - DNA, 20 bp, Homo sapiens
taggaatattctgtagcaaa

SEQ ID NO: 5996 - DNA, 22 bp, Homo sapiens
tgtcagtgtgctgcaatttaac

SEQ ID NO: 5997 - DNA, 21 bp, Homo sapiens
atgttatgatgatgggcgaaa

SEQ ID NO: 5998 - DNA, 22 bp, Homo sapiens
agagggttgggacagcaactca

SEQ ID NO: 5999 - DNA, 22 bp, Homo sapiens
acgacatcatcaaaaatgtcac

SEQ ID NO: 6000 - DNA, 22 bp, Homo sapiens
agctgtgggtgtgggcgtgggt

SEQ ID NO: 6001 - DNA, 22 bp, Homo sapiens
ttgggacatctaggctactcac

SEQ ID NO: 6002 - DNA, 20 bp, Homo sapiens
ttgtcgtatagaataacata

SEQ ID NO: 6003 - DNA, 22 bp, Homo sapiens
tccagataattcaggatagcaa

SEQ ID NO: 6004 - DNA, 23 bp, Homo sapiens
tccctgtcctccaggagatcaca

SEQ ID NO: 6005 - DNA, 22 bp, Homo sapiens
attgatatgccagtctaattac

SEQ ID NO: 6006 - DNA, 23 bp, Homo sapiens
gcccagttttctgtccttagggg

SEQ ID NO: 6007 - DNA, 21 bp, Homo sapiens
tgctgtgacgatggtgatggt

SEQ ID NO: 6008 - DNA, 22 bp, Homo sapiens
tggagacttctgcagaaggtga

SEQ ID NO: 6009 - DNA, 22 bp, Homo sapiens
ggatcagatgggatcaggtgta

SEQ ID NO: 6010 - DNA, 21 bp, Homo sapiens
ctcacagggctaaaattaagt

SEQ ID NO: 6011 - DNA, 21 bp, Homo sapiens
agatggatttatgtgtgtgtg

SEQ ID NO: 6012 - DNA, 20 bp, Homo sapiens
gatgatgccatatgatccat

SEQ ID NO: 6013 - DNA, 23 bp, Homo sapiens
cagcagggcagccagggaaatgc

SEQ ID NO: 6014 - DNA, 20 bp, Homo sapiens
tatctatgatgatggatttt

SEQ ID NO: 6015 - DNA, 23 bp, Homo sapiens
ctcttcagctccgtctcccttgc

SEQ ID NO: 6016 - DNA, 21 bp, Homo sapiens
atgacctatgaatagacccac

SEQ ID NO: 6017 - DNA, 23 bp, Homo sapiens
gctactaagtgaccaatggggtg

SEQ ID NO: 6018 - DNA, 22 bp, Homo sapiens
tgtctcaaacagtgaataaaac

SEQ ID NO: 6019 - DNA, 22 bp, Homo sapiens
ttcctgatcaaagccatgtgtc

SEQ ID NO: 6020 - DNA, 23 bp, Homo sapiens
ccatctgaagactacttctgtca

SEQ ID NO: 6021 - DNA, 22 bp, Homo sapiens
tcttcaatgtagtaataatgcc

SEQ ID NO: 6022 - DNA, 22 bp, Homo sapiens
ttcaagtattcccagatagcga

SEQ ID NO: 6023 - DNA, 22 bp, Homo sapiens
atcatgcccaactgctaaaggt

SEQ ID NO: 6024 - DNA, 22 bp, Homo sapiens
cagccattttagcattaccagg

SEQ ID NO: 6025 - DNA, 22 bp, Homo sapiens
cttatctgaggggggagttttt

SEQ ID NO: 6026 - DNA, 22 bp, Homo sapiens
agccatgcgttcgtacactcaa

SEQ ID NO: 6027 - DNA, 20 bp, Homo sapiens
gggctcagttcagcagacaa

SEQ ID NO: 6028 - DNA, 22 bp, Homo sapiens
tagcttatcattgcaaccatgt

SEQ ID NO: 6029 - DNA, 24 bp, Homo sapiens
aattattactccctttatttttta

SEQ ID NO: 6030 - DNA, 23 bp, Homo sapiens
atcatgaattcagggatttccaa

SEQ ID NO: 6031 - DNA, 20 bp, Homo sapiens
taggaatatgagtgtcactt

SEQ ID NO: 6032 - DNA, 22 bp, Homo sapiens
tgagagattagtgagatagatg

SEQ ID NO: 6033 - DNA, 22 bp, Homo sapiens
ggaccacatcatctctggcttt

SEQ ID NO: 6034 - DNA, 21 bp, Homo sapiens
atcatggagcttttcttgtat

SEQ ID NO: 6035 - DNA, 21 bp, Homo sapiens
gggcagagcagcaatatagcc

SEQ ID NO: 6036 - DNA, 21 bp, Homo sapiens
catcaacttagcaagctcgcc

SEQ ID NO: 6037 - DNA, 22 bp, Homo sapiens
tgtctcaaactcattatgcctc

SEQ ID NO: 6038 - DNA, 20 bp, Homo sapiens
gcccgcatcctccacctggc

SEQ ID NO: 6039 - DNA, 23 bp, Homo sapiens
taggttgtaaacttgctgagcac

SEQ ID NO: 6040 - DNA, 21 bp, Homo sapiens
gcctttaaattataggatctt

SEQ ID NO: 6041 - DNA, 20 bp, Homo sapiens
cactcgccaggaagtacatc

SEQ ID NO: 6042 - DNA, 20 bp, Homo sapiens
tccccgggtggaggtgggaa

SEQ ID NO: 6043 - DNA, 23 bp, Homo sapiens
taatccattgagtttatgtttgt

SEQ ID NO: 6044 - DNA, 21 bp, Homo sapiens
aaaccaaatgataatgactca

SEQ ID NO: 6045 - DNA, 22 bp, Homo sapiens
ttctcagagtttccacttctga

SEQ ID NO: 6046 - DNA, 21 bp, Homo sapiens
tttggcaatggtaaagaccca

SEQ ID NO: 6047 - DNA, 20 bp, Homo sapiens
cttcctacttctcttatgag

SEQ ID NO: 6048 - DNA, 21 bp, Homo sapiens
tagcagcacataatgtggtga

SEQ ID NO: 6049 - DNA, 20 bp, Homo sapiens
atcatcggctattgttccag

SEQ ID NO: 6050 - DNA, 21 bp, Homo sapiens
cgatccaatgcatctccacca

SEQ ID NO: 6051 - DNA, 23 bp, Homo sapiens
agccttgattctacagcaggtct

SEQ ID NO: 6052 - DNA, 20 bp, Homo sapiens
ggtagcgtggccagatgact

SEQ ID NO: 6053 - DNA, 22 bp, Homo sapiens
acaggctgagtatcattgcaac

SEQ ID NO: 6054 - DNA, 20 bp, Homo sapiens
tgaggtagtagtttgaatgg

SEQ ID NO: 6055 - DNA, 21 bp, Homo sapiens
actgcaagaaggggcctggca

SEQ ID NO: 6056 - DNA, 20 bp, Homo sapiens
atccctgcggcggagaaccc

SEQ ID NO: 6057 - DNA, 20 bp, Homo sapiens
atggtagtgcacaccttgca

SEQ ID NO: 6058 - DNA, 24 bp, Homo sapiens
taagtgatccttaaagggtttttc

SEQ ID NO: 6059 - DNA, 23 bp, Homo sapiens
cagaggcggtgaccatacaaagt

SEQ ID NO: 6060 - DNA, 22 bp, Homo sapiens
gcttacagctgagtcagccatc

SEQ ID NO: 6061 - DNA, 20 bp, Homo sapiens
aaaggaattgacggaacctc

SEQ ID NO: 6062 - DNA, 20 bp, Homo sapiens
ctcccggcatctccattggg

SEQ ID NO: 6063 - DNA, 22 bp, Homo sapiens
gaataatagcataataataaat

SEQ ID NO: 6064 - DNA, 20 bp, Homo sapiens
ggcagggcggactgtccatc

SEQ ID NO: 6065 - DNA, 23 bp, Homo sapiens
ttcacagtggagcctggatgtgc

SEQ ID NO: 6066 - DNA, 21 bp, Homo sapiens
agctactagactagcaccacc

SEQ ID NO: 6067 - DNA, 20 bp, Homo sapiens
accctttgcccaccccaggc

SEQ ID NO: 6068 - DNA, 23 bp, Homo sapiens
agttatgctgcttagtgaacaat

SEQ ID NO: 6069 - DNA, 20 bp, Homo sapiens
ttacaacaggatcccgaggc

SEQ ID NO: 6070 - DNA, 20 bp, Homo sapiens
tactgtgtgatttagcgttg

SEQ ID NO: 6071 - DNA, 21 bp, Homo sapiens
caggtctccagaacaggtacc

SEQ ID NO: 6072 - DNA, 21 bp, Homo sapiens
gcgtgagcttttggctcaatg

SEQ ID NO: 6073 - DNA, 20 bp, Homo sapiens
aagacttttctctcagttgc

SEQ ID NO: 6074 - DNA, 23 bp, Homo sapiens
agcagcaggatacagctagcgtg

SEQ ID NO: 6075 - DNA, 22 bp, Homo sapiens
tccagtctcaaagccaggccac

SEQ ID NO: 6076 - DNA, 23 bp, Homo sapiens
ttgctcagttcagctcagcactc

SEQ ID NO: 6077 - DNA, 21 bp, Homo sapiens
gcctctacaaagctttagagt

SEQ ID NO: 6078 - DNA, 21 bp, Homo sapiens
aaacgtaagcatctgcagatc

SEQ ID NO: 6079 - DNA, 22 bp, Homo sapiens
acctgctgagtaccaggtgtta

SEQ ID NO: 6080 - DNA, 22 bp, Homo sapiens
gcaaagcacatcatggtttaca

SEQ ID NO: 6081 - DNA, 23 bp, Homo sapiens
aagaatgcctaggtccaggtgtg

SEQ ID NO: 6082 - DNA, 20 bp, Homo sapiens
cgggaacgccgtacacgcca

SEQ ID NO: 6083 - DNA, 22 bp, Homo sapiens
cagtctggtagtgataccccct

SEQ ID NO: 6084 - DNA, 22 bp, Homo sapiens
ctccagaaaaggacttccaaag

SEQ ID NO: 6085 - DNA, 22 bp, Homo sapiens
ggagcccacccttgtaccagtg

SEQ ID NO: 6086 - DNA, 20 bp, Homo sapiens
agcctggtccacatggggaa

SEQ ID NO: 6087 - DNA, 22 bp, Homo sapiens
tgaagtatcaaagcacagttga

SEQ ID NO: 6088 - DNA, 24 bp, Homo sapiens
ttcacattgccagagattacacag

SEQ ID NO: 6089 - DNA, 20 bp, Homo sapiens
ggaataatagaataggaatg

SEQ ID NO: 6090 - DNA, 23 bp, Homo sapiens
gctgtgtgtggggtattgtgttg

SEQ ID NO: 6091 - DNA, 23 bp, Homo sapiens
atgcagccactcaactacaaaat

SEQ ID NO: 6092 - DNA, 21 bp, Homo sapiens
cataccgtgctgcctaatggg

SEQ ID NO: 6093 - DNA, 20 bp, Homo sapiens
ctgacagcacttaatcacta

SEQ ID NO: 6094 - DNA, 22 bp, Homo sapiens
attcctttttctcttcctcaga

SEQ ID NO: 6095 - DNA, 21 bp, Homo sapiens
gatatcaagagactaaatttg

SEQ ID NO: 6096 - DNA, 22 bp, Homo sapiens
accctcatctaggctgtggtgc

SEQ ID NO: 6097 - DNA, 23 bp, Homo sapiens
tgacatggcacataggaaatgcc

SEQ ID NO: 6098 - DNA, 21 bp, Homo sapiens
cattgttctaggtcctgtttg

SEQ ID NO: 6099 - DNA, 20 bp, Homo sapiens
tctgctagatgagatctaaa

SEQ ID NO: 6100 - DNA, 22 bp, Homo sapiens
gcacagccattgacttaatcca

SEQ ID NO: 6101 - DNA, 20 bp, Homo sapiens
agcattgttctgggaatgct

SEQ ID NO: 6102 - DNA, 22 bp, Homo sapiens
cggcaatgtctgcagccacgtt

SEQ ID NO: 6103 - DNA, 22 bp, Homo sapiens
cctgggtaatccaggaatccct

SEQ ID NO: 6104 - DNA, 21 bp, Homo sapiens
tcagtagactggggtcttgct

SEQ ID NO: 6105 - DNA, 23 bp, Homo sapiens
gtccagcaagcccaggggctttc

SEQ ID NO: 6106 - DNA, 22 bp, Homo sapiens
cctatgtgctcaggtagccaat

SEQ ID NO: 6107 - DNA, 20 bp, Homo sapiens
actacctatttttagggttt

SEQ ID NO: 6108 - DNA, 22 bp, Homo sapiens
tgagtcatactcaggcgtccta

SEQ ID NO: 6109 - DNA, 20 bp, Homo sapiens
gcatttgtggttcagtttca

SEQ ID NO: 6110 - DNA, 23 bp, Homo sapiens
tagatggctcagactatgacaag

SEQ ID NO: 6111 - DNA, 22 bp, Homo sapiens
atgcatataatgcactactaat

SEQ ID NO: 6112 - DNA, 20 bp, Homo sapiens
gagtattgccatatcaatag

SEQ ID NO: 6113 - DNA, 20 bp, Homo sapiens
aggagtctatgtgcacatct

SEQ ID NO: 6114 - DNA, 22 bp, Homo sapiens
tgcatcattcttgagatagctc

SEQ ID NO: 6115 - DNA, 23 bp, Homo sapiens
aacccttaagcttagcatgtgtc

SEQ ID NO: 6116 - DNA, 20 bp, Homo sapiens
gtccagttttcccaggatct

SEQ ID NO: 6117 - DNA, 22 bp, Homo sapiens
accaataatggtaatctttccc

SEQ ID NO: 6118 - DNA, 22 bp, Homo sapiens
ggggccttagctcagctgagat

SEQ ID NO: 6119 - DNA, 24 bp, Homo sapiens
gggtttatgctggacgttggtaga

SEQ ID NO: 6120 - DNA, 21 bp, Homo sapiens
aaaaacatgactactatatat

SEQ ID NO: 6121 - DNA, 23 bp, Homo sapiens
ggagggggcgggctccggcggga

SEQ ID NO: 6122 - DNA, 23 bp, Homo sapiens
tgagcaaatccacatggccagtt

SEQ ID NO: 6123 - DNA, 20 bp, Homo sapiens
tagcttatcaaggtgcccca

SEQ ID NO: 6124 - DNA, 20 bp, Homo sapiens
tccccatgaacgaggatgag

SEQ ID NO: 6125 - DNA, 23 bp, Homo sapiens
tagcagcacagaaatgccagtgg

SEQ ID NO: 6126 - DNA, 23 bp, Homo sapiens
cttccttgaatttgatttacaag

SEQ ID NO: 6127 - DNA, 23 bp, Homo sapiens
tgttctgattctatgaaggtgac

SEQ ID NO: 6128 - DNA, 24 bp, Homo sapiens
ctcagagccagccacctagtgagc

SEQ ID NO: 6129 - DNA, 22 bp, Homo sapiens
accagcaacaacgtactagaca

SEQ ID NO: 6130 - DNA, 20 bp, Homo sapiens
aaaaagagtgttttttgttt

SEQ ID NO: 6131 - DNA, 22 bp, Homo sapiens
tctcccaaccctcagcccagtg

SEQ ID NO: 6132 - DNA, 22 bp, Homo sapiens
tgctgaccgcagattatgtttg

SEQ ID NO: 6133 - DNA, 22 bp, Homo sapiens
tgactgggactgggccaaagtt

SEQ ID NO: 6134 - DNA, 22 bp, Homo sapiens
tgacttatcagaacaggaccag

SEQ ID NO: 6135 - DNA, 20 bp, Homo sapiens
tttcctaatgttcgataaaa

SEQ ID NO: 6136 - DNA, 20 bp, Homo sapiens
tctctcattgagtcagctcc

SEQ ID NO: 6137 - DNA, 23 bp, Homo sapiens
agcagcaccacgtgaatgaggag

SEQ ID NO: 6138 - DNA, 22 bp, Homo sapiens
tagcaccatttgaatcatgtta

SEQ ID NO: 6139 - DNA, 23 bp, Homo sapiens
agcgctgccctctactctctctg

SEQ ID NO: 6140 - DNA, 20 bp, Homo sapiens
gcattggtggtgactgcacc

SEQ ID NO: 6141 - DNA, 20 bp, Homo sapiens
caggttcaggagcaggtgag

SEQ ID NO: 6142 - DNA, 22 bp, Homo sapiens
catcatggcactggggcacgtg

SEQ ID NO: 6143 - DNA, 23 bp, Homo sapiens
gtccaggtttcccattaatcccg

SEQ ID NO: 6144 - DNA, 22 bp, Homo sapiens
gcatgacctcagtttatgtttg

SEQ ID NO: 6145 - DNA, 21 bp, Homo sapiens
ttcagtactgtgatacagttt

SEQ ID NO: 6146 - DNA, 21 bp, Homo sapiens
agcagctgtgctagtttctat

SEQ ID NO: 6147 - DNA, 22 bp, Homo sapiens
acagttgacccttgtaccacac

SEQ ID NO: 6148 - DNA, 21 bp, Homo sapiens
tagctactttacagtgctaaa

SEQ ID NO: 6149 - DNA, 22 bp, Homo sapiens
agctagtgagaaagctgctgcc

SEQ ID NO: 6150 - DNA, 22 bp, Homo sapiens
caaatgccaggattttattcca

SEQ ID NO: 6151 - DNA, 20 bp, Homo sapiens
gtaatgctattgaagtcatt

SEQ ID NO: 6152 - DNA, 20 bp, Homo sapiens
gagcccagcgggaggctccc

SEQ ID NO: 6153 - DNA, 20 bp, Homo sapiens
agctgggcttggtttggatg

SEQ ID NO: 6154 - DNA, 22 bp, Homo sapiens
tttccctcctaaattagataga

SEQ ID NO: 6155 - DNA, 22 bp, Homo sapiens
tgcgcagcaggtctccagaact

SEQ ID NO: 6156 - DNA, 22 bp, Homo sapiens
accacagggttcttgtgtaagt

SEQ ID NO: 6157 - DNA, 22 bp, Homo sapiens
tccctgagcaaagctgtagtga

SEQ ID NO: 6158 - DNA, 20 bp, Homo sapiens
ccccggcgcgcggcggacag

SEQ ID NO: 6159 - DNA, 22 bp, Homo sapiens
caccgcaggcagttataccaac

SEQ ID NO: 6160 - DNA, 22 bp, Homo sapiens
acctgctgagtaactaactggc

SEQ ID NO: 6161 - DNA, 20 bp, Homo sapiens
accattccagggttttatgg

SEQ ID NO: 6162 - DNA, 23 bp, Homo sapiens
aggttctcagacccggtgcgcgt

SEQ ID NO: 6163 - DNA, 21 bp, Homo sapiens
agtcaagcgcttatctatgcc

SEQ ID NO: 6164 - DNA, 21 bp, Homo sapiens
tagcagcacgtaatggagacc

SEQ ID NO: 6165 - DNA, 22 bp, Homo sapiens
tagaggcccccttgatggtcac

SEQ ID NO: 6166 - DNA, 22 bp, Homo sapiens
aaccttcctcttcttacacaac

SEQ ID NO: 6167 - DNA, 21 bp, Homo sapiens
ctttaatacggggttgcatat

SEQ ID NO: 6168 - DNA, 22 bp, Homo sapiens
ctggatctgacttggaggattg

SEQ ID NO: 6169 - DNA, 20 bp, Homo sapiens
aacacctctttacaggaggt

SEQ ID NO: 6170 - DNA, 20 bp, Homo sapiens
ccaccagctagaatttgatt

SEQ ID NO: 6171 - DNA, 21 bp, Homo sapiens
cactcaataaatgatagcagc

SEQ ID NO: 6172 - DNA, 22 bp, Homo sapiens
cagtaggccaggtctcgctgct

SEQ ID NO: 6173 - DNA, 20 bp, Homo sapiens
cccccgccccaccccgcgcg

SEQ ID NO: 6174 - DNA, 22 bp, Homo sapiens
tcgaggagctcacagagacagg

SEQ ID NO: 6175 - DNA, 21 bp, Homo sapiens
cagcaaaggctcatgttttga

SEQ ID NO: 6176 - DNA, 23 bp, Homo sapiens
tagcaggtattgaaatcaacaaa

SEQ ID NO: 6177 - DNA, 23 bp, Homo sapiens
tgggagacaagagctccttgtca

SEQ ID NO: 6178 - DNA, 20 bp, Homo sapiens
ggcgttacactgccattgta

SEQ ID NO: 6179 - DNA, 22 bp, Homo sapiens
gaatgttgcttgaggctacaat

SEQ ID NO: 6180 - DNA, 21 bp, Homo sapiens
ctgaggatacttaactgtatt

SEQ ID NO: 6181 - DNA, 22 bp, Homo sapiens
tctagacatgtatatctgattt

SEQ ID NO: 6182 - DNA, 22 bp, Homo sapiens
agctacatcactaataaaattc

SEQ ID NO: 6183 - DNA, 23 bp, Homo sapiens
tagctcagaagtccaggcacagt

SEQ ID NO: 6184 - DNA, 21 bp, Homo sapiens
ggcagtttgtcaaataccagt

SEQ ID NO: 6185 - DNA, 23 bp, Homo sapiens
gtttctctaaataacaatatata

SEQ ID NO: 6186 - DNA, 23 bp, Homo sapiens
cagagcaggatggcacggtctgg

SEQ ID NO: 6187 - DNA, 22 bp, Homo sapiens
agagcagctgggattgccacag

SEQ ID NO: 6188 - DNA, 23 bp, Homo sapiens
tgtgcaaatctatgtggcactac

SEQ ID NO: 6189 - DNA, 22 bp, Homo sapiens
tggaagttacctaatatggagg

SEQ ID NO: 6190 - DNA, 22 bp, Homo sapiens
ttcttgagtagatgtgtatcaa

SEQ ID NO: 6191 - DNA, 23 bp, Homo sapiens
agcagtggcacccaggaatccct

SEQ ID NO: 6192 - DNA, 22 bp, Homo sapiens
gctattaggaagttgatactag

SEQ ID NO: 6193 - DNA, 20 bp, Homo sapiens
ctttaaacaccagtatagca

SEQ ID NO: 6194 - DNA, 20 bp, Homo sapiens
aagggcctgcgatttttgtc

SEQ ID NO: 6195 - DNA, 23 bp, Homo sapiens
tttagacacctgatgtcacactt

SEQ ID NO: 6196 - DNA, 21 bp, Homo sapiens
ttctcaaatttccttcttctg

SEQ ID NO: 6197 - DNA, 20 bp, Homo sapiens
tctgcatcagaggctatgaa

SEQ ID NO: 6198 - DNA, 22 bp, Homo sapiens
tcctttgaccctcactgcagtg

SEQ ID NO: 6199 - DNA, 20 bp, Homo sapiens
taatgttgctcagagctaac

SEQ ID NO: 6200 - DNA, 22 bp, Homo sapiens
gtagttgaatctggatacaaac

SEQ ID NO: 6201 - DNA, 24 bp, Homo sapiens
gagttttctattcctatatcatga

SEQ ID NO: 6202 - DNA, 23 bp, Homo sapiens
caaggtcacgccattgcatcaat

SEQ ID NO: 6203 - DNA, 21 bp, Homo sapiens
tggaatgtacctcctgctgca

SEQ ID NO: 6204 - DNA, 20 bp, Homo sapiens
aacatggaggaaattttgta

SEQ ID NO: 6205 - DNA, 21 bp, Homo sapiens
actcatcagaatgttaacctt

SEQ ID NO: 6206 - DNA, 21 bp, Homo sapiens
tgaactttttcccaggaatca

SEQ ID NO: 6207 - DNA, 20 bp, Homo sapiens
tttaggtggtgcagatgtac

SEQ ID NO: 6208 - DNA, 20 bp, Homo sapiens
ttgcaaagctgaaactcatc

SEQ ID NO: 6209 - DNA, 22 bp, Homo sapiens
tttagactgggctacttcacag

SEQ ID NO: 6210 - DNA, 22 bp, Homo sapiens
ttcactgccgaagaagcaagag

SEQ ID NO: 6211 - DNA, 20 bp, Homo sapiens
tgcttatcaaggttaccaac

SEQ ID NO: 6212 - DNA, 22 bp, Homo sapiens
tgacagtttaaacttctttttg

SEQ ID NO: 6213 - DNA, 22 bp, Homo sapiens
tagcagcacaagttgcaactgc

SEQ ID NO: 6214 - DNA, 21 bp, Homo sapiens
tctgtggggcattttgggctt

SEQ ID NO: 6215 - DNA, 22 bp, Homo sapiens
agcaatccttccccctccacct

SEQ ID NO: 6216 - DNA, 22 bp, Homo sapiens
atattgctgctgggtatgtcaa

SEQ ID NO: 6217 - DNA, 21 bp, Homo sapiens
cattatgcagaaaccagtatg

SEQ ID NO: 6218 - DNA, 22 bp, Homo sapiens
gccattgaaacaatttggaaaa

SEQ ID NO: 6219 - DNA, 22 bp, Homo sapiens
cagtgcaatgtttgggaggcat

SEQ ID NO: 6220 - DNA, 24 bp, Homo sapiens
ctcttctgagggagagaaaggcat

SEQ ID NO: 6221 - DNA, 20 bp, Homo sapiens
taatagaccacagtatagca

SEQ ID NO: 6222 - DNA, 20 bp, Homo sapiens
tagaatgggtgtgataggtg

SEQ ID NO: 6223 - DNA, 20 bp, Homo sapiens
ctgctctcaaactaaataaa

SEQ ID NO: 6224 - DNA, 22 bp, Homo sapiens
atacatcagctgacatgaacac

SEQ ID NO: 6225 - DNA, 20 bp, Homo sapiens
cattgcactcactctgtcag

SEQ ID NO: 6226 - DNA, 23 bp, Homo sapiens
tgtatcagctcatcaggaactca

SEQ ID NO: 6227 - DNA, 20 bp, Homo sapiens
cagcccagcgccgagctcgc

SEQ ID NO: 6228 - DNA, 20 bp, Homo sapiens
gagatgggtgctcttattac

SEQ ID NO: 6229 - DNA, 23 bp, Homo sapiens
atgtggatagaattgacaaagca

SEQ ID NO: 6230 - DNA, 20 bp, Homo sapiens
cacctgtgacaagcactcag

SEQ ID NO: 6231 - DNA, 22 bp, Homo sapiens
tagaaaccaggaacatacagtg

SEQ ID NO: 6232 - DNA, 23 bp, Homo sapiens
atactactgtggcaaaggatgct

SEQ ID NO: 6233 - DNA, 22 bp, Homo sapiens
tgcggtctagctgagaggtgga

SEQ ID NO: 6234 - DNA, 22 bp, Homo sapiens
aggaatggtggtagcagtagtt

SEQ ID NO: 6235 - DNA, 20 bp, Homo sapiens
cctcaatgatataacgggtc

SEQ ID NO: 6236 - DNA, 21 bp, Homo sapiens
aatgtgccattagggtaaagg

SEQ ID NO: 6237 - DNA, 20 bp, Homo sapiens
cgaacctctgaccacaagca

SEQ ID NO: 6238 - DNA, 24 bp, Homo sapiens
ggaggattgcttgtggtcagaggt

SEQ ID NO: 6239 - DNA, 20 bp, Homo sapiens
tggggttttaagctcctctg

SEQ ID NO: 6240 - DNA, 22 bp, Homo sapiens
ctgttcattgtgtcaattatgc

SEQ ID NO: 6241 - DNA, 22 bp, Homo sapiens
ttgttcaaatcctcctatctgg

SEQ ID NO: 6242 - DNA, 21 bp, Homo sapiens
gcagtgagccgagcacgcacc

SEQ ID NO: 6243 - DNA, 20 bp, Homo sapiens
tatcgtatcagactgatgtg

SEQ ID NO: 6244 - DNA, 22 bp, Homo sapiens
atgtgtacattgaaatattggc

SEQ ID NO: 6245 - DNA, 21 bp, Homo sapiens
tcatggcactcattgccatat

SEQ ID NO: 6246 - DNA, 22 bp, Homo sapiens
tagtctaggtctgtgataggct

SEQ ID NO: 6247 - DNA, 20 bp, Homo sapiens
ggcagggaggcttcaaaggg

SEQ ID NO: 6248 - DNA, 23 bp, Homo sapiens
tgtcagtttgtaccattgttacc

SEQ ID NO: 6249 - DNA, 21 bp, Homo sapiens
tgagatgaaggtgaccacaga

SEQ ID NO: 6250 - DNA, 21 bp, Homo sapiens
ggttatgaaattgctagacgc

SEQ ID NO: 6251 - DNA, 21 bp, Homo sapiens
cagagcaggatgctgtagccc

SEQ ID NO: 6252 - DNA, 22 bp, Homo sapiens
tctttctttaatttgcatgtgt

SEQ ID NO: 6253 - DNA, 22 bp, Homo sapiens
tgtcagtttgccaaatcccctc

SEQ ID NO: 6254 - DNA, 21 bp, Homo sapiens
tagcaccatctctaatgcatc

SEQ ID NO: 6255 - DNA, 22 bp, Homo sapiens
gaagtgtttcagcaatattttg

SEQ ID NO: 6256 - DNA, 20 bp, Homo sapiens
gcattatgctgaggatgaag

SEQ ID NO: 6257 - DNA, 22 bp, Homo sapiens
taccttgtaatgtgtcactaat

SEQ ID NO: 6258 - DNA, 23 bp, Homo sapiens
agtgtgcatattatttcattgat

SEQ ID NO: 6259 - DNA, 20 bp, Homo sapiens
acattcaaatttctcatggt

SEQ ID NO: 6260 - DNA, 23 bp, Homo sapiens
tgtgcagatctatgcaacactga

SEQ ID NO: 6261 - DNA, 22 bp, Homo sapiens
atctgcacatactaccaaatgt

SEQ ID NO: 6262 - DNA, 22 bp, Homo sapiens
tccctgagagtttgacttgtga

SEQ ID NO: 6263 - DNA, 20 bp, Homo sapiens
gtcttttgtgcctactccag

SEQ ID NO: 6264 - DNA, 20 bp, Homo sapiens
ctaatagcataataattgta

SEQ ID NO: 6265 - DNA, 20 bp, Homo sapiens
ggccctaatcgagtcaacct

SEQ ID NO: 6266 - DNA, 22 bp, Homo sapiens
ttagtcaggcttaaatacaaac

SEQ ID NO: 6267 - DNA, 21 bp, Homo sapiens
cattatgcattttatgcatat

SEQ ID NO: 6268 - DNA, 23 bp, Homo sapiens
aataataattttataacagcaga

SEQ ID NO: 6269 - DNA, 21 bp, Homo sapiens
gtgccactacactccagcacc

SEQ ID NO: 6270 - DNA, 22 bp, Homo sapiens
tctcccagtttcccgcaactgt

SEQ ID NO: 6271 - DNA, 22 bp, Homo sapiens
attctgccattgacctaaaggt

SEQ ID NO: 6272 - DNA, 20 bp, Homo sapiens
tgagcaggttgctgctactc

SEQ ID NO: 6273 - DNA, 20 bp, Homo sapiens
actacaagctattttgacta

SEQ ID NO: 6274 - DNA, 23 bp, Homo sapiens
atcacatgattgaagtccaggtt

SEQ ID NO: 6275 - DNA, 20 bp, Homo sapiens
aaaacgcgtagaggtggtag

SEQ ID NO: 6276 - DNA, 22 bp, Homo sapiens
ttcactgccactgaatactttg

SEQ ID NO: 6277 - DNA, 22 bp, Homo sapiens
gaggctgttcctgtcatttagt

SEQ ID NO: 6278 - DNA, 23 bp, Homo sapiens
tgaagaccctccctccttaggga

SEQ ID NO: 6279 - DNA, 20 bp, Homo sapiens
gcaatgaaggtgaaggcatt

SEQ ID NO: 6280 - DNA, 21 bp, Homo sapiens
ctagcaatcagacggcggagg

SEQ ID NO: 6281 - DNA, 22 bp, Homo sapiens
tcttaggcaagagcagggcacg

SEQ ID NO: 6282 - DNA, 21 bp, Homo sapiens
ctattctcatagtcctagctt

SEQ ID NO: 6283 - DNA, 22 bp, Homo sapiens
gtcagttagctgggcgtggtgg

SEQ ID NO: 6284 - DNA, 23 bp, Homo sapiens
tcatctgacctggcaggccactc

SEQ ID NO: 6285 - DNA, 22 bp, Homo sapiens
cttgccaatcctgggggcaggt

SEQ ID NO: 6286 - DNA, 24 bp, Homo sapiens
gtttgaatcctgtctctgtcacca

SEQ ID NO: 6287 - DNA, 21 bp, Homo sapiens
agccatgatgcaacactgaaa

SEQ ID NO: 6288 - DNA, 23 bp, Homo sapiens
cattaccaggcactgtacttgct

SEQ ID NO: 6289 - DNA, 20 bp, Homo sapiens
cgctggcccgcgggagctgt

SEQ ID NO: 6290 - DNA, 21 bp, Homo sapiens
aaacagacaaagcctcctcac

SEQ ID NO: 6291 - DNA, 22 bp, Homo sapiens
cctcgagggagagaaaccacag

SEQ ID NO: 6292 - DNA, 22 bp, Homo sapiens
agcagccttagggagataggct

SEQ ID NO: 6293 - DNA, 21 bp, Homo sapiens
agattatgagatctgagggct

SEQ ID NO: 6294 - DNA, 20 bp, Homo sapiens
aagtactgtcgattcagaat

SEQ ID NO: 6295 - DNA, 22 bp, Homo sapiens
gggactgggctaaaatccaaac

SEQ ID NO: 6296 - DNA, 22 bp, Homo sapiens
atgttcagctctaaaattctgg

SEQ ID NO: 6297 - DNA, 21 bp, Homo sapiens
catctgagctcacagtctagt

SEQ ID NO: 6298 - DNA, 20 bp, Homo sapiens
ccactacgcccccgccgagc

SEQ ID NO: 6299 - DNA, 21 bp, Homo sapiens
tggcactgctcagggctaacc

SEQ ID NO: 6300 - DNA, 21 bp, Homo sapiens
tatctgacagaccattgccaa

SEQ ID NO: 6301 - DNA, 22 bp, Homo sapiens
ctgtccgtcatgatgcagtcac

SEQ ID NO: 6302 - DNA, 23 bp, Homo sapiens
gctaggcgcactggctgcttctg

SEQ ID NO: 6303 - DNA, 23 bp, Homo sapiens
gggctcagggactcaggaccaga

SEQ ID NO: 6304 - DNA, 21 bp, Homo sapiens
cattgtttaaaggagctggga

SEQ ID NO: 6305 - DNA, 23 bp, Homo sapiens
cagcgttgcttgaaatcagtctt

SEQ ID NO: 6306 - DNA, 21 bp, Homo sapiens
actcaggcttcccaccccact

SEQ ID NO: 6307 - DNA, 20 bp, Homo sapiens
ctcattccaaccagtccagt

SEQ ID NO: 6308 - DNA, 20 bp, Homo sapiens
catgctgtcttagcggatct

SEQ ID NO: 6309 - DNA, 22 bp, Homo sapiens
caaagtgctcacagtggtctgc

SEQ ID NO: 6310 - DNA, 23 bp, Homo sapiens
tgaactggggaccaggaatttct

SEQ ID NO: 6311 - DNA, 21 bp, Homo sapiens
cagactggcggcattttgctg

SEQ ID NO: 6312 - DNA, 20 bp, Homo sapiens
taataatgtggtctatagca

SEQ ID NO: 6313 - DNA, 22 bp, Homo sapiens
agagtgccattctgggccaggc

SEQ ID NO: 6314 - DNA, 20 bp, Homo sapiens
agatgctgagatagtggtga

SEQ ID NO: 6315 - DNA, 20 bp, Homo sapiens
gctagatgtcctagggcttc

SEQ ID NO: 6316 - DNA, 20 bp, Homo sapiens
agatgtatggtggcatgaga

SEQ ID NO: 6317 - DNA, 20 bp, Homo sapiens
tttcccactgcgccatttgg

SEQ ID NO: 6318 - DNA, 22 bp, Homo sapiens
aaactacaaacagggccgagtg

SEQ ID NO: 6319 - DNA, 20 bp, Homo sapiens
ccagcagaacccttcttggt

SEQ ID NO: 6320 - DNA, 20 bp, Homo sapiens
ttccagttttcccagaggtt

SEQ ID NO: 6321 - DNA, 22 bp, Homo sapiens
ccagccctcccgccggcccagc

SEQ ID NO: 6322 - DNA, 20 bp, Homo sapiens
ccttgcacgcaggaggcact

SEQ ID NO: 6323 - DNA, 23 bp, Homo sapiens
tggcttatcagatcaatgagctc

SEQ ID NO: 6324 - DNA, 22 bp, Homo sapiens
tgactgtgggggtgggaaggtc

SEQ ID NO: 6325 - DNA, 22 bp, Homo sapiens
tgacagtaatctgagtatccaa

SEQ ID NO: 6326 - DNA, 22 bp, Homo sapiens
gctagatagtagtacctggcat

SEQ ID NO: 6327 - DNA, 22 bp, Homo sapiens
gtcctgtagtacagtgcagata

SEQ ID NO: 6328 - DNA, 20 bp, Homo sapiens
ctgacctatgaattctatcc

SEQ ID NO: 6329 - DNA, 20 bp, Homo sapiens
ttccatatgctaggtggtat

SEQ ID NO: 6330 - DNA, 22 bp, Homo sapiens
gtatcaggattttattcctaac

SEQ ID NO: 6331 - DNA, 20 bp, Homo sapiens
atgatattcttaagtataat

SEQ ID NO: 6332 - DNA, 20 bp, Homo sapiens
agtaaggtcagctaggttta

SEQ ID NO: 6333 - DNA, 20 bp, Homo sapiens
ccatttgagtataaatccag

SEQ ID NO: 6334 - DNA, 22 bp, Homo sapiens
gctctgagctcagccgatgtcc

SEQ ID NO: 6335 - DNA, 21 bp, Homo sapiens
ggcagcaatggtagcagctca

SEQ ID NO: 6336 - DNA, 23 bp, Homo sapiens
tgtggaaatctatgcaaaacagg

SEQ ID NO: 6337 - DNA, 22 bp, Homo sapiens
tagcttcttgagtcagcaaaag

SEQ ID NO: 6338 - DNA, 22 bp, Homo sapiens
aaagcaaatgttgggtgaacgg

SEQ ID NO: 6339 - DNA, 22 bp, Homo sapiens
agctgctgagtatcactgcaat

SEQ ID NO: 6340 - DNA, 22 bp, Homo sapiens
cgatgatgagctatggtttaca

SEQ ID NO: 6341 - DNA, 23 bp, Homo sapiens
aagaatcactttatggagatgga

SEQ ID NO: 6342 - DNA, 20 bp, Homo sapiens
atcagaggctatgtggatga

SEQ ID NO: 6343 - DNA, 22 bp, Homo sapiens
tgacagtaatccaaaaatttag

SEQ ID NO: 6344 - DNA, 20 bp, Homo sapiens
atcagctgctccataagggg

SEQ ID NO: 6345 - DNA, 22 bp, Homo sapiens
ggttcaggatcatcaacacatt

SEQ ID NO: 6346 - DNA, 22 bp, Homo sapiens
tctgttgttcctcttgttacta

SEQ ID NO: 6347 - DNA, 23 bp, Homo sapiens
gtcctcatttcccaggaatttct

SEQ ID NO: 6348 - DNA, 20 bp, Homo sapiens
actctagtttgacattgaga

SEQ ID NO: 6349 - DNA, 21 bp, Homo sapiens
tgagagttgtctttatttttg

SEQ ID NO: 6350 - DNA, 24 bp, Homo sapiens
aggctgcaatgtctttcccttata

SEQ ID NO: 6351 - DNA, 20 bp, Homo sapiens
ggcggcggcggggtgtgtgt

SEQ ID NO: 6352 - DNA, 20 bp, Homo sapiens
gtatgccgtcttcttctggg

SEQ ID NO: 6353 - DNA, 20 bp, Homo sapiens
cagaccccaaggaatactct

SEQ ID NO: 6354 - DNA, 20 bp, Homo sapiens
ccctgggaataaaagataat

SEQ ID NO: 6355 - DNA, 20 bp, Homo sapiens
attagcaaattataggatct

SEQ ID NO: 6356 - DNA, 22 bp, Homo sapiens
atgcatcagaggagtaacagaa

SEQ ID NO: 6357 - DNA, 21 bp, Homo sapiens
ttgggccgctaggctgaggtg

SEQ ID NO: 6358 - DNA, 22 bp, Homo sapiens
ggttccatagtgtagtggttag

SEQ ID NO: 6359 - DNA, 22 bp, Homo sapiens
tctaaccatctgaaatattttc

SEQ ID NO: 6360 - DNA, 20 bp, Homo sapiens
ctggttccctcggaagatct

SEQ ID NO: 6361 - DNA, 20 bp, Homo sapiens
tatatggcaccagtatagta

SEQ ID NO: 6362 - DNA, 21 bp, Homo sapiens
agctacattagcttataacaa

SEQ ID NO: 6363 - DNA, 20 bp, Homo sapiens
ccatttggatcggggattgg

SEQ ID NO: 6364 - DNA, 22 bp, Homo sapiens
tgtcagtctactctataccaac

SEQ ID NO: 6365 - DNA, 22 bp, Homo sapiens
aaagccagcaggctttcaatgc

SEQ ID NO: 6366 - DNA, 24 bp, Homo sapiens
aaactgccattgacctagcttgtc

SEQ ID NO: 6367 - DNA, 22 bp, Homo sapiens
tcccaacaggagggtctaaagt

SEQ ID NO: 6368 - DNA, 22 bp, Homo sapiens
tgtaggtgcttccagtcacatc

SEQ ID NO: 6369 - DNA, 20 bp, Homo sapiens
tggatcagaggctatcacta

SEQ ID NO: 6370 - DNA, 24 bp, Homo sapiens
aacaagggggcctggctctgggat

SEQ ID NO: 6371 - DNA, 22 bp, Homo sapiens
acagcctgagtatgtaacagga

SEQ ID NO: 6372 - DNA, 21 bp, Homo sapiens
ctgacctacaggttgaaaccc

SEQ ID NO: 6373 - DNA, 23 bp, Homo sapiens
tagctgtgactctcagcacactt

SEQ ID NO: 6374 - DNA, 23 bp, Homo sapiens
taatctgctgagttgatgggttg

SEQ ID NO: 6375 - DNA, 23 bp, Homo sapiens
gtctataaactttgtgtgagtct

SEQ ID NO: 6376 - DNA, 22 bp, Homo sapiens
tatagttctgagctgactagcg

SEQ ID NO: 6377 - DNA, 22 bp, Homo sapiens
atacaggactctttccatctcc

SEQ ID NO: 6378 - DNA, 22 bp, Homo sapiens
ccacgcccggccgtgtttttct

SEQ ID NO: 6379 - DNA, 21 bp, Homo sapiens
atttagtatgtttttattgtg

SEQ ID NO: 6380 - DNA, 21 bp, Homo sapiens
ccaaatgctcgaatcgagtag

SEQ ID NO: 6381 - DNA, 22 bp, Homo sapiens
tcagtctaacagtttatggtat

SEQ ID NO: 6382 - DNA, 23 bp, Homo sapiens
tctgtcattagtctgataggctt

SEQ ID NO: 6383 - DNA, 22 bp, Homo sapiens
ttcatgcggcctgagataggtt

SEQ ID NO: 6384 - DNA, 22 bp, Homo sapiens
taatagcacatcatggttttgt

SEQ ID NO: 6385 - DNA, 22 bp, Homo sapiens
ttatcatagttctacatcacag

SEQ ID NO: 6386 - DNA, 22 bp, Homo sapiens
tgtaacagcacagaacagactc

SEQ ID NO: 6387 - DNA, 21 bp, Homo sapiens
ttgacctacaggccagtgtat

SEQ ID NO: 6388 - DNA, 21 bp, Homo sapiens
cagcaccagctgaatagcacc

SEQ ID NO: 6389 - DNA, 22 bp, Homo sapiens
ctcagtctcaaagcccttgtgt

SEQ ID NO: 6390 - DNA, 20 bp, Homo sapiens
ccgctgagacttagtcacaa

SEQ ID NO: 6391 - DNA, 21 bp, Homo sapiens
gtgagctgagtacaattgtgg

SEQ ID NO: 6392 - DNA, 22 bp, Homo sapiens
agcagtggtgacccacaaaacc

SEQ ID NO: 6393 - DNA, 22 bp, Homo sapiens
tgagactcattttacaggctga

SEQ ID NO: 6394 - DNA, 22 bp, Homo sapiens
agctacatctggctactgaata

SEQ ID NO: 6395 - DNA, 23 bp, Homo sapiens
actggacttggagtcatggaatg

SEQ ID NO: 6396 - DNA, 21 bp, Homo sapiens
atatgttgctcagcagatgtt

SEQ ID NO: 6397 - DNA, 20 bp, Homo sapiens
cggtcctctgcacgtggcta

SEQ ID NO: 6398 - DNA, 21 bp, Homo sapiens
caatggtgatctttggatctg

SEQ ID NO: 6399 - DNA, 20 bp, Homo sapiens
taccaccatctgagcgattg

SEQ ID NO: 6400 - DNA, 22 bp, Homo sapiens
tatgcaatgttcaaagcccaca

SEQ ID NO: 6401 - DNA, 20 bp, Homo sapiens
aggcaagatgctggcaagag

SEQ ID NO: 6402 - DNA, 21 bp, Homo sapiens
catgtttagtatgtttttatt

SEQ ID NO: 6403 - DNA, 22 bp, Homo sapiens
ctaatttagtagtaatggtgct

SEQ ID NO: 6404 - DNA, 22 bp, Homo sapiens
atcacatcattgaatgcaaggt

SEQ ID NO: 6405 - DNA, 20 bp, Homo sapiens
tgttccatagcacgacagtt

SEQ ID NO: 6406 - DNA, 22 bp, Homo sapiens
ccaccgcgccttgcggcacact

SEQ ID NO: 6407 - DNA, 22 bp, Homo sapiens
cattgaaaaaaatggcccaggc

SEQ ID NO: 6408 - DNA, 20 bp, Homo sapiens
ggcggcgggagccccgggac

SEQ ID NO: 6409 - DNA, 20 bp, Homo sapiens
tcaatgctggtatgggtgag

SEQ ID NO: 6410 - DNA, 20 bp, Homo sapiens
aattaaataagggtgtcatt

SEQ ID NO: 6411 - DNA, 21 bp, Homo sapiens
tagtagttttcccaggaaccc

SEQ ID NO: 6412 - DNA, 22 bp, Homo sapiens
tggagactttcaggtcctgtga

SEQ ID NO: 6413 - DNA, 21 bp, Homo sapiens
tgtagggatggaagccatgaa

SEQ ID NO: 6414 - DNA, 21 bp, Homo sapiens
tgtgtgagcactggcatagct

SEQ ID NO: 6415 - DNA, 24 bp, Homo sapiens
gactcgactcgtgtgcggacattt

SEQ ID NO: 6416 - DNA, 22 bp, Homo sapiens
aagtgcagtagtagctggctag

SEQ ID NO: 6417 - DNA, 23 bp, Homo sapiens
agtcagtttgtcgggcgcagtgg

SEQ ID NO: 6418 - DNA, 21 bp, Homo sapiens
gaatggttgggaacatggtca

SEQ ID NO: 6419 - DNA, 20 bp, Homo sapiens
ctgacctatgaattcagact

SEQ ID NO: 6420 - DNA, 20 bp, Homo sapiens
aggaaaacaagctattttgg

SEQ ID NO: 6421 - DNA, 20 bp, Homo sapiens
gtatattcttaaatttgggt

SEQ ID NO: 6422 - DNA, 20 bp, Homo sapiens
acctatatccctccctggca

SEQ ID NO: 6423 - DNA, 20 bp, Homo sapiens
aagaccctgttgagcttatc

SEQ ID NO: 6424 - DNA, 20 bp, Homo sapiens
ttgaaattcttggacccatc

SEQ ID NO: 6425 - DNA, 22 bp, Homo sapiens
cctgagacatgaacattgagtc

SEQ ID NO: 6426 - DNA, 21 bp, Homo sapiens
ctaataatgaaaaaatacata

SEQ ID NO: 6427 - DNA, 20 bp, Homo sapiens
tccccggcatagaacatagg

SEQ ID NO: 6428 - DNA, 23 bp, Homo sapiens
ctcttagagacttggagggctaa

SEQ ID NO: 6429 - DNA, 23 bp, Homo sapiens
tgggagtcaatgcacttctgtcc

SEQ ID NO: 6430 - DNA, 20 bp, Homo sapiens
tagcaccaagactccagcca

SEQ ID NO: 6431 - DNA, 22 bp, Homo sapiens
gcccagttttcccaggtaagga

SEQ ID NO: 6432 - DNA, 23 bp, Homo sapiens
gttgtcatgactggtatggggtg

SEQ ID NO: 6433 - DNA, 23 bp, Homo sapiens
aatgatgaaagtcagaagacagt

SEQ ID NO: 6434 - DNA, 22 bp, Homo sapiens
tcaatgaagttttaactcacag

SEQ ID NO: 6435 - DNA, 20 bp, Homo sapiens
ccacattgcacgcaggtgtg

SEQ ID NO: 6436 - DNA, 20 bp, Homo sapiens
ccactacattcttatccctt

SEQ ID NO: 6437 - DNA, 22 bp, Homo sapiens
tcttctcgtcaggggagggcta

SEQ ID NO: 6438 - DNA, 20 bp, Homo sapiens
caacccatcaaggagaactg

SEQ ID NO: 6439 - DNA, 21 bp, Homo sapiens
gtgacctgtcctcctatactc

SEQ ID NO: 6440 - DNA, 21 bp, Homo sapiens
ctgacctacctgccagtgaaa

SEQ ID NO: 6441 - DNA, 21 bp, Homo sapiens
caaataatgatttttgcatac

SEQ ID NO: 6442 - DNA, 20 bp, Homo sapiens
tgagatgaagcactgaccag

SEQ ID NO: 6443 - DNA, 20 bp, Homo sapiens
ccccaacagtataaataaca

SEQ ID NO: 6444 - DNA, 20 bp, Homo sapiens
actgagtaatccaggaggct

SEQ ID NO: 6445 - DNA, 22 bp, Homo sapiens
gagattccgaatgggctacttg

SEQ ID NO: 6446 - DNA, 21 bp, Homo sapiens
acagcaccctgacatatggga

SEQ ID NO: 6447 - DNA, 20 bp, Homo sapiens
ccaataaatcctgaccccac

SEQ ID NO: 6448 - DNA, 22 bp, Homo sapiens
tgagtcaggtgacatatggggt

SEQ ID NO: 6449 - DNA, 22 bp, Homo sapiens
tgtaccagctgacctatgggca

SEQ ID NO: 6450 - DNA, 20 bp, Homo sapiens
gcatcccagcagccacacca

SEQ ID NO: 6451 - DNA, 21 bp, Homo sapiens
tgagatgggatgagtccatgt

SEQ ID NO: 6452 - DNA, 23 bp, Homo sapiens
tgttctgggacatttatgggaac

SEQ ID NO: 6453 - DNA, 20 bp, Homo sapiens
cacagggatcatcgagtcca

SEQ ID NO: 6454 - DNA, 22 bp, Homo sapiens
atgcatcagaggctgtgtgctg

SEQ ID NO: 6455 - DNA, 22 bp, Homo sapiens
gcgcacatcaatcctgggcttt

SEQ ID NO: 6456 - DNA, 21 bp, Homo sapiens
tggccgagcttcctggtgggg

SEQ ID NO: 6457 - DNA, 21 bp, Homo sapiens
gcataaattttacaaaaaaga

SEQ ID NO: 6458 - DNA, 23 bp, Homo sapiens
tctagtatcagagcagctgtgat

SEQ ID NO: 6459 - DNA, 21 bp, Homo sapiens
aggggagtgttttttgttttg

SEQ ID NO: 6460 - DNA, 23 bp, Homo sapiens
gcttctaagtcccaggaaaggga

SEQ ID NO: 6461 - DNA, 22 bp, Homo sapiens
tgaggatcatctatgtatagga

SEQ ID NO: 6462 - DNA, 20 bp, Homo sapiens
acaaccctaggagcttttat

SEQ ID NO: 6463 - DNA, 21 bp, Homo sapiens
tctctctctctcccgctcatc

SEQ ID NO: 6464 - DNA, 20 bp, Homo sapiens
cggcgggtgttggtattatg

SEQ ID NO: 6465 - DNA, 22 bp, Homo sapiens
tcctctgaaagattcaaggacc

SEQ ID NO: 6466 - DNA, 22 bp, Homo sapiens
tcctttgcaaaggtgctcagtg

SEQ ID NO: 6467 - DNA, 21 bp, Homo sapiens
gggtcacaagtgactaccaat

SEQ ID NO: 6468 - DNA, 22 bp, Homo sapiens
tcatgatggtgtgggcattttg

SEQ ID NO: 6469 - DNA, 22 bp, Homo sapiens
gggaataatggtagctcagacc

SEQ ID NO: 6470 - DNA, 20 bp, Homo sapiens
cgcgacgatgagctgagagg

SEQ ID NO: 6471 - DNA, 23 bp, Homo sapiens
tggctcagaagtccagggacaga

SEQ ID NO: 6472 - DNA, 20 bp, Homo sapiens
gggacatgtggccatgcctg

SEQ ID NO: 6473 - DNA, 21 bp, Homo sapiens
ctgactccaaggccagtggtt

SEQ ID NO: 6474 - DNA, 20 bp, Homo sapiens
gcattggtggttgtcaaact

SEQ ID NO: 6475 - DNA, 22 bp, Homo sapiens
tgtccctcatccaacatattca

SEQ ID NO: 6476 - DNA, 22 bp, Homo sapiens
tctcaccggtctgggcgttggc

SEQ ID NO: 6477 - DNA, 22 bp, Homo sapiens
gctccaacaacctgacaagagg

SEQ ID NO: 6478 - DNA, 22 bp, Homo sapiens
tgtcatctctccttcaccgcca

SEQ ID NO: 6479 - DNA, 20 bp, Homo sapiens
aggggtgaggaccatggtgg

SEQ ID NO: 6480 - DNA, 23 bp, Homo sapiens
gctaggcgtctcacatacttgac

SEQ ID NO: 6481 - DNA, 20 bp, Homo sapiens
ccactacgcctccatcagaa

SEQ ID NO: 6482 - DNA, 21 bp, Homo sapiens
tgaaggtatgcacactatccc

SEQ ID NO: 6483 - DNA, 22 bp, Homo sapiens
tgatgccatttgattagctggc

SEQ ID NO: 6484 - DNA, 23 bp, Homo sapiens
tggctcagaagtctgaacacagc

SEQ ID NO: 6485 - DNA, 24 bp, Homo sapiens
ccatggcggcggccgcggggcccc

SEQ ID NO: 6486 - DNA, 22 bp, Homo sapiens
agttccataatgacagcgagga

SEQ ID NO: 6487 - DNA, 23 bp, Homo sapiens
ccagtgtttgtcaaataaaactg

SEQ ID NO: 6488 - DNA, 22 bp, Homo sapiens
ctgaagctctttctctcccttg

SEQ ID NO: 6489 - DNA, 21 bp, Homo sapiens
cagtgcaatgttagagggcat

SEQ ID NO: 6490 - DNA, 20 bp, Homo sapiens
tcaagtaatccagctacctc

SEQ ID NO: 6491 - DNA, 22 bp, Homo sapiens
ataggacccgaactgatatcga

SEQ ID NO: 6492 - DNA, 20 bp, Homo sapiens
tataggcgactcagtcaccc

SEQ ID NO: 6493 - DNA, 22 bp, Homo sapiens
cgaggaggaggagggggcagag

SEQ ID NO: 6494 - DNA, 22 bp, Homo sapiens
tgctactgtgagtaataatgca

SEQ ID NO: 6495 - DNA, 21 bp, Homo sapiens
atcccactgctgccaccaata

SEQ ID NO: 6496 - DNA, 20 bp, Homo sapiens
agacaccattagagctcatc

SEQ ID NO: 6497 - DNA, 23 bp, Homo sapiens
ctgttcatttctattatttttat

SEQ ID NO: 6498 - DNA, 22 bp, Homo sapiens
gcggtaggaacagggcattcac

SEQ ID NO: 6499 - DNA, 21 bp, Homo sapiens
gcatggcacctgcatatgctc

SEQ ID NO: 6500 - DNA, 22 bp, Homo sapiens
tagcaccagctgagtagcctta

SEQ ID NO: 6501 - DNA, 22 bp, Homo sapiens
gctaggcgacgagctgcaccag

SEQ ID NO: 6502 - DNA, 21 bp, Homo sapiens
catcacaaaggacagccgcac

SEQ ID NO: 6503 - DNA, 22 bp, Homo sapiens
taccagcgtaggtaccaagcac

SEQ ID NO: 6504 - DNA, 21 bp, Homo sapiens
cggcggagggcggcgcgccgc

SEQ ID NO: 6505 - DNA, 23 bp, Homo sapiens
gtcactggggaacaggatcttta

SEQ ID NO: 6506 - DNA, 22 bp, Homo sapiens
gtcatcagaggctatgtggaca

SEQ ID NO: 6507 - DNA, 20 bp, Homo sapiens
atgtatcagtagaaagcaag

SEQ ID NO: 6508 - DNA, 22 bp, Homo sapiens
acagcaggcaagagtgaatgag

SEQ ID NO: 6509 - DNA, 22 bp, Homo sapiens
atcacatctttctcctaatggt

SEQ ID NO: 6510 - DNA, 21 bp, Homo sapiens
tagcaaagctcaggatcggtc

SEQ ID NO: 6511 - DNA, 21 bp, Homo sapiens
atcgtggctcgctacagcctc

SEQ ID NO: 6512 - DNA, 21 bp, Homo sapiens
tccctgagactctaacttctg

SEQ ID NO: 6513 - DNA, 22 bp, Homo sapiens
cagactgccagacttatttcag

SEQ ID NO: 6514 - DNA, 20 bp, Homo sapiens
gtcacattgccagggaaaca

SEQ ID NO: 6515 - DNA, 22 bp, Homo sapiens
gacccaaaacacagcctactaa

SEQ ID NO: 6516 - DNA, 22 bp, Homo sapiens
ctaatggctgagtttaaacaaa

SEQ ID NO: 6517 - DNA, 21 bp, Homo sapiens
gtgaaccaccaagccaccaca

SEQ ID NO: 6518 - DNA, 20 bp, Homo sapiens
aagtccattaggtcagcctt

SEQ ID NO: 6519 - DNA, 23 bp, Homo sapiens
agcagctagtacagtgccttgct

SEQ ID NO: 6520 - DNA, 21 bp, Homo sapiens
cagagtgatgtgcagctgatc

SEQ ID NO: 6521 - DNA, 20 bp, Homo sapiens
gaatctaaaggtgcacgcaa

SEQ ID NO: 6522 - DNA, 21 bp, Homo sapiens
tcctcccggggctgtgcctgt

SEQ ID NO: 6523 - DNA, 22 bp, Homo sapiens
gctactgtgtagtttatggggt

SEQ ID NO: 6524 - DNA, 23 bp, Homo sapiens
atatactagactgatgcaaaaaa

SEQ ID NO: 6525 - DNA, 22 bp, Homo sapiens
aagagctgccaactctcctatc

SEQ ID NO: 6526 - DNA, 23 bp, Homo sapiens
acccagacgcctcggaggcctca

SEQ ID NO: 6527 - DNA, 20 bp, Homo sapiens
tagtggatacttaattgttg

SEQ ID NO: 6528 - DNA, 23 bp, Homo sapiens
cactgacctgctcccgccccatg

SEQ ID NO: 6529 - DNA, 23 bp, Homo sapiens
agcgtggcagcgtgtgatacaga

SEQ ID NO: 6530 - DNA, 23 bp, Homo sapiens
gcggcgggagcggagccggcggg

SEQ ID NO: 6531 - DNA, 20 bp, Homo sapiens
cactcaggatagctggcatc

SEQ ID NO: 6532 - DNA, 22 bp, Homo sapiens
accccaggaatcccctcccagg

SEQ ID NO: 6533 - DNA, 22 bp, Homo sapiens
tagcttatcactgctgagttga

SEQ ID NO: 6534 - DNA, 20 bp, Homo sapiens
tcatatcatctgagcttctc

SEQ ID NO: 6535 - DNA, 22 bp, Homo sapiens
cgaggagcccggggcggggatc

SEQ ID NO: 6536 - DNA, 22 bp, Homo sapiens
aagcttatcactctgtatggtc

SEQ ID NO: 6537 - DNA, 20 bp, Homo sapiens
cccagcccttagaaaggggg

SEQ ID NO: 6538 - DNA, 22 bp, Homo sapiens
gagcttcgggcaacaagatggt

SEQ ID NO: 6539 - DNA, 24 bp, Homo sapiens
aggaagagagggagataaaccaca

SEQ ID NO: 6540 - DNA, 22 bp, Homo sapiens
agcagtttgctgaaatgggacc

SEQ ID NO: 6541 - DNA, 20 bp, Homo sapiens
ccatctccaggtgaagaata

SEQ ID NO: 6542 - DNA, 21 bp, Homo sapiens
caggcggcagaggttgcaata

SEQ ID NO: 6543 - DNA, 20 bp, Homo sapiens
tggttcgctctacatcttct

SEQ ID NO: 6544 - DNA, 20 bp, Homo sapiens
acctacaggaagagacaggg

SEQ ID NO: 6545 - DNA, 20 bp, Homo sapiens
tcagtcgtgatgtctcagtc

SEQ ID NO: 6546 - DNA, 21 bp, Homo sapiens
tataggcatctgccgctacgc

SEQ ID NO: 6547 - DNA, 22 bp, Homo sapiens
taatactgcctgggccactaca

SEQ ID NO: 6548 - DNA, 22 bp, Homo sapiens
acacactttgctccttcatgac

SEQ ID NO: 6549 - DNA, 23 bp, Homo sapiens
tactgacccactgggcacagagg

SEQ ID NO: 6550 - DNA, 23 bp, Homo sapiens
cgatcgtatgttgtggcaatgca

SEQ ID NO: 6551 - DNA, 22 bp, Homo sapiens
aagcaccatacagtgctgacgc

SEQ ID NO: 6552 - DNA, 22 bp, Homo sapiens
tggcagcacctagcagctgtgc

SEQ ID NO: 6553 - DNA, 22 bp, Homo sapiens
attcacggtaagaagatttaag

SEQ ID NO: 6554 - DNA, 21 bp, Homo sapiens
agcagcatcactgtccttact

SEQ ID NO: 6555 - DNA, 24 bp, Homo sapiens
gaatggcttggcttgttaatgagt

SEQ ID NO: 6556 - DNA, 24 bp, Homo sapiens
tccctgagacccttacacagtgtg

SEQ ID NO: 6557 - DNA, 22 bp, Homo sapiens
aatgtaggcgacggcagtctgg

SEQ ID NO: 6558 - DNA, 22 bp, Homo sapiens
cacatgggcttgcatgaacatg

SEQ ID NO: 6559 - DNA, 22 bp, Homo sapiens
caacggaatcccaaaagggcag

SEQ ID NO: 6560 - DNA, 22 bp, Homo sapiens
tatatgatactcattatgcata

SEQ ID NO: 6561 - DNA, 23 bp, Homo sapiens
acgctcacactgtacttcgtgat

SEQ ID NO: 6562 - DNA, 20 bp, Homo sapiens
cggatgacttgtggataatt

SEQ ID NO: 6563 - DNA, 22 bp, Homo sapiens
tagaggcctgagtgtcctggtg

SEQ ID NO: 6564 - DNA, 23 bp, Homo sapiens
caatctgagtcagcaggaggtca

SEQ ID NO: 6565 - DNA, 22 bp, Homo sapiens
tgggagagaccagcacttgtta

SEQ ID NO: 6566 - DNA, 22 bp, Homo sapiens
tccctgagaccctttacaggag

SEQ ID NO: 6567 - DNA, 22 bp, Homo sapiens
caagccttgggggttagcagct

SEQ ID NO: 6568 - DNA, 20 bp, Homo sapiens
cagcaattgatcatggactg

SEQ ID NO: 6569 - DNA, 22 bp, Homo sapiens
tcgatgtacactgggctttgca

SEQ ID NO: 6570 - DNA, 22 bp, Homo sapiens
ttgtacattcatcactttgtaa

SEQ ID NO: 6571 - DNA, 22 bp, Homo sapiens
ttgttcagtaagaggatgaacc

SEQ ID NO: 6572 - DNA, 21 bp, Homo sapiens
gtccagttttcccagcgcgag

SEQ ID NO: 6573 - DNA, 20 bp, Homo sapiens
gggcgccacaactgcggtgc

SEQ ID NO: 6574 - DNA, 22 bp, Homo sapiens
cactgcacacagtggcgtccca

SEQ ID NO: 6575 - DNA, 23 bp, Homo sapiens
tagctcatcagactgcggtttgt

SEQ ID NO: 6576 - DNA, 24 bp, Homo sapiens
agtgggcgctgagagatgccgctc

SEQ ID NO: 6577 - DNA, 21 bp, Homo sapiens
tcaagtccctgtgtagggtgt

SEQ ID NO: 6578 - DNA, 23 bp, Homo sapiens
tggctcagaagtgcaggcacagt

SEQ ID NO: 6579 - DNA, 21 bp, Homo sapiens
aggggcatctaggctcaggag

SEQ ID NO: 6580 - DNA, 22 bp, Homo sapiens
aagtcatttccaggagcccttg

SEQ ID NO: 6581 - DNA, 20 bp, Homo sapiens
gactggccgcccgtgttcac

SEQ ID NO: 6582 - DNA, 20 bp, Homo sapiens
agctggcagcaaggttcttg

SEQ ID NO: 6583 - DNA, 22 bp, Homo sapiens
tgtactgggtgacggccttggt

SEQ ID NO: 6584 - DNA, 21 bp, Homo sapiens
tgtcatactcatcagcaccaa

SEQ ID NO: 6585 - DNA, 21 bp, Homo sapiens
cacgctgtctatgtcacgggc

SEQ ID NO: 6586 - DNA, 22 bp, Homo sapiens
atcacattgccaggtttggaag

SEQ ID NO: 6587 - DNA, 20 bp, Homo sapiens
taggactttggcatacgaat

SEQ ID NO: 6588 - DNA, 20 bp, Homo sapiens
ctttcactcagatcaaacgt

SEQ ID NO: 6589 - DNA, 22 bp, Homo sapiens
aggttaatacctaattcagact

SEQ ID NO: 6590 - DNA, 24 bp, Homo sapiens
tgcaagtggcttctgatagatagc

SEQ ID NO: 6591 - DNA, 20 bp, Homo sapiens
cccacgggagctccctcaca

SEQ ID NO: 6592 - DNA, 21 bp, Homo sapiens
accaatggcaagttactcagt

SEQ ID NO: 6593 - DNA, 22 bp, Homo sapiens
tagcagctgtgcaaatattttg

SEQ ID NO: 6594 - DNA, 22 bp, Homo sapiens
cagtgcaattggccaagttatg

SEQ ID NO: 6595 - DNA, 20 bp, Homo sapiens
tggactacagatgtaactgg

SEQ ID NO: 6596 - DNA, 21 bp, Homo sapiens
cagagggctgagtcagaccag

SEQ ID NO: 6597 - DNA, 21 bp, Homo sapiens
tccccagtacctccacatgtg

SEQ ID NO: 6598 - DNA, 20 bp, Homo sapiens
ccagaggagctgggggttac

SEQ ID NO: 6599 - DNA, 22 bp, Homo sapiens
atcacatgtaactaagccagta

SEQ ID NO: 6600 - DNA, 23 bp, Homo sapiens
agcagcaagtgctgatttcgcac

SEQ ID NO: 6601 - DNA, 21 bp, Homo sapiens
ttgggctctagggccttgttg

SEQ ID NO: 6602 - DNA, 20 bp, Homo sapiens
tagcaccaaaactttacatg

SEQ ID NO: 6603 - DNA, 20 bp, Homo sapiens
taaagtctcaaagctgagtg

SEQ ID NO: 6604 - DNA, 22 bp, Homo sapiens
acatgacccactgggctaaaac

SEQ ID NO: 6605 - DNA, 21 bp, Homo sapiens
gtctcactgcttggtgatagt

SEQ ID NO: 6606 - DNA, 23 bp, Homo sapiens
agcagcattgtttgaaactccct

SEQ ID NO: 6607 - DNA, 24 bp, Homo sapiens
tagcccactgagtcagcatcattc

SEQ ID NO: 6608 - DNA, 22 bp, Homo sapiens
gatgtcatgacactatcctaaa

SEQ ID NO: 6609 - DNA, 23 bp, Homo sapiens
acagttgatgtcaaatacgggtt

SEQ ID NO: 6610 - DNA, 20 bp, Homo sapiens
aaccacctgatcccagaaat

SEQ ID NO: 6611 - DNA, 22 bp, Homo sapiens
cataatttaccgaaggcccttg

SEQ ID NO: 6612 - DNA, 21 bp, Homo sapiens
ctgcggcatctgccgccgtag

SEQ ID NO: 6613 - DNA, 20 bp, Homo sapiens
atttgtgtgtggatgtgtgt

SEQ ID NO: 6614 - DNA, 20 bp, Homo sapiens
acaggagatagtcaacgtct

SEQ ID NO: 6615 - DNA, 21 bp, Homo sapiens
agcatggcactcattgactta

SEQ ID NO: 6616 - DNA, 22 bp, Homo sapiens
aagggcaatggtatactgtgtt

SEQ ID NO: 6617 - DNA, 22 bp, Homo sapiens
ggcggcggcggcggtcccgccc

SEQ ID NO: 6618 - DNA, 21 bp, Homo sapiens
aacctctgtggctgtggtgtc

SEQ ID NO: 6619 - DNA, 20 bp, Homo sapiens
tagcagcacgcgttatacaa

SEQ ID NO: 6620 - DNA, 23 bp, Homo sapiens
tattcatagtacagtgtcttgca

SEQ ID NO: 6621 - DNA, 21 bp, Homo sapiens
agcagcatgacactattttga

SEQ ID NO: 6622 - DNA, 22 bp, Homo sapiens
gaatcagagtaagccaggtaga

SEQ ID NO: 6623 - DNA, 22 bp, Homo sapiens
tctcacaatgtcacatacaaac

SEQ ID NO: 6624 - DNA, 23 bp, Homo sapiens
aaatgtctgaaataccactacga

SEQ ID NO: 6625 - DNA, 20 bp, Homo sapiens
gcattggtggtccagtggga

SEQ ID NO: 6626 - DNA, 22 bp, Homo sapiens
atatactagtgacactaaaaaa

SEQ ID NO: 6627 - DNA, 23 bp, Homo sapiens
tagcttatcagacagggtcttag

SEQ ID NO: 6628 - DNA, 21 bp, Homo sapiens
agcagtttgtgttgctttcca

SEQ ID NO: 6629 - DNA, 20 bp, Homo sapiens
cctaatcagaggctactgtc

SEQ ID NO: 6630 - DNA, 21 bp, Homo sapiens
cagtgcaattggaaaagcagg

SEQ ID NO: 6631 - DNA, 23 bp, Homo sapiens
tgtatcagttcatacttccattg

SEQ ID NO: 6632 - DNA, 23 bp, Homo sapiens
tcaggctcagtaaacgaaatggg

SEQ ID NO: 6633 - DNA, 21 bp, Homo sapiens
atgacctatgaatgtccagtg

SEQ ID NO: 6634 - DNA, 23 bp, Homo sapiens
aaactgtggattcagcaataaat

SEQ ID NO: 6635 - DNA, 22 bp, Homo sapiens
gcccgttgccagactggcctgg

SEQ ID NO: 6636 - DNA, 21 bp, Homo sapiens
gatactatgacactatgtcag

SEQ ID NO: 6637 - DNA, 20 bp, Homo sapiens
gacctgatgctgctggagct

SEQ ID NO: 6638 - DNA, 22 bp, Homo sapiens
tagcttatcagacctagtggtc

SEQ ID NO: 6639 - DNA, 21 bp, Homo sapiens
cggagaagatgtggggggcgg

SEQ ID NO: 6640 - DNA, 23 bp, Homo sapiens
cgataatatctcacaatccctca

SEQ ID NO: 6641 - DNA, 20 bp, Homo sapiens
gtgacctattttaactgtat

SEQ ID NO: 6642 - DNA, 20 bp, Homo sapiens
gtccccggcacctcaacctg

SEQ ID NO: 6643 - DNA, 22 bp, Homo sapiens
tgtcagtttgtcaaagcagaac

SEQ ID NO: 6644 - DNA, 22 bp, Homo sapiens
gaaagtctcaaagtcaggtgac

SEQ ID NO: 6645 - DNA, 23 bp, Homo sapiens
atcgtcaaaaggggccttaaaag

SEQ ID NO: 6646 - DNA, 21 bp, Homo sapiens
aggcaagatgctggctatgga

SEQ ID NO: 6647 - DNA, 20 bp, Homo sapiens
ctcaggataaggccagtgaa

SEQ ID NO: 6648 - DNA, 22 bp, Homo sapiens
tgattcattaggtttatagggc

SEQ ID NO: 6649 - DNA, 23 bp, Homo sapiens
tggagacccctcttgccaacaca

SEQ ID NO: 6650 - DNA, 20 bp, Homo sapiens
tccccagtacctccactagg

SEQ ID NO: 6651 - DNA, 23 bp, Homo sapiens
ggtactggggaaacttccaaaag

SEQ ID NO: 6652 - DNA, 22 bp, Homo sapiens
tagcaccatttgactatctaca

SEQ ID NO: 6653 - DNA, 21 bp, Homo sapiens
tctcacagtggaacatggtca

SEQ ID NO: 6654 - DNA, 20 bp, Homo sapiens
tatccaatatggcagtccac

SEQ ID NO: 6655 - DNA, 20 bp, Homo sapiens
gcccggctagctcagctttg

SEQ ID NO: 6656 - DNA, 23 bp, Homo sapiens
tggcagtttgagtaataccaacc

SEQ ID NO: 6657 - DNA, 22 bp, Homo sapiens
accaccaccatcagcaccacgg

SEQ ID NO: 6658 - DNA, 20 bp, Homo sapiens
agacactgttagcctcaatg

SEQ ID NO: 6659 - DNA, 22 bp, Homo sapiens
tctgactctgggatcattgtct

SEQ ID NO: 6660 - DNA, 23 bp, Homo sapiens
caatctgctttgagtcctcaatc

SEQ ID NO: 6661 - DNA, 23 bp, Homo sapiens
ttgcttatcactacatctccagt

SEQ ID NO: 6662 - DNA, 20 bp, Homo sapiens
tcatgttgcccagggttgag

SEQ ID NO: 6663 - DNA, 20 bp, Homo sapiens
aggcaagatgctggcccctc

SEQ ID NO: 6664 - DNA, 22 bp, Homo sapiens
ttacctgggcttgatctgatag

SEQ ID NO: 6665 - DNA, 22 bp, Homo sapiens
tagcagcagcataaataacata

SEQ ID NO: 6666 - DNA, 24 bp, Homo sapiens
tagcttataggatcagagagttga

SEQ ID NO: 6667 - DNA, 22 bp, Homo sapiens
tagtgattgccagggattactc

SEQ ID NO: 6668 - DNA, 23 bp, Homo sapiens
tccctatacactgtggcaggctg

SEQ ID NO: 6669 - DNA, 20 bp, Homo sapiens
agccagagcatcaatggatt

SEQ ID NO: 6670 - DNA, 22 bp, Homo sapiens
tgctagggagacgaggaacatg

SEQ ID NO: 6671 - DNA, 21 bp, Homo sapiens
gtactcaaaagggtccttagt

SEQ ID NO: 6672 - DNA, 21 bp, Homo sapiens
acactatcttcccgaggtggt

SEQ ID NO: 6673 - DNA, 22 bp, Homo sapiens
cttggtgatgtctaacctgaaa

SEQ ID NO: 6674 - DNA, 22 bp, Homo sapiens
actcagtttgtcaatattttgt

SEQ ID NO: 6675 - DNA, 22 bp, Homo sapiens
taactgagacaagccaagtgtc

SEQ ID NO: 6676 - DNA, 20 bp, Homo sapiens
attcatacagtagccatttg

SEQ ID NO: 6677 - DNA, 20 bp, Homo sapiens
gcagaagcgcatacggtgtg

SEQ ID NO: 6678 - DNA, 22 bp, Homo sapiens
cgcgccgctgcgagggagggct

SEQ ID NO: 6679 - DNA, 23 bp, Homo sapiens
tgccagtcaagctactctgtgag

SEQ ID NO: 6680 - DNA, 22 bp, Homo sapiens
tgtctgggctggtttatggggt

SEQ ID NO: 6681 - DNA, 21 bp, Homo sapiens
ggaaccaaaagggtccttgga

SEQ ID NO: 6682 - DNA, 23 bp, Homo sapiens
aggaggagggaatctggaagttt

SEQ ID NO: 6683 - DNA, 20 bp, Homo sapiens
catacatgtttatcagatca

SEQ ID NO: 6684 - DNA, 21 bp, Homo sapiens
caaaggtgccgtgtgattatg

SEQ ID NO: 6685 - DNA, 20 bp, Homo sapiens
aaagtgctataggaatttat

SEQ ID NO: 6686 - DNA, 22 bp, Homo sapiens
tactgatggtgctttatgggga

SEQ ID NO: 6687 - DNA, 21 bp, Homo sapiens
gaaaaagtcatggaaatgttg

SEQ ID NO: 6688 - DNA, 20 bp, Homo sapiens
tactgcagttgaacatgatc

SEQ ID NO: 6689 - DNA, 21 bp, Homo sapiens
ctagaagatctgttcctcagg

SEQ ID NO: 6690 - DNA, 22 bp, Homo sapiens
tgaccattctgtctctttagga

SEQ ID NO: 6691 - DNA, 22 bp, Homo sapiens
tgctacattgtcaaataattta

SEQ ID NO: 6692 - DNA, 23 bp, Homo sapiens
caaagttcttacctgttgagtaa

SEQ ID NO: 6693 - DNA, 22 bp, Homo sapiens
attgcatgtaactagatttcgt

SEQ ID NO: 6694 - DNA, 22 bp, Homo sapiens
actttcgaagagatatgttgca

SEQ ID NO: 6695 - DNA, 21 bp, Homo sapiens
gactcttagattgtagatgtc

SEQ ID NO: 6696 - DNA, 22 bp, Homo sapiens
agctacattgtcaatatggtag

SEQ ID NO: 6697 - DNA, 21 bp, Homo sapiens
gatggcatagtttgggcatac

SEQ ID NO: 6698 - DNA, 22 bp, Homo sapiens
ttacctgggcttagctaagggt

SEQ ID NO: 6699 - DNA, 20 bp, Homo sapiens
aaattgaaggtaacatgttg

SEQ ID NO: 6700 - DNA, 22 bp, Homo sapiens
agctgacaagtctttataaaac

SEQ ID NO: 6701 - DNA, 22 bp, Homo sapiens
ctaatggctgagatttaatgag

SEQ ID NO: 6702 - DNA, 22 bp, Homo sapiens
agggggaacccttgtacactgt

SEQ ID NO: 6703 - DNA, 24 bp, Homo sapiens
cacgtgaaaccctgtctctgctaa

SEQ ID NO: 6704 - DNA, 22 bp, Homo sapiens
tctattttctcctgacctgcca

SEQ ID NO: 6705 - DNA, 20 bp, Homo sapiens
taggaatagtctgacttgtg

SEQ ID NO: 6706 - DNA, 20 bp, Homo sapiens
atcacattgccaggaaatgg

SEQ ID NO: 6707 - DNA, 22 bp, Homo sapiens
gtctgacggctcaggataggac

SEQ ID NO: 6708 - DNA, 20 bp, Homo sapiens
tcctcggcgcgcggcggctg

SEQ ID NO: 6709 - DNA, 21 bp, Homo sapiens
tgtccgctgcttggtgtctgg

SEQ ID NO: 6710 - DNA, 22 bp, Homo sapiens
tccctgctaggagctgaacact

SEQ ID NO: 6711 - DNA, 21 bp, Homo sapiens
cattatttagaagttgcatat

SEQ ID NO: 6712 - DNA, 21 bp, Homo sapiens
agcggtcatcaaagcactact

SEQ ID NO: 6713 - DNA, 21 bp, Homo sapiens
aacaatctcctttagaacact

SEQ ID NO: 6714 - DNA, 20 bp, Homo sapiens
ggaacgtagctaggaattta

SEQ ID NO: 6715 - DNA, 20 bp, Homo sapiens
ccgttagaaatatgaacaaa

SEQ ID NO: 6716 - DNA, 22 bp, Homo sapiens
agcagcaatgcataggactcaa

SEQ ID NO: 6717 - DNA, 21 bp, Homo sapiens
gtcctcagaggctattgtttc

SEQ ID NO: 6718 - DNA, 21 bp, Homo sapiens
ataatttaacaaaagaaacat

SEQ ID NO: 6719 - DNA, 23 bp, Homo sapiens
tggctcagggactgcttcgagga

SEQ ID NO: 6720 - DNA, 22 bp, Homo sapiens
cagctgctgtctgactgcaact

SEQ ID NO: 6721 - DNA, 20 bp, Homo sapiens
tgtaacagcagtcttaaaag

SEQ ID NO: 6722 - DNA, 21 bp, Homo sapiens
tcagttctcaggccagtgggt

SEQ ID NO: 6723 - DNA, 20 bp, Homo sapiens
agattccgggagaaagaaaa

SEQ ID NO: 6724 - DNA, 22 bp, Homo sapiens
ttagcaattgagtttattttta

SEQ ID NO: 6725 - DNA, 21 bp, Homo sapiens
ggatgaacatcaaataccaca

SEQ ID NO: 6726 - DNA, 21 bp, Homo sapiens
taatgatgtgctgcataactt

SEQ ID NO: 6727 - DNA, 20 bp, Homo sapiens
tagaaccatttgaattcagt

SEQ ID NO: 6728 - DNA, 24 bp, Homo sapiens
tatttttttaattttacttatttt

SEQ ID NO: 6729 - DNA, 20 bp, Homo sapiens
atcccactcctgacaactga

SEQ ID NO: 6730 - DNA, 22 bp, Homo sapiens
cctggacggcttgatatgactg

SEQ ID NO: 6731 - DNA, 22 bp, Homo sapiens
tatatcttactgctgtttgttg

SEQ ID NO: 6732 - DNA, 23 bp, Homo sapiens
ctctttggacagtttatggggtt

SEQ ID NO: 6733 - DNA, 22 bp, Homo sapiens
tttcagtttgtaccattgtttg

SEQ ID NO: 6734 - DNA, 21 bp, Homo sapiens
ctactacatgcccagaactat

SEQ ID NO: 6735 - DNA, 21 bp, Homo sapiens
gcttggttttcccaggaaaaa

SEQ ID NO: 6736 - DNA, 21 bp, Homo sapiens
agcagcaacagccaggaatcc

SEQ ID NO: 6737 - DNA, 22 bp, Homo sapiens
tcagtcattgtcaaatactcca

SEQ ID NO: 6738 - DNA, 22 bp, Homo sapiens
tgcagatgactgatagtcagct

SEQ ID NO: 6739 - DNA, 22 bp, Homo sapiens
acagtatgagcgtgaaaccaat

SEQ ID NO: 6740 - DNA, 20 bp, Homo sapiens
agattgaagcggtaatttgt

SEQ ID NO: 6741 - DNA, 20 bp, Homo sapiens
ccatacaaattaccgcttca

SEQ ID NO: 6742 - DNA, 22 bp, Homo sapiens
tgactcaggctttcaggctgtc

SEQ ID NO: 6743 - DNA, 21 bp, Homo sapiens
tagcaccatctctctagcgct

SEQ ID NO: 6744 - DNA, 22 bp, Homo sapiens
ttctttggtttcctgcaacttt

SEQ ID NO: 6745 - DNA, 21 bp, Homo sapiens
acatgctgagtacaggtggcc

SEQ ID NO: 6746 - DNA, 22 bp, Homo sapiens
tacctgagaccctttagtgtgt

SEQ ID NO: 6747 - DNA, 22 bp, Homo sapiens
agatgtcataggaatagctgat

SEQ ID NO: 6748 - DNA, 22 bp, Homo sapiens
ctcacattgccagaagctacca

SEQ ID NO: 6749 - DNA, 23 bp, Homo sapiens
agcaatgctcaggctagagtaca

SEQ ID NO: 6750 - DNA, 22 bp, Homo sapiens
tccctctctgtgatgaaacact

SEQ ID NO: 6751 - DNA, 20 bp, Homo sapiens
gctttgttatcatacaacat

SEQ ID NO: 6752 - DNA, 21 bp, Homo sapiens
aactagttttattgcacaagt

SEQ ID NO: 6753 - DNA, 22 bp, Homo sapiens
ttgactattaggtttataggct

SEQ ID NO: 6754 - DNA, 21 bp, Homo sapiens
atccagttttcccagattagt

SEQ ID NO: 6755 - DNA, 22 bp, Homo sapiens
actctagtctgcaagccaaaat

SEQ ID NO: 6756 - DNA, 22 bp, Homo sapiens
gatcagaaattcggtttccatc

SEQ ID NO: 6757 - DNA, 22 bp, Homo sapiens
tacactgtcaacctagcaaagt

SEQ ID NO: 6758 - DNA, 21 bp, Homo sapiens
tgagatgactacagtggcagg

SEQ ID NO: 6759 - DNA, 23 bp, Homo sapiens
agtttaaactttatggtgatgag

SEQ ID NO: 6760 - DNA, 22 bp, Homo sapiens
ttcactgttagtctgataggct

SEQ ID NO: 6761 - DNA, 22 bp, Homo sapiens
gaggaatatgagtcagcagaga

SEQ ID NO: 6762 - DNA, 22 bp, Homo sapiens
attgcaatgctctaataattgc

SEQ ID NO: 6763 - DNA, 22 bp, Homo sapiens
tagcagcatgtaaaatattgga

SEQ ID NO: 6764 - DNA, 21 bp, Homo sapiens
gggctagctttcctctgattt

SEQ ID NO: 6765 - DNA, 23 bp, Homo sapiens
ctacctgcactataagcacttta

SEQ ID NO: 6766 - DNA, 20 bp, Homo sapiens
agtggttaatacgtcttcct

SEQ ID NO: 6767 - DNA, 23 bp, Homo sapiens
gcaatgcatcagactgatatttc

SEQ ID NO: 6768 - DNA, 21 bp, Homo sapiens
ataaacagaagtcacaacaga

SEQ ID NO: 6769 - DNA, 23 bp, Homo sapiens
taggaatatgctgtgatgatcat

SEQ ID NO: 6770 - DNA, 22 bp, Homo sapiens
tgtaccacgtgatgtatcagga

SEQ ID NO: 6771 - DNA, 20 bp, Homo sapiens
tactggatagaattgtcaga

SEQ ID NO: 6772 - DNA, 23 bp, Homo sapiens
tctacacactggggatacaaatg

SEQ ID NO: 6773 - DNA, 20 bp, Homo sapiens
actccaccgctgccaccatt

SEQ ID NO: 6774 - DNA, 22 bp, Homo sapiens
tatagtagactgctgagtgcat

SEQ ID NO: 6775 - DNA, 23 bp, Homo sapiens
tggcaataacatggtatgcccac

SEQ ID NO: 6776 - DNA, 22 bp, Homo sapiens
tatagaatttcaggctgggaag

SEQ ID NO: 6777 - DNA, 20 bp, Homo sapiens
ctgacctataggaactgtgg

SEQ ID NO: 6778 - DNA, 20 bp, Homo sapiens
cccagcccttagaactgtga

SEQ ID NO: 6779 - DNA, 22 bp, Homo sapiens
gtacagtaatccaggagctgct

SEQ ID NO: 6780 - DNA, 22 bp, Homo sapiens
agggactctgagatccttgtga

SEQ ID NO: 6781 - DNA, 23 bp, Homo sapiens
acacgtcatccatgcacccactg

SEQ ID NO: 6782 - DNA, 20 bp, Homo sapiens
tttttaactgctaaagcact

SEQ ID NO: 6783 - DNA, 23 bp, Homo sapiens
gagaaaccattccacgtgggtga

SEQ ID NO: 6784 - DNA, 22 bp, Homo sapiens
gatcagagctcactcagatccg

SEQ ID NO: 6785 - DNA, 22 bp, Homo sapiens
tcctttgcaaagacagtcagtg

SEQ ID NO: 6786 - DNA, 20 bp, Homo sapiens
gctaaaggatattttgggtt

SEQ ID NO: 6787 - DNA, 22 bp, Homo sapiens
cgcacattgccagggatttctg

SEQ ID NO: 6788 - DNA, 22 bp, Homo sapiens
cccagtcaagtctgatgagatg

SEQ ID NO: 6789 - DNA, 22 bp, Homo sapiens
tggctcagttcagtaggacaga

SEQ ID NO: 6790 - DNA, 21 bp, Homo sapiens
gcgctttctatgattttttgc

SEQ ID NO: 6791 - DNA, 21 bp, Homo sapiens
caaagtgctatgtcatacctc

SEQ ID NO: 6792 - DNA, 21 bp, Homo sapiens
agcagccggtgcactggaaga

SEQ ID NO: 6793 - DNA, 21 bp, Homo sapiens
aggtgcatgtggcttcaaatc

SEQ ID NO: 6794 - DNA, 20 bp, Homo sapiens
ttgctatttgtgatactgga

SEQ ID NO: 6795 - DNA, 22 bp, Homo sapiens
gtgagacccactgctatggggt

SEQ ID NO: 6796 - DNA, 23 bp, Homo sapiens
agaggccaaggcgcaacagcaga

SEQ ID NO: 6797 - DNA, 23 bp, Homo sapiens
tcttatggagcttaggtcctgtc

SEQ ID NO: 6798 - DNA, 22 bp, Homo sapiens
cgtgactctgagctgagtgacc

SEQ ID NO: 6799 - DNA, 22 bp, Homo sapiens
agcatgtgcagacggcggtgcg

SEQ ID NO: 6800 - DNA, 23 bp, Homo sapiens
aaggaatatgctgtgatgaaaac

SEQ ID NO: 6801 - DNA, 23 bp, Homo sapiens
caaagtgctggtattgcagacgt

SEQ ID NO: 6802 - DNA, 20 bp, Homo sapiens
aatctcaagcaataactttg

SEQ ID NO: 6803 - DNA, 21 bp, Homo sapiens
aggcagatgaagtaatccaga

SEQ ID NO: 6804 - DNA, 20 bp, Homo sapiens
aacgcaggtgtcctgtctgc

SEQ ID NO: 6805 - DNA, 23 bp, Homo sapiens
tggagacacctgatgaaacatca

SEQ ID NO: 6806 - DNA, 22 bp, Homo sapiens
gcatacgtaactcagtggatgg

SEQ ID NO: 6807 - DNA, 20 bp, Homo sapiens
gatgcaatgtctattcagca

SEQ ID NO: 6808 - DNA, 22 bp, Homo sapiens
cttgcctatcctggggatgttt

SEQ ID NO: 6809 - DNA, 22 bp, Homo sapiens
ttctgataatgacttatgaaaa

SEQ ID NO: 6810 - DNA, 20 bp, Homo sapiens
gaggggggaccaaaaaaccc

SEQ ID NO: 6811 - DNA, 22 bp, Homo sapiens
cctgagtaatccaggataatct

SEQ ID NO: 6812 - DNA, 21 bp, Homo sapiens
ctgtagtggggtacttgtggt

SEQ ID NO: 6813 - DNA, 22 bp, Homo sapiens
ctaagtctcagctactccacag

SEQ ID NO: 6814 - DNA, 20 bp, Homo sapiens
ccatcgccaggcagtacttg

SEQ ID NO: 6815 - DNA, 23 bp, Homo sapiens
ggaaagttttcccaggaagaaag

SEQ ID NO: 6816 - DNA, 21 bp, Homo sapiens
ggttcagtttgcttcaccaat

SEQ ID NO: 6817 - DNA, 20 bp, Homo sapiens
gaatggagcatcacgaagct

SEQ ID NO: 6818 - DNA, 22 bp, Homo sapiens
cactgcaatgtcattatggcat

SEQ ID NO: 6819 - DNA, 23 bp, Homo sapiens
atcaaatagtctgtggcaggagt

SEQ ID NO: 6820 - DNA, 22 bp, Homo sapiens
gtcatgggcttggtatgtgttt

SEQ ID NO: 6821 - DNA, 22 bp, Homo sapiens
tgaggttcatctggtttgttga

SEQ ID NO: 6822 - DNA, 20 bp, Homo sapiens
gctcaaacatcacgacaggc

SEQ ID NO: 6823 - DNA, 23 bp, Homo sapiens
ggcctgtatcatattcgacaggt

SEQ ID NO: 6824 - DNA, 20 bp, Homo sapiens
aaagcaagctgttcttccct

SEQ ID NO: 6825 - DNA, 22 bp, Homo sapiens
agttcttcagtgatagatccct

SEQ ID NO: 6826 - DNA, 22 bp, Homo sapiens
tgaggcaggcctgactatagtt

SEQ ID NO: 6827 - DNA, 22 bp, Homo sapiens
cagcagcacattgcaaaagcac

SEQ ID NO: 6828 - DNA, 20 bp, Homo sapiens
agcatgctgagagctacccc

SEQ ID NO: 6829 - DNA, 23 bp, Homo sapiens
catactaaatgcaaatgttttgc

SEQ ID NO: 6830 - DNA, 20 bp, Homo sapiens
attttaatgctcttgttgaa

SEQ ID NO: 6831 - DNA, 20 bp, Homo sapiens
agcagcattgcataggtagc

SEQ ID NO: 6832 - DNA, 21 bp, Homo sapiens
agggaagccagctcccacaca

SEQ ID NO: 6833 - DNA, 22 bp, Homo sapiens
tggcagctgctatagcgtgggc

SEQ ID NO: 6834 - DNA, 21 bp, Homo sapiens
gtccagtgaagggtccttgga

SEQ ID NO: 6835 - DNA, 23 bp, Homo sapiens
tgaggttcatggttgttaagtta

SEQ ID NO: 6836 - DNA, 20 bp, Homo sapiens
gatgccaagaagcaacctcc

SEQ ID NO: 6837 - DNA, 22 bp, Homo sapiens
ctgacctataggccacattcaa

SEQ ID NO: 6838 - DNA, 20 bp, Homo sapiens
gtcgggcacctgcacacact

SEQ ID NO: 6839 - DNA, 23 bp, Homo sapiens
cagcctagcattttaaattttga

SEQ ID NO: 6840 - DNA, 22 bp, Homo sapiens
tgagtcaaacctgggcgggggt

SEQ ID NO: 6841 - DNA, 22 bp, Homo sapiens
ctttccacggcagtagctcctg

SEQ ID NO: 6842 - DNA, 22 bp, Homo sapiens
tgcactgaaagatgaccttcaa

SEQ ID NO: 6843 - DNA, 20 bp, Homo sapiens
taaaggtgccgtgtgatgaa

SEQ ID NO: 6844 - DNA, 20 bp, Homo sapiens
aaatactgtggtcatatcgt

SEQ ID NO: 6845 - DNA, 20 bp, Homo sapiens
cgggggtctgcgccatttgg

SEQ ID NO: 6846 - DNA, 23 bp, Homo sapiens
tgtgcaaacccatgcacccactc

SEQ ID NO: 6847 - DNA, 21 bp, Homo sapiens
aaaccgttacgtggctcatca

SEQ ID NO: 6848 - DNA, 20 bp, Homo sapiens
taaaatatgctcttgtgtga

SEQ ID NO: 6849 - DNA, 20 bp, Homo sapiens
gaggcgggtgcctccgccct

SEQ ID NO: 6850 - DNA, 21 bp, Homo sapiens
agcggctgtaccaccagccac

SEQ ID NO: 6851 - DNA, 20 bp, Homo sapiens
gccggggctgggatgcgggc

SEQ ID NO: 6852 - DNA, 23 bp, Homo sapiens
cccctccccgcccctcgcggctc

SEQ ID NO: 6853 - DNA, 22 bp, Homo sapiens
tcctcctccccgcgcccccgcc

SEQ ID NO: 6854 - DNA, 21 bp, Homo sapiens
gctgtgccattgaacttagca

SEQ ID NO: 6855 - DNA, 22 bp, Homo sapiens
actgaacccactgggcgtttta

SEQ ID NO: 6856 - DNA, 22 bp, Homo sapiens
agctcctcgagtggagagagtc

SEQ ID NO: 6857 - DNA, 20 bp, Homo sapiens
gcgcgggccggtcccccccg

SEQ ID NO: 6858 - DNA, 22 bp, Homo sapiens
atcaacggattgaaacttgaac

SEQ ID NO: 6859 - DNA, 23 bp, Homo sapiens
agcagcaccctttgaaggatcct

SEQ ID NO: 6860 - DNA, 22 bp, Homo sapiens
gaggactctgggatactcacag

SEQ ID NO: 6861 - DNA, 20 bp, Homo sapiens
gacgctgaagcctcttgcta

SEQ ID NO: 6862 - DNA, 20 bp, Homo sapiens
cacgtgacaccagtatagca

SEQ ID NO: 6863 - DNA, 23 bp, Homo sapiens
cagtcggtcctgcggtgaccctg

SEQ ID NO: 6864 - DNA, 22 bp, Homo sapiens
tccctctctccagccaggtgtc

SEQ ID NO: 6865 - DNA, 20 bp, Homo sapiens
cgacaaactatcagaacttc

SEQ ID NO: 6866 - DNA, 22 bp, Homo sapiens
gcagcagcagaggcacactgac

SEQ ID NO: 6867 - DNA, 21 bp, Homo sapiens
catggcgaaggcccgctccac

SEQ ID NO: 6868 - DNA, 23 bp, Homo sapiens
tgaactgggctttgaaggatttc

SEQ ID NO: 6869 - DNA, 22 bp, Homo sapiens
cactaaggcactgggcgtggct

SEQ ID NO: 6870 - DNA, 21 bp, Homo sapiens
tgggaagaatcctgggaaaga

SEQ ID NO: 6871 - DNA, 22 bp, Homo sapiens
gggtcggtcgggctgggcaggg

SEQ ID NO: 6872 - DNA, 21 bp, Homo sapiens
ttgacctctggcactgtcaat

SEQ ID NO: 6873 - DNA, 22 bp, Homo sapiens
atgttggaggtcagacctggtg

SEQ ID NO: 6874 - DNA, 20 bp, Homo sapiens
atccattgaagccttgctat

SEQ ID NO: 6875 - DNA, 20 bp, Homo sapiens
tcggcggcacctccacaccc

SEQ ID NO: 6876 - DNA, 22 bp, Homo sapiens
gcgcccaggcggcggaggggcc

SEQ ID NO: 6877 - DNA, 22 bp, Homo sapiens
tgcagacgtcacagcggtaggg

SEQ ID NO: 6878 - DNA, 21 bp, Homo sapiens
tgcaggagagacactgagagt

SEQ ID NO: 6879 - DNA, 23 bp, Homo sapiens
atatatatgtgaaaatgttttgg

SEQ ID NO: 6880 - DNA, 20 bp, Homo sapiens
cccggggccgagggagctgg

SEQ ID NO: 6881 - DNA, 20 bp, Homo sapiens
cctcttgcccatggcatggg

SEQ ID NO: 6882 - DNA, 22 bp, Homo sapiens
taggactctgggatcagctgtg

SEQ ID NO: 6883 - DNA, 22 bp, Homo sapiens
cagtgcaatcaaaaccttcaag

SEQ ID NO: 6884 - DNA, 22 bp, Homo sapiens
gctactatgcccagctatccac

SEQ ID NO: 6885 - DNA, 20 bp, Homo sapiens
actggacttggagtcaagac

SEQ ID NO: 6886 - DNA, 22 bp, Homo sapiens
ttctaggaggtatatatttgct

SEQ ID NO: 6887 - DNA, 20 bp, Homo sapiens
tctggccctgctccctacag

SEQ ID NO: 6888 - DNA, 23 bp, Homo sapiens
tattgctcagtaaagagggctaa

SEQ ID NO: 6889 - DNA, 22 bp, Homo sapiens
tgagtgtttactaaataaaggt

SEQ ID NO: 6890 - DNA, 23 bp, Homo sapiens
tttgcaaatctgcatgcccagtg

SEQ ID NO: 6891 - DNA, 22 bp, Homo sapiens
ccttgcatctaggcttctgaat

SEQ ID NO: 6892 - DNA, 22 bp, Homo sapiens
attagatatggattagactcaa

SEQ ID NO: 6893 - DNA, 21 bp, Homo sapiens
ttttattacttttgcgcatat

SEQ ID NO: 6894 - DNA, 21 bp, Homo sapiens
acttccaggggtaacagtggt

SEQ ID NO: 6895 - DNA, 22 bp, Homo sapiens
gtctgcaaacagaaatattttg

SEQ ID NO: 6896 - DNA, 22 bp, Homo sapiens
tagctgcgaccttgtgacacag

SEQ ID NO: 6897 - DNA, 22 bp, Homo sapiens
tctttggatctgaatagccaat

SEQ ID NO: 6898 - DNA, 23 bp, Homo sapiens
aagctcatttccagagcgaggtc

SEQ ID NO: 6899 - DNA, 22 bp, Homo sapiens
agctacatgtgactagtggtta

SEQ ID NO: 6900 - DNA, 22 bp, Homo sapiens
tttctcattaggtttatgaaac

SEQ ID NO: 6901 - DNA, 22 bp, Homo sapiens
tcagtagactgaaaagccagat

SEQ ID NO: 6902 - DNA, 22 bp, Homo sapiens
taaatggagaaagctgaacata

SEQ ID NO: 6903 - DNA, 22 bp, Homo sapiens
ttccctgccggcaggatagggg

SEQ ID NO: 6904 - DNA, 22 bp, Homo sapiens
gagactacatgcatatacatat

SEQ ID NO: 6905 - DNA, 21 bp, Homo sapiens
cgccctttcctgtccatcttg

SEQ ID NO: 6906 - DNA, 22 bp, Homo sapiens
ccttggttgaggcaagataaga

SEQ ID NO: 6907 - DNA, 22 bp, Homo sapiens
gctagatagtctgactctggtt

SEQ ID NO: 6908 - DNA, 23 bp, Homo sapiens
cgcggcggggcgcggggtgaagt

SEQ ID NO: 6909 - DNA, 22 bp, Homo sapiens
atcatgtgtggtgttctaagtg

SEQ ID NO: 6910 - DNA, 20 bp, Homo sapiens
ctggttcgcaggccacattt

SEQ ID NO: 6911 - DNA, 20 bp, Homo sapiens
tggacaaaacgcccaccaaa

SEQ ID NO: 6912 - DNA, 22 bp, Homo sapiens
ggctggtccgagtgcagtggtt

SEQ ID NO: 6913 - DNA, 21 bp, Homo sapiens
tctttatatagaccagtgctg

SEQ ID NO: 6914 - DNA, 22 bp, Homo sapiens
tgatgtgtgggagttagtcact

SEQ ID NO: 6915 - DNA, 21 bp, Homo sapiens
actagatacttacagggattg

SEQ ID NO: 6916 - DNA, 23 bp, Homo sapiens
acagcaaatccatgcatttgatg

SEQ ID NO: 6917 - DNA, 20 bp, Homo sapiens
aatgatgtctcacttggctg

SEQ ID NO: 6918 - DNA, 22 bp, Homo sapiens
actccatctagagcagcgctgg

SEQ ID NO: 6919 - DNA, 20 bp, Homo sapiens
aagcttatcagactggatga

SEQ ID NO: 6920 - DNA, 22 bp, Homo sapiens
atgtgtacattcaaagcttcca

SEQ ID NO: 6921 - DNA, 20 bp, Homo sapiens
gccgctgcggtgagccaacc

SEQ ID NO: 6922 - DNA, 20 bp, Homo sapiens
gggcagcttccgggaagggc

SEQ ID NO: 6923 - DNA, 22 bp, Homo sapiens
cccaatgggtttggaagctcaa

SEQ ID NO: 6924 - DNA, 22 bp, Homo sapiens
agacctgccgaactctttctga

SEQ ID NO: 6925 - DNA, 20 bp, Homo sapiens
acacgccatgtatagtttgt

SEQ ID NO: 6926 - DNA, 20 bp, Homo sapiens
gaagttcaggttaataagta

SEQ ID NO: 6927 - DNA, 22 bp, Homo sapiens
gtcacgttacaatggaaagcat

SEQ ID NO: 6928 - DNA, 20 bp, Homo sapiens
catgctgagagctatcaaca

SEQ ID NO: 6929 - DNA, 23 bp, Homo sapiens
tgctgctaacagttttacccata

SEQ ID NO: 6930 - DNA, 22 bp, Homo sapiens
tagcagcacgtcaaatagctta

SEQ ID NO: 6931 - DNA, 20 bp, Homo sapiens
tacggctgttggactgttgt

SEQ ID NO: 6932 - DNA, 22 bp, Homo sapiens
gcatggcactcatttacctatg

SEQ ID NO: 6933 - DNA, 22 bp, Homo sapiens
tggcttaagaaaaaaaccacaa

SEQ ID NO: 6934 - DNA, 22 bp, Homo sapiens
tatctacccactgttatgggtt

SEQ ID NO: 6935 - DNA, 22 bp, Homo sapiens
gtgtcttgaatgctatgtcctt

SEQ ID NO: 6936 - DNA, 21 bp, Homo sapiens
ctcttgctgcttggtactcaa

SEQ ID NO: 6937 - DNA, 21 bp, Homo sapiens
gttttaataagactattgctt

SEQ ID NO: 6938 - DNA, 22 bp, Homo sapiens
aagactaaaagagactggtggt

SEQ ID NO: 6939 - DNA, 21 bp, Homo sapiens
atcacatttttgacctattgg

SEQ ID NO: 6940 - DNA, 22 bp, Homo sapiens
tacaccacggggtatttgtggt

SEQ ID NO: 6941 - DNA, 22 bp, Homo sapiens
gagcccaacccttgcaccagtg

SEQ ID NO: 6942 - DNA, 21 bp, Homo sapiens
tcttaggacccgaaagatgtc

SEQ ID NO: 6943 - DNA, 20 bp, Homo sapiens
ctagggctggactgcacagt

SEQ ID NO: 6944 - DNA, 22 bp, Homo sapiens
ttctttgcaaagagtaccagtg

SEQ ID NO: 6945 - DNA, 22 bp, Homo sapiens
ttagcaatgtctgggtggcata

SEQ ID NO: 6946 - DNA, 21 bp, Homo sapiens
atattaaccccagttagctgc

SEQ ID NO: 6947 - DNA, 22 bp, Homo sapiens
catgcctgctttaaaaggatag

SEQ ID NO: 6948 - DNA, 22 bp, Homo sapiens
gaaagtctctggatccttgtga

SEQ ID NO: 6949 - DNA, 22 bp, Homo sapiens
tatactacatatgtatagtata

SEQ ID NO: 6950 - DNA, 20 bp, Homo sapiens
atcccactcctgacatcatc

SEQ ID NO: 6951 - DNA, 22 bp, Homo sapiens
tgtatatacagacgtatgcata

SEQ ID NO: 6952 - DNA, 22 bp, Homo sapiens
cagcatatcatcatggcccgtg

SEQ ID NO: 6953 - DNA, 22 bp, Homo sapiens
gatgatggtgacctatggatgg

SEQ ID NO: 6954 - DNA, 23 bp, Homo sapiens
gtcttctttctccaggaatccct

SEQ ID NO: 6955 - DNA, 20 bp, Homo sapiens
tcatatcaagactccgtctc

SEQ ID NO: 6956 - DNA, 20 bp, Homo sapiens
ggcggtcgggcggcggcagc

SEQ ID NO: 6957 - DNA, 20 bp, Homo sapiens
aggcagtttatgccctattt

SEQ ID NO: 6958 - DNA, 20 bp, Homo sapiens
ccttttttctgtcagtttaa

SEQ ID NO: 6959 - DNA, 20 bp, Homo sapiens
tgggactctgggattgcatt

SEQ ID NO: 6960 - DNA, 21 bp, Homo sapiens
gagcatgctgagaatcaccga

SEQ ID NO: 6961 - DNA, 22 bp, Homo sapiens
tttagtctcaaagccaggagtc

SEQ ID NO: 6962 - DNA, 22 bp, Homo sapiens
catcagtttgactttatgtttg

SEQ ID NO: 6963 - DNA, 20 bp, Homo sapiens
tccccagtacagaacacaca

SEQ ID NO: 6964 - DNA, 21 bp, Homo sapiens
gatgatgctgtacagggatgg

SEQ ID NO: 6965 - DNA, 22 bp, Homo sapiens
taatactgcctggaaatgtaga

SEQ ID NO: 6966 - DNA, 22 bp, Homo sapiens
aaatgatgtatacgttgggcat

SEQ ID NO: 6967 - DNA, 23 bp, Homo sapiens
actggacttggagtcagaagact

SEQ ID NO: 6968 - DNA, 22 bp, Homo sapiens
tgacttgacctgatgatgtgac

SEQ ID NO: 6969 - DNA, 22 bp, Homo sapiens
tcagcgagtcaggtagaggcta

SEQ ID NO: 6970 - DNA, 22 bp, Homo sapiens
cagcgaacaggacgttgggctg

SEQ ID NO: 6971 - DNA, 24 bp, Homo sapiens
cacaaccagttacagatttcttta

SEQ ID NO: 6972 - DNA, 20 bp, Homo sapiens
tagcttgtaatgcagatgag

SEQ ID NO: 6973 - DNA, 24 bp, Homo sapiens
gaaatgtaagtcatcattatgtaa

SEQ ID NO: 6974 - DNA, 22 bp, Homo sapiens
tggagactttcaggtccttgtc

SEQ ID NO: 6975 - DNA, 23 bp, Homo sapiens
tagcagtttacgtttattgttat

SEQ ID NO: 6976 - DNA, 22 bp, Homo sapiens
aacgaatgtctgcctaatgatg

SEQ ID NO: 6977 - DNA, 22 bp, Homo sapiens
gctacaaggagctagctacata

SEQ ID NO: 6978 - DNA, 20 bp, Homo sapiens
aacctcgcttccctacctcc

SEQ ID NO: 6979 - DNA, 21 bp, Homo sapiens
caggtcaaaagggtttccaaa

SEQ ID NO: 6980 - DNA, 21 bp, Homo sapiens
aaataaaatcgtggaggtggt

SEQ ID NO: 6981 - DNA, 23 bp, Homo sapiens
tgaggtatgctgggtgcagtggc

SEQ ID NO: 6982 - DNA, 21 bp, Homo sapiens
cggtggatctgagctagatgc

SEQ ID NO: 6983 - DNA, 20 bp, Homo sapiens
atcacatcattgaaagaatc

SEQ ID NO: 6984 - DNA, 21 bp, Homo sapiens
cccgcgttctgcctggtcacc

SEQ ID NO: 6985 - DNA, 23 bp, Homo sapiens
tagcttgtcatcacagcaggtat

SEQ ID NO: 6986 - DNA, 21 bp, Homo sapiens
ttcacagtggctttcaaggct

SEQ ID NO: 6987 - DNA, 22 bp, Homo sapiens
taagtcattaaacttataggga

SEQ ID NO: 6988 - DNA, 22 bp, Homo sapiens
ttttatttctaaattatttatc

SEQ ID NO: 6989 - DNA, 22 bp, Homo sapiens
tagaaatagtctgtgatgcaga

SEQ ID NO: 6990 - DNA, 20 bp, Homo sapiens
tctaaatagtctgactgcct

SEQ ID NO: 6991 - DNA, 22 bp, Homo sapiens
tctagtatcagactgattatga

SEQ ID NO: 6992 - DNA, 21 bp, Homo sapiens
gtggagttttcccagaggagg

SEQ ID NO: 6993 - DNA, 20 bp, Homo sapiens
tatgcatcagaggctattta

SEQ ID NO: 6994 - DNA, 20 bp, Homo sapiens
ccaccctgccatataagcat

SEQ ID NO: 6995 - DNA, 23 bp, Homo sapiens
ggaagattacagactccaaagag

SEQ ID NO: 6996 - DNA, 20 bp, Homo sapiens
gtcgtgctgaataataccac

SEQ ID NO: 6997 - DNA, 21 bp, Homo sapiens
tttgtctagtgcttccatcgg

SEQ ID NO: 6998 - DNA, 20 bp, Homo sapiens
tggggtcatggcttgttggg

SEQ ID NO: 6999 - DNA, 22 bp, Homo sapiens
accatagcaggatggtatatag

SEQ ID NO: 7000 - DNA, 20 bp, Homo sapiens
ggagaattactcaagagaca

SEQ ID NO: 7001 - DNA, 20 bp, Homo sapiens
ctggtttggaattttttctg

SEQ ID NO: 7002 - DNA, 22 bp, Homo sapiens
ttgcttgagtctggtatgttga

SEQ ID NO: 7003 - DNA, 24 bp, Homo sapiens
tagcttatcttctagtacctggct

SEQ ID NO: 7004 - DNA, 22 bp, Homo sapiens
tactgatttttctttatttttg

SEQ ID NO: 7005 - DNA, 22 bp, Homo sapiens
tctcagtttgtcaaatacttga

SEQ ID NO: 7006 - DNA, 22 bp, Homo sapiens
gacagtctcaaagccaggtgac

SEQ ID NO: 7007 - DNA, 22 bp, Homo sapiens
atagtgcttatgaaataacttg

SEQ ID NO: 7008 - DNA, 20 bp, Homo sapiens
agtgtacatagaggcgtttg

SEQ ID NO: 7009 - DNA, 22 bp, Homo sapiens
ttgccacagtaggggaagggaa

SEQ ID NO: 7010 - DNA, 24 bp, Homo sapiens
cccctaaatgatccttaaatttga

SEQ ID NO: 7011 - DNA, 22 bp, Homo sapiens
tccagatagaatggctactgag

SEQ ID NO: 7012 - DNA, 20 bp, Homo sapiens
tgattagcttgagcaacttc

SEQ ID NO: 7013 - DNA, 22 bp, Homo sapiens
atagcaaagccctttcaaaggt

SEQ ID NO: 7014 - DNA, 21 bp, Homo sapiens
ggccttgtaatgacagccccc

SEQ ID NO: 7015 - DNA, 20 bp, Homo sapiens
tccccctgcaagaacaaagg

SEQ ID NO: 7016 - DNA, 22 bp, Homo sapiens
tagtggttatcacacccaaggc

SEQ ID NO: 7017 - DNA, 21 bp, Homo sapiens
cgctgcccgccgccgcgtggt

SEQ ID NO: 7018 - DNA, 21 bp, Homo sapiens
cgcccacccccgcggggctga

SEQ ID NO: 7019 - DNA, 22 bp, Homo sapiens
gaatgtctaggactttccacct

SEQ ID NO: 7020 - DNA, 22 bp, Homo sapiens
tcgaggagctcacagtagaata

SEQ ID NO: 7021 - DNA, 21 bp, Homo sapiens
cgattggatggtttagttata

SEQ ID NO: 7022 - DNA, 22 bp, Homo sapiens
tgagtcaccactgggggttttg

SEQ ID NO: 7023 - DNA, 23 bp, Homo sapiens
aagctgcatgtcttgctgacaca

SEQ ID NO: 7024 - DNA, 21 bp, Homo sapiens
cattagccagcaggcacctgt

SEQ ID NO: 7025 - DNA, 21 bp, Homo sapiens
tagcaccagagtcacgatgtt

SEQ ID NO: 7026 - DNA, 20 bp, Homo sapiens
attttaatgctcttcaaccc

SEQ ID NO: 7027 - DNA, 22 bp, Homo sapiens
caacgttagtctgggcaacata

SEQ ID NO: 7028 - DNA, 20 bp, Homo sapiens
ctccctcagatcagaagtgg

SEQ ID NO: 7029 - DNA, 22 bp, Homo sapiens
cctccaccaccttgatggtcac

SEQ ID NO: 7030 - DNA, 20 bp, Homo sapiens
aggtgtcagaatagttaggg

SEQ ID NO: 7031 - DNA, 20 bp, Homo sapiens
gcctagacaataaggtgaca

SEQ ID NO: 7032 - DNA, 23 bp, Homo sapiens
agcagcaatgtgcaggaagcact

SEQ ID NO: 7033 - DNA, 22 bp, Homo sapiens
gtctatgaagcacttgctagtc

SEQ ID NO: 7034 - DNA, 23 bp, Homo sapiens
ctccagaaaatccaggaatcctc

SEQ ID NO: 7035 - DNA, 20 bp, Homo sapiens
gcatcccaccaagtcaggtg

SEQ ID NO: 7036 - DNA, 22 bp, Homo sapiens
tcgatttgtaatatttgacaac

SEQ ID NO: 7037 - DNA, 22 bp, Homo sapiens
ctaatggctgagtatattgtgt

SEQ ID NO: 7038 - DNA, 21 bp, Homo sapiens
gtcagtttgtcaaatacctgg

SEQ ID NO: 7039 - DNA, 20 bp, Homo sapiens
caaggattgggtctaagatc

SEQ ID NO: 7040 - DNA, 23 bp, Homo sapiens
agcagcaccacgtgcttgagcag

SEQ ID NO: 7041 - DNA, 22 bp, Homo sapiens
tgcaaggcaggccagtggtgac

SEQ ID NO: 7042 - DNA, 20 bp, Homo sapiens
gaaatttgggattacccatt

SEQ ID NO: 7043 - DNA, 20 bp, Homo sapiens
gctccgaggtgaaaaaatgg

SEQ ID NO: 7044 - DNA, 20 bp, Homo sapiens
cttatctgaggggggtcaca

SEQ ID NO: 7045 - DNA, 23 bp, Homo sapiens
tatcatgaggtctttagttttgc

SEQ ID NO: 7046 - DNA, 21 bp, Homo sapiens
acagctgttttcctatagatg

SEQ ID NO: 7047 - DNA, 22 bp, Homo sapiens
tatcattgggtctttcgttttg

SEQ ID NO: 7048 - DNA, 23 bp, Homo sapiens
ggtgtaatagccaaatttgcctt

SEQ ID NO: 7049 - DNA, 23 bp, Homo sapiens
aagtatttaggtcatgaagtcag

SEQ ID NO: 7050 - DNA, 23 bp, Homo sapiens
aatgatgttgtatgaaaagcaca

SEQ ID NO: 7051 - DNA, 24 bp, Homo sapiens
tgtgcaaatctgcattgctcagtc

SEQ ID NO: 7052 - DNA, 24 bp, Homo sapiens
caggagaatcgccacctgggaggt

SEQ ID NO: 7053 - DNA, 22 bp, Homo sapiens
atctacattgtagtagaaactg

SEQ ID NO: 7054 - DNA, 23 bp, Homo sapiens
tgctctggacgacttatgggacc

SEQ ID NO: 7055 - DNA, 22 bp, Homo sapiens
gctgaatagaatattattattt

SEQ ID NO: 7056 - DNA, 20 bp, Homo sapiens
caagaactgctaactcaaca

SEQ ID NO: 7057 - DNA, 20 bp, Homo sapiens
ctgacctagtccggttgtgt

SEQ ID NO: 7058 - DNA, 22 bp, Homo sapiens
ggcacattgccgaaagctgaac

SEQ ID NO: 7059 - DNA, 20 bp, Homo sapiens
cagaggatacttaactgtct

SEQ ID NO: 7060 - DNA, 22 bp, Homo sapiens
ttgggtcatggaccaccatctt

SEQ ID NO: 7061 - DNA, 22 bp, Homo sapiens
tgactggtcagaaatgccaacc

SEQ ID NO: 7062 - DNA, 22 bp, Homo sapiens
gcagaccaccagatcaccaatt

SEQ ID NO: 7063 - DNA, 22 bp, Homo sapiens
ccatggccactcaaatactatg

SEQ ID NO: 7064 - DNA, 21 bp, Homo sapiens
aaggccgaagtgagaggattg

SEQ ID NO: 7065 - DNA, 22 bp, Homo sapiens
ttcacattgccaggagcagttc

SEQ ID NO: 7066 - DNA, 23 bp, Homo sapiens
agtgcaaatccatgcaaagggag

SEQ ID NO: 7067 - DNA, 23 bp, Homo sapiens
atagttgggtcttttatgtttgt

SEQ ID NO: 7068 - DNA, 22 bp, Homo sapiens
ccatgtatctatctgtcgcact

SEQ ID NO: 7069 - DNA, 22 bp, Homo sapiens
atcacagggcctccctaatggt

SEQ ID NO: 7070 - DNA, 21 bp, Homo sapiens
ttccactgttagcctggcaag

SEQ ID NO: 7071 - DNA, 21 bp, Homo sapiens
tgacactgttagtctggagtg

SEQ ID NO: 7072 - DNA, 21 bp, Homo sapiens
caatgaaggtgaaggccgagc

SEQ ID NO: 7073 - DNA, 22 bp, Homo sapiens
agctgctcatgccccaggtagc

SEQ ID NO: 7074 - DNA, 22 bp, Homo sapiens
aggcatgtctaggctcaggtgt

SEQ ID NO: 7075 - DNA, 20 bp, Homo sapiens
ctgtggtgatcagtggtcca

SEQ ID NO: 7076 - DNA, 23 bp, Homo sapiens
agcagcaaacattgaagcaggta

SEQ ID NO: 7077 - DNA, 21 bp, Homo sapiens
tgcataaccgacaacattaga

SEQ ID NO: 7078 - DNA, 23 bp, Homo sapiens
cgaatgcttgaaataccactact

SEQ ID NO: 7079 - DNA, 23 bp, Homo sapiens
gctttaaataacaagattattat

SEQ ID NO: 7080 - DNA, 23 bp, Homo sapiens
cttcctctctttctgccttgtga

SEQ ID NO: 7081 - DNA, 22 bp, Homo sapiens
tagagcaaactcaacgcaaagt

SEQ ID NO: 7082 - DNA, 20 bp, Homo sapiens
cccataaagtaggggactga

SEQ ID NO: 7083 - DNA, 20 bp, Homo sapiens
cccttatttctggggcccct

SEQ ID NO: 7084 - DNA, 22 bp, Homo sapiens
agagcctgtttctgtaggtgac

SEQ ID NO: 7085 - DNA, 20 bp, Homo sapiens
caactaaagtagaaagacag

SEQ ID NO: 7086 - DNA, 23 bp, Homo sapiens
atccttatacagtaatacaactg

SEQ ID NO: 7087 - DNA, 23 bp, Homo sapiens
gggagagtatggatttgttggaa

SEQ ID NO: 7088 - DNA, 21 bp, Homo sapiens
tccctgagaccctgacctcca

SEQ ID NO: 7089 - DNA, 20 bp, Homo sapiens
ccctgttgcaatgatgagca

SEQ ID NO: 7090 - DNA, 21 bp, Homo sapiens
tggctcagttcagaaggactt

SEQ ID NO: 7091 - DNA, 20 bp, Homo sapiens
ccctcctattccggtcactg

SEQ ID NO: 7092 - DNA, 22 bp, Homo sapiens
tctctgggtgacccgcacttgg

SEQ ID NO: 7093 - DNA, 23 bp, Homo sapiens
aggctcatggagatgctcacagg

SEQ ID NO: 7094 - DNA, 22 bp, Homo sapiens
tgccctgcaggccacaccaact

SEQ ID NO: 7095 - DNA, 23 bp, Homo sapiens
tataggcttgagccagcaccctg

SEQ ID NO: 7096 - DNA, 22 bp, Homo sapiens
cgatcactcaggctgagtgcag

SEQ ID NO: 7097 - DNA, 24 bp, Homo sapiens
gggtggtggtgctttgtgactctg

SEQ ID NO: 7098 - DNA, 21 bp, Homo sapiens
cgttccatttactgagcaggt

SEQ ID NO: 7099 - DNA, 23 bp, Homo sapiens
gctacacatccaggactgacacc

SEQ ID NO: 7100 - DNA, 21 bp, Homo sapiens
tgagctgggattagacatgat

SEQ ID NO: 7101 - DNA, 20 bp, Homo sapiens
tcaagtatcaaagcacttgg

SEQ ID NO: 7102 - DNA, 23 bp, Homo sapiens
ttgagatggtgagtttatgggtg

SEQ ID NO: 7103 - DNA, 22 bp, Homo sapiens
ctggagagagtgatgtccacag

SEQ ID NO: 7104 - DNA, 20 bp, Homo sapiens
ggagtaatgctcttgttgcc

SEQ ID NO: 7105 - DNA, 22 bp, Homo sapiens
cccgtggacggtgtgctgcccc

SEQ ID NO: 7106 - DNA, 22 bp, Homo sapiens
atgaaatcttacggatctgcat

SEQ ID NO: 7107 - DNA, 22 bp, Homo sapiens
gtagtcattcagttatgttttg

SEQ ID NO: 7108 - DNA, 20 bp, Homo sapiens
ccactgtggactcatcaaga

SEQ ID NO: 7109 - DNA, 22 bp, Homo sapiens
acagcaggtcatcgtcagagcc

SEQ ID NO: 7110 - DNA, 20 bp, Homo sapiens
ccatggtccatattgcccag

SEQ ID NO: 7111 - DNA, 23 bp, Homo sapiens
gtgactgtttagaccatacccac

SEQ ID NO: 7112 - DNA, 20 bp, Homo sapiens
tggctcagttcagccgggcc

SEQ ID NO: 7113 - DNA, 20 bp, Homo sapiens
tggagcaggggagcaagggg

SEQ ID NO: 7114 - DNA, 22 bp, Homo sapiens
tggtaaggctctgggatggggt

SEQ ID NO: 7115 - DNA, 22 bp, Homo sapiens
cccgctccccccgggcccgcgg

SEQ ID NO: 7116 - DNA, 24 bp, Homo sapiens
gaatgaatgaatgaatgaagaaga

SEQ ID NO: 7117 - DNA, 23 bp, Homo sapiens
acagcctgctgatttatgggaca

SEQ ID NO: 7118 - DNA, 24 bp, Homo sapiens
agatgtaccgtgcgctccagactg

SEQ ID NO: 7119 - DNA, 22 bp, Homo sapiens
agtttccctcaggatagccata

SEQ ID NO: 7120 - DNA, 21 bp, Homo sapiens
ccgctgtctgagctggggtgg

SEQ ID NO: 7121 - DNA, 23 bp, Homo sapiens
ggcgatgggggaacatggagtga

SEQ ID NO: 7122 - DNA, 22 bp, Homo sapiens
atgatgtagactagcagttgcc

SEQ ID NO: 7123 - DNA, 20 bp, Homo sapiens
acaagcagtgggagccggga

SEQ ID NO: 7124 - DNA, 22 bp, Homo sapiens
aggcaagatgctggcctgaggg

SEQ ID NO: 7125 - DNA, 22 bp, Homo sapiens
gcataaacagttcagtccctgg

SEQ ID NO: 7126 - DNA, 23 bp, Homo sapiens
cagccaggcctcctaaccctcca

SEQ ID NO: 7127 - DNA, 20 bp, Homo sapiens
gaagcggctgtgcagacagg

SEQ ID NO: 7128 - DNA, 21 bp, Homo sapiens
tgaggtttgcttggtgcctgg

SEQ ID NO: 7129 - DNA, 22 bp, Homo sapiens
agttgcccgtgtttttttcgct

SEQ ID NO: 7130 - DNA, 21 bp, Homo sapiens
ctgacctatgggcacacagct

SEQ ID NO: 7131 - DNA, 20 bp, Homo sapiens
cacaagacatggttcccctc

SEQ ID NO: 7132 - DNA, 20 bp, Homo sapiens
ccccttgcctctcccgccgc

SEQ ID NO: 7133 - DNA, 20 bp, Homo sapiens
cccagcccgtggacggcgcc

SEQ ID NO: 7134 - DNA, 22 bp, Homo sapiens
tgtcatgaacagtaatattttg

SEQ ID NO: 7135 - DNA, 20 bp, Homo sapiens
ccgtcctcctcgccctccct

SEQ ID NO: 7136 - DNA, 22 bp, Homo sapiens
cgcgatcttacttacttactta

SEQ ID NO: 7137 - DNA, 21 bp, Homo sapiens
atccatcttcttggtggtaca

SEQ ID NO: 7138 - DNA, 23 bp, Homo sapiens
tagctcatctctgcagctggtca

SEQ ID NO: 7139 - DNA, 20 bp, Homo sapiens
gcgctgctcagatcagctac

SEQ ID NO: 7140 - DNA, 20 bp, Homo sapiens
tcccgggtttcggcaccaaa

SEQ ID NO: 7141 - DNA, 22 bp, Homo sapiens
tgcagctgctggaaaagcagct

SEQ ID NO: 7142 - DNA, 22 bp, Homo sapiens
tatttgtattttatcttttatt

SEQ ID NO: 7143 - DNA, 21 bp, Homo sapiens
ctgtcaccacccatgtaccac

SEQ ID NO: 7144 - DNA, 23 bp, Homo sapiens
acagagacccagacctcacccca

SEQ ID NO: 7145 - DNA, 22 bp, Homo sapiens
agctagtggaagcaggtggggt

SEQ ID NO: 7146 - DNA, 23 bp, Homo sapiens
gcagtcaggtctgggctggggtt

SEQ ID NO: 7147 - DNA, 20 bp, Homo sapiens
gtgccaatggttactgtagc

SEQ ID NO: 7148 - DNA, 23 bp, Homo sapiens
aatctacccacgtggcctcccaa

SEQ ID NO: 7149 - DNA, 22 bp, Homo sapiens
gagaaagcaccttgtacactgt

SEQ ID NO: 7150 - DNA, 22 bp, Homo sapiens
agtggttcttaacagttcaaca

SEQ ID NO: 7151 - DNA, 22 bp, Homo sapiens
tgtcagtgacagttcgcaccct

SEQ ID NO: 7152 - DNA, 23 bp, Homo sapiens
tgcttgctgcttgggtgtggttg

SEQ ID NO: 7153 - DNA, 22 bp, Homo sapiens
tcagtccccagacccgtggggt

SEQ ID NO: 7154 - DNA, 20 bp, Homo sapiens
agctccaccgcccctgcaac

SEQ ID NO: 7155 - DNA, 20 bp, Homo sapiens
gggaccgtgtcattgccgtt

SEQ ID NO: 7156 - DNA, 20 bp, Homo sapiens
gtggggaaggatcattaatc

SEQ ID NO: 7157 - DNA, 22 bp, Homo sapiens
cccagtcaagtctgagttcacc

SEQ ID NO: 7158 - DNA, 20 bp, Homo sapiens
ctccccgccccgcgcccgcc

SEQ ID NO: 7159 - DNA, 20 bp, Homo sapiens
ttgtagtctccgatagcaaa

SEQ ID NO: 7160 - DNA, 22 bp, Homo sapiens
tcctcagagcctcgcaggtgcc

SEQ ID NO: 7161 - DNA, 21 bp, Homo sapiens
gggcgcccgggcggcgggggc

SEQ ID NO: 7162 - DNA, 22 bp, Homo sapiens
agctaggggtcaccttggtggt

SEQ ID NO: 7163 - DNA, 20 bp, Homo sapiens
cagagcaggatgtcaggagc

SEQ ID NO: 7164 - DNA, 22 bp, Homo sapiens
tacctgcgtaggctggtgtgct

SEQ ID NO: 7165 - DNA, 22 bp, Homo sapiens
gagcccaacccttgtatcagtg

SEQ ID NO: 7166 - DNA, 22 bp, Homo sapiens
tccctgagacaaggacacctgt

SEQ ID NO: 7167 - DNA, 21 bp, Homo sapiens
tattccttaattacagcaggt

SEQ ID NO: 7168 - DNA, 20 bp, Homo sapiens
gtagttgaatcgggtacact

SEQ ID NO: 7169 - DNA, 23 bp, Homo sapiens
atcgttacgtagttagcaccaga

SEQ ID NO: 7170 - DNA, 22 bp, Homo sapiens
taagtgtgtttctgtagtgact

SEQ ID NO: 7171 - DNA, 22 bp, Homo sapiens
ggcaggggccggcggcggcacc

SEQ ID NO: 7172 - DNA, 22 bp, Homo sapiens
gtgctgtgggaagcagcctacg

SEQ ID NO: 7173 - DNA, 22 bp, Homo sapiens
gatcgatgatgactttcataca

SEQ ID NO: 7174 - DNA, 20 bp, Homo sapiens
tggcagcacagtacgcgatg

SEQ ID NO: 7175 - DNA, 23 bp, Homo sapiens
tgactcatcactgacgcagggca

SEQ ID NO: 7176 - DNA, 22 bp, Homo sapiens
cagtgcagcactggggtcatgc

SEQ ID NO: 7177 - DNA, 23 bp, Homo sapiens
tggctcgctgatggtgcaggtca

SEQ ID NO: 7178 - DNA, 22 bp, Homo sapiens
caggaatagtctgacttcttct

SEQ ID NO: 7179 - DNA, 22 bp, Homo sapiens
gccaggagggcgaggcccgcga

SEQ ID NO: 7180 - DNA, 24 bp, Homo sapiens
ggcccgttggtgaaatccagccat

SEQ ID NO: 7181 - DNA, 20 bp, Homo sapiens
ccccccactgctgggccccc

SEQ ID NO: 7182 - DNA, 23 bp, Homo sapiens
agcatagagtatcagattcgagt

SEQ ID NO: 7183 - DNA, 22 bp, Homo sapiens
tccctgagacttcgagaatgtc

SEQ ID NO: 7184 - DNA, 20 bp, Homo sapiens
gaggcaaagctttaggattc

SEQ ID NO: 7185 - DNA, 21 bp, Homo sapiens
gagcttatcagactgagagga

SEQ ID NO: 7186 - DNA, 20 bp, Homo sapiens
ctgagtattctaaggcgtcc

SEQ ID NO: 7187 - DNA, 22 bp, Homo sapiens
aaggcggcaggggttgcatcga

SEQ ID NO: 7188 - DNA, 23 bp, Homo sapiens
tgcctgagcttgcatgaggagct

SEQ ID NO: 7189 - DNA, 24 bp, Homo sapiens
tgtatgtgcttttgactggagttc

SEQ ID NO: 7190 - DNA, 20 bp, Homo sapiens
ccagagtgggatcccgagcg

SEQ ID NO: 7191 - DNA, 23 bp, Homo sapiens
ctctttggaaagcacgggtcaca

SEQ ID NO: 7192 - DNA, 22 bp, Homo sapiens
tcgcgtagtctccgatggaagg

SEQ ID NO: 7193 - DNA, 21 bp, Homo sapiens
gttcaagtcctagctcattac

SEQ ID NO: 7194 - DNA, 20 bp, Homo sapiens
gcagcaggagaggtgaacac

SEQ ID NO: 7195 - DNA, 22 bp, Homo sapiens
tagtcacaagtctgatgcttat

SEQ ID NO: 7196 - DNA, 20 bp, Homo sapiens
gactggataaggctgacaac

SEQ ID NO: 7197 - DNA, 23 bp, Homo sapiens
gtattattattatttttgtgtgt

SEQ ID NO: 7198 - DNA, 22 bp, Homo sapiens
ttcactgcctccgaagcgagcg

SEQ ID NO: 7199 - DNA, 23 bp, Homo sapiens
ctgcctctgcactttgcagtgga

SEQ ID NO: 7200 - DNA, 22 bp, Homo sapiens
ttcctgctcaggatcaggtgct

SEQ ID NO: 7201 - DNA, 23 bp, Homo sapiens
tgggagtgttcagcaggtgtctg

SEQ ID NO: 7202 - DNA, 23 bp, Homo sapiens
tgcagcaaactttgggaatccct

SEQ ID NO: 7203 - DNA, 20 bp, Homo sapiens
ctgtgcataagaataacagg

SEQ ID NO: 7204 - DNA, 20 bp, Homo sapiens
aagggtgctgtgttatttac

SEQ ID NO: 7205 - DNA, 21 bp, Homo sapiens
taaacgggtggggtcctcatg

SEQ ID NO: 7206 - DNA, 22 bp, Homo sapiens
aggatgattgggattcttgttt

SEQ ID NO: 7207 - DNA, 22 bp, Homo sapiens
tcaggacctgtcaaatcaaaac

SEQ ID NO: 7208 - DNA, 21 bp, Homo sapiens
ccaggccagtagaaaggtgat

SEQ ID NO: 7209 - DNA, 21 bp, Homo sapiens
atctgattgccagggataccc

SEQ ID NO: 7210 - DNA, 21 bp, Homo sapiens
caggcaaaccaacaacaggaa

SEQ ID NO: 7211 - DNA, 21 bp, Homo sapiens
gtccagtccctttgaaggaag

SEQ ID NO: 7212 - DNA, 20 bp, Homo sapiens
aaagcaattgtctgctggga

SEQ ID NO: 7213 - DNA, 23 bp, Homo sapiens
tacagtggcttgcatggagtgag

SEQ ID NO: 7214 - DNA, 20 bp, Homo sapiens
tgatgatgtgctgcaaccat

SEQ ID NO: 7215 - DNA, 23 bp, Homo sapiens
tgaggtagtagttttgtagtctt

SEQ ID NO: 7216 - DNA, 20 bp, Homo sapiens
gagtatggtggcatgatctg

SEQ ID NO: 7217 - DNA, 24 bp, Homo sapiens
atctcatgtaaagggatttccatt

SEQ ID NO: 7218 - DNA, 20 bp, Homo sapiens
tagtgggttatcagaagaaa

SEQ ID NO: 7219 - DNA, 23 bp, Homo sapiens
tggctcttaagtgcaggaacaga

SEQ ID NO: 7220 - DNA, 22 bp, Homo sapiens
tcccacatggagattatggctt

SEQ ID NO: 7221 - DNA, 22 bp, Homo sapiens
ttcatcatttccagagtcttag

SEQ ID NO: 7222 - DNA, 23 bp, Homo sapiens
tgtcagtttgtcggcgcaacagg

SEQ ID NO: 7223 - DNA, 21 bp, Homo sapiens
tggcagcttccgcctttggtt

SEQ ID NO: 7224 - DNA, 20 bp, Homo sapiens
gcccaggtggtgaaatgggc

SEQ ID NO: 7225 - DNA, 20 bp, Homo sapiens
gctttgttattgccaccact

SEQ ID NO: 7226 - DNA, 22 bp, Homo sapiens
cagtgcaatgtcaaataccagg

SEQ ID NO: 7227 - DNA, 23 bp, Homo sapiens
tgacggtacctgatgaaggtggt

SEQ ID NO: 7228 - DNA, 24 bp, Homo sapiens
tcctgctcatgcccctcccaggcc

SEQ ID NO: 7229 - DNA, 21 bp, Homo sapiens
gctcctgccagggtccttagg

SEQ ID NO: 7230 - DNA, 22 bp, Homo sapiens
tcctcttaattcaggatagtgc

SEQ ID NO: 7231 - DNA, 22 bp, Homo sapiens
cagactgggtggttttacccaa

SEQ ID NO: 7232 - DNA, 20 bp, Homo sapiens
tgggcccaggattacaactg

SEQ ID NO: 7233 - DNA, 22 bp, Homo sapiens
ttaccgctgtaatcccaacact

SEQ ID NO: 7234 - DNA, 20 bp, Homo sapiens
atccagttttcccagaagtc

SEQ ID NO: 7235 - DNA, 22 bp, Homo sapiens
aagtgacggccctctcggagga

SEQ ID NO: 7236 - DNA, 23 bp, Homo sapiens
catggtggtggtggagagagagc

SEQ ID NO: 7237 - DNA, 22 bp, Homo sapiens
gatcccaacccggtgcttggga

SEQ ID NO: 7238 - DNA, 20 bp, Homo sapiens
aggagcaggaactctgtctt

SEQ ID NO: 7239 - DNA, 22 bp, Homo sapiens
ctttactagtgagccaggtgtc

SEQ ID NO: 7240 - DNA, 23 bp, Homo sapiens
agacatttattgcatgccctcaa

SEQ ID NO: 7241 - DNA, 22 bp, Homo sapiens
tggaaacatttctgcacaaact

SEQ ID NO: 7242 - DNA, 21 bp, Homo sapiens
gggggtacccgaagcctagta

SEQ ID NO: 7243 - DNA, 22 bp, Homo sapiens
tggcagtgtcttaaagttggtg

SEQ ID NO: 7244 - DNA, 22 bp, Homo sapiens
tgagacaggaatagtgctagag

SEQ ID NO: 7245 - DNA, 21 bp, Homo sapiens
tcgaggagctcacagtctaaa

SEQ ID NO: 7246 - DNA, 21 bp, Homo sapiens
atggaatggtaaagattaatc

SEQ ID NO: 7247 - DNA, 21 bp, Homo sapiens
aacaacatggcttctctgttc

SEQ ID NO: 7248 - DNA, 23 bp, Homo sapiens
agcagctaacatgtcccctaaat

SEQ ID NO: 7249 - DNA, 22 bp, Homo sapiens
taatgttgcccaggcggtctca

SEQ ID NO: 7250 - DNA, 22 bp, Homo sapiens
tcctcattcaaagccaggtgtc

SEQ ID NO: 7251 - DNA, 20 bp, Homo sapiens
ccttgaagatagagggacag

SEQ ID NO: 7252 - DNA, 23 bp, Homo sapiens
tggatttttggaattgaagataa

SEQ ID NO: 7253 - DNA, 21 bp, Homo sapiens
ttacactgttagcctaagaga

SEQ ID NO: 7254 - DNA, 22 bp, Homo sapiens
ttctgacccactaaataaaaag

SEQ ID NO: 7255 - DNA, 20 bp, Homo sapiens
taaccagtgagttgccagtt

SEQ ID NO: 7256 - DNA, 20 bp, Homo sapiens
tagcggaagctaagcagatc

SEQ ID NO: 7257 - DNA, 21 bp, Homo sapiens
tgacctatgaatacttttcac

SEQ ID NO: 7258 - DNA, 21 bp, Homo sapiens
caattctgctccctacagcct

SEQ ID NO: 7259 - DNA, 22 bp, Homo sapiens
tctacttaacagtttatggttt

SEQ ID NO: 7260 - DNA, 22 bp, Homo sapiens
ccttatctcccgcgcgcccagc

SEQ ID NO: 7261 - DNA, 20 bp, Homo sapiens
tttggcacacaataaatgat

SEQ ID NO: 7262 - DNA, 20 bp, Homo sapiens
aacaactatcaaagatcttc

SEQ ID NO: 7263 - DNA, 21 bp, Homo sapiens
tagcagcacgtaaggcaacag

SEQ ID NO: 7264 - DNA, 21 bp, Homo sapiens
cagctgcatctgaaatcggaa

SEQ ID NO: 7265 - DNA, 20 bp, Homo sapiens
cagataacaataccgatcct

SEQ ID NO: 7266 - DNA, 23 bp, Homo sapiens
actgggtacttaactgttggctc

SEQ ID NO: 7267 - DNA, 22 bp, Homo sapiens
aggagctctgtagttaggtgga

SEQ ID NO: 7268 - DNA, 23 bp, Homo sapiens
ttgtctgcctcatagtaattaat

SEQ ID NO: 7269 - DNA, 22 bp, Homo sapiens
atgggcatctaggctgattgca

SEQ ID NO: 7270 - DNA, 22 bp, Homo sapiens
tgagaaaggatgtctgctagag

SEQ ID NO: 7271 - DNA, 20 bp, Homo sapiens
gaaaactgcaagaacacatc

SEQ ID NO: 7272 - DNA, 22 bp, Homo sapiens
tagtctgccactgactatcccc

SEQ ID NO: 7273 - DNA, 22 bp, Homo sapiens
tctacatgctctcagctgaggc

SEQ ID NO: 7274 - DNA, 22 bp, Homo sapiens
ggaaaaccctcccaggaatccc

SEQ ID NO: 7275 - DNA, 22 bp, Homo sapiens
tctgagtaattcaggctaggtt

SEQ ID NO: 7276 - DNA, 22 bp, Homo sapiens
tccctgagaccctgctccatga

SEQ ID NO: 7277 - DNA, 22 bp, Homo sapiens
tgagagtcatcaccagatagta

SEQ ID NO: 7278 - DNA, 20 bp, Homo sapiens
gcaataccaaggaaaccagc

SEQ ID NO: 7279 - DNA, 23 bp, Homo sapiens
gctaggcgctagtaggtgttgag

SEQ ID NO: 7280 - DNA, 20 bp, Homo sapiens
agtgtatagactcaattgac

SEQ ID NO: 7281 - DNA, 20 bp, Homo sapiens
cactggatacttaacctgtg

SEQ ID NO: 7282 - DNA, 21 bp, Homo sapiens
tgaactggcctttgaagggtg

SEQ ID NO: 7283 - DNA, 20 bp, Homo sapiens
ggtgggcagtagtgggtggt

SEQ ID NO: 7284 - DNA, 20 bp, Homo sapiens
gtatagggagtctagtttgt

SEQ ID NO: 7285 - DNA, 20 bp, Homo sapiens
agtcaagcaaggccagtgtt

SEQ ID NO: 7286 - DNA, 22 bp, Homo sapiens
tctcttcctaaagcacttgtga

SEQ ID NO: 7287 - DNA, 21 bp, Homo sapiens
tctggatacttacagtggaca

SEQ ID NO: 7288 - DNA, 20 bp, Homo sapiens
cttaatcagaggctattgcc

SEQ ID NO: 7289 - DNA, 22 bp, Homo sapiens
atccttgctgagtcagcaggct

SEQ ID NO: 7290 - DNA, 23 bp, Homo sapiens
aacattcacacgacagaacaaac

SEQ ID NO: 7291 - DNA, 21 bp, Homo sapiens
atcgtgccactgggcgtttgc

SEQ ID NO: 7292 - DNA, 21 bp, Homo sapiens
cattattagaaggttgcatga

SEQ ID NO: 7293 - DNA, 22 bp, Homo sapiens
gtcacaaacagttttattttac

SEQ ID NO: 7294 - DNA, 23 bp, Homo sapiens
caaagtgctgcaagtgcaggcat

SEQ ID NO: 7295 - DNA, 22 bp, Homo sapiens
gcaatgctagtctgacaccacc

SEQ ID NO: 7296 - DNA, 21 bp, Homo sapiens
ctgtcgtcctcttcagcctct

SEQ ID NO: 7297 - DNA, 20 bp, Homo sapiens
ctttagtttgattgatggat

SEQ ID NO: 7298 - DNA, 23 bp, Homo sapiens
tagcttaagtctgcagcaccaca

SEQ ID NO: 7299 - DNA, 22 bp, Homo sapiens
agcactaacggtcctcggaggt

SEQ ID NO: 7300 - DNA, 21 bp, Homo sapiens
acagatgaagcactgtagcct

SEQ ID NO: 7301 - DNA, 23 bp, Homo sapiens
agcgatctttcagcaggtcactc

SEQ ID NO: 7302 - DNA, 22 bp, Homo sapiens
tccctgagcaaagtcaggtttc

SEQ ID NO: 7303 - DNA, 23 bp, Homo sapiens
tggagtcgcctcctcttcttact

SEQ ID NO: 7304 - DNA, 21 bp, Homo sapiens
gcctgtgagtggtgggtttgt

SEQ ID NO: 7305 - DNA, 23 bp, Homo sapiens
catcaccatggtcccgactgtgg

SEQ ID NO: 7306 - DNA, 22 bp, Homo sapiens
tagcagagttggaaagaatcct

SEQ ID NO: 7307 - DNA, 20 bp, Homo sapiens
cagagcaggatgtcagagct

SEQ ID NO: 7308 - DNA, 20 bp, Homo sapiens
tctccagcttgccacgtgtt

SEQ ID NO: 7309 - DNA, 20 bp, Homo sapiens
ccactacgcctcaattaaga

SEQ ID NO: 7310 - DNA, 23 bp, Homo sapiens
gatgctggggaggtccttaggag

SEQ ID NO: 7311 - DNA, 23 bp, Homo sapiens
tagcttgtcagagcaggttgtca

SEQ ID NO: 7312 - DNA, 22 bp, Homo sapiens
tagcacgtagagacactactgc

SEQ ID NO: 7313 - DNA, 22 bp, Homo sapiens
tcaaatccccctaccccgtgtg

SEQ ID NO: 7314 - DNA, 22 bp, Homo sapiens
tgtgactctgggagcaggtgtc

SEQ ID NO: 7315 - DNA, 21 bp, Homo sapiens
attcgtatctggctactggcc

SEQ ID NO: 7316 - DNA, 20 bp, Homo sapiens
gggacatgtggctgcatgac

SEQ ID NO: 7317 - DNA, 20 bp, Homo sapiens
atcacagtgatcggacctgc

SEQ ID NO: 7318 - DNA, 24 bp, Homo sapiens
ggtaataacgattatggtgatgag

SEQ ID NO: 7319 - DNA, 23 bp, Homo sapiens
tgtgctgggtgtgggctggggtt

SEQ ID NO: 7320 - DNA, 21 bp, Homo sapiens
aatgacaggacttgatgctgt

SEQ ID NO: 7321 - DNA, 22 bp, Homo sapiens
acaggcatctaggcaagaagag

SEQ ID NO: 7322 - DNA, 24 bp, Homo sapiens
aggaagccctggaggggttggctc

SEQ ID NO: 7323 - DNA, 21 bp, Homo sapiens
tcagtgcactacagttgctat

SEQ ID NO: 7324 - DNA, 21 bp, Homo sapiens
aatggcaatggtaattcagaa

SEQ ID NO: 7325 - DNA, 22 bp, Homo sapiens
tgaggtagtaataacataatca

SEQ ID NO: 7326 - DNA, 21 bp, Homo sapiens
tatagtgaggagctgactctt

SEQ ID NO: 7327 - DNA, 20 bp, Homo sapiens
tggagcagggagatggaggg

SEQ ID NO: 7328 - DNA, 22 bp, Homo sapiens
ccccctcctcctcggcgtcctc

SEQ ID NO: 7329 - DNA, 22 bp, Homo sapiens
tgggactctggagccaggcact

SEQ ID NO: 7330 - DNA, 22 bp, Homo sapiens
agcagcattagacttcgcttga

SEQ ID NO: 7331 - DNA, 20 bp, Homo sapiens
ggcctggtagttcgacaact

SEQ ID NO: 7332 - DNA, 22 bp, Homo sapiens
cttctgagaccctagtacacag

SEQ ID NO: 7333 - DNA, 23 bp, Homo sapiens
tgtcctgttgctgggcgtggtgg

SEQ ID NO: 7334 - DNA, 21 bp, Homo sapiens
ccggctcccaagtggctggga

SEQ ID NO: 7335 - DNA, 20 bp, Homo sapiens
ccccgccgcgcgccgggcag

SEQ ID NO: 7336 - DNA, 23 bp, Homo sapiens
aggagcaggtgacagggctgcag

SEQ ID NO: 7337 - DNA, 22 bp, Homo sapiens
agcagcattttacaggactaca

SEQ ID NO: 7338 - DNA, 21 bp, Homo sapiens
agctcagtcctagaaggtctc

SEQ ID NO: 7339 - DNA, 21 bp, Homo sapiens
cctgagtaaaggtcagccatt

SEQ ID NO: 7340 - DNA, 22 bp, Homo sapiens
ctgtgcgtgtgacccgctgtct

SEQ ID NO: 7341 - DNA, 22 bp, Homo sapiens
tctctacttaacagtgcttaga

SEQ ID NO: 7342 - DNA, 22 bp, Homo sapiens
ttcactgggcctgggatggggt

SEQ ID NO: 7343 - DNA, 20 bp, Homo sapiens
tgggccaccgcgcgcagggg

SEQ ID NO: 7344 - DNA, 21 bp, Homo sapiens
accttcattctaggcctcaga

SEQ ID NO: 7345 - DNA, 23 bp, Homo sapiens
attctagctggttgtcttgccgg

SEQ ID NO: 7346 - DNA, 24 bp, Homo sapiens
gactaattgctatatgacagcgag

SEQ ID NO: 7347 - DNA, 22 bp, Homo sapiens
atcacaacatcagggcctgaat

SEQ ID NO: 7348 - DNA, 23 bp, Homo sapiens
tagctctgttcagcaggtacaca

SEQ ID NO: 7349 - DNA, 20 bp, Homo sapiens
actgagggtttggaattttt

SEQ ID NO: 7350 - DNA, 20 bp, Homo sapiens
gaagcggggggaggaaaata

SEQ ID NO: 7351 - DNA, 20 bp, Homo sapiens
cccagcccttagagagcacc

SEQ ID NO: 7352 - DNA, 22 bp, Homo sapiens
aagctgccagttgaaggccagt

SEQ ID NO: 7353 - DNA, 22 bp, Homo sapiens
tagcttatcctcagtctagtag

SEQ ID NO: 7354 - DNA, 21 bp, Homo sapiens
gcagtccatgggcatagccaa

SEQ ID NO: 7355 - DNA, 23 bp, Homo sapiens
accagcattgtgtgattagatgt

SEQ ID NO: 7356 - DNA, 22 bp, Homo sapiens
ctgataacgccaaggtagcagg

SEQ ID NO: 7357 - DNA, 22 bp, Homo sapiens
tttcagtttaagtttatgtttg

SEQ ID NO: 7358 - DNA, 21 bp, Homo sapiens
gtcactggggaccaggagcta

SEQ ID NO: 7359 - DNA, 22 bp, Homo sapiens
tttcctcagctgtcgaatgaag

SEQ ID NO: 7360 - DNA, 22 bp, Homo sapiens
gctagcatcagagcagcaccag

SEQ ID NO: 7361 - DNA, 24 bp, Homo sapiens
actcagcagtgaaacgatattggc

SEQ ID NO: 7362 - DNA, 23 bp, Homo sapiens
agctcatccatagttgtcactgt

SEQ ID NO: 7363 - DNA, 22 bp, Homo sapiens
gacaactatggatgagctctca

SEQ ID NO: 7364 - DNA, 23 bp, Homo sapiens
agctcatccatagttgtcactga

SEQ ID NO: 7365 - DNA, 22 bp, Homo sapiens
tagcaccatctgctgctgaaaa

SEQ ID NO: 7366 - DNA, 21 bp, Homo sapiens
tagcagcatagcttatacagc

SEQ ID NO: 7367 - DNA, 22 bp, Homo sapiens
gcaaggctagatacagggactg

SEQ ID NO: 7368 - DNA, 20 bp, Homo sapiens
tattatttgtagatgcgggg

SEQ ID NO: 7369 - DNA, 21 bp, Homo sapiens
ctcggcgggcgccgccgcatc

SEQ ID NO: 7370 - DNA, 22 bp, Homo sapiens
caacggaaccccaaaaacagca

SEQ ID NO: 7371 - DNA, 22 bp, Homo sapiens
atgacacagcatcaataccttc

SEQ ID NO: 7372 - DNA, 21 bp, Homo sapiens
gttctctcggggccattctta

SEQ ID NO: 7373 - DNA, 22 bp, Homo sapiens
aatcatgggtctgttatggggt

SEQ ID NO: 7374 - DNA, 23 bp, Homo sapiens
accctgtagatccgatatgtgga

SEQ ID NO: 7375 - DNA, 20 bp, Homo sapiens
agacgcgcccttgaaaattt

SEQ ID NO: 7376 - DNA, 20 bp, Homo sapiens
tgatgttgctcagggttatt

SEQ ID NO: 7377 - DNA, 22 bp, Homo sapiens
atcaaggccgacaggagctatg

SEQ ID NO: 7378 - DNA, 21 bp, Homo sapiens
tagcttttactcagtgggtca

SEQ ID NO: 7379 - DNA, 21 bp, Homo sapiens
aaagtggctgtgcaccaccaa

SEQ ID NO: 7380 - DNA, 22 bp, Homo sapiens
taatttctcgctggggcctcca

SEQ ID NO: 7381 - DNA, 21 bp, Homo sapiens
tccctgtcctccaggagcaca

SEQ ID NO: 7382 - DNA, 21 bp, Homo sapiens
tggctcagttcaacaggtgtt

SEQ ID NO: 7383 - DNA, 22 bp, Homo sapiens
tcaggtctcaaagccaggtgga

SEQ ID NO: 7384 - DNA, 20 bp, Homo sapiens
cggcaggcggcgctccccgg

SEQ ID NO: 7385 - DNA, 22 bp, Homo sapiens
cttcggagctttgttagcagag

SEQ ID NO: 7386 - DNA, 21 bp, Homo sapiens
aatctggtaaaggaagaactg

SEQ ID NO: 7387 - DNA, 23 bp, Homo sapiens
ataagcaaagaacaggaatccct

SEQ ID NO: 7388 - DNA, 21 bp, Homo sapiens
cgatggtgagctaataagtat

SEQ ID NO: 7389 - DNA, 22 bp, Homo sapiens
ctctaaggctggtttataggga

SEQ ID NO: 7390 - DNA, 23 bp, Homo sapiens
tgtcagtccactgggctttgggg

SEQ ID NO: 7391 - DNA, 22 bp, Homo sapiens
caggctctagggttaagcagct

SEQ ID NO: 7392 - DNA, 22 bp, Homo sapiens
ataagtaagccagggatttcct

SEQ ID NO: 7393 - DNA, 22 bp, Homo sapiens
tagcacaagagtaggctacaat

SEQ ID NO: 7394 - DNA, 21 bp, Homo sapiens
cagcataagacatttcctact

SEQ ID NO: 7395 - DNA, 20 bp, Homo sapiens
tttttattagctcagttggc

SEQ ID NO: 7396 - DNA, 20 bp, Homo sapiens
ctgacctatgaattagttag

SEQ ID NO: 7397 - DNA, 24 bp, Homo sapiens
tggaggcaggaagcggagctagag

SEQ ID NO: 7398 - DNA, 20 bp, Homo sapiens
tggctcagtgactacatcca

SEQ ID NO: 7399 - DNA, 20 bp, Homo sapiens
gactatggtgctcttacctc

SEQ ID NO: 7400 - DNA, 22 bp, Homo sapiens
tggatgctattggtgtacagaa

SEQ ID NO: 7401 - DNA, 22 bp, Homo sapiens
gtaaatattttaagcttcgcaa

SEQ ID NO: 7402 - DNA, 20 bp, Homo sapiens
gcaagcataagaataacagg

SEQ ID NO: 7403 - DNA, 22 bp, Homo sapiens
tagcacacgggagtgctagcga

SEQ ID NO: 7404 - DNA, 22 bp, Homo sapiens
aatcctctgatcagggtagggg

SEQ ID NO: 7405 - DNA, 21 bp, Homo sapiens
cttatcagactgatgtatggt

SEQ ID NO: 7406 - DNA, 20 bp, Homo sapiens
tagcagcacgtaaaatgagt

SEQ ID NO: 7407 - DNA, 23 bp, Homo sapiens
atcataaccatcctctgctattg

SEQ ID NO: 7408 - DNA, 20 bp, Homo sapiens
gcagaggagcaccccaggcc

SEQ ID NO: 7409 - DNA, 21 bp, Homo sapiens
gtccagttttcccagacctca

SEQ ID NO: 7410 - DNA, 24 bp, Homo sapiens
gggcggggtggggcgcgcgcgcca

SEQ ID NO: 7411 - DNA, 23 bp, Homo sapiens
tgatcaactggttcatactgtgg

SEQ ID NO: 7412 - DNA, 22 bp, Homo sapiens
tggagtccaggtcgtggacggt

SEQ ID NO: 7413 - DNA, 23 bp, Homo sapiens
tgttctgctgctgacgcaccatg

SEQ ID NO: 7414 - DNA, 22 bp, Homo sapiens
tagcagcacggctttctcaggg

SEQ ID NO: 7415 - DNA, 20 bp, Homo sapiens
ccacatcagaggctactgta

SEQ ID NO: 7416 - DNA, 20 bp, Homo sapiens
tggctcagggactgtccctc

SEQ ID NO: 7417 - DNA, 20 bp, Homo sapiens
cccagtgggactcagcatgg

SEQ ID NO: 7418 - DNA, 22 bp, Homo sapiens
aaaccgtgcatgccacttgacc

SEQ ID NO: 7419 - DNA, 23 bp, Homo sapiens
tagcttaatgctttgatgttgtc

SEQ ID NO: 7420 - DNA, 20 bp, Homo sapiens
agtgatgccacgtgactagc

SEQ ID NO: 7421 - DNA, 21 bp, Homo sapiens
gggctccgggacggctgttcc

SEQ ID NO: 7422 - DNA, 20 bp, Homo sapiens
tttggttttcgtaactgatc

SEQ ID NO: 7423 - DNA, 21 bp, Homo sapiens
cactggatacttagttggctt

SEQ ID NO: 7424 - DNA, 20 bp, Homo sapiens
cagaatggtaaagattaact

SEQ ID NO: 7425 - DNA, 21 bp, Homo sapiens
gagtggataaggccaatgata

SEQ ID NO: 7426 - DNA, 22 bp, Homo sapiens
tgctccggctcccacccacagg

SEQ ID NO: 7427 - DNA, 21 bp, Homo sapiens
aaaggcaatggtattgactca

SEQ ID NO: 7428 - DNA, 20 bp, Homo sapiens
ccccttgctgcgctgcttgg

SEQ ID NO: 7429 - DNA, 20 bp, Homo sapiens
ggcgatgaccagtgtaccca

SEQ ID NO: 7430 - DNA, 21 bp, Homo sapiens
ttggggtagatccgggtcctg

SEQ ID NO: 7431 - DNA, 20 bp, Homo sapiens
cagcatggtccacgtttgcg

SEQ ID NO: 7432 - DNA, 20 bp, Homo sapiens
cccgccgcgcgccggggttt

SEQ ID NO: 7433 - DNA, 20 bp, Homo sapiens
cctccctccccgggggagca

SEQ ID NO: 7434 - DNA, 20 bp, Homo sapiens
agctctcgctggcccagacg

SEQ ID NO: 7435 - DNA, 23 bp, Homo sapiens
gcttgatggatttgaaggcttcg

SEQ ID NO: 7436 - DNA, 20 bp, Homo sapiens
acagctctcccacccctcct

SEQ ID NO: 7437 - DNA, 24 bp, Homo sapiens
ccggcgttggttgaaaatcgcccc

SEQ ID NO: 7438 - DNA, 23 bp, Homo sapiens
agctgtgcttccctgcacccagc

SEQ ID NO: 7439 - DNA, 22 bp, Homo sapiens
atcagcattgtacagggcaggg

SEQ ID NO: 7440 - DNA, 22 bp, Homo sapiens
tccctggctggggctgaacact

SEQ ID NO: 7441 - DNA, 22 bp, Homo sapiens
ccgcgcggggggcccgggcttc

SEQ ID NO: 7442 - DNA, 20 bp, Homo sapiens
gcaggatggcggagagggct

SEQ ID NO: 7443 - DNA, 22 bp, Homo sapiens
cagtttttgaattgccctatcc

SEQ ID NO: 7444 - DNA, 22 bp, Homo sapiens
cttgactctgggattaagtgtc

SEQ ID NO: 7445 - DNA, 21 bp, Homo sapiens
tgacactttagccccaaatca

SEQ ID NO: 7446 - DNA, 22 bp, Homo sapiens
cgctgttgcccagggctgagtg

SEQ ID NO: 7447 - DNA, 22 bp, Homo sapiens
tgtaaacgtcctacacacacag

SEQ ID NO: 7448 - DNA, 21 bp, Homo sapiens
ctccccgcgcccccggggaga

SEQ ID NO: 7449 - DNA, 22 bp, Homo sapiens
ttgctgagctcagccagcaccg

SEQ ID NO: 7450 - DNA, 22 bp, Homo sapiens
gagaaactgccttgtaaactgt

SEQ ID NO: 7451 - DNA, 22 bp, Homo sapiens
ccccccactgctaagccttcct

SEQ ID NO: 7452 - DNA, 23 bp, Homo sapiens
tagctcatcagagcaggacaggc

SEQ ID NO: 7453 - DNA, 22 bp, Homo sapiens
aaacatggcaacggagcctcaa

SEQ ID NO: 7454 - DNA, 22 bp, Homo sapiens
tagcttatctctgcaggcaact

SEQ ID NO: 7455 - DNA, 22 bp, Homo sapiens
gccctgatgctgagtgtgtgct

SEQ ID NO: 7456 - DNA, 21 bp, Homo sapiens
tctggatacttaactgccttg

SEQ ID NO: 7457 - DNA, 20 bp, Homo sapiens
tgatgaacacatcatatcgt

SEQ ID NO: 7458 - DNA, 22 bp, Homo sapiens
tctgcttacagagcaggatgtg

SEQ ID NO: 7459 - DNA, 20 bp, Homo sapiens
gtttcaacaacctagtggct

SEQ ID NO: 7460 - DNA, 22 bp, Homo sapiens
gtttctgggactgtcccactgt

SEQ ID NO: 7461 - DNA, 23 bp, Homo sapiens
gtgatcaaagatggcgccactgc

SEQ ID NO: 7462 - DNA, 22 bp, Homo sapiens
tctcccttgttcacagttgcac

SEQ ID NO: 7463 - DNA, 22 bp, Homo sapiens
tgagctgtggaatctggcagca

SEQ ID NO: 7464 - DNA, 20 bp, Homo sapiens
catctggagtctagtttgca

SEQ ID NO: 7465 - DNA, 22 bp, Homo sapiens
ctcaacccactgggcgttagtt

SEQ ID NO: 7466 - DNA, 22 bp, Homo sapiens
tgacagtaatccaaagcctgtc

SEQ ID NO: 7467 - DNA, 23 bp, Homo sapiens
agcatggcgaaccatctgatcag

SEQ ID NO: 7468 - DNA, 22 bp, Homo sapiens
cagtgcaattggaaatcctgaa

SEQ ID NO: 7469 - DNA, 23 bp, Homo sapiens
cactttgggtctgggcgtggtgg

SEQ ID NO: 7470 - DNA, 21 bp, Homo sapiens
gcgtggcctggagctgggcga

SEQ ID NO: 7471 - DNA, 20 bp, Homo sapiens
gactcttagcggggcctttg

SEQ ID NO: 7472 - DNA, 20 bp, Homo sapiens
cgtgaggagctgggggtcgg

SEQ ID NO: 7473 - DNA, 23 bp, Homo sapiens
agcagacccctttgaaggcagga

SEQ ID NO: 7474 - DNA, 22 bp, Homo sapiens
gcacttactggtcgccagtccc

SEQ ID NO: 7475 - DNA, 20 bp, Homo sapiens
taactcagttcagcagacag

SEQ ID NO: 7476 - DNA, 21 bp, Homo sapiens
tggcagagcaagaatgcgatc

SEQ ID NO: 7477 - DNA, 22 bp, Homo sapiens
cccatacccggccgtcgaaggt

SEQ ID NO: 7478 - DNA, 20 bp, Homo sapiens
gccccatgttggactgttgg

SEQ ID NO: 7479 - DNA, 23 bp, Homo sapiens
tggctcacaagtcgtgtccactg

SEQ ID NO: 7480 - DNA, 22 bp, Homo sapiens
tcctcagagtcctaattcacag

SEQ ID NO: 7481 - DNA, 20 bp, Homo sapiens
agctacattgtctgcacttt

SEQ ID NO: 7482 - DNA, 20 bp, Homo sapiens
cagaaagcgggcaatgggct

SEQ ID NO: 7483 - DNA, 22 bp, Homo sapiens
tcagtgttcacttttattttta

SEQ ID NO: 7484 - DNA, 22 bp, Homo sapiens
tgatcatgggaagcagcatacc

SEQ ID NO: 7485 - DNA, 22 bp, Homo sapiens
tgagttaaacagaaataaaaac

SEQ ID NO: 7486 - DNA, 22 bp, Homo sapiens
tcaggctttgtgtagtttgtta

SEQ ID NO: 7487 - DNA, 20 bp, Homo sapiens
ggcgcgggcccgggtggggc

SEQ ID NO: 7488 - DNA, 21 bp, Homo sapiens
ccatgctgagaatcgctgttc

SEQ ID NO: 7489 - DNA, 20 bp, Homo sapiens
gaagaaattataagccaggc

SEQ ID NO: 7490 - DNA, 22 bp, Homo sapiens
atcagtttgctgggatgggaaa

SEQ ID NO: 7491 - DNA, 23 bp, Homo sapiens
tgctgacaacagaaattcaaaca

SEQ ID NO: 7492 - DNA, 22 bp, Homo sapiens
tccagccccagtggacaacaca

SEQ ID NO: 7493 - DNA, 23 bp, Homo sapiens
gtaacacagacaagtaaagtgac

SEQ ID NO: 7494 - DNA, 20 bp, Homo sapiens
atgccaggattttattctcc

SEQ ID NO: 7495 - DNA, 20 bp, Homo sapiens
atttcgactcttagcggaaa

SEQ ID NO: 7496 - DNA, 20 bp, Homo sapiens
gggatgtctattaggctttc

SEQ ID NO: 7497 - DNA, 20 bp, Homo sapiens
tccctgctccaacaccaact

SEQ ID NO: 7498 - DNA, 20 bp, Homo sapiens
gagaaagctcacaggaactt

SEQ ID NO: 7499 - DNA, 20 bp, Homo sapiens
cagctttggggggttagctc

SEQ ID NO: 7500 - DNA, 21 bp, Homo sapiens
cagaacctgcttaacatatca

SEQ ID NO: 7501 - DNA, 23 bp, Homo sapiens
agtgaggctatcacaggagcatg

SEQ ID NO: 7502 - DNA, 20 bp, Homo sapiens
tacaagtaactgtcttaaaa

SEQ ID NO: 7503 - DNA, 20 bp, Homo sapiens
tagtctgccaggtcagcacg

SEQ ID NO: 7504 - DNA, 23 bp, Homo sapiens
cacatgtgcaatgtctttactga

SEQ ID NO: 7505 - DNA, 24 bp, Homo sapiens
tctttctgactagcatatttctat

SEQ ID NO: 7506 - DNA, 21 bp, Homo sapiens
cctgtcattactgactatcca

SEQ ID NO: 7507 - DNA, 21 bp, Homo sapiens
cgcgcgccgctcgcgccctcc

SEQ ID NO: 7508 - DNA, 23 bp, Homo sapiens
gtattcagttcagctccggtgaa

SEQ ID NO: 7509 - DNA, 20 bp, Homo sapiens
gggcccaggatatgttcttt

SEQ ID NO: 7510 - DNA, 20 bp, Homo sapiens
cttcctttacaagctatgca

SEQ ID NO: 7511 - DNA, 22 bp, Homo sapiens
gtccagttttcccaggactata

SEQ ID NO: 7512 - DNA, 22 bp, Homo sapiens
acagcaggcacagagaagcagc

SEQ ID NO: 7513 - DNA, 21 bp, Homo sapiens
cgcgggagaccgggtgcgagc

SEQ ID NO: 7514 - DNA, 23 bp, Homo sapiens
tagcggtagtagtcagcaccttg

SEQ ID NO: 7515 - DNA, 20 bp, Homo sapiens
aggagtctacacatgtgata

SEQ ID NO: 7516 - DNA, 21 bp, Homo sapiens
gtccagttttctcaggaaatt

SEQ ID NO: 7517 - DNA, 23 bp, Homo sapiens
agcttatccacgtggcgttttgg

SEQ ID NO: 7518 - DNA, 21 bp, Homo sapiens
cccggggccctcccttatctg

SEQ ID NO: 7519 - DNA, 23 bp, Homo sapiens
ctccataattcccaggaatccat

SEQ ID NO: 7520 - DNA, 23 bp, Homo sapiens
caaagtgctgtgatgtaaggtat

SEQ ID NO: 7521 - DNA, 20 bp, Homo sapiens
aatatctgtgcagtatagca

SEQ ID NO: 7522 - DNA, 20 bp, Homo sapiens
tcagtttccctaatgttgcc

SEQ ID NO: 7523 - DNA, 20 bp, Homo sapiens
aggaaactctgtgttcctgc

SEQ ID NO: 7524 - DNA, 22 bp, Homo sapiens
tagctatgactcatgaagttga

SEQ ID NO: 7525 - DNA, 20 bp, Homo sapiens
gctgtggtggttcagtggtt

SEQ ID NO: 7526 - DNA, 20 bp, Homo sapiens
ggttgcctgcgatgacgagg

SEQ ID NO: 7527 - DNA, 20 bp, Homo sapiens
gcctggggccatcgattttt

SEQ ID NO: 7528 - DNA, 22 bp, Homo sapiens
ctgatggctgagtttattaata

SEQ ID NO: 7529 - DNA, 21 bp, Homo sapiens
cagacctatgggccataccat

SEQ ID NO: 7530 - DNA, 22 bp, Homo sapiens
cagggtttgtacccacaaaacc

SEQ ID NO: 7531 - DNA, 23 bp, Homo sapiens
tgactcaggtctcgtatccgcac

SEQ ID NO: 7532 - DNA, 21 bp, Homo sapiens
cccccggcacctccacccggc

SEQ ID NO: 7533 - DNA, 23 bp, Homo sapiens
tgaactggggaaactgaagcccc

SEQ ID NO: 7534 - DNA, 20 bp, Homo sapiens
tccctgtcctccaggagcca

SEQ ID NO: 7535 - DNA, 20 bp, Homo sapiens
ggggggcctacaagaacatc

SEQ ID NO: 7536 - DNA, 21 bp, Homo sapiens
ccccctccccgcccccggagc

SEQ ID NO: 7537 - DNA, 20 bp, Homo sapiens
gccttttacttcttctttct

SEQ ID NO: 7538 - DNA, 23 bp, Homo sapiens
cggccgcccccgtttctgggccc

SEQ ID NO: 7539 - DNA, 22 bp, Homo sapiens
gtccagtttagggaggaagaaa

SEQ ID NO: 7540 - DNA, 20 bp, Homo sapiens
agcagcaggtctccagagtg

SEQ ID NO: 7541 - DNA, 20 bp, Homo sapiens
agtgtatggtggcatgatca

SEQ ID NO: 7542 - DNA, 21 bp, Homo sapiens
tgggctaactacttatggtgc

SEQ ID NO: 7543 - DNA, 22 bp, Homo sapiens
caaagtctcaggatcattgtga

SEQ ID NO: 7544 - DNA, 22 bp, Homo sapiens
tagctggacatcatggtgggtg

SEQ ID NO: 7545 - DNA, 22 bp, Homo sapiens
cagtggtgcagcctttccatgc

SEQ ID NO: 7546 - DNA, 23 bp, Homo sapiens
caatctgattcagcaggcctgag

SEQ ID NO: 7547 - DNA, 21 bp, Homo sapiens
ccgcttcctcggacccgtccc

SEQ ID NO: 7548 - DNA, 23 bp, Homo sapiens
gtccagttggcccaggataggga

SEQ ID NO: 7549 - DNA, 22 bp, Homo sapiens
tgagtcattgagtttacaaaac

SEQ ID NO: 7550 - DNA, 22 bp, Homo sapiens
cagcaccagagagaatcgtggc

SEQ ID NO: 7551 - DNA, 23 bp, Homo sapiens
ttcaagtccctgttcaggtgcca

SEQ ID NO: 7552 - DNA, 21 bp, Homo sapiens
tgaaggttaatggtagcctaa

SEQ ID NO: 7553 - DNA, 20 bp, Homo sapiens
ctagaggtccacttccgatc

SEQ ID NO: 7554 - DNA, 22 bp, Homo sapiens
gatatgcggacgccaagtgcag

SEQ ID NO: 7555 - DNA, 22 bp, Homo sapiens
tgagtcaaactcattatgaacc

SEQ ID NO: 7556 - DNA, 23 bp, Homo sapiens
cttactactatattgcccagtac

SEQ ID NO: 7557 - DNA, 22 bp, Homo sapiens
gatgttccagacacaggactaa

SEQ ID NO: 7558 - DNA, 20 bp, Homo sapiens
gctcctgaggactgtggtaa

SEQ ID NO: 7559 - DNA, 22 bp, Homo sapiens
agagtagtctgtgtgccaccct

SEQ ID NO: 7560 - DNA, 20 bp, Homo sapiens
gagtctcacattgaactcag

SEQ ID NO: 7561 - DNA, 20 bp, Homo sapiens
ccccaaatctggcagcactc

SEQ ID NO: 7562 - DNA, 22 bp, Homo sapiens
gtcagtggtgggtgggaaggcc

SEQ ID NO: 7563 - DNA, 23 bp, Homo sapiens
catagaccaagtatgaaggtggc

SEQ ID NO: 7564 - DNA, 23 bp, Homo sapiens
atatgaaccaactgatcagtgct

SEQ ID NO: 7565 - DNA, 21 bp, Homo sapiens
atgggcatctaggctgtggtc

SEQ ID NO: 7566 - DNA, 22 bp, Homo sapiens
aaggatgcttgagtaccacaag

SEQ ID NO: 7567 - DNA, 22 bp, Homo sapiens
taagactctgggatctccactg

SEQ ID NO: 7568 - DNA, 20 bp, Homo sapiens
agcagggtgagcactcagat

SEQ ID NO: 7569 - DNA, 23 bp, Homo sapiens
aaatgttgcccagaatcagtgtt

SEQ ID NO: 7570 - DNA, 22 bp, Homo sapiens
ttcacatgtaactgctaatggt

SEQ ID NO: 7571 - DNA, 21 bp, Homo sapiens
tctggtttttgtccttcatgt

SEQ ID NO: 7572 - DNA, 22 bp, Homo sapiens
tatccttttaattggtatgttg

SEQ ID NO: 7573 - DNA, 20 bp, Homo sapiens
ggtgatactctcagcttgtg

SEQ ID NO: 7574 - DNA, 20 bp, Homo sapiens
gccgcccacccccgcggatc

SEQ ID NO: 7575 - DNA, 22 bp, Homo sapiens
gagtgacatagggaaagctacg

SEQ ID NO: 7576 - DNA, 20 bp, Homo sapiens
tagcttatgtccatgatgtt

SEQ ID NO: 7577 - DNA, 20 bp, Homo sapiens
tatcgggcccacaaaaatgt

SEQ ID NO: 7578 - DNA, 23 bp, Homo sapiens
ccttatgcagtgtttatggggtt

SEQ ID NO: 7579 - DNA, 23 bp, Homo sapiens
agaggcatgttctgtgtgttttc

SEQ ID NO: 7580 - DNA, 21 bp, Homo sapiens
aagaatgaagcactgtactca

SEQ ID NO: 7581 - DNA, 21 bp, Homo sapiens
ccccccactgctcccgaggac

SEQ ID NO: 7582 - DNA, 22 bp, Homo sapiens
gatgtcatgacactaagtgcag

SEQ ID NO: 7583 - DNA, 22 bp, Homo sapiens
agctaaggggctgttttctgac

SEQ ID NO: 7584 - DNA, 22 bp, Homo sapiens
tgccttgtaatggtgatgactg

SEQ ID NO: 7585 - DNA, 20 bp, Homo sapiens
aagcagcacgtaggcgcgct

SEQ ID NO: 7586 - DNA, 23 bp, Homo sapiens
gagactgggaagtgaaggctcag

SEQ ID NO: 7587 - DNA, 23 bp, Homo sapiens
cattacatctgtgacatgaaaga

SEQ ID NO: 7588 - DNA, 23 bp, Homo sapiens
tagcttatcagatagatgccaac

SEQ ID NO: 7589 - DNA, 21 bp, Homo sapiens
ctgacctataggccatcacaa

SEQ ID NO: 7590 - DNA, 20 bp, Homo sapiens
acacctgagacaagtccgct

SEQ ID NO: 7591 - DNA, 22 bp, Homo sapiens
tgagtgctggagccagcgctgg

SEQ ID NO: 7592 - DNA, 20 bp, Homo sapiens
gcatgtcagaggctattatg

SEQ ID NO: 7593 - DNA, 21 bp, Homo sapiens
acgatgtaacatcatcttctt

SEQ ID NO: 7594 - DNA, 23 bp, Homo sapiens
tagcttatcaagtgagacaaagt

SEQ ID NO: 7595 - DNA, 22 bp, Homo sapiens
ctctaattaggatggctactag

SEQ ID NO: 7596 - DNA, 23 bp, Homo sapiens
ccctacagtagcaacaggttttt

SEQ ID NO: 7597 - DNA, 21 bp, Homo sapiens
atatacgtgtctatatgcata

SEQ ID NO: 7598 - DNA, 23 bp, Homo sapiens
atcagcaaacatgttataagcag

SEQ ID NO: 7599 - DNA, 20 bp, Homo sapiens
aatcaactcatattgctttt

SEQ ID NO: 7600 - DNA, 22 bp, Homo sapiens
tgacagtaatccaggcactttg

SEQ ID NO: 7601 - DNA, 22 bp, Homo sapiens
tctttgcttaggctgatatctg

SEQ ID NO: 7602 - DNA, 22 bp, Homo sapiens
ttcaagtaattatcctatctgg

SEQ ID NO: 7603 - DNA, 20 bp, Homo sapiens
gtccagttttcccagtcaag

SEQ ID NO: 7604 - DNA, 21 bp, Homo sapiens
tgtggtgatggtcttgcagat

SEQ ID NO: 7605 - DNA, 22 bp, Homo sapiens
atttctgcacatatgcatagga

SEQ ID NO: 7606 - DNA, 22 bp, Homo sapiens
aagcagcctgtcccatacccct

SEQ ID NO: 7607 - DNA, 23 bp, Homo sapiens
gtccagtttcaaacttctgaaaa

SEQ ID NO: 7608 - DNA, 20 bp, Homo sapiens
taccactgtctggtaaatgt

SEQ ID NO: 7609 - DNA, 21 bp, Homo sapiens
tagcttatcagaccaaggggc

SEQ ID NO: 7610 - DNA, 21 bp, Homo sapiens
cagatctgttattcacaggga

SEQ ID NO: 7611 - DNA, 23 bp, Homo sapiens
atacatatatacaatattaaatt

SEQ ID NO: 7612 - DNA, 20 bp, Homo sapiens
cctcccatctagtttctact

SEQ ID NO: 7613 - DNA, 22 bp, Homo sapiens
cccctccccgaggcccgcggcg

SEQ ID NO: 7614 - DNA, 22 bp, Homo sapiens
attggaaccaggactagggtct

SEQ ID NO: 7615 - DNA, 22 bp, Homo sapiens
tgctggtggtctgggctggggt

SEQ ID NO: 7616 - DNA, 24 bp, Homo sapiens
ctcctgacccacctctcccccagc

SEQ ID NO: 7617 - DNA, 20 bp, Homo sapiens
tcctacgactcttagcaggt

SEQ ID NO: 7618 - DNA, 20 bp, Homo sapiens
acgctcatcagacaccacca

SEQ ID NO: 7619 - DNA, 21 bp, Homo sapiens
caatttcatcgggattggcag

SEQ ID NO: 7620 - DNA, 23 bp, Homo sapiens
tgctgacccagaaattaccccat

SEQ ID NO: 7621 - DNA, 24 bp, Homo sapiens
tctccagtcctctttttgccctca

SEQ ID NO: 7622 - DNA, 22 bp, Homo sapiens
gctgctgccaccaggatagtat

SEQ ID NO: 7623 - DNA, 20 bp, Homo sapiens
cagagtgagtctagtctgta

SEQ ID NO: 7624 - DNA, 22 bp, Homo sapiens
tgggagtcttcagcaggagtgg

SEQ ID NO: 7625 - DNA, 20 bp, Homo sapiens
ggctttgtcatattgcccag

SEQ ID NO: 7626 - DNA, 22 bp, Homo sapiens
agatcacaccactgcagcatag

SEQ ID NO: 7627 - DNA, 21 bp, Homo sapiens
agacctatgaattgacactga

SEQ ID NO: 7628 - DNA, 23 bp, Homo sapiens
agctatgccacgtgagaagggga

SEQ ID NO: 7629 - DNA, 20 bp, Homo sapiens
tagcagcactgccatattgc

SEQ ID NO: 7630 - DNA, 23 bp, Homo sapiens
aagcagcagccaaaatcagtgtt

SEQ ID NO: 7631 - DNA, 23 bp, Homo sapiens
gcaacagcatcaccaacacatcg

SEQ ID NO: 7632 - DNA, 20 bp, Homo sapiens
agatgttggtattgaacttc

SEQ ID NO: 7633 - DNA, 20 bp, Homo sapiens
ctaggatgccggagcggtct

SEQ ID NO: 7634 - DNA, 21 bp, Homo sapiens
gttggaggatgaaagtacgga

SEQ ID NO: 7635 - DNA, 23 bp, Homo sapiens
tgcgggtcatcagcaggacactg

SEQ ID NO: 7636 - DNA, 20 bp, Homo sapiens
gcgatagtctcttcatatca

SEQ ID NO: 7637 - DNA, 21 bp, Homo sapiens
acacatcagacgtgtgaccct

SEQ ID NO: 7638 - DNA, 21 bp, Homo sapiens
acaataatgaaccatgcaagt

SEQ ID NO: 7639 - DNA, 20 bp, Homo sapiens
gccgggagcggcgggggcgg

SEQ ID NO: 7640 - DNA, 22 bp, Homo sapiens
gagaccatcagacccgcaaaac

SEQ ID NO: 7641 - DNA, 22 bp, Homo sapiens
ctgaatctctgaaaaggggaag

SEQ ID NO: 7642 - DNA, 20 bp, Homo sapiens
atgtagtctcgctattgttg

SEQ ID NO: 7643 - DNA, 20 bp, Homo sapiens
gagaattttcactgtaactc

SEQ ID NO: 7644 - DNA, 20 bp, Homo sapiens
tccacagtggctaaaccttt

SEQ ID NO: 7645 - DNA, 23 bp, Homo sapiens
tataggcgtgagccagcacactg

SEQ ID NO: 7646 - DNA, 20 bp, Homo sapiens
ataaggttaatgcatatgtg

SEQ ID NO: 7647 - DNA, 20 bp, Homo sapiens
actactgcttcattctacat

SEQ ID NO: 7648 - DNA, 21 bp, Homo sapiens
cctcccaagagaacatggtca

SEQ ID NO: 7649 - DNA, 21 bp, Homo sapiens
gcagaccattaggaagaactg

SEQ ID NO: 7650 - DNA, 20 bp, Homo sapiens
accgaagctgaatttgcaca

SEQ ID NO: 7651 - DNA, 22 bp, Homo sapiens
gtccagcccttttgatggcttt

SEQ ID NO: 7652 - DNA, 20 bp, Homo sapiens
gtccagttttcccaaggagt

SEQ ID NO: 7653 - DNA, 23 bp, Homo sapiens
tcccaccacactttggaaggcca

SEQ ID NO: 7654 - DNA, 20 bp, Homo sapiens
ttcgattctcgccatctctg

SEQ ID NO: 7655 - DNA, 24 bp, Homo sapiens
catggtttcccctctgctggcagc

SEQ ID NO: 7656 - DNA, 22 bp, Homo sapiens
actgtcgtgccagtttaatcca

SEQ ID NO: 7657 - DNA, 22 bp, Homo sapiens
gcagagggtaatgctaggtggt

SEQ ID NO: 7658 - DNA, 20 bp, Homo sapiens
tactcttctagtaaaaaatc

SEQ ID NO: 7659 - DNA, 23 bp, Homo sapiens
ggagtttcagcttgattgcatta

SEQ ID NO: 7660 - DNA, 21 bp, Homo sapiens
tctgcacgcctggtccccttt

SEQ ID NO: 7661 - DNA, 22 bp, Homo sapiens
tggaggggaggagggcgggtgc

SEQ ID NO: 7662 - DNA, 23 bp, Homo sapiens
caaagtgctgcaattgcagacgt

SEQ ID NO: 7663 - DNA, 22 bp, Homo sapiens
tggctcagcctgacaggctttc

SEQ ID NO: 7664 - DNA, 22 bp, Homo sapiens
tcagagaggactggcatccccg

SEQ ID NO: 7665 - DNA, 23 bp, Homo sapiens
cttccatctccatcaccttgagc

SEQ ID NO: 7666 - DNA, 24 bp, Homo sapiens
tgtgcactgtacacatacatgtga

SEQ ID NO: 7667 - DNA, 21 bp, Homo sapiens
tgttgggaaaatacagttatc

SEQ ID NO: 7668 - DNA, 23 bp, Homo sapiens
aggcagagaataagagcaatata

SEQ ID NO: 7669 - DNA, 22 bp, Homo sapiens
ttgggtcatggaggtggattct

SEQ ID NO: 7670 - DNA, 22 bp, Homo sapiens
agcagccttgtacagggcagaa

SEQ ID NO: 7671 - DNA, 20 bp, Homo sapiens
tagcagcacatcatagcggt

SEQ ID NO: 7672 - DNA, 20 bp, Homo sapiens
atcacattgggtcctcccag

SEQ ID NO: 7673 - DNA, 20 bp, Homo sapiens
gcaagttgttggactgtcag

SEQ ID NO: 7674 - DNA, 20 bp, Homo sapiens
gacttttaatcattgggcca

SEQ ID NO: 7675 - DNA, 21 bp, Homo sapiens
aaaataatgaaccatgcataa

SEQ ID NO: 7676 - DNA, 23 bp, Homo sapiens
tatgcaagcttgcatgcttgact

SEQ ID NO: 7677 - DNA, 22 bp, Homo sapiens
agagacactctttagtgtggga

SEQ ID NO: 7678 - DNA, 21 bp, Homo sapiens
ctcccatagctgtgcttcagt

SEQ ID NO: 7679 - DNA, 22 bp, Homo sapiens
tatcagcacatcatgcaacact

SEQ ID NO: 7680 - DNA, 22 bp, Homo sapiens
tcaaatctctgaaaaggggctc

SEQ ID NO: 7681 - DNA, 20 bp, Homo sapiens
atagtttttattttcataac

SEQ ID NO: 7682 - DNA, 20 bp, Homo sapiens
gccctggtagtctagtggcc

SEQ ID NO: 7683 - DNA, 21 bp, Homo sapiens
gtccagtgcctttgagttagg

SEQ ID NO: 7684 - DNA, 21 bp, Homo sapiens
atcccattgccagggaataca

SEQ ID NO: 7685 - DNA, 22 bp, Homo sapiens
tgggactctggagccagacaca

SEQ ID NO: 7686 - DNA, 20 bp, Homo sapiens
ttgcgctggctctttaagag

SEQ ID NO: 7687 - DNA, 22 bp, Homo sapiens
gtgcaccgattgtgtggctgga

SEQ ID NO: 7688 - DNA, 21 bp, Homo sapiens
ggtggctctgcccaaggtgca

SEQ ID NO: 7689 - DNA, 20 bp, Homo sapiens
cgcgacctcctcgacttccg

SEQ ID NO: 7690 - DNA, 20 bp, Homo sapiens
aacacacgttcccaaggtgc

SEQ ID NO: 7691 - DNA, 22 bp, Homo sapiens
tagcacacagagacaagcaggg

SEQ ID NO: 7692 - DNA, 20 bp, Homo sapiens
gctgctaatgaagctctttc

SEQ ID NO: 7693 - DNA, 20 bp, Homo sapiens
cattcacgagcttaggacag

SEQ ID NO: 7694 - DNA, 22 bp, Homo sapiens
tcgctgtgatgagtgatgggga

SEQ ID NO: 7695 - DNA, 20 bp, Homo sapiens
gcctcctatgaattggcagc

SEQ ID NO: 7696 - DNA, 22 bp, Homo sapiens
tacgtcaacactgggcggggat

SEQ ID NO: 7697 - DNA, 20 bp, Homo sapiens
gaaagaccccgtggagcttg

SEQ ID NO: 7698 - DNA, 23 bp, Homo sapiens
atattccagccgacagctcgtgc

SEQ ID NO: 7699 - DNA, 22 bp, Homo sapiens
cccggcaccttcaccacaatgg

SEQ ID NO: 7700 - DNA, 21 bp, Homo sapiens
cgcgacagccgtgtgatgatg

SEQ ID NO: 7701 - DNA, 23 bp, Homo sapiens
tcggccgtgatgcctcacaccca

SEQ ID NO: 7702 - DNA, 21 bp, Homo sapiens
tctcccagcacagccccctga

SEQ ID NO: 7703 - DNA, 20 bp, Homo sapiens
cccctcctcctcggcgcaca

SEQ ID NO: 7704 - DNA, 22 bp, Homo sapiens
gagcttccctgacccctgggtg

SEQ ID NO: 7705 - DNA, 21 bp, Homo sapiens
cagcagcacactgtgacccaa

SEQ ID NO: 7706 - DNA, 23 bp, Homo sapiens
gctgccgcgccgccctccaggcg

SEQ ID NO: 7707 - DNA, 22 bp, Homo sapiens
cggtgtcactcaacgtgggcag

SEQ ID NO: 7708 - DNA, 20 bp, Homo sapiens
ctctcggggccatatattat

SEQ ID NO: 7709 - DNA, 21 bp, Homo sapiens
cggcagtgtcttagctgtgtg

SEQ ID NO: 7710 - DNA, 23 bp, Homo sapiens
agcagcaaacacacagcagccac

SEQ ID NO: 7711 - DNA, 23 bp, Homo sapiens
gaggttactactggttacgggac

SEQ ID NO: 7712 - DNA, 20 bp, Homo sapiens
gccccgccctcttttaaaag

SEQ ID NO: 7713 - DNA, 24 bp, Homo sapiens
ccgcccccggagccccgcccagcg

SEQ ID NO: 7714 - DNA, 24 bp, Homo sapiens
gcacctgctccgcggcggcctccc

SEQ ID NO: 7715 - DNA, 20 bp, Homo sapiens
tggagcaggatgtcaggtca

SEQ ID NO: 7716 - DNA, 22 bp, Homo sapiens
caggatgaaaagaagcagacgg

SEQ ID NO: 7717 - DNA, 21 bp, Homo sapiens
tcaacaccttccacccccaca

SEQ ID NO: 7718 - DNA, 22 bp, Homo sapiens
gtccagttttcccaaagctgac

SEQ ID NO: 7719 - DNA, 22 bp, Homo sapiens
agtagcttagggtgggatctag

SEQ ID NO: 7720 - DNA, 21 bp, Homo sapiens
tagcacctcgactttagctgg

SEQ ID NO: 7721 - DNA, 22 bp, Homo sapiens
tctagttgggaagcagttatgt

SEQ ID NO: 7722 - DNA, 20 bp, Homo sapiens
ctaagtgatgatgtataact

SEQ ID NO: 7723 - DNA, 22 bp, Homo sapiens
tcatggccctctgggcgtggca

SEQ ID NO: 7724 - DNA, 21 bp, Homo sapiens
catcaagcatttattgatgtt

SEQ ID NO: 7725 - DNA, 20 bp, Homo sapiens
gagttgggttaaattgccag

SEQ ID NO: 7726 - DNA, 22 bp, Homo sapiens
acagtagagaccactaaccatt

SEQ ID NO: 7727 - DNA, 23 bp, Homo sapiens
tgaccatacttaactgtattaag

SEQ ID NO: 7728 - DNA, 20 bp, Homo sapiens
tcgtattacagataaaatgc

SEQ ID NO: 7729 - DNA, 23 bp, Homo sapiens
tatagacacctgatgactgtggc

SEQ ID NO: 7730 - DNA, 24 bp, Homo sapiens
aagctcccactcacagcaccagtg

SEQ ID NO: 7731 - DNA, 22 bp, Homo sapiens
cagactgggtgatttatttttc

SEQ ID NO: 7732 - DNA, 22 bp, Homo sapiens
gtcacagtggctactggaaggc

SEQ ID NO: 7733 - DNA, 23 bp, Homo sapiens
aagcttatcagacacatgtgatg

SEQ ID NO: 7734 - DNA, 20 bp, Homo sapiens
cgcgccccccccccacccca

SEQ ID NO: 7735 - DNA, 22 bp, Homo sapiens
ggctgtgggaagcaggcgccct

SEQ ID NO: 7736 - DNA, 22 bp, Homo sapiens
caaaggttaatgcacttgggat

SEQ ID NO: 7737 - DNA, 22 bp, Homo sapiens
atctgtgggcaggggcgttcca

SEQ ID NO: 7738 - DNA, 22 bp, Homo sapiens
acacgtccgaggagcagcagct

SEQ ID NO: 7739 - DNA, 20 bp, Homo sapiens
ggtggagcacgagcgcagct

SEQ ID NO: 7740 - DNA, 23 bp, Homo sapiens
gatttattgaagactaaagcaga

SEQ ID NO: 7741 - DNA, 20 bp, Homo sapiens
ttcccgcgtggaggtgtgct

SEQ ID NO: 7742 - DNA, 20 bp, Homo sapiens
cccagccctgctccagcact

SEQ ID NO: 7743 - DNA, 23 bp, Homo sapiens
gagatcccctgatggctgggacc

SEQ ID NO: 7744 - DNA, 23 bp, Homo sapiens
tctaggagaagagcaggaacagt

SEQ ID NO: 7745 - DNA, 22 bp, Homo sapiens
tcggtccctaaccccctccgga

SEQ ID NO: 7746 - DNA, 20 bp, Homo sapiens
caggagaatcgccaccgcgc

SEQ ID NO: 7747 - DNA, 22 bp, Homo sapiens
cctcttctcatctccccacaga

SEQ ID NO: 7748 - DNA, 20 bp, Homo sapiens
gggggtgtagctcagtgtgt

SEQ ID NO: 7749 - DNA, 22 bp, Homo sapiens
tgagtacccagcaaataaatgt

SEQ ID NO: 7750 - DNA, 22 bp, Homo sapiens
gagtctgggcttgagataggcc

SEQ ID NO: 7751 - DNA, 23 bp, Homo sapiens
gaggaagctgagctgatggtgac

SEQ ID NO: 7752 - DNA, 20 bp, Homo sapiens
ccagattgacccccagtctg

SEQ ID NO: 7753 - DNA, 22 bp, Homo sapiens
ctagctttagaatcttccacca

SEQ ID NO: 7754 - DNA, 22 bp, Homo sapiens
actggacttggagtcaaaagat

SEQ ID NO: 7755 - DNA, 20 bp, Homo sapiens
catcttatgtctgtgatgtt

SEQ ID NO: 7756 - DNA, 22 bp, Homo sapiens
tctcaaccaaaggtagccagtg

SEQ ID NO: 7757 - DNA, 23 bp, Homo sapiens
atagtctcatcacagggctatga

SEQ ID NO: 7758 - DNA, 20 bp, Homo sapiens
agctcccacacaggtctgct

SEQ ID NO: 7759 - DNA, 20 bp, Homo sapiens
atcccaaatagtaacatgag

SEQ ID NO: 7760 - DNA, 23 bp, Homo sapiens
atctacaggtgatgctgttgggc

SEQ ID NO: 7761 - DNA, 20 bp, Homo sapiens
tgaattgcaggacacatagc

SEQ ID NO: 7762 - DNA, 22 bp, Homo sapiens
tggaagtgtcttagtcagctgt

SEQ ID NO: 7763 - DNA, 20 bp, Homo sapiens
aagagacatgagaggtgatg

SEQ ID NO: 7764 - DNA, 23 bp, Homo sapiens
tgtcctgctgctgggcgtggtgg

SEQ ID NO: 7765 - DNA, 22 bp, Homo sapiens
agggaacaaatgcactatcttc

SEQ ID NO: 7766 - DNA, 21 bp, Homo sapiens
agcgttctacctggcttagct

SEQ ID NO: 7767 - DNA, 20 bp, Homo sapiens
aagataatgtagaggcggcg

SEQ ID NO: 7768 - DNA, 20 bp, Homo sapiens
ataaacgatgccgaccgaca

SEQ ID NO: 7769 - DNA, 23 bp, Homo sapiens
cagttgctgcttggtgtgctgtc

SEQ ID NO: 7770 - DNA, 20 bp, Homo sapiens
gcctcgtcctacagcctagc

SEQ ID NO: 7771 - DNA, 24 bp, Homo sapiens
cagttgctgcttggtgtgttgtcc

SEQ ID NO: 7772 - DNA, 21 bp, Homo sapiens
ctagatggtttcctcgttctg

SEQ ID NO: 7773 - DNA, 20 bp, Homo sapiens
taggtgccattgaaggccct

SEQ ID NO: 7774 - DNA, 22 bp, Homo sapiens
acagtcaagtgacccgctcaac

SEQ ID NO: 7775 - DNA, 22 bp, Homo sapiens
catgaaccggcatgtctctgag

SEQ ID NO: 7776 - DNA, 22 bp, Homo sapiens
gaatagaacataaatagctgct

SEQ ID NO: 7777 - DNA, 24 bp, Homo sapiens
tatgatgatgccttaacactgact

SEQ ID NO: 7778 - DNA, 22 bp, Homo sapiens
gccggtatagctactttggaag

SEQ ID NO: 7779 - DNA, 23 bp, Homo sapiens
gatgatgcaagctacttctgtct

SEQ ID NO: 7780 - DNA, 21 bp, Homo sapiens
gaacatcatctgagctgagtg

SEQ ID NO: 7781 - DNA, 23 bp, Homo sapiens
tccctgagaccctttctggaggt

SEQ ID NO: 7782 - DNA, 24 bp, Homo sapiens
ctcctccgacccagccagcaggac

SEQ ID NO: 7783 - DNA, 22 bp, Homo sapiens
aacatctgcctctcttgccccc

SEQ ID NO: 7784 - DNA, 24 bp, Homo sapiens
tcaaatggcaatgcctggatttaa

SEQ ID NO: 7785 - DNA, 23 bp, Homo sapiens
gcaacagccttcataggctaggt

SEQ ID NO: 7786 - DNA, 23 bp, Homo sapiens
cggctgtaccaccacaacttaaa

SEQ ID NO: 7787 - DNA, 23 bp, Homo sapiens
ggccgtgatgaaacaacctgagt

SEQ ID NO: 7788 - DNA, 20 bp, Homo sapiens
ggaacctagtgagccgagca

SEQ ID NO: 7789 - DNA, 23 bp, Homo sapiens
ctccttaacttaaaacttcaaga

SEQ ID NO: 7790 - DNA, 21 bp, Homo sapiens
ccaaggtattactgagcagag

SEQ ID NO: 7791 - DNA, 22 bp, Homo sapiens
tgctgttgtagtttatggggtt

SEQ ID NO: 7792 - DNA, 23 bp, Homo sapiens
tactgacccactaccgcccccat

SEQ ID NO: 7793 - DNA, 21 bp, Homo sapiens
tttttggaaataggagtccat

SEQ ID NO: 7794 - DNA, 22 bp, Homo sapiens
aaacctggcagtttatcctcta

SEQ ID NO: 7795 - DNA, 20 bp, Homo sapiens
ccggcgacgggggggggggc

SEQ ID NO: 7796 - DNA, 22 bp, Homo sapiens
tattgcactgagaaattaagtc

SEQ ID NO: 7797 - DNA, 20 bp, Homo sapiens
cccctcctcccgcccacgcc

SEQ ID NO: 7798 - DNA, 23 bp, Homo sapiens
tataggcgtgagtcagcatgccg

SEQ ID NO: 7799 - DNA, 20 bp, Homo sapiens
tggctcagttcaggagtctt

SEQ ID NO: 7800 - DNA, 22 bp, Homo sapiens
tgtgactctgggattggtcact

SEQ ID NO: 7801 - DNA, 23 bp, Homo sapiens
tgatcatagttcaacgtaaactg

SEQ ID NO: 7802 - DNA, 22 bp, Homo sapiens
tcctgtgccagacccgcaggtt

SEQ ID NO: 7803 - DNA, 20 bp, Homo sapiens
cttgaagctcatgttggtct

SEQ ID NO: 7804 - DNA, 22 bp, Homo sapiens
cattattataaaaatgcatatg

SEQ ID NO: 7805 - DNA, 20 bp, Homo sapiens
gagcgccgcgtgggggccag

SEQ ID NO: 7806 - DNA, 21 bp, Homo sapiens
agtctgtgccagcagccgcag

SEQ ID NO: 7807 - DNA, 21 bp, Homo sapiens
gcggcctatcagatcagcagc

SEQ ID NO: 7808 - DNA, 23 bp, Homo sapiens
ttatctgctagctacttcacagt

SEQ ID NO: 7809 - DNA, 23 bp, Homo sapiens
agcagctaacatgtcctgagcat

SEQ ID NO: 7810 - DNA, 22 bp, Homo sapiens
ctgctctctgggatttccacag

SEQ ID NO: 7811 - DNA, 22 bp, Homo sapiens
gaggtcgtgcatggcatcatta

SEQ ID NO: 7812 - DNA, 23 bp, Homo sapiens
gcttgaccttcccaggaaaaaag

SEQ ID NO: 7813 - DNA, 22 bp, Homo sapiens
cagtgcaattggcccctggagc

SEQ ID NO: 7814 - DNA, 20 bp, Homo sapiens
attttttgtgatcatatcgt

SEQ ID NO: 7815 - DNA, 21 bp, Homo sapiens
acaggtagtaggttgcgtagt

SEQ ID NO: 7816 - DNA, 22 bp, Homo sapiens
ttctgtgggctcaggcgtccca

SEQ ID NO: 7817 - DNA, 21 bp, Homo sapiens
gacgtagatgctggctgctag

SEQ ID NO: 7818 - DNA, 22 bp, Homo sapiens
ggcagtggttttgtttccttgt

SEQ ID NO: 7819 - DNA, 21 bp, Homo sapiens
tggaatggcaacggcagagac

SEQ ID NO: 7820 - DNA, 20 bp, Homo sapiens
gtccagttttcccagaggac

SEQ ID NO: 7821 - DNA, 22 bp, Homo sapiens
tggagagccagtgagatagata

SEQ ID NO: 7822 - DNA, 20 bp, Homo sapiens
tctttaaataatatgttgcc

SEQ ID NO: 7823 - DNA, 22 bp, Homo sapiens
tcaggagaacagtttattttca

SEQ ID NO: 7824 - DNA, 22 bp, Homo sapiens
atctgtagtcccggttactcac

SEQ ID NO: 7825 - DNA, 22 bp, Homo sapiens
tgagtcaggcatggtagtgggt

SEQ ID NO: 7826 - DNA, 20 bp, Homo sapiens
gcgcccacaacctgacggtg

SEQ ID NO: 7827 - DNA, 22 bp, Homo sapiens
ggcactcaattctgcggtagga

SEQ ID NO: 7828 - DNA, 20 bp, Homo sapiens
gagacttctcctgggcacca

SEQ ID NO: 7829 - DNA, 23 bp, Homo sapiens
agcagtgaaagggtccttagggt

SEQ ID NO: 7830 - DNA, 23 bp, Homo sapiens
ctgggctgtaaggacagcagggg

SEQ ID NO: 7831 - DNA, 23 bp, Homo sapiens
actgtctttgctcaggacctcag

SEQ ID NO: 7832 - DNA, 22 bp, Homo sapiens
tccctgagacttcggagacatt

SEQ ID NO: 7833 - DNA, 22 bp, Homo sapiens
gaaattccgtctctgggcaaca

SEQ ID NO: 7834 - DNA, 21 bp, Homo sapiens
ttcactgcccctgggatagga

SEQ ID NO: 7835 - DNA, 22 bp, Homo sapiens
tggctcagttcagccatccctg

SEQ ID NO: 7836 - DNA, 20 bp, Homo sapiens
agcccccagaaaaggtgatc

SEQ ID NO: 7837 - DNA, 22 bp, Homo sapiens
tgtcctgggtgacccatggggc

SEQ ID NO: 7838 - DNA, 20 bp, Homo sapiens
tgctcttgaagtcctcggct

SEQ ID NO: 7839 - DNA, 23 bp, Homo sapiens
gtccaatttcttcaggaatccag

SEQ ID NO: 7840 - DNA, 22 bp, Homo sapiens
tctactacagctgcaacctacc

SEQ ID NO: 7841 - DNA, 22 bp, Homo sapiens
ctcacttgcctctctccccagg

SEQ ID NO: 7842 - DNA, 24 bp, Homo sapiens
ggatgttggccctgcagttccatc

SEQ ID NO: 7843 - DNA, 24 bp, Homo sapiens
cgggcccgcccagcgccgcagccc

SEQ ID NO: 7844 - DNA, 22 bp, Homo sapiens
ttcaagtaatcctcccgctgct

SEQ ID NO: 7845 - DNA, 22 bp, Homo sapiens
tggtgactaagtcacttctgtc

SEQ ID NO: 7846 - DNA, 23 bp, Homo sapiens
cggcggcggcggcgactcaggac

SEQ ID NO: 7847 - DNA, 20 bp, Homo sapiens
tttttaaagccaaccctttg

SEQ ID NO: 7848 - DNA, 22 bp, Homo sapiens
ggagcagctgggatatccacag

SEQ ID NO: 7849 - DNA, 22 bp, Homo sapiens
agctagggcggcagcaggtggt

SEQ ID NO: 7850 - DNA, 22 bp, Homo sapiens
ttcaagtaatatgaaggctcaa

SEQ ID NO: 7851 - DNA, 20 bp, Homo sapiens
gcagtccatgggcatgcata

SEQ ID NO: 7852 - DNA, 21 bp, Homo sapiens
agcaataccgtcatgtttcag

SEQ ID NO: 7853 - DNA, 21 bp, Homo sapiens
gcggaccagagcagggatgcc

SEQ ID NO: 7854 - DNA, 22 bp, Homo sapiens
atcgccgctgagtcagcaacgc

SEQ ID NO: 7855 - DNA, 24 bp, Homo sapiens
ctacaaaaaattaaaaacttaaaa

SEQ ID NO: 7856 - DNA, 23 bp, Homo sapiens
tgcttacatctatgcaaagtcag

SEQ ID NO: 7857 - DNA, 22 bp, Homo sapiens
gggaccaggctaaacagtgttg

SEQ ID NO: 7858 - DNA, 22 bp, Homo sapiens
tggagggctgagtcagcgtcag

SEQ ID NO: 7859 - DNA, 22 bp, Homo sapiens
ccagtgctgatgtcttgttact

SEQ ID NO: 7860 - DNA, 22 bp, Homo sapiens
ccccgcgcccccgccccggctc

SEQ ID NO: 7861 - DNA, 22 bp, Homo sapiens
tctcatccacctgttatgtttg

SEQ ID NO: 7862 - DNA, 23 bp, Homo sapiens
aagctccagtttacaagacaccc

SEQ ID NO: 7863 - DNA, 21 bp, Homo sapiens
tgagctggggtttctggcagg

SEQ ID NO: 7864 - DNA, 22 bp, Homo sapiens
tccctgagactgcggtccactg

SEQ ID NO: 7865 - DNA, 21 bp, Homo sapiens
agcagtaacagttgccaaatg

SEQ ID NO: 7866 - DNA, 23 bp, Homo sapiens
tagtgcaatgttgcaagggcatt

SEQ ID NO: 7867 - DNA, 22 bp, Homo sapiens
tctcaaccaaaggtaaccacac

SEQ ID NO: 7868 - DNA, 22 bp, Homo sapiens
tctccagagcccttgtcgctga

SEQ ID NO: 7869 - DNA, 22 bp, Homo sapiens
acaacaacattaaaccacccga

SEQ ID NO: 7870 - DNA, 23 bp, Homo sapiens
cccgacagggaggtggccgggcg

SEQ ID NO: 7871 - DNA, 23 bp, Homo sapiens
gcgactgcctccctgctgtgagc

SEQ ID NO: 7872 - DNA, 22 bp, Homo sapiens
gagtaccaggatgcccactcct

SEQ ID NO: 7873 - DNA, 20 bp, Homo sapiens
ggtcctttttttattttttt

SEQ ID NO: 7874 - DNA, 21 bp, Homo sapiens
cagctgccagacccgcaactg

SEQ ID NO: 7875 - DNA, 22 bp, Homo sapiens
ggagatgccactgttatgaagt

SEQ ID NO: 7876 - DNA, 20 bp, Homo sapiens
ctatgtaccaatcctgggct

SEQ ID NO: 7877 - DNA, 20 bp, Homo sapiens
agcggctgtgcaaaaacaaa

SEQ ID NO: 7878 - DNA, 22 bp, Homo sapiens
tatactggtgtctttatttttg

SEQ ID NO: 7879 - DNA, 20 bp, Homo sapiens
cccgcgcgggggcgcgcatc

SEQ ID NO: 7880 - DNA, 20 bp, Homo sapiens
tcccacgtcgggcgccaatc

SEQ ID NO: 7881 - DNA, 21 bp, Homo sapiens
gataagacctcagatcagaca

SEQ ID NO: 7882 - DNA, 22 bp, Homo sapiens
tataagtgtgctgcataaatgt

SEQ ID NO: 7883 - DNA, 20 bp, Homo sapiens
cctctccgccccccggcatc

SEQ ID NO: 7884 - DNA, 20 bp, Homo sapiens
cagtgcaatgttatttctgt

SEQ ID NO: 7885 - DNA, 22 bp, Homo sapiens
tttacatacctatagatatgtc

SEQ ID NO: 7886 - DNA, 22 bp, Homo sapiens
gaaagtctcaaagcatgatgtc

SEQ ID NO: 7887 - DNA, 22 bp, Homo sapiens
catcaagggaagtttatttttg

SEQ ID NO: 7888 - DNA, 20 bp, Homo sapiens
ggtagttagtctagtctgca

SEQ ID NO: 7889 - DNA, 22 bp, Homo sapiens
tagcagcaagtaccagcaccca

SEQ ID NO: 7890 - DNA, 23 bp, Homo sapiens
gtaatcaaaagggtccttaaaag

SEQ ID NO: 7891 - DNA, 22 bp, Homo sapiens
atctgtagtaaaaactacaggc

SEQ ID NO: 7892 - DNA, 22 bp, Homo sapiens
ctcccaggtggcacatatgcac

SEQ ID NO: 7893 - DNA, 23 bp, Homo sapiens
tctcctgacccttgtactgactg

SEQ ID NO: 7894 - DNA, 23 bp, Homo sapiens
taagaatagctcatgatgttgaa

SEQ ID NO: 7895 - DNA, 20 bp, Homo sapiens
ggacactgacgcggacctta

SEQ ID NO: 7896 - DNA, 23 bp, Homo sapiens
tgatccgctgagtaagcacctcc

SEQ ID NO: 7897 - DNA, 22 bp, Homo sapiens
atttcagggttactcaatgcac

SEQ ID NO: 7898 - DNA, 23 bp, Homo sapiens
ttctgtttgtcaaatattttggc

SEQ ID NO: 7899 - DNA, 23 bp, Homo sapiens
gagcttatcctcatggcaccctg

SEQ ID NO: 7900 - DNA, 21 bp, Homo sapiens
caacatggcaacggcagagca

SEQ ID NO: 7901 - DNA, 23 bp, Homo sapiens
tgcagcaaaagggtccttagcct

SEQ ID NO: 7902 - DNA, 22 bp, Homo sapiens
gttacaacagactagctactta

SEQ ID NO: 7903 - DNA, 21 bp, Homo sapiens
cgaattctcctaagattgttg

SEQ ID NO: 7904 - DNA, 20 bp, Homo sapiens
caagctgagaatcgcacctt

SEQ ID NO: 7905 - DNA, 21 bp, Homo sapiens
aggggtttggctgtgtcccac

SEQ ID NO: 7906 - DNA, 22 bp, Homo sapiens
gaatagtgcctgatgaaggtga

SEQ ID NO: 7907 - DNA, 20 bp, Homo sapiens
tctttaatgttctgtggtca

SEQ ID NO: 7908 - DNA, 22 bp, Homo sapiens
ccccccaccccatcagagcagc

SEQ ID NO: 7909 - DNA, 20 bp, Homo sapiens
tcccccccacgcccggggca

SEQ ID NO: 7910 - DNA, 23 bp, Homo sapiens
tagaggtagtgaccatacacttg

SEQ ID NO: 7911 - DNA, 23 bp, Homo sapiens
tggatcagctgattttaagaaat

SEQ ID NO: 7912 - DNA, 20 bp, Homo sapiens
tcccactgctgccaccaatc

SEQ ID NO: 7913 - DNA, 23 bp, Homo sapiens
agcgatgggtgcaaatactatgg

SEQ ID NO: 7914 - DNA, 23 bp, Homo sapiens
cagctgtatttcttgctgacacc

SEQ ID NO: 7915 - DNA, 21 bp, Homo sapiens
atccagttttcccaccttggg

SEQ ID NO: 7916 - DNA, 21 bp, Homo sapiens
catataatgaaaacacgtata

SEQ ID NO: 7917 - DNA, 22 bp, Homo sapiens
tacgtattgtctgggccaaaat

SEQ ID NO: 7918 - DNA, 23 bp, Homo sapiens
ggaactgtttccagaaggctttc

SEQ ID NO: 7919 - DNA, 22 bp, Homo sapiens
gtcactgggcttgaggatatga

SEQ ID NO: 7920 - DNA, 22 bp, Homo sapiens
tctaataagctccctttatggg

SEQ ID NO: 7921 - DNA, 23 bp, Homo sapiens
aggcaagatgctggcagtttaca

SEQ ID NO: 7922 - DNA, 20 bp, Homo sapiens
cttcctctctttctcgaaag

SEQ ID NO: 7923 - DNA, 21 bp, Homo sapiens
cccgccgggcagccctcggga

SEQ ID NO: 7924 - DNA, 22 bp, Homo sapiens
tggctcagaatgatgaaggtca

SEQ ID NO: 7925 - DNA, 22 bp, Homo sapiens
gcaatggcgatctgactcagct

SEQ ID NO: 7926 - DNA, 22 bp, Homo sapiens
tctccccacccatgtaccagtg

SEQ ID NO: 7927 - DNA, 22 bp, Homo sapiens
taaatgagcaaagctaagtgct

SEQ ID NO: 7928 - DNA, 21 bp, Homo sapiens
atgtggagaaatgtctggtgc

SEQ ID NO: 7929 - DNA, 23 bp, Homo sapiens
gtaagatttaagaaagagaattt

SEQ ID NO: 7930 - DNA, 21 bp, Homo sapiens
caaggaatgtcattcctttac

SEQ ID NO: 7931 - DNA, 21 bp, Homo sapiens
ctctttgaaaaggtgcaactg

SEQ ID NO: 7932 - DNA, 22 bp, Homo sapiens
catgagaggtgtaggataaatc

SEQ ID NO: 7933 - DNA, 22 bp, Homo sapiens
gaatctctcaggatgcttgtga

SEQ ID NO: 7934 - DNA, 23 bp, Homo sapiens
tgggaaaagtgaccataccccac

SEQ ID NO: 7935 - DNA, 20 bp, Homo sapiens
cggctccgggacccgcaaag

SEQ ID NO: 7936 - DNA, 23 bp, Homo sapiens
accacagaacgaggttggaagtg

SEQ ID NO: 7937 - DNA, 20 bp, Homo sapiens
tgaccgctctgaccacccct

SEQ ID NO: 7938 - DNA, 21 bp, Homo sapiens
accctccaaatggggacgttg

SEQ ID NO: 7939 - DNA, 22 bp, Homo sapiens
tagctggctgagacagcaggtc

SEQ ID NO: 7940 - DNA, 21 bp, Homo sapiens
agcgatttaaaggaagaagac

SEQ ID NO: 7941 - DNA, 24 bp, Homo sapiens
tattaatcctagggaaaggtctgg

SEQ ID NO: 7942 - DNA, 23 bp, Homo sapiens
tgtctcagaagtcacttcacagt

SEQ ID NO: 7943 - DNA, 24 bp, Homo sapiens
tcgaccgacctcgcgcgctgcaca

SEQ ID NO: 7944 - DNA, 22 bp, Homo sapiens
tctcccaacccctgtagtgaca

SEQ ID NO: 7945 - DNA, 20 bp, Homo sapiens
tgggcaacatatcgaggccc

SEQ ID NO: 7946 - DNA, 20 bp, Homo sapiens
cttaaggccagagggagcca

SEQ ID NO: 7947 - DNA, 22 bp, Homo sapiens
tgagggctgcttggtgtagtca

SEQ ID NO: 7948 - DNA, 22 bp, Homo sapiens
actcagcagacgtttatggggc

SEQ ID NO: 7949 - DNA, 21 bp, Homo sapiens
gccccccggccccggcagctc

SEQ ID NO: 7950 - DNA, 20 bp, Homo sapiens
taatactgccgggcgcggtg

SEQ ID NO: 7951 - DNA, 22 bp, Homo sapiens
tagcttgctgtcaaatgttttg

SEQ ID NO: 7952 - DNA, 22 bp, Homo sapiens
tagcaccatttgagatccatta

SEQ ID NO: 7953 - DNA, 22 bp, Homo sapiens
atcttactattgggcagtttgg

SEQ ID NO: 7954 - DNA, 23 bp, Homo sapiens
aggcagagcatcaatgcaactgt

SEQ ID NO: 7955 - DNA, 23 bp, Homo sapiens
acggtctggggaaaggctcctgt

SEQ ID NO: 7956 - DNA, 20 bp, Homo sapiens
ggctgggcttcgcgagtagc

SEQ ID NO: 7957 - DNA, 23 bp, Homo sapiens
tgatggctgctgggtgcactggc

SEQ ID NO: 7958 - DNA, 20 bp, Homo sapiens
ggaccaagggaggcttcaag

SEQ ID NO: 7959 - DNA, 21 bp, Homo sapiens
agcacctgccgagcactgaga

SEQ ID NO: 7960 - DNA, 23 bp, Homo sapiens
aagttgtggcttgagatagtagg

SEQ ID NO: 7961 - DNA, 22 bp, Homo sapiens
agttcagaggaagccaggtgtc

SEQ ID NO: 7962 - DNA, 22 bp, Homo sapiens
acagtagtctgcagtaatgtat

SEQ ID NO: 7963 - DNA, 23 bp, Homo sapiens
gaagcagcgcctgtcgcaactcg

SEQ ID NO: 7964 - DNA, 21 bp, Homo sapiens
ggtcttcgccgtagtcgtcgt

SEQ ID NO: 7965 - DNA, 20 bp, Homo sapiens
gtgcagcaccaagtcaccat

SEQ ID NO: 7966 - DNA, 22 bp, Homo sapiens
cagagacttccactgtagctct

SEQ ID NO: 7967 - DNA, 23 bp, Homo sapiens
ttcttgctgctgggtcatcttcc

SEQ ID NO: 7968 - DNA, 24 bp, Homo sapiens
cagctgcgaggagggatgcaacag

SEQ ID NO: 7969 - DNA, 20 bp, Homo sapiens
cagggactggagcttcccat

SEQ ID NO: 7970 - DNA, 20 bp, Homo sapiens
ctgacctagtccgattgtag

SEQ ID NO: 7971 - DNA, 22 bp, Homo sapiens
tgagatgaagtgtcacggcact

SEQ ID NO: 7972 - DNA, 22 bp, Homo sapiens
ctgtgcgtgtgacagcagctct

SEQ ID NO: 7973 - DNA, 22 bp, Homo sapiens
acgcaggcgacccccgcccctc

SEQ ID NO: 7974 - DNA, 20 bp, Homo sapiens
ccccggggaggggccgcctc

SEQ ID NO: 7975 - DNA, 21 bp, Homo sapiens
gcattggtggtgactgggacc

SEQ ID NO: 7976 - DNA, 23 bp, Homo sapiens
aaatctgacccaggtcctgtgac

SEQ ID NO: 7977 - DNA, 20 bp, Homo sapiens
aggaaactctgacaagggtc

SEQ ID NO: 7978 - DNA, 21 bp, Homo sapiens
tctgtgagatgcccctttagt

SEQ ID NO: 7979 - DNA, 20 bp, Homo sapiens
gggttccggggggagttggg

SEQ ID NO: 7980 - DNA, 22 bp, Homo sapiens
atccagccattgactcagcttg

SEQ ID NO: 7981 - DNA, 21 bp, Homo sapiens
tcgggcgggcgcgcgggtcgg

SEQ ID NO: 7982 - DNA, 20 bp, Homo sapiens
caggaaccggcccagagtgt

SEQ ID NO: 7983 - DNA, 21 bp, Homo sapiens
cccacggcggggcgcgggatc

SEQ ID NO: 7984 - DNA, 20 bp, Homo sapiens
atcccactcctgacaccaca

SEQ ID NO: 7985 - DNA, 23 bp, Homo sapiens
gaccacctgcactgtgccccagg

SEQ ID NO: 7986 - DNA, 20 bp, Homo sapiens
ccgcgtcctcggaccccacg

SEQ ID NO: 7987 - DNA, 22 bp, Homo sapiens
gagaacttgggaacatggctgt

SEQ ID NO: 7988 - DNA, 24 bp, Homo sapiens
ctctcttttcctcctcctcctgcc

SEQ ID NO: 7989 - DNA, 22 bp, Homo sapiens
tgcttgctgctaaacagtgaca

SEQ ID NO: 7990 - DNA, 21 bp, Homo sapiens
atcccattatcattgtgtaat

SEQ ID NO: 7991 - DNA, 22 bp, Homo sapiens
tagcttatcaagatgaaatcag

SEQ ID NO: 7992 - DNA, 20 bp, Homo sapiens
ctgacccgacagaataatta

SEQ ID NO: 7993 - DNA, 20 bp, Homo sapiens
atcccactcctgacaccatt

SEQ ID NO: 7994 - DNA, 22 bp, Homo sapiens
agatcattgtcaaatacaccaa

SEQ ID NO: 7995 - DNA, 20 bp, Homo sapiens
aaagtatagattaagccctt

SEQ ID NO: 7996 - DNA, 22 bp, Homo sapiens
ttatgttatctgagggattggc

SEQ ID NO: 7997 - DNA, 23 bp, Homo sapiens
atctatactgctgcagctttgtg

SEQ ID NO: 7998 - DNA, 23 bp, Homo sapiens
tcgccatagtctgactacttgac

SEQ ID NO: 7999 - DNA, 23 bp, Homo sapiens
cccgggcgtgttcgtgtggagca

SEQ ID NO: 8000 - DNA, 20 bp, Homo sapiens
ccccttgcctctcggctctc

SEQ ID NO: 8001 - DNA, 22 bp, Homo sapiens
gtcttgctgccaaacatgtgcg

SEQ ID NO: 8002 - DNA, 21 bp, Homo sapiens
agaaaccaagggtgcacagca

SEQ ID NO: 8003 - DNA, 21 bp, Homo sapiens
gcagtggtagacttgctaacc

SEQ ID NO: 8004 - DNA, 21 bp, Homo sapiens
atcatatttatctttgtgccc

SEQ ID NO: 8005 - DNA, 23 bp, Homo sapiens
aagcagcatacaaatattatatg

SEQ ID NO: 8006 - DNA, 21 bp, Homo sapiens
gactcttaggccacagcccag

SEQ ID NO: 8007 - DNA, 20 bp, Homo sapiens
gatgctgagaatcattgtag

SEQ ID NO: 8008 - DNA, 22 bp, Homo sapiens
gtaactggggcccaggaagttt

SEQ ID NO: 8009 - DNA, 20 bp, Homo sapiens
gccggcccctcccccgggga

SEQ ID NO: 8010 - DNA, 22 bp, Homo sapiens
cttccgaagggacgggcggcgg

SEQ ID NO: 8011 - DNA, 23 bp, Homo sapiens
caggaatagtctctgatgggttg

SEQ ID NO: 8012 - DNA, 23 bp, Homo sapiens
gtccagttttccccttctgggga

SEQ ID NO: 8013 - DNA, 23 bp, Homo sapiens
catatggtgaatatggtgatgct

SEQ ID NO: 8014 - DNA, 20 bp, Homo sapiens
cacagcataagaataaaagt

SEQ ID NO: 8015 - DNA, 23 bp, Homo sapiens
ggaggtaggaggttgtaaagaat

SEQ ID NO: 8016 - DNA, 20 bp, Homo sapiens
agagcaagtctggtgccagc

SEQ ID NO: 8017 - DNA, 23 bp, Homo sapiens
atagcacctctcagcatgggtct

SEQ ID NO: 8018 - DNA, 21 bp, Homo sapiens
gttatccaatggagttgaaaa

SEQ ID NO: 8019 - DNA, 23 bp, Homo sapiens
aatagccacttgcgtacagcagc

SEQ ID NO: 8020 - DNA, 20 bp, Homo sapiens
taacactgagaccattccta

SEQ ID NO: 8021 - DNA, 22 bp, Homo sapiens
agggactctggggtgaccacag

SEQ ID NO: 8022 - DNA, 22 bp, Homo sapiens
tggaggagctcactcagagaat

SEQ ID NO: 8023 - DNA, 21 bp, Homo sapiens
gcggcaggcggcggaggggtg

SEQ ID NO: 8024 - DNA, 20 bp, Homo sapiens
ctgacctaggaattgtgtct

SEQ ID NO: 8025 - DNA, 23 bp, Homo sapiens
tcctcctccccgccgcccctccc

SEQ ID NO: 8026 - DNA, 20 bp, Homo sapiens
gacgcgccggggaggtggag

SEQ ID NO: 8027 - DNA, 20 bp, Homo sapiens
gactggataaggccatgagc

SEQ ID NO: 8028 - DNA, 20 bp, Homo sapiens
tgatgaactcttgaggtgat

SEQ ID NO: 8029 - DNA, 22 bp, Homo sapiens
agagatgggatgtcacggtgtt

SEQ ID NO: 8030 - DNA, 22 bp, Homo sapiens
gcagtagtcttacagccaaggc

SEQ ID NO: 8031 - DNA, 20 bp, Homo sapiens
catccagaaggaatgacagc

SEQ ID NO: 8032 - DNA, 21 bp, Homo sapiens
ccagctagaatttctaaatgt

SEQ ID NO: 8033 - DNA, 22 bp, Homo sapiens
cagtgcaatgttgaaagggcat

SEQ ID NO: 8034 - DNA, 21 bp, Homo sapiens
actcagctgctcggtgcgctg

SEQ ID NO: 8035 - DNA, 20 bp, Homo sapiens
tgatctgacctgatgaggga

SEQ ID NO: 8036 - DNA, 20 bp, Homo sapiens
cctgattggtaagctttgta

SEQ ID NO: 8037 - DNA, 24 bp, Homo sapiens
tcccactgcttcacttgactagtt

SEQ ID NO: 8038 - DNA, 22 bp, Homo sapiens
tagcttactgcagactccaact

SEQ ID NO: 8039 - DNA, 20 bp, Homo sapiens
gtgatcagagatcgccactg

SEQ ID NO: 8040 - DNA, 23 bp, Homo sapiens
gccagcaaaagggtaaggctttc

SEQ ID NO: 8041 - DNA, 20 bp, Homo sapiens
gggggagaagggtcgggggg

SEQ ID NO: 8042 - DNA, 22 bp, Homo sapiens
acagcaggcacaggcaagcaga

SEQ ID NO: 8043 - DNA, 22 bp, Homo sapiens
gtagtgtttgattttatttttc

SEQ ID NO: 8044 - DNA, 22 bp, Homo sapiens
acaggcttgagtcacggcacca

SEQ ID NO: 8045 - DNA, 23 bp, Homo sapiens
atagcatagttcactgcaacctg

SEQ ID NO: 8046 - DNA, 20 bp, Homo sapiens
tgcttatgcttcttgttgct

SEQ ID NO: 8047 - DNA, 22 bp, Homo sapiens
aggttcagctgatttatctcaa

SEQ ID NO: 8048 - DNA, 23 bp, Homo sapiens
tgtcacaaaggtggccgttttgg

SEQ ID NO: 8049 - DNA, 23 bp, Homo sapiens
agctccatttcttgaaggcttct

SEQ ID NO: 8050 - DNA, 22 bp, Homo sapiens
agggactctggagcacttgtgt

SEQ ID NO: 8051 - DNA, 23 bp, Homo sapiens
tgccgatgatgctgatctgagga

SEQ ID NO: 8052 - DNA, 23 bp, Homo sapiens
gtccagttttcccagcagcgttt

SEQ ID NO: 8053 - DNA, 22 bp, Homo sapiens
cagagtagtagtttcatgtcaa

SEQ ID NO: 8054 - DNA, 21 bp, Homo sapiens
atcacattgccagggctgccc

SEQ ID NO: 8055 - DNA, 20 bp, Homo sapiens
acctggcagcagggttcttg

SEQ ID NO: 8056 - DNA, 22 bp, Homo sapiens
tgagtcattagtgggcatttac

SEQ ID NO: 8057 - DNA, 21 bp, Homo sapiens
gagatagtttattcttggaaa

SEQ ID NO: 8058 - DNA, 20 bp, Homo sapiens
cgtatggtggttcagtcctt

SEQ ID NO: 8059 - DNA, 20 bp, Homo sapiens
tgctgatgcctatgtgggtt

SEQ ID NO: 8060 - DNA, 22 bp, Homo sapiens
ttcagcatgcttgagatagatg

SEQ ID NO: 8061 - DNA, 21 bp, Homo sapiens
tagcagccaggagtgcaactg

SEQ ID NO: 8062 - DNA, 20 bp, Homo sapiens
agcggccgccgccgggcgca

SEQ ID NO: 8063 - DNA, 23 bp, Homo sapiens
gggtcggggcggcggctgcgccg

SEQ ID NO: 8064 - DNA, 20 bp, Homo sapiens
tagcagctgcatttaatctt

SEQ ID NO: 8065 - DNA, 21 bp, Homo sapiens
ctgacctatgaattgcatgtt

SEQ ID NO: 8066 - DNA, 22 bp, Homo sapiens
tctactacgcagaaatatgtat

SEQ ID NO: 8067 - DNA, 22 bp, Homo sapiens
ttgcagtgacagtttatttttg

SEQ ID NO: 8068 - DNA, 23 bp, Homo sapiens
gtttagtttctttgaaggcttct

SEQ ID NO: 8069 - DNA, 21 bp, Homo sapiens
ctactagtggctactggctct

SEQ ID NO: 8070 - DNA, 20 bp, Homo sapiens
ttggtgattaagggctgttt

SEQ ID NO: 8071 - DNA, 23 bp, Homo sapiens
tacagcatcctctacttcacagt

SEQ ID NO: 8072 - DNA, 22 bp, Homo sapiens
cgtggacggtgcagagccgtgc

SEQ ID NO: 8073 - DNA, 20 bp, Homo sapiens
aatagttctgagctgaggtg

SEQ ID NO: 8074 - DNA, 20 bp, Homo sapiens
tatagttctatgatcctggt

SEQ ID NO: 8075 - DNA, 22 bp, Homo sapiens
cagtaagatcctcccctcagct

SEQ ID NO: 8076 - DNA, 20 bp, Homo sapiens
gagccgcagaggctgggttt

SEQ ID NO: 8077 - DNA, 22 bp, Homo sapiens
cagcctctgttaatttcaaaca

SEQ ID NO: 8078 - DNA, 20 bp, Homo sapiens
gggacatgtggccagtaagg

SEQ ID NO: 8079 - DNA, 22 bp, Homo sapiens
tggctcatgagtgcaggacact

SEQ ID NO: 8080 - DNA, 23 bp, Homo sapiens
tgttctgtggactgtggacactg

SEQ ID NO: 8081 - DNA, 22 bp, Homo sapiens
agatagcatactgggggcagct

SEQ ID NO: 8082 - DNA, 23 bp, Homo sapiens
aggctatagtgcactatgatagt

SEQ ID NO: 8083 - DNA, 20 bp, Homo sapiens
ccagttgtcatattgcttct

SEQ ID NO: 8084 - DNA, 20 bp, Homo sapiens
caacctttgtaaccttcagg

SEQ ID NO: 8085 - DNA, 20 bp, Homo sapiens
ttatggttcctttggagaga

SEQ ID NO: 8086 - DNA, 20 bp, Homo sapiens
attgtgccattgaagaataa

SEQ ID NO: 8087 - DNA, 21 bp, Homo sapiens
gctccaagtagtttatggttg

SEQ ID NO: 8088 - DNA, 22 bp, Homo sapiens
tgtactgggactcctatgggga

SEQ ID NO: 8089 - DNA, 23 bp, Homo sapiens
tcagtctttgtagttatgggcta

SEQ ID NO: 8090 - DNA, 22 bp, Homo sapiens
ttcagacaaaggtcgaaaggct

SEQ ID NO: 8091 - DNA, 22 bp, Homo sapiens
taggacgctgctccagcaccac

SEQ ID NO: 8092 - DNA, 23 bp, Homo sapiens
tctccatcatccttgtgtgaagt

SEQ ID NO: 8093 - DNA, 20 bp, Homo sapiens
gactggataaggccagatac

SEQ ID NO: 8094 - DNA, 22 bp, Homo sapiens
gtcttgctgcttggtatagatc

SEQ ID NO: 8095 - DNA, 21 bp, Homo sapiens
aaaggatccactgaagtccta

SEQ ID NO: 8096 - DNA, 20 bp, Homo sapiens
gagcttatcagactgttcag

SEQ ID NO: 8097 - DNA, 22 bp, Homo sapiens
tcctcagagcggaacaggctga

SEQ ID NO: 8098 - DNA, 22 bp, Homo sapiens
tcagctgggagcaaagacccca

SEQ ID NO: 8099 - DNA, 21 bp, Homo sapiens
tctcctcgtggaggggttggg

SEQ ID NO: 8100 - DNA, 22 bp, Homo sapiens
ttccttatcagactgatagggt

SEQ ID NO: 8101 - DNA, 22 bp, Homo sapiens
gtgaaatgtttaggactagaag

SEQ ID NO: 8102 - DNA, 20 bp, Homo sapiens
agcagccctgcctggatgag

SEQ ID NO: 8103 - DNA, 22 bp, Homo sapiens
tagagcaggatgtcagcagtct

SEQ ID NO: 8104 - DNA, 21 bp, Homo sapiens
tagcaccaaaacaaatcaaca

SEQ ID NO: 8105 - DNA, 21 bp, Homo sapiens
gaattggttctaaattagcta

SEQ ID NO: 8106 - DNA, 20 bp, Homo sapiens
tagcagtaaactgagagtac

SEQ ID NO: 8107 - DNA, 21 bp, Homo sapiens
tcagcaaactacttattctca

SEQ ID NO: 8108 - DNA, 21 bp, Homo sapiens
accaagaggaactctgtcccc

SEQ ID NO: 8109 - DNA, 22 bp, Homo sapiens
ctgacctatgtattgtgttggg

SEQ ID NO: 8110 - DNA, 22 bp, Homo sapiens
tcagttgttgtcaaataccatg

SEQ ID NO: 8111 - DNA, 21 bp, Homo sapiens
atcttgctgcttggtgctcaa

SEQ ID NO: 8112 - DNA, 22 bp, Homo sapiens
tgaagtgggcagtttatggggt

SEQ ID NO: 8113 - DNA, 22 bp, Homo sapiens
atcactggacagaaataaaggt

SEQ ID NO: 8114 - DNA, 22 bp, Homo sapiens
aatgactctgtctagtccacag

SEQ ID NO: 8115 - DNA, 21 bp, Homo sapiens
gctgataagaagaggagggac

SEQ ID NO: 8116 - DNA, 21 bp, Homo sapiens
tgtcacaagcctcagtgtggc

SEQ ID NO: 8117 - DNA, 21 bp, Homo sapiens
accctgagaccctagtggtca

SEQ ID NO: 8118 - DNA, 22 bp, Homo sapiens
taaagcctcaaagcctaacact

SEQ ID NO: 8119 - DNA, 20 bp, Homo sapiens
cagagcaggatgtcaatggt

SEQ ID NO: 8120 - DNA, 24 bp, Homo sapiens
agggaaactaaacctaattctaat

SEQ ID NO: 8121 - DNA, 22 bp, Homo sapiens
gaagtcctcgtgttgctggaaa

SEQ ID NO: 8122 - DNA, 22 bp, Homo sapiens
tggctcagtctgagtcccacag

SEQ ID NO: 8123 - DNA, 21 bp, Homo sapiens
gactggataaaattgagagtt

SEQ ID NO: 8124 - DNA, 22 bp, Homo sapiens
ctgattccaggaacatggtctc

SEQ ID NO: 8125 - DNA, 22 bp, Homo sapiens
ctctgacggctcaaataacaag

SEQ ID NO: 8126 - DNA, 22 bp, Homo sapiens
tagcaccaaaactttctggcat

SEQ ID NO: 8127 - DNA, 20 bp, Homo sapiens
ctgaaacatttttcttgccc

SEQ ID NO: 8128 - DNA, 23 bp, Homo sapiens
gtgctccacctgtgtcccacagt

SEQ ID NO: 8129 - DNA, 22 bp, Homo sapiens
atcccattgccagggattaatt

SEQ ID NO: 8130 - DNA, 24 bp, Homo sapiens
cccccacactcccacacatggcca

SEQ ID NO: 8131 - DNA, 23 bp, Homo sapiens
gtattaacagttatggtgatact

SEQ ID NO: 8132 - DNA, 21 bp, Homo sapiens
agatgcatcagaggctgggtg

SEQ ID NO: 8133 - DNA, 22 bp, Homo sapiens
tcttttggtttcctgcaacttg

SEQ ID NO: 8134 - DNA, 22 bp, Homo sapiens
ctttcagagtggactaggtgct

SEQ ID NO: 8135 - DNA, 22 bp, Homo sapiens
tctcagtaactgtttatggggc

SEQ ID NO: 8136 - DNA, 20 bp, Homo sapiens
cctgcaccccccgggttcag

SEQ ID NO: 8137 - DNA, 20 bp, Homo sapiens
ggctcacagcttgctacagt

SEQ ID NO: 8138 - DNA, 20 bp, Homo sapiens
cttcagagagggagagaaag

SEQ ID NO: 8139 - DNA, 20 bp, Homo sapiens
tgggactctgggatcaggtc

SEQ ID NO: 8140 - DNA, 22 bp, Homo sapiens
tctagaattgagtaataccata

SEQ ID NO: 8141 - DNA, 21 bp, Homo sapiens
aggctgagcatcaatgccttt

SEQ ID NO: 8142 - DNA, 24 bp, Homo sapiens
gcctgctgaaacagaacctgtagg

SEQ ID NO: 8143 - DNA, 23 bp, Homo sapiens
cactggtccatcaaattccccaa

SEQ ID NO: 8144 - DNA, 22 bp, Homo sapiens
tatatccacatctaccaaatgt

SEQ ID NO: 8145 - DNA, 23 bp, Homo sapiens
taggaatagtccatgcctggctg

SEQ ID NO: 8146 - DNA, 20 bp, Homo sapiens
gactatttgtagattatttg

SEQ ID NO: 8147 - DNA, 22 bp, Homo sapiens
ctgctgaaaccctaacttgtga

SEQ ID NO: 8148 - DNA, 22 bp, Homo sapiens
gagtgcaatcaattttctctgg

SEQ ID NO: 8149 - DNA, 23 bp, Homo sapiens
agcagcaaaagccaggataggtc

SEQ ID NO: 8150 - DNA, 22 bp, Homo sapiens
cctgagtaatccaagatagcaa

SEQ ID NO: 8151 - DNA, 22 bp, Homo sapiens
gtctcaagttcaaataccaagc

SEQ ID NO: 8152 - DNA, 22 bp, Homo sapiens
tatcagttgcagttaatggagt

SEQ ID NO: 8153 - DNA, 22 bp, Homo sapiens
tagcacacacagacatcactgt

SEQ ID NO: 8154 - DNA, 23 bp, Homo sapiens
tagcagtattgacctatggggtg

SEQ ID NO: 8155 - DNA, 21 bp, Homo sapiens
catgccaacccacagagaatt

SEQ ID NO: 8156 - DNA, 21 bp, Homo sapiens
ttacactgttagtctggacca

SEQ ID NO: 8157 - DNA, 20 bp, Homo sapiens
cattttatcagcaactacaa

SEQ ID NO: 8158 - DNA, 20 bp, Homo sapiens
gttgatgtagatatgtacac

SEQ ID NO: 8159 - DNA, 22 bp, Homo sapiens
tgtacacaacagggatacccca

SEQ ID NO: 8160 - DNA, 22 bp, Homo sapiens
tctctgagacaagcactgtgtc

SEQ ID NO: 8161 - DNA, 22 bp, Homo sapiens
taaagcctcaagatcgccacag

SEQ ID NO: 8162 - DNA, 21 bp, Homo sapiens
atgtggactctgtgacttcag

SEQ ID NO: 8163 - DNA, 20 bp, Homo sapiens
aacctcacatcaagtgctgg

SEQ ID NO: 8164 - DNA, 23 bp, Homo sapiens
agctatgtgtgacatcatcatta

SEQ ID NO: 8165 - DNA, 22 bp, Homo sapiens
aggtgcaatggattacacctgt

SEQ ID NO: 8166 - DNA, 21 bp, Homo sapiens
cacgcagcgaacctacagcag

SEQ ID NO: 8167 - DNA, 23 bp, Homo sapiens
aagacggtgaaaatggtgatgag

SEQ ID NO: 8168 - DNA, 20 bp, Homo sapiens
cattattacttttggttgag

SEQ ID NO: 8169 - DNA, 20 bp, Homo sapiens
ctaccactagctacaccact

SEQ ID NO: 8170 - DNA, 21 bp, Homo sapiens
cgtacggtgtcattattaccg

SEQ ID NO: 8171 - DNA, 20 bp, Homo sapiens
ttgggacatcttggctaaaa

SEQ ID NO: 8172 - DNA, 20 bp, Homo sapiens
tagcaccatctctgtacagt

SEQ ID NO: 8173 - DNA, 21 bp, Homo sapiens
gagtgtacagcactccatgtg

SEQ ID NO: 8174 - DNA, 22 bp, Homo sapiens
tgatgtcaagatactaaatttg

SEQ ID NO: 8175 - DNA, 20 bp, Homo sapiens
ttctgcaggatgtctgctag

SEQ ID NO: 8176 - DNA, 20 bp, Homo sapiens
agtcaccgagctacaagcag

SEQ ID NO: 8177 - DNA, 22 bp, Homo sapiens
cactgctgagtatgtacctaat

SEQ ID NO: 8178 - DNA, 22 bp, Homo sapiens
agttacatttgagtagtttggg

SEQ ID NO: 8179 - DNA, 21 bp, Homo sapiens
ctcacagggcattttcctaga

SEQ ID NO: 8180 - DNA, 21 bp, Homo sapiens
aggcatctagctggttatcgt

SEQ ID NO: 8181 - DNA, 22 bp, Homo sapiens
gtattggcaacaggtacaccat

SEQ ID NO: 8182 - DNA, 20 bp, Homo sapiens
caaaaagaaccccggagaga

SEQ ID NO: 8183 - DNA, 22 bp, Homo sapiens
tgatgttgcccaggcagcgtta

SEQ ID NO: 8184 - DNA, 20 bp, Homo sapiens
cagaaaatgagagatagagg

SEQ ID NO: 8185 - DNA, 22 bp, Homo sapiens
accaggtttgtcaaatacaaac

SEQ ID NO: 8186 - DNA, 21 bp, Homo sapiens
gttcttgatcctaacatgttg

SEQ ID NO: 8187 - DNA, 22 bp, Homo sapiens
taggaggtcaggtaacatgcca

SEQ ID NO: 8188 - DNA, 22 bp, Homo sapiens
cagacaaacagaaataccaaca

SEQ ID NO: 8189 - DNA, 20 bp, Homo sapiens
tggtagaatgagatggataa

SEQ ID NO: 8190 - DNA, 23 bp, Homo sapiens
tagctgctcaagaatatgacaca

SEQ ID NO: 8191 - DNA, 22 bp, Homo sapiens
cattattacttttggtatgtta

SEQ ID NO: 8192 - DNA, 21 bp, Homo sapiens
tagcaccatggttttggctaa

SEQ ID NO: 8193 - DNA, 21 bp, Homo sapiens
gggagagattttaacagcgta

SEQ ID NO: 8194 - DNA, 22 bp, Homo sapiens
caaggagggactgggcgtgggt

SEQ ID NO: 8195 - DNA, 22 bp, Homo sapiens
atcacattgccagggcaacttt

SEQ ID NO: 8196 - DNA, 21 bp, Homo sapiens
atatggctgagtaatagcaga

SEQ ID NO: 8197 - DNA, 23 bp, Homo sapiens
tagctgcgacgagactacaaagt

SEQ ID NO: 8198 - DNA, 20 bp, Homo sapiens
catgttatacaacttccact

SEQ ID NO: 8199 - DNA, 21 bp, Homo sapiens
taccaggtagactttagccaa

SEQ ID NO: 8200 - DNA, 20 bp, Homo sapiens
catagactggactactgcta

SEQ ID NO: 8201 - DNA, 20 bp, Homo sapiens
cgccttgtaatgcacagctc

SEQ ID NO: 8202 - DNA, 20 bp, Homo sapiens
tctaattaacatatatatga

SEQ ID NO: 8203 - DNA, 23 bp, Homo sapiens
agggctgcggagatgaaggtgac

SEQ ID NO: 8204 - DNA, 21 bp, Homo sapiens
agtcccaaccctacatggtca

SEQ ID NO: 8205 - DNA, 22 bp, Homo sapiens
aggttattgatacaatatcgta

SEQ ID NO: 8206 - DNA, 20 bp, Homo sapiens
cgggcgtgggggcggtgcgt

SEQ ID NO: 8207 - DNA, 22 bp, Homo sapiens
aatgtggtaaacttgctacggc

SEQ ID NO: 8208 - DNA, 23 bp, Homo sapiens
gctaggcgaacactgatgggtca

SEQ ID NO: 8209 - DNA, 22 bp, Homo sapiens
aaagaggctattgtttagcagg

SEQ ID NO: 8210 - DNA, 21 bp, Homo sapiens
ctagaagagagtcagctcagt

SEQ ID NO: 8211 - DNA, 20 bp, Homo sapiens
ttcatctaatcctcagccag

SEQ ID NO: 8212 - DNA, 24 bp, Homo sapiens
tccagctcagtcccctttgctaaa

SEQ ID NO: 8213 - DNA, 22 bp, Homo sapiens
tctcaacccactgggcattttt

SEQ ID NO: 8214 - DNA, 23 bp, Homo sapiens
gctactaaatgcaaatacaagcc

SEQ ID NO: 8215 - DNA, 20 bp, Homo sapiens
ccgtgtatacgcaggatgtc

SEQ ID NO: 8216 - DNA, 22 bp, Homo sapiens
ctaagccctaatgttcttgttg

SEQ ID NO: 8217 - DNA, 21 bp, Homo sapiens
ccggggggcccctccccggcg

SEQ ID NO: 8218 - DNA, 20 bp, Homo sapiens
atgtggataaggcacttcgg

SEQ ID NO: 8219 - DNA, 21 bp, Homo sapiens
agcataaactggactgcatat

SEQ ID NO: 8220 - DNA, 20 bp, Homo sapiens
ggacatgtggctgcatccct

SEQ ID NO: 8221 - DNA, 23 bp, Homo sapiens
gtcatcaaaagagtccttagaag

SEQ ID NO: 8222 - DNA, 22 bp, Homo sapiens
tcctgacttgaggggcgttttg

SEQ ID NO: 8223 - DNA, 24 bp, Homo sapiens
cttccttctttctctccctgtgtc

SEQ ID NO: 8224 - DNA, 22 bp, Homo sapiens
ccatggccaatcaaatacaaac

SEQ ID NO: 8225 - DNA, 21 bp, Homo sapiens
ttgtgtcgctctgctgagctg

SEQ ID NO: 8226 - DNA, 22 bp, Homo sapiens
agtccaggctggtgggatcgct

SEQ ID NO: 8227 - DNA, 22 bp, Homo sapiens
tgcaatcctgtcctcagtgttg

SEQ ID NO: 8228 - DNA, 23 bp, Homo sapiens
ttgggtagaatccgatctttgtc

SEQ ID NO: 8229 - DNA, 22 bp, Homo sapiens
acagcaggctctctgtgtcctg

SEQ ID NO: 8230 - DNA, 23 bp, Homo sapiens
aaagcgatgggaaaagctgttca

SEQ ID NO: 8231 - DNA, 22 bp, Homo sapiens
gagactttgcaggtgcaactgt

SEQ ID NO: 8232 - DNA, 22 bp, Homo sapiens
ttcctcattgagtcagcgagct

SEQ ID NO: 8233 - DNA, 22 bp, Homo sapiens
gctgtgggtagtttagccccat

SEQ ID NO: 8234 - DNA, 23 bp, Homo sapiens
cagctcatcagttacttctgtca

SEQ ID NO: 8235 - DNA, 20 bp, Homo sapiens
gagcttatcagactgaaaac

SEQ ID NO: 8236 - DNA, 22 bp, Homo sapiens
acgggaacgccgtgtgactcac

SEQ ID NO: 8237 - DNA, 22 bp, Homo sapiens
gcctgggggccgtggaggtggt

SEQ ID NO: 8238 - DNA, 23 bp, Homo sapiens
agtaatacagggctggtgtacag

SEQ ID NO: 8239 - DNA, 22 bp, Homo sapiens
agagatgggtgcaccgcagcgt

SEQ ID NO: 8240 - DNA, 23 bp, Homo sapiens
ggaggggctcccgagcccgggag

SEQ ID NO: 8241 - DNA, 24 bp, Homo sapiens
gagccccctccagaaaggccgtgt

SEQ ID NO: 8242 - DNA, 20 bp, Homo sapiens
aggcgcgcggggcggggatc

SEQ ID NO: 8243 - DNA, 23 bp, Homo sapiens
ctcacggcccgtctcgccccagc

SEQ ID NO: 8244 - DNA, 21 bp, Homo sapiens
aggaagagggggcaacaacac

SEQ ID NO: 8245 - DNA, 22 bp, Homo sapiens
gggcattttcgggggcttttat

SEQ ID NO: 8246 - DNA, 22 bp, Homo sapiens
gtgtgtaacggctttgcccttg

SEQ ID NO: 8247 - DNA, 21 bp, Homo sapiens
gctagggctgagtcagggcag

SEQ ID NO: 8248 - DNA, 21 bp, Homo sapiens
ccccggccccgcgccctccct

SEQ ID NO: 8249 - DNA, 22 bp, Homo sapiens
cactctgccatcaggatggggt

SEQ ID NO: 8250 - DNA, 20 bp, Homo sapiens
gccggcgggagcccgccccc

SEQ ID NO: 8251 - DNA, 23 bp, Homo sapiens
gatgcgacctcagatcactgcag

SEQ ID NO: 8252 - DNA, 22 bp, Homo sapiens
tcggtccccagcatctccaccc

SEQ ID NO: 8253 - DNA, 22 bp, Homo sapiens
gctgctgccgccaggatatgcg

SEQ ID NO: 8254 - DNA, 22 bp, Homo sapiens
tcatcaacaactcctgttggct

SEQ ID NO: 8255 - DNA, 23 bp, Homo sapiens
tctttaaaatcgtatccagagtc

SEQ ID NO: 8256 - DNA, 21 bp, Homo sapiens
caggctgtaaacgcccacaac

SEQ ID NO: 8257 - DNA, 21 bp, Homo sapiens
tggctcagttcagctggagac

SEQ ID NO: 8258 - DNA, 20 bp, Homo sapiens
caactgtgggctcagctgga

SEQ ID NO: 8259 - DNA, 20 bp, Homo sapiens
aaatagaacgtacaaagagg

SEQ ID NO: 8260 - DNA, 22 bp, Homo sapiens
tccctgcacccctagtccacag

SEQ ID NO: 8261 - DNA, 21 bp, Homo sapiens
tccggggctgggatgcggggg

SEQ ID NO: 8262 - DNA, 20 bp, Homo sapiens
tggccggggggcgggcgaac

SEQ ID NO: 8263 - DNA, 22 bp, Homo sapiens
aggctgagcaaaggcagcacag

SEQ ID NO: 8264 - DNA, 23 bp, Homo sapiens
gagcttgctcagtcagcaccagt

SEQ ID NO: 8265 - DNA, 22 bp, Homo sapiens
tgctcagagccgatcaggtgtc

SEQ ID NO: 8266 - DNA, 20 bp, Homo sapiens
cagcaggtctccacttctcc

SEQ ID NO: 8267 - DNA, 22 bp, Homo sapiens
catggcttcctgcctttgacag

SEQ ID NO: 8268 - DNA, 23 bp, Homo sapiens
ttcaccgctgagtcctacacagt

SEQ ID NO: 8269 - DNA, 20 bp, Homo sapiens
gtccagttttcccagctccc

SEQ ID NO: 8270 - DNA, 23 bp, Homo sapiens
gggggtacactacacacgttaac

SEQ ID NO: 8271 - DNA, 21 bp, Homo sapiens
ggtagttctgagctgggtata

SEQ ID NO: 8272 - DNA, 22 bp, Homo sapiens
tgctacgcctgagtagtagttg

SEQ ID NO: 8273 - DNA, 20 bp, Homo sapiens
ctctggataaggccaggtcc

SEQ ID NO: 8274 - DNA, 21 bp, Homo sapiens
ggggcggccttgattaagcag

SEQ ID NO: 8275 - DNA, 23 bp, Homo sapiens
atctatgccactgtctgccacct

SEQ ID NO: 8276 - DNA, 21 bp, Homo sapiens
gcttgactttcccaggaattg

SEQ ID NO: 8277 - DNA, 22 bp, Homo sapiens
aaacgggaagtgtgtgtcgtgt

SEQ ID NO: 8278 - DNA, 23 bp, Homo sapiens
agcagcaaacaactgcttaggga

SEQ ID NO: 8279 - DNA, 22 bp, Homo sapiens
ttcaagtaatcctcctatttag

SEQ ID NO: 8280 - DNA, 22 bp, Homo sapiens
tcccggctcaaagccagacact

SEQ ID NO: 8281 - DNA, 20 bp, Homo sapiens
ccccggggagggcggcgggc

SEQ ID NO: 8282 - DNA, 20 bp, Homo sapiens
taatatttggggccacagct

SEQ ID NO: 8283 - DNA, 22 bp, Homo sapiens
ccggctccccccgggcccgcag

SEQ ID NO: 8284 - DNA, 20 bp, Homo sapiens
tcccacccctcctccccgcg

SEQ ID NO: 8285 - DNA, 20 bp, Homo sapiens
ttatatgtctgcctggttct

SEQ ID NO: 8286 - DNA, 22 bp, Homo sapiens
gcgaccaggctagggctgtgct

SEQ ID NO: 8287 - DNA, 24 bp, Homo sapiens
gaggcgaggtcacgccattgcatt

SEQ ID NO: 8288 - DNA, 20 bp, Homo sapiens
cccccggggccgcggttgtc

SEQ ID NO: 8289 - DNA, 21 bp, Homo sapiens
gtcacaccactgggcgtttcc

SEQ ID NO: 8290 - DNA, 21 bp, Homo sapiens
actgcaagcttgcatgggtga

SEQ ID NO: 8291 - DNA, 22 bp, Homo sapiens
acagcagcgctccgtgacgtca

SEQ ID NO: 8292 - DNA, 20 bp, Homo sapiens
aatttcaccctccgggggca

SEQ ID NO: 8293 - DNA, 21 bp, Homo sapiens
tgccgccgtccccatgcgcgc

SEQ ID NO: 8294 - DNA, 20 bp, Homo sapiens
tagcagcaccaagtcactga

SEQ ID NO: 8295 - DNA, 22 bp, Homo sapiens
gcatcagagtagcaacaagcta

SEQ ID NO: 8296 - DNA, 23 bp, Homo sapiens
cagcagcaccgccacgttgacag

SEQ ID NO: 8297 - DNA, 21 bp, Homo sapiens
gtcagtttcagtttatttgac

SEQ ID NO: 8298 - DNA, 21 bp, Homo sapiens
tacttataatgccgaggttgc

SEQ ID NO: 8299 - DNA, 20 bp, Homo sapiens
ggctgccgttctgcctccgt

SEQ ID NO: 8300 - DNA, 22 bp, Homo sapiens
gtctctcccagtttatggggtg

SEQ ID NO: 8301 - DNA, 20 bp, Homo sapiens
gcattcgtgtctagtggcct

SEQ ID NO: 8302 - DNA, 23 bp, Homo sapiens
ccccgtccgtccgtccgtccgtc

SEQ ID NO: 8303 - DNA, 22 bp, Homo sapiens
atcccagcaacgcctcgaagtc

SEQ ID NO: 8304 - DNA, 23 bp, Homo sapiens
cagcagcaatctctgttttgaaa

SEQ ID NO: 8305 - DNA, 22 bp, Homo sapiens
agacacggtaagaaagaacttg

SEQ ID NO: 8306 - DNA, 20 bp, Homo sapiens
gggttcggcctaggcattgc

SEQ ID NO: 8307 - DNA, 22 bp, Homo sapiens
gagtgacggcttgcaattcgcc

SEQ ID NO: 8308 - DNA, 24 bp, Homo sapiens
aacccggccctccttgtccacagg

SEQ ID NO: 8309 - DNA, 22 bp, Homo sapiens
tggctgccttctttcccacagg

SEQ ID NO: 8310 - DNA, 24 bp, Homo sapiens
cccgcccctccgcgcccccccccc

SEQ ID NO: 8311 - DNA, 20 bp, Homo sapiens
gccggcggctcggggccccc

SEQ ID NO: 8312 - DNA, 23 bp, Homo sapiens
ccttcagctcgcagtgcaggtat

SEQ ID NO: 8313 - DNA, 22 bp, Homo sapiens
aactgacttagaaattaccaac

SEQ ID NO: 8314 - DNA, 20 bp, Homo sapiens
ggggggaagggcacctagct

SEQ ID NO: 8315 - DNA, 22 bp, Homo sapiens
ttgggcatctaggctgtgccac

SEQ ID NO: 8316 - DNA, 20 bp, Homo sapiens
gccccgctccccggcgcacc

SEQ ID NO: 8317 - DNA, 20 bp, Homo sapiens
gggcggggtccgccggcgcc

SEQ ID NO: 8318 - DNA, 22 bp, Homo sapiens
tccctgagacttcacattgtct

SEQ ID NO: 8319 - DNA, 22 bp, Homo sapiens
accgcgcccagctagctttttt

SEQ ID NO: 8320 - DNA, 23 bp, Homo sapiens
ctgcgctactctatggtcatgag

SEQ ID NO: 8321 - DNA, 23 bp, Homo sapiens
cctggatggagcggacgcctctg

SEQ ID NO: 8322 - DNA, 22 bp, Homo sapiens
agctacgcctgacatctttgtt

SEQ ID NO: 8323 - DNA, 20 bp, Homo sapiens
cgcgccccgccggccagccc

SEQ ID NO: 8324 - DNA, 22 bp, Homo sapiens
ctgcacctccgacctccccagg

SEQ ID NO: 8325 - DNA, 21 bp, Homo sapiens
ggttgacctgtgggtaataaa

SEQ ID NO: 8326 - DNA, 21 bp, Homo sapiens
gctgtgccattgaaacggcct

SEQ ID NO: 8327 - DNA, 20 bp, Homo sapiens
tggccattctctaatatttt

SEQ ID NO: 8328 - DNA, 20 bp, Homo sapiens
tcccgccgtggaggtggaac

SEQ ID NO: 8329 - DNA, 21 bp, Homo sapiens
acacaggcttggtggtagaga

SEQ ID NO: 8330 - DNA, 21 bp, Homo sapiens
atggaacattacacagcaatg

SEQ ID NO: 8331 - DNA, 20 bp, Homo sapiens
ctgtaggcattgaagcccta

SEQ ID NO: 8332 - DNA, 22 bp, Homo sapiens
tagtgattatccaggatagatc

SEQ ID NO: 8333 - DNA, 23 bp, Homo sapiens
aatggcaatgttgtcctagcacc

SEQ ID NO: 8334 - DNA, 20 bp, Homo sapiens
cccgccgcccctcctcctcc

SEQ ID NO: 8335 - DNA, 21 bp, Homo sapiens
atacgttctaggggcttaatg

SEQ ID NO: 8336 - DNA, 20 bp, Homo sapiens
ggccgaggtgggatcccggg

SEQ ID NO: 8337 - DNA, 21 bp, Homo sapiens
tgagatgaagtgtcactgtca

SEQ ID NO: 8338 - DNA, 20 bp, Homo sapiens
cggggccgagggagccatct

SEQ ID NO: 8339 - DNA, 21 bp, Homo sapiens
gaggctgagatagcggtgagc

SEQ ID NO: 8340 - DNA, 21 bp, Homo sapiens
acagcaggcacagcacatacc

SEQ ID NO: 8341 - DNA, 21 bp, Homo sapiens
gtgacctagtctggtcactaa

SEQ ID NO: 8342 - DNA, 20 bp, Homo sapiens
taaagattctcggttagagc

SEQ ID NO: 8343 - DNA, 22 bp, Homo sapiens
tctctgaacccagcacctcggt

SEQ ID NO: 8344 - DNA, 22 bp, Homo sapiens
tcaatagctcatgtatgttggg

SEQ ID NO: 8345 - DNA, 22 bp, Homo sapiens
tgcatggatccagtacaccatt

SEQ ID NO: 8346 - DNA, 20 bp, Homo sapiens
cgcacggggtcggcagcagg

SEQ ID NO: 8347 - DNA, 21 bp, Homo sapiens
ccccggccccgtccgcccagc

SEQ ID NO: 8348 - DNA, 22 bp, Homo sapiens
aagggcatctaggctgagtgtg

SEQ ID NO: 8349 - DNA, 21 bp, Homo sapiens
aactcttagcggtggatcact

SEQ ID NO: 8350 - DNA, 21 bp, Homo sapiens
tgagctgggtttagaaatgat

SEQ ID NO: 8351 - DNA, 20 bp, Homo sapiens
cttcccacagagataaaact

SEQ ID NO: 8352 - DNA, 22 bp, Homo sapiens
tccagtctcgagcacccaggga

SEQ ID NO: 8353 - DNA, 23 bp, Homo sapiens
tacctggttgacttcaggcattg

SEQ ID NO: 8354 - DNA, 22 bp, Homo sapiens
tagctgcctggaatgtacactg

SEQ ID NO: 8355 - DNA, 23 bp, Homo sapiens
acataacaacagaaatacaaaca

SEQ ID NO: 8356 - DNA, 22 bp, Homo sapiens
gaaagtctcattcgacttgtct

SEQ ID NO: 8357 - DNA, 23 bp, Homo sapiens
taatactgcctgcatgcagaagt

SEQ ID NO: 8358 - DNA, 22 bp, Homo sapiens
cagtgcacgtgatgggaacgtg

SEQ ID NO: 8359 - DNA, 22 bp, Homo sapiens
tagcaccaaaactggctcgtaa

SEQ ID NO: 8360 - DNA, 21 bp, Homo sapiens
agcagcccactggcgcaaggc

SEQ ID NO: 8361 - DNA, 20 bp, Homo sapiens
ggctggggcgcgcctactcc

SEQ ID NO: 8362 - DNA, 22 bp, Homo sapiens
ctcactggcagctgggattacg

SEQ ID NO: 8363 - DNA, 22 bp, Homo sapiens
gtgctcagttcagcagagagag

SEQ ID NO: 8364 - DNA, 21 bp, Homo sapiens
ttgaaaccaaaggtatggtca

SEQ ID NO: 8365 - DNA, 22 bp, Homo sapiens
actgtgccatcaggcgccctgt

SEQ ID NO: 8366 - DNA, 20 bp, Homo sapiens
tccctgtccaggcgccttgt

SEQ ID NO: 8367 - DNA, 22 bp, Homo sapiens
tagcagcgactcagtcagggtc

SEQ ID NO: 8368 - DNA, 21 bp, Homo sapiens
ggaaggttaatggtgattccc

SEQ ID NO: 8369 - DNA, 23 bp, Homo sapiens
taaagtgctaataggatgacatc

SEQ ID NO: 8370 - DNA, 21 bp, Homo sapiens
ttcatcagacgtgtatctggg

SEQ ID NO: 8371 - DNA, 20 bp, Homo sapiens
tgtgacgtccaccttctgta

SEQ ID NO: 8372 - DNA, 22 bp, Homo sapiens
atttgatttgtctttatggttg

SEQ ID NO: 8373 - DNA, 20 bp, Homo sapiens
acacctcgggctgacagttg

SEQ ID NO: 8374 - DNA, 22 bp, Homo sapiens
gaggtggtaccagggctgtgtg

SEQ ID NO: 8375 - DNA, 24 bp, Homo sapiens
tcagtagagacgggtcttgctata

SEQ ID NO: 8376 - DNA, 24 bp, Homo sapiens
tgtcatccagggcccaggcgtctt

SEQ ID NO: 8377 - DNA, 20 bp, Homo sapiens
aggttaatgttcttgttggg

SEQ ID NO: 8378 - DNA, 21 bp, Homo sapiens
tagcttatctctggtagcaaa

SEQ ID NO: 8379 - DNA, 20 bp, Homo sapiens
ctttctagcctaagccccca

SEQ ID NO: 8380 - DNA, 22 bp, Homo sapiens
tctcccaaaaagcaaaatgttg

SEQ ID NO: 8381 - DNA, 21 bp, Homo sapiens
ccgccccgcgccctctcgctc

SEQ ID NO: 8382 - DNA, 22 bp, Homo sapiens
tggctcagggactgtctttgcc

SEQ ID NO: 8383 - DNA, 21 bp, Homo sapiens
ctatccataattacagcagtt

SEQ ID NO: 8384 - DNA, 23 bp, Homo sapiens
tggcttatcagatgtcgtgtaag

SEQ ID NO: 8385 - DNA, 20 bp, Homo sapiens
cttcagtgatgacacgaatg

SEQ ID NO: 8386 - DNA, 22 bp, Homo sapiens
accataagtccaggcagtctgg

SEQ ID NO: 8387 - DNA, 20 bp, Homo sapiens
tcctgctcacagcgccatct

SEQ ID NO: 8388 - DNA, 20 bp, Homo sapiens
tgaccatcatccaacactct

SEQ ID NO: 8389 - DNA, 22 bp, Homo sapiens
cctcctcccgcccccgccccgc

SEQ ID NO: 8390 - DNA, 22 bp, Homo sapiens
tgggacgctggagctgctggtc

SEQ ID NO: 8391 - DNA, 20 bp, Homo sapiens
ctggggcttgcacaagtgac

SEQ ID NO: 8392 - DNA, 20 bp, Homo sapiens
aacagcagttgagtgcaagg

SEQ ID NO: 8393 - DNA, 21 bp, Homo sapiens
gcggcggctcgggccttgcgc

SEQ ID NO: 8394 - DNA, 22 bp, Homo sapiens
tccgactctgtgatgtctgtga

SEQ ID NO: 8395 - DNA, 23 bp, Homo sapiens
tccatgagcttgcagtcttctga

SEQ ID NO: 8396 - DNA, 20 bp, Homo sapiens
tggcctccgttgccctctgc

SEQ ID NO: 8397 - DNA, 22 bp, Homo sapiens
atcactatgccctccaatacca

SEQ ID NO: 8398 - DNA, 20 bp, Homo sapiens
cactgctgagtatgtactgg

SEQ ID NO: 8399 - DNA, 23 bp, Homo sapiens
cccagtgtttagactgaggctag

SEQ ID NO: 8400 - DNA, 22 bp, Homo sapiens
tggctcagcctgggtcctgtgc

SEQ ID NO: 8401 - DNA, 21 bp, Homo sapiens
tggccgagtgcgcgggcgagc

SEQ ID NO: 8402 - DNA, 23 bp, Homo sapiens
agcagacccacgtgaagcaggcc

SEQ ID NO: 8403 - DNA, 23 bp, Homo sapiens
agctactccactgggcgtttttt

SEQ ID NO: 8404 - DNA, 20 bp, Homo sapiens
atcagagtatattgtagctg

SEQ ID NO: 8405 - DNA, 23 bp, Homo sapiens
ttttctctccagataacaggaag

SEQ ID NO: 8406 - DNA, 20 bp, Homo sapiens
ccctccccgggggcgcgggc

SEQ ID NO: 8407 - DNA, 22 bp, Homo sapiens
tgactgtcctatgtctttcctt

SEQ ID NO: 8408 - DNA, 22 bp, Homo sapiens
gaggactctgggattgaatgag

SEQ ID NO: 8409 - DNA, 20 bp, Homo sapiens
atcccacttctgacaccata

SEQ ID NO: 8410 - DNA, 22 bp, Homo sapiens
attgtgcagcagcgttggccca

SEQ ID NO: 8411 - DNA, 20 bp, Homo sapiens
aaagcggctgtacaccagaa

SEQ ID NO: 8412 - DNA, 23 bp, Homo sapiens
ggaatcacaagggtccttaggag

SEQ ID NO: 8413 - DNA, 20 bp, Homo sapiens
cccgctccccccgggcccaa

SEQ ID NO: 8414 - DNA, 23 bp, Homo sapiens
acacagccatgagggcgccttgg

SEQ ID NO: 8415 - DNA, 22 bp, Homo sapiens
tcaaatcagaggcagggcttgt

SEQ ID NO: 8416 - DNA, 23 bp, Homo sapiens
gcacacatacaaacaaacacaca

SEQ ID NO: 8417 - DNA, 22 bp, Homo sapiens
aatccatccccatcccctcagc

SEQ ID NO: 8418 - DNA, 21 bp, Homo sapiens
gctggaggaggcgccgccgcc

SEQ ID NO: 8419 - DNA, 22 bp, Homo sapiens
aagttaccgccgctactgagta

SEQ ID NO: 8420 - DNA, 21 bp, Homo sapiens
acttgcaagagaatcctcctg

SEQ ID NO: 8421 - DNA, 21 bp, Homo sapiens
tagcgttgtagtactagccaa

SEQ ID NO: 8422 - DNA, 21 bp, Homo sapiens
ccctccccaccccgcgccgag

SEQ ID NO: 8423 - DNA, 21 bp, Homo sapiens
ccccccactgctaacgccact

SEQ ID NO: 8424 - DNA, 20 bp, Homo sapiens
tcgatgtaatgatgctgctc

SEQ ID NO: 8425 - DNA, 20 bp, Homo sapiens
cggcggcggcgactctgatg

SEQ ID NO: 8426 - DNA, 20 bp, Homo sapiens
gccggcgggagggccgggga

SEQ ID NO: 8427 - DNA, 21 bp, Homo sapiens
tgacctatgaatgtcatctat

SEQ ID NO: 8428 - DNA, 22 bp, Homo sapiens
accctgagagggatgtacacag

SEQ ID NO: 8429 - DNA, 20 bp, Homo sapiens
ggctgatgatgaggctgaag

SEQ ID NO: 8430 - DNA, 23 bp, Homo sapiens
tgtgttttaggtactgggagaca

SEQ ID NO: 8431 - DNA, 22 bp, Homo sapiens
tcagctgctgagtttatggtaa

SEQ ID NO: 8432 - DNA, 20 bp, Homo sapiens
gcagaggagctgggggcatg

SEQ ID NO: 8433 - DNA, 22 bp, Homo sapiens
agagagatgccagagtggccga

SEQ ID NO: 8434 - DNA, 20 bp, Homo sapiens
cggccggtgatgagaacttc

SEQ ID NO: 8435 - DNA, 21 bp, Homo sapiens
cgggggctcacaatgttgccc

SEQ ID NO: 8436 - DNA, 22 bp, Homo sapiens
tctggtcccttcgtggtcgcca

SEQ ID NO: 8437 - DNA, 21 bp, Homo sapiens
taatactgcctgcattctatg

SEQ ID NO: 8438 - DNA, 20 bp, Homo sapiens
gccggggtggcggaacctgc

SEQ ID NO: 8439 - DNA, 20 bp, Homo sapiens
cgcgctctcccccctccccg

SEQ ID NO: 8440 - DNA, 22 bp, Homo sapiens
cccagccctgctcctcgggatg

SEQ ID NO: 8441 - DNA, 20 bp, Homo sapiens
acatggtgccggcacttctc

SEQ ID NO: 8442 - DNA, 20 bp, Homo sapiens
ggggtccgccggccctgggt

SEQ ID NO: 8443 - DNA, 22 bp, Homo sapiens
ttgcagcacgcgccattttata

SEQ ID NO: 8444 - DNA, 20 bp, Homo sapiens
catctgcttccttactactt

SEQ ID NO: 8445 - DNA, 22 bp, Homo sapiens
ctgggggaacacagcctcagcc

SEQ ID NO: 8446 - DNA, 22 bp, Homo sapiens
tttggcagcaacagcatagact

SEQ ID NO: 8447 - DNA, 22 bp, Homo sapiens
tggctctctgaagcctccacga

SEQ ID NO: 8448 - DNA, 22 bp, Homo sapiens
agggactctggggctgaactga

SEQ ID NO: 8449 - DNA, 22 bp, Homo sapiens
tactggtttgtaccatcaaaac

SEQ ID NO: 8450 - DNA, 22 bp, Homo sapiens
ctgaatctctgaaaagaaaggg

SEQ ID NO: 8451 - DNA, 22 bp, Homo sapiens
tagttcagctgattggggagtt

SEQ ID NO: 8452 - DNA, 20 bp, Homo sapiens
ctgggaagaatggcagctac

SEQ ID NO: 8453 - DNA, 22 bp, Homo sapiens
gtccagtttttccaaaggctgg

SEQ ID NO: 8454 - DNA, 22 bp, Homo sapiens
tccctgatcaaagcctccaccc

SEQ ID NO: 8455 - DNA, 20 bp, Homo sapiens
gagcccagcgcctccgtttt

SEQ ID NO: 8456 - DNA, 21 bp, Homo sapiens
aatggcaatgcatttctgagt

SEQ ID NO: 8457 - DNA, 22 bp, Homo sapiens
taggacagcaaagccaggtgtc

SEQ ID NO: 8458 - DNA, 22 bp, Homo sapiens
agagagtaaagggagatagata

SEQ ID NO: 8459 - DNA, 20 bp, Homo sapiens
ggcgtgattcataccttgca

SEQ ID NO: 8460 - DNA, 20 bp, Homo sapiens
cgaggcgccgccgcccccgc

SEQ ID NO: 8461 - DNA, 20 bp, Homo sapiens
cctggtgatgacagatggaa

SEQ ID NO: 8462 - DNA, 20 bp, Homo sapiens
atatcactcagatcagatta

SEQ ID NO: 8463 - DNA, 20 bp, Homo sapiens
attagaggctattgttcagt

SEQ ID NO: 8464 - DNA, 20 bp, Homo sapiens
aagtcccattggtctagttt

SEQ ID NO: 8465 - DNA, 22 bp, Homo sapiens
tagcttgcttagtcatatggtc

SEQ ID NO: 8466 - DNA, 20 bp, Homo sapiens
agcagcattagcacttgctt

SEQ ID NO: 8467 - DNA, 22 bp, Homo sapiens
ggtctgagatggggggcgaggt

SEQ ID NO: 8468 - DNA, 23 bp, Homo sapiens
agggccccgagagggagcgagac

SEQ ID NO: 8469 - DNA, 22 bp, Homo sapiens
cctccactgctgccaccatgtt

SEQ ID NO: 8470 - DNA, 20 bp, Homo sapiens
gccctcggggccgcggtatc

SEQ ID NO: 8471 - DNA, 21 bp, Homo sapiens
aggtagaggtggcaggaatta

SEQ ID NO: 8472 - DNA, 22 bp, Homo sapiens
tccctgatcaaagtatccacag

SEQ ID NO: 8473 - DNA, 22 bp, Homo sapiens
tcttcagagtttcagtccagct

SEQ ID NO: 8474 - DNA, 22 bp, Homo sapiens
ttagtggctccctctgcctgca

SEQ ID NO: 8475 - DNA, 20 bp, Homo sapiens
acgtccctgttcgggcgcca

SEQ ID NO: 8476 - DNA, 22 bp, Homo sapiens
tgacagtaatctgggctatcat

SEQ ID NO: 8477 - DNA, 22 bp, Homo sapiens
gaatgatggagtgacggcatct

SEQ ID NO: 8478 - DNA, 20 bp, Homo sapiens
caggcgtagcgcttccggcc

SEQ ID NO: 8479 - DNA, 21 bp, Homo sapiens
aaccttctgagccagatgtat

SEQ ID NO: 8480 - DNA, 22 bp, Homo sapiens
cagttgggtagtttttgggtgg

SEQ ID NO: 8481 - DNA, 21 bp, Homo sapiens
ggacagggctgtgtttccaca

SEQ ID NO: 8482 - DNA, 22 bp, Homo sapiens
cagcaccatctctagctgtggc

SEQ ID NO: 8483 - DNA, 20 bp, Homo sapiens
cggccgccccctcgcccgac

SEQ ID NO: 8484 - DNA, 23 bp, Homo sapiens
tccctgtcctccaggagctcact

SEQ ID NO: 8485 - DNA, 23 bp, Homo sapiens
cgtccgacctgggtaatttttgt

SEQ ID NO: 8486 - DNA, 20 bp, Homo sapiens
gaggttgacctgtccctgct

SEQ ID NO: 8487 - DNA, 22 bp, Homo sapiens
gtctctttgtgaaatatcccca

SEQ ID NO: 8488 - DNA, 23 bp, Homo sapiens
taataataactctcagcaaactg

SEQ ID NO: 8489 - DNA, 22 bp, Homo sapiens
gtcagtggttttgtttaaggag

SEQ ID NO: 8490 - DNA, 23 bp, Homo sapiens
aaagcaggcacagacagtacgta

SEQ ID NO: 8491 - DNA, 20 bp, Homo sapiens
ggaagctctggtggaggatc

SEQ ID NO: 8492 - DNA, 24 bp, Homo sapiens
ccctcgctccctcccccggggcgc

SEQ ID NO: 8493 - DNA, 23 bp, Homo sapiens
ttataagtgagtctatgacaggg

SEQ ID NO: 8494 - DNA, 21 bp, Homo sapiens
gtctggctgctattgctacag

SEQ ID NO: 8495 - DNA, 20 bp, Homo sapiens
tggtcatcagaggccattgt

SEQ ID NO: 8496 - DNA, 22 bp, Homo sapiens
caaaatgatgaggtacctgata

SEQ ID NO: 8497 - DNA, 22 bp, Homo sapiens
ttcactgccagacccgccagag

SEQ ID NO: 8498 - DNA, 20 bp, Homo sapiens
gcttgttgctcctagctaca

SEQ ID NO: 8499 - DNA, 22 bp, Homo sapiens
ttttcagagtcctaatccacgg

SEQ ID NO: 8500 - DNA, 23 bp, Homo sapiens
gtcactggggaccaggatagggt

SEQ ID NO: 8501 - DNA, 20 bp, Homo sapiens
ggacatgaggggtgtagatc

SEQ ID NO: 8502 - DNA, 21 bp, Homo sapiens
cttgccccagctggaacacgg

SEQ ID NO: 8503 - DNA, 22 bp, Homo sapiens
caacggaaatttggggatgggg

SEQ ID NO: 8504 - DNA, 20 bp, Homo sapiens
cctctttacagtgaccgttt

SEQ ID NO: 8505 - DNA, 20 bp, Homo sapiens
acttctaatcagcataactc

SEQ ID NO: 8506 - DNA, 23 bp, Homo sapiens
cactgacatgtctttatgggtgg

SEQ ID NO: 8507 - DNA, 22 bp, Homo sapiens
tgctcagagcaaaggggctcca

SEQ ID NO: 8508 - DNA, 20 bp, Homo sapiens
cgttttccgtagtgtagatc

SEQ ID NO: 8509 - DNA, 23 bp, Homo sapiens
cctaatgtgaaataccactgtga

SEQ ID NO: 8510 - DNA, 20 bp, Homo sapiens
tcccctcctccaacatgcag

SEQ ID NO: 8511 - DNA, 23 bp, Homo sapiens
ttggggtttgagtttatgtttgg

SEQ ID NO: 8512 - DNA, 21 bp, Homo sapiens
atcatggaacggggcttgtac

SEQ ID NO: 8513 - DNA, 24 bp, Homo sapiens
gtgaacagcctctggcaatggcag

SEQ ID NO: 8514 - DNA, 21 bp, Homo sapiens
tccactctctaattaacatat

SEQ ID NO: 8515 - DNA, 22 bp, Homo sapiens
tctacaacaaactggctttgtg

SEQ ID NO: 8516 - DNA, 21 bp, Homo sapiens
ccttagttctgccatttattg

SEQ ID NO: 8517 - DNA, 22 bp, Homo sapiens
tggatgtttgtccccgcaaata

SEQ ID NO: 8518 - DNA, 22 bp, Homo sapiens
ttcatcattaggtcagcctgct

SEQ ID NO: 8519 - DNA, 23 bp, Homo sapiens
aatgtgtgctagaagaaatggtg

SEQ ID NO: 8520 - DNA, 22 bp, Homo sapiens
ttcagaaggcttctgatagatt

SEQ ID NO: 8521 - DNA, 21 bp, Homo sapiens
gactgctcagtaaaagtatag

SEQ ID NO: 8522 - DNA, 22 bp, Homo sapiens
tgaggtagtactgttatatcca

SEQ ID NO: 8523 - DNA, 23 bp, Homo sapiens
agcataccactatgcaaagtact

SEQ ID NO: 8524 - DNA, 22 bp, Homo sapiens
gctacgtgctcagaatcgtgcc

SEQ ID NO: 8525 - DNA, 23 bp, Homo sapiens
actgtcaaccttgatccccacag

SEQ ID NO: 8526 - DNA, 22 bp, Homo sapiens
agcgcagctggagccaggtgct

SEQ ID NO: 8527 - DNA, 22 bp, Homo sapiens
tctcaaccacagtgtaagttac

SEQ ID NO: 8528 - DNA, 20 bp, Homo sapiens
atcccacacgacccactgcc

SEQ ID NO: 8529 - DNA, 23 bp, Homo sapiens
gtataatcactggcaccacgcag

SEQ ID NO: 8530 - DNA, 22 bp, Homo sapiens
tgcattccagagtgctctgtct

SEQ ID NO: 8531 - DNA, 22 bp, Homo sapiens
taacttatcagactgatttcct

SEQ ID NO: 8532 - DNA, 22 bp, Homo sapiens
ggactcatttccaggataaagc

SEQ ID NO: 8533 - DNA, 22 bp, Homo sapiens
cttatctgggaaggagagttgt

SEQ ID NO: 8534 - DNA, 20 bp, Homo sapiens
gtgatttgcccaccccaggc

SEQ ID NO: 8535 - DNA, 22 bp, Homo sapiens
gcatcagagtcctgacttgcag

SEQ ID NO: 8536 - DNA, 22 bp, Homo sapiens
tgaggtagtagtttggcatggc

SEQ ID NO: 8537 - DNA, 21 bp, Homo sapiens
tcagtaacagcactccactgt

SEQ ID NO: 8538 - DNA, 23 bp, Homo sapiens
taaattagctctcagagcattct

SEQ ID NO: 8539 - DNA, 21 bp, Homo sapiens
atgacctattccgcagtggga

SEQ ID NO: 8540 - DNA, 22 bp, Homo sapiens
tcctcagagtttcggttcactc

SEQ ID NO: 8541 - DNA, 20 bp, Homo sapiens
ctgaggatacttaactatgg

SEQ ID NO: 8542 - DNA, 20 bp, Homo sapiens
gaacaactggacatttgggg

SEQ ID NO: 8543 - DNA, 22 bp, Homo sapiens
gagagatagcttgactacttct

SEQ ID NO: 8544 - DNA, 23 bp, Homo sapiens
tgcctgtctacagcaggacactg

SEQ ID NO: 8545 - DNA, 22 bp, Homo sapiens
catcagtccacttttataaacc

SEQ ID NO: 8546 - DNA, 20 bp, Homo sapiens
atgtctgggtgctgtagttg

SEQ ID NO: 8547 - DNA, 20 bp, Homo sapiens
cttcatctcccattcctggt

SEQ ID NO: 8548 - DNA, 22 bp, Homo sapiens
ctctaaggcttcacatgggact

SEQ ID NO: 8549 - DNA, 23 bp, Homo sapiens
ttataataggagtcagcacactg

SEQ ID NO: 8550 - DNA, 22 bp, Homo sapiens
aacagcatgagaatagggaaga

SEQ ID NO: 8551 - DNA, 20 bp, Homo sapiens
atgtgttatttactgtgtcg

SEQ ID NO: 8552 - DNA, 23 bp, Homo sapiens
tagcaatagtgaccacgtggccc

SEQ ID NO: 8553 - DNA, 23 bp, Homo sapiens
taacactactcaacggtatgctt

SEQ ID NO: 8554 - DNA, 20 bp, Homo sapiens
ccagaagattgatggggctg

SEQ ID NO: 8555 - DNA, 22 bp, Homo sapiens
agctacagtttccacgttgttt

SEQ ID NO: 8556 - DNA, 22 bp, Homo sapiens
actcagctgcagccatatgggg

SEQ ID NO: 8557 - DNA, 20 bp, Homo sapiens
agcaggtaacatgtcatagc

SEQ ID NO: 8558 - DNA, 22 bp, Homo sapiens
gaaagctagaaagctgaacact

SEQ ID NO: 8559 - DNA, 23 bp, Homo sapiens
cttattttttctcctttgagggg

SEQ ID NO: 8560 - DNA, 21 bp, Homo sapiens
cccgtggatcgccccgaagtg

SEQ ID NO: 8561 - DNA, 21 bp, Homo sapiens
tcctgtgtgttatgcatgaag

SEQ ID NO: 8562 - DNA, 22 bp, Homo sapiens
tctcccccaaaggagcaactat

SEQ ID NO: 8563 - DNA, 23 bp, Homo sapiens
gtccagttgtaaacttctaggga

SEQ ID NO: 8564 - DNA, 23 bp, Homo sapiens
gtccctaaagaaacttctaggga

SEQ ID NO: 8565 - DNA, 22 bp, Homo sapiens
tgtctcaaactcaaataaaggg

SEQ ID NO: 8566 - DNA, 24 bp, Homo sapiens
tataatatgaaatacacagcacag

SEQ ID NO: 8567 - DNA, 22 bp, Homo sapiens
tgtcaggggtgtgggctgggga

SEQ ID NO: 8568 - DNA, 22 bp, Homo sapiens
atgcgtatgccaaaagccattg

SEQ ID NO: 8569 - DNA, 22 bp, Homo sapiens
agcagcatcagcagaaatgcag

SEQ ID NO: 8570 - DNA, 22 bp, Homo sapiens
ggagtcattaggcttatagggt

SEQ ID NO: 8571 - DNA, 21 bp, Homo sapiens
tagcttatcagatactcatgg

SEQ ID NO: 8572 - DNA, 22 bp, Homo sapiens
tctcagttgggaacacaactgt

SEQ ID NO: 8573 - DNA, 23 bp, Homo sapiens
tcagtgctctacctccaggcttg

SEQ ID NO: 8574 - DNA, 20 bp, Homo sapiens
ctataagtgcctcatataag

SEQ ID NO: 8575 - DNA, 22 bp, Homo sapiens
tgctggtcaggccccatgttgg

SEQ ID NO: 8576 - DNA, 21 bp, Homo sapiens
cattccaattaatgagaaaaa

SEQ ID NO: 8577 - DNA, 20 bp, Homo sapiens
cccgtggccgagggagcatc

SEQ ID NO: 8578 - DNA, 22 bp, Homo sapiens
agcgagggttccgccggccacc

SEQ ID NO: 8579 - DNA, 22 bp, Homo sapiens
agaacattgccaggagcccttc

SEQ ID NO: 8580 - DNA, 23 bp, Homo sapiens
cgccggccttgaccccgcccacc

SEQ ID NO: 8581 - DNA, 22 bp, Homo sapiens
gagcagggacagtttatggggt

SEQ ID NO: 8582 - DNA, 21 bp, Homo sapiens
cagctgtaagaagagctgtaa

SEQ ID NO: 8583 - DNA, 22 bp, Homo sapiens
agctacattggaggctgaaccc

SEQ ID NO: 8584 - DNA, 22 bp, Homo sapiens
tgtctgtttgtcacccgaaggt

SEQ ID NO: 8585 - DNA, 20 bp, Homo sapiens
acaggattgaacccaggatt

SEQ ID NO: 8586 - DNA, 20 bp, Homo sapiens
cacgctattgaaagctgatg

SEQ ID NO: 8587 - DNA, 21 bp, Homo sapiens
ccagtaatgacccaagcatat

SEQ ID NO: 8588 - DNA, 21 bp, Homo sapiens
aggctccggagtggctgggac

SEQ ID NO: 8589 - DNA, 20 bp, Homo sapiens
cgcgccccccccacccccac

SEQ ID NO: 8590 - DNA, 22 bp, Homo sapiens
gacctgctgctgctgtgtgtac

SEQ ID NO: 8591 - DNA, 21 bp, Homo sapiens
cagagaaatacagggttaggt

SEQ ID NO: 8592 - DNA, 20 bp, Homo sapiens
aaacggaatcccagaagcat

SEQ ID NO: 8593 - DNA, 20 bp, Homo sapiens
acaaagcgagtcttttcaac

SEQ ID NO: 8594 - DNA, 21 bp, Homo sapiens
ctcgccaggctggccccggct

SEQ ID NO: 8595 - DNA, 23 bp, Homo sapiens
tgtcagcctgctgggcacccaca

SEQ ID NO: 8596 - DNA, 20 bp, Homo sapiens
ggggacggcggagcgtgcgc

SEQ ID NO: 8597 - DNA, 22 bp, Homo sapiens
caggtcgggctggtccttaggg

SEQ ID NO: 8598 - DNA, 20 bp, Homo sapiens
agttgggagagcatcgggat

SEQ ID NO: 8599 - DNA, 20 bp, Homo sapiens
atcacattgaacttctagat

SEQ ID NO: 8600 - DNA, 20 bp, Homo sapiens
tggtgccaacaacagggagg

SEQ ID NO: 8601 - DNA, 21 bp, Homo sapiens
cctgttgttggcaccagcacc

SEQ ID NO: 8602 - DNA, 24 bp, Homo sapiens
agcgagcgcacgcccagccggccg

SEQ ID NO: 8603 - DNA, 20 bp, Homo sapiens
cccagcataagaatagcatg

SEQ ID NO: 8604 - DNA, 20 bp, Homo sapiens
ccccgtcctcccccctccct

SEQ ID NO: 8605 - DNA, 22 bp, Homo sapiens
tccctgagaccctaccctgaga

SEQ ID NO: 8606 - DNA, 23 bp, Homo sapiens
aactctggagctttcgtacatgc

SEQ ID NO: 8607 - DNA, 22 bp, Homo sapiens
gctgaaagccgtttcccgtgtt

SEQ ID NO: 8608 - DNA, 21 bp, Homo sapiens
tttgtaaaggctccttgtggc

SEQ ID NO: 8609 - DNA, 20 bp, Homo sapiens
attatgtgcatggattggat

SEQ ID NO: 8610 - DNA, 20 bp, Homo sapiens
atttagattatagttcgcaa

SEQ ID NO: 8611 - DNA, 22 bp, Homo sapiens
ttcacttaatccagaggcttat

SEQ ID NO: 8612 - DNA, 20 bp, Homo sapiens
aggaggtttccagacaagca

SEQ ID NO: 8613 - DNA, 23 bp, Homo sapiens
gggtgacttagcaaatacaaacc

SEQ ID NO: 8614 - DNA, 23 bp, Homo sapiens
gaaaagtgggaggtccttaggga

SEQ ID NO: 8615 - DNA, 20 bp, Homo sapiens
cattccataattacagcctt

SEQ ID NO: 8616 - DNA, 22 bp, Homo sapiens
aagcgcgggcgggcggcgggcg

SEQ ID NO: 8617 - DNA, 22 bp, Homo sapiens
tggctctcagaagcaggacact

SEQ ID NO: 8618 - DNA, 20 bp, Homo sapiens
cccaattttgcctttcgtga

SEQ ID NO: 8619 - DNA, 20 bp, Homo sapiens
ggcagcaggtctccactcac

SEQ ID NO: 8620 - DNA, 21 bp, Homo sapiens
atcacattgcatccctttgaa

SEQ ID NO: 8621 - DNA, 22 bp, Homo sapiens
actagttttctggcgcaaagtt

SEQ ID NO: 8622 - DNA, 20 bp, Homo sapiens
agtcacatggttgctaatgt

SEQ ID NO: 8623 - DNA, 22 bp, Homo sapiens
agcaatggcccatatctgacaa

SEQ ID NO: 8624 - DNA, 23 bp, Homo sapiens
ctactagactgtgaggactcttt

SEQ ID NO: 8625 - DNA, 22 bp, Homo sapiens
tggagagaaaggctcaatcttc

SEQ ID NO: 8626 - DNA, 20 bp, Homo sapiens
tagctatagctcttgttatt

SEQ ID NO: 8627 - DNA, 23 bp, Homo sapiens
cactggttcaccaaatgcaaaca

SEQ ID NO: 8628 - DNA, 23 bp, Homo sapiens
tctctctctttcccccctccttc

SEQ ID NO: 8629 - DNA, 22 bp, Homo sapiens
cgggccttagggtgggatgaaa

SEQ ID NO: 8630 - DNA, 20 bp, Homo sapiens
ggtagttctgagttgagtgt

SEQ ID NO: 8631 - DNA, 23 bp, Homo sapiens
tctaaaatcagtgcagctgtgac

SEQ ID NO: 8632 - DNA, 21 bp, Homo sapiens
aaggtacgagcttagctggac

SEQ ID NO: 8633 - DNA, 22 bp, Homo sapiens
caacaaatcatgactcattgtg

SEQ ID NO: 8634 - DNA, 21 bp, Homo sapiens
ccctgccctgctccccacagc

SEQ ID NO: 8635 - DNA, 21 bp, Homo sapiens
ctgtgacagtggccatctcca

SEQ ID NO: 8636 - DNA, 21 bp, Homo sapiens
cctagcaggcacctgggtata

SEQ ID NO: 8637 - DNA, 22 bp, Homo sapiens
tggtgcaatggacctatggaca

SEQ ID NO: 8638 - DNA, 22 bp, Homo sapiens
gacaatgtctaggctgtccatg

SEQ ID NO: 8639 - DNA, 21 bp, Homo sapiens
tatggcttttcattccctttc

SEQ ID NO: 8640 - DNA, 20 bp, Homo sapiens
tttggcaatggtaatgtgag

SEQ ID NO: 8641 - DNA, 23 bp, Homo sapiens
tgaatgggcttgcatgcccagtt

SEQ ID NO: 8642 - DNA, 21 bp, Homo sapiens
cagtgctgcagcaggaaatgc

SEQ ID NO: 8643 - DNA, 23 bp, Homo sapiens
acttgcatctaaatctgatcaag

SEQ ID NO: 8644 - DNA, 22 bp, Homo sapiens
ctcccccctccccgcccctcgc

SEQ ID NO: 8645 - DNA, 20 bp, Homo sapiens
agggctgcagcatgaaggtt

SEQ ID NO: 8646 - DNA, 20 bp, Homo sapiens
aacggcaacttggggtaagg

SEQ ID NO: 8647 - DNA, 24 bp, Homo sapiens
aggggagcattagtatctgctgag

SEQ ID NO: 8648 - DNA, 21 bp, Homo sapiens
atgctgtgcagacattaaaaa

SEQ ID NO: 8649 - DNA, 20 bp, Homo sapiens
tgccacagtgttgtttgtct

SEQ ID NO: 8650 - DNA, 20 bp, Homo sapiens
cagcaattcctgatgtgctg

SEQ ID NO: 8651 - DNA, 21 bp, Homo sapiens
cagagcaggaacagtggcaga

SEQ ID NO: 8652 - DNA, 22 bp, Homo sapiens
ttctttggtttccagcaacaga

SEQ ID NO: 8653 - DNA, 20 bp, Homo sapiens
cccccggcatctccaccgcc

SEQ ID NO: 8654 - DNA, 21 bp, Homo sapiens
tgaacgtcctacagtgcctag

SEQ ID NO: 8655 - DNA, 23 bp, Homo sapiens
ttcaagtaatcctcccgcttcag

SEQ ID NO: 8656 - DNA, 21 bp, Homo sapiens
catcgctggagaatctcatgc

SEQ ID NO: 8657 - DNA, 22 bp, Homo sapiens
tagcaggtagagaaataggggc

SEQ ID NO: 8658 - DNA, 23 bp, Homo sapiens
taggaatagttgctgatgtttca

SEQ ID NO: 8659 - DNA, 21 bp, Homo sapiens
ccactacgcctaatatttttt

SEQ ID NO: 8660 - DNA, 22 bp, Homo sapiens
ttcagacgggagtctcgctctc

SEQ ID NO: 8661 - DNA, 22 bp, Homo sapiens
tgagtggagcagtttatgccca

SEQ ID NO: 8662 - DNA, 22 bp, Homo sapiens
ttcaaggccgacaggaagaagg

SEQ ID NO: 8663 - DNA, 22 bp, Homo sapiens
tggggctttttcgtttgctggt

SEQ ID NO: 8664 - DNA, 22 bp, Homo sapiens
gtctgattgcagaaagcaacca

SEQ ID NO: 8665 - DNA, 22 bp, Homo sapiens
ggctgggtgctcaatgatgtct

SEQ ID NO: 8666 - DNA, 23 bp, Homo sapiens
gagctcgctgagtggggtaggga

SEQ ID NO: 8667 - DNA, 22 bp, Homo sapiens
tctgactctgaagcccctgcat

SEQ ID NO: 8668 - DNA, 23 bp, Homo sapiens
tgtccttagttaccatatgcaga

SEQ ID NO: 8669 - DNA, 20 bp, Homo sapiens
gcattggtggttcagcttga

SEQ ID NO: 8670 - DNA, 24 bp, Homo sapiens
gattattagtgaggctggtgatga

SEQ ID NO: 8671 - DNA, 22 bp, Homo sapiens
tggtgtcccagaggttgtgagg

SEQ ID NO: 8672 - DNA, 20 bp, Homo sapiens
cttttaatgctcttgttcaa

SEQ ID NO: 8673 - DNA, 21 bp, Homo sapiens
tagcaggtagcaggtagcaca

SEQ ID NO: 8674 - DNA, 21 bp, Homo sapiens
ttctgcttgatctttggtgta

SEQ ID NO: 8675 - DNA, 22 bp, Homo sapiens
tagagacggtcactgattccct

SEQ ID NO: 8676 - DNA, 21 bp, Homo sapiens
catgctgtttttatttgtggg

SEQ ID NO: 8677 - DNA, 20 bp, Homo sapiens
cgtctcctcgtgtttctatg

SEQ ID NO: 8678 - DNA, 23 bp, Homo sapiens
acccaaaaacgtgtgaccactga

SEQ ID NO: 8679 - DNA, 21 bp, Homo sapiens
ttgcaaactcaaatacccaca

SEQ ID NO: 8680 - DNA, 22 bp, Homo sapiens
tccctgagcaagatacttaact

SEQ ID NO: 8681 - DNA, 21 bp, Homo sapiens
tttctaattagctaggggaag

SEQ ID NO: 8682 - DNA, 22 bp, Homo sapiens
gtggcaaatctggtatggggtt

SEQ ID NO: 8683 - DNA, 22 bp, Homo sapiens
tgtgcgaatcccaaaagcatag

SEQ ID NO: 8684 - DNA, 20 bp, Homo sapiens
ccaggagctatacaacggct

SEQ ID NO: 8685 - DNA, 22 bp, Homo sapiens
tgaggtagtagtttgtgtcttt

SEQ ID NO: 8686 - DNA, 24 bp, Homo sapiens
ttggaggacattgtgttcagtgga

SEQ ID NO: 8687 - DNA, 21 bp, Homo sapiens
aagccatctaggaagttgggg

SEQ ID NO: 8688 - DNA, 20 bp, Homo sapiens
ccccggcatctccaggcaaa

SEQ ID NO: 8689 - DNA, 23 bp, Homo sapiens
gtgctcctggcagcaggaacagt

SEQ ID NO: 8690 - DNA, 22 bp, Homo sapiens
caacggaatcccagaggtgaga

SEQ ID NO: 8691 - DNA, 24 bp, Homo sapiens
cctcccggggcttgcgggtgaggc

SEQ ID NO: 8692 - DNA, 22 bp, Homo sapiens
caaatagcagggtccatatatt

SEQ ID NO: 8693 - DNA, 22 bp, Homo sapiens
tctgagtaatccctgatgaatc

SEQ ID NO: 8694 - DNA, 22 bp, Homo sapiens
cccgccgcgccgggctccgtcc

SEQ ID NO: 8695 - DNA, 20 bp, Homo sapiens
tgaggtagtagtttgcaagt

SEQ ID NO: 8696 - DNA, 22 bp, Homo sapiens
tcgacaccattaacatcactgt

SEQ ID NO: 8697 - DNA, 22 bp, Homo sapiens
ggtggcaaacagtggcgttttg

SEQ ID NO: 8698 - DNA, 22 bp, Homo sapiens
gcctcagagtttcgcaggtcct

SEQ ID NO: 8699 - DNA, 21 bp, Homo sapiens
tatcaacttagcaaatcgaaa

SEQ ID NO: 8700 - DNA, 23 bp, Homo sapiens
gggccgcggagcggagccggggc

SEQ ID NO: 8701 - DNA, 23 bp, Homo sapiens
aactctgatgtgagattcagcat

SEQ ID NO: 8702 - DNA, 24 bp, Homo sapiens
gcctaggctttgacatattttttg

SEQ ID NO: 8703 - DNA, 20 bp, Homo sapiens
ctccaaggtgaacagaagag

SEQ ID NO: 8704 - DNA, 23 bp, Homo sapiens
gagaaaccaaaggtgcctctgtg

SEQ ID NO: 8705 - DNA, 20 bp, Homo sapiens
gacagctaaggactgcaggt

SEQ ID NO: 8706 - DNA, 22 bp, Homo sapiens
tactgaactcttgccacgtggc

SEQ ID NO: 8707 - DNA, 23 bp, Homo sapiens
tggcaccatccatgcaggtgacc

SEQ ID NO: 8708 - DNA, 20 bp, Homo sapiens
gcctccaactggacattttg

SEQ ID NO: 8709 - DNA, 21 bp, Homo sapiens
tctcttatcagatcagcagca

SEQ ID NO: 8710 - DNA, 22 bp, Homo sapiens
catgccttagggaaaagcccat

SEQ ID NO: 8711 - DNA, 23 bp, Homo sapiens
tagcttactgcttcagcagcatt

SEQ ID NO: 8712 - DNA, 21 bp, Homo sapiens
tggctcacaagtcacttgtct

SEQ ID NO: 8713 - DNA, 23 bp, Homo sapiens
tcttgaaaactttgaaggcttct

SEQ ID NO: 8714 - DNA, 21 bp, Homo sapiens
ctggggatcaggccagtggtt

SEQ ID NO: 8715 - DNA, 23 bp, Homo sapiens
cctctgggccctcttctggacgg

SEQ ID NO: 8716 - DNA, 20 bp, Homo sapiens
gggaaactcgcgccatccag

SEQ ID NO: 8717 - DNA, 20 bp, Homo sapiens
ggcagaggtgggatccctct

SEQ ID NO: 8718 - DNA, 20 bp, Homo sapiens
tcctgccggctcttgttgcc

SEQ ID NO: 8719 - DNA, 20 bp, Homo sapiens
cgacacggtaactttggaat

SEQ ID NO: 8720 - DNA, 20 bp, Homo sapiens
gcgcgcccccccccaccccg

SEQ ID NO: 8721 - DNA, 23 bp, Homo sapiens
tgacgatgatgttgattctgagc

SEQ ID NO: 8722 - DNA, 22 bp, Homo sapiens
acagcaggcacaagtgagccag

SEQ ID NO: 8723 - DNA, 21 bp, Homo sapiens
gccccgggcgggtgcgcggct

SEQ ID NO: 8724 - DNA, 21 bp, Homo sapiens
cggcggcacctgcccggcata

SEQ ID NO: 8725 - DNA, 23 bp, Homo sapiens
acatacttctttatatgcccata

SEQ ID NO: 8726 - DNA, 22 bp, Homo sapiens
cgtgggggatttggagtcttct

SEQ ID NO: 8727 - DNA, 22 bp, Homo sapiens
agttgatgtttggatccctttc

SEQ ID NO: 8728 - DNA, 20 bp, Homo sapiens
acgggcatgacacagcacag

SEQ ID NO: 8729 - DNA, 20 bp, Homo sapiens
tctgcaagaaggggcttgta

SEQ ID NO: 8730 - DNA, 22 bp, Homo sapiens
tagcaccaagactgatcgcctg

SEQ ID NO: 8731 - DNA, 22 bp, Homo sapiens
cagtgcaatcagggggcaatgc

SEQ ID NO: 8732 - DNA, 22 bp, Homo sapiens
tccctgagaaccttgtccatga

SEQ ID NO: 8733 - DNA, 21 bp, Homo sapiens
cagcagcaattctagtttaga

SEQ ID NO: 8734 - DNA, 23 bp, Homo sapiens
cttaggctcctgatgcctgtgac

SEQ ID NO: 8735 - DNA, 22 bp, Homo sapiens
tctcaaccacagtgttgtgaca

SEQ ID NO: 8736 - DNA, 23 bp, Homo sapiens
ctattaggtccgcgttgtgcaga

SEQ ID NO: 8737 - DNA, 23 bp, Homo sapiens
cacattttagatacgttttgaag

SEQ ID NO: 8738 - DNA, 20 bp, Homo sapiens
tgaggtagtaggttgctacc

SEQ ID NO: 8739 - DNA, 22 bp, Homo sapiens
tctagttagttgaaatcagtgt

SEQ ID NO: 8740 - DNA, 23 bp, Homo sapiens
gcttctggggcccaggaagcccc

SEQ ID NO: 8741 - DNA, 21 bp, Homo sapiens
aaaaatgcaggggttgcatat

SEQ ID NO: 8742 - DNA, 22 bp, Homo sapiens
tccaaactgggatgtactgaca

SEQ ID NO: 8743 - DNA, 21 bp, Homo sapiens
tgtgatgccacgtgaacgcag

SEQ ID NO: 8744 - DNA, 20 bp, Homo sapiens
tgagatgaagcactgtgttg

SEQ ID NO: 8745 - DNA, 22 bp, Homo sapiens
gtccagtttttccaggaagagg

SEQ ID NO: 8746 - DNA, 22 bp, Homo sapiens
ttggactccgggattaggtgct

SEQ ID NO: 8747 - DNA, 21 bp, Homo sapiens
gtccagccccttcaggaatca

SEQ ID NO: 8748 - DNA, 20 bp, Homo sapiens
gtgacgacattgccctgcag

SEQ ID NO: 8749 - DNA, 20 bp, Homo sapiens
cccccggcatctctgttttc

SEQ ID NO: 8750 - DNA, 21 bp, Homo sapiens
agaggtagtactggtataagt

SEQ ID NO: 8751 - DNA, 20 bp, Homo sapiens
gccacttgaccagtatagca

SEQ ID NO: 8752 - DNA, 22 bp, Homo sapiens
gtcttgctgctgttgttgttgt

SEQ ID NO: 8753 - DNA, 21 bp, Homo sapiens
caactccaaataaaacatggt

SEQ ID NO: 8754 - DNA, 20 bp, Homo sapiens
ccttcacaccatgtacccag

SEQ ID NO: 8755 - DNA, 21 bp, Homo sapiens
ttgtagagattacagtgacca

SEQ ID NO: 8756 - DNA, 20 bp, Homo sapiens
gcaaggtgctgtgctgttga

SEQ ID NO: 8757 - DNA, 21 bp, Homo sapiens
ctgacctatgggccaggggct

SEQ ID NO: 8758 - DNA, 22 bp, Homo sapiens
taggatatcagacactaaaact

SEQ ID NO: 8759 - DNA, 21 bp, Homo sapiens
ttccagttttcccaggaaaga

SEQ ID NO: 8760 - DNA, 21 bp, Homo sapiens
acagcaggcacagacaagatt

SEQ ID NO: 8761 - DNA, 22 bp, Homo sapiens
cacacctgttgtgtcttaattg

SEQ ID NO: 8762 - DNA, 23 bp, Homo sapiens
actgaacttcctgggcagcactc

SEQ ID NO: 8763 - DNA, 23 bp, Homo sapiens
tagcttataatcagctacaatct

SEQ ID NO: 8764 - DNA, 22 bp, Homo sapiens
tagcaccatagtccatatgcag

SEQ ID NO: 8765 - DNA, 21 bp, Homo sapiens
gggaaggccacattcctttac

SEQ ID NO: 8766 - DNA, 21 bp, Homo sapiens
cttacctatgaatgtcactta

SEQ ID NO: 8767 - DNA, 20 bp, Homo sapiens
atcccacatagtaacaaggg

SEQ ID NO: 8768 - DNA, 20 bp, Homo sapiens
ctgcgctggagtcttgtgtg

SEQ ID NO: 8769 - DNA, 20 bp, Homo sapiens
gaaggcatgctcttgttgcc

SEQ ID NO: 8770 - DNA, 20 bp, Homo sapiens
aaagctgggttgagagagga

SEQ ID NO: 8771 - DNA, 21 bp, Homo sapiens
ggacaactggagtgtatggtg

SEQ ID NO: 8772 - DNA, 20 bp, Homo sapiens
gcccgtggacaacacaccat

SEQ ID NO: 8773 - DNA, 23 bp, Homo sapiens
tgcaagcgcttacagtgaggtct

SEQ ID NO: 8774 - DNA, 22 bp, Homo sapiens
tagaaactaaagacatggtcac

SEQ ID NO: 8775 - DNA, 21 bp, Homo sapiens
cctaggcgagagccataacac

SEQ ID NO: 8776 - DNA, 21 bp, Homo sapiens
agctcgagtctgtgatctctg

SEQ ID NO: 8777 - DNA, 22 bp, Homo sapiens
acgaggttaatgcactagtcct

SEQ ID NO: 8778 - DNA, 20 bp, Homo sapiens
gggctgaagggtatacatgg

SEQ ID NO: 8779 - DNA, 22 bp, Homo sapiens
tgtcagtttgagaagcacccca

SEQ ID NO: 8780 - DNA, 22 bp, Homo sapiens
gcgccccaccccgcgcgcccga

SEQ ID NO: 8781 - DNA, 20 bp, Homo sapiens
taggatgctataggagccca

SEQ ID NO: 8782 - DNA, 22 bp, Homo sapiens
gggaggttgaaggtgcaactca

SEQ ID NO: 8783 - DNA, 22 bp, Homo sapiens
tagaaactgaaggtatggtcat

SEQ ID NO: 8784 - DNA, 21 bp, Homo sapiens
gcagtctcaagtatagatctg

SEQ ID NO: 8785 - DNA, 20 bp, Homo sapiens
atagccgacacgtggtggtg

SEQ ID NO: 8786 - DNA, 21 bp, Homo sapiens
gggaatgatgatttcacaggc

SEQ ID NO: 8787 - DNA, 22 bp, Homo sapiens
aggagtctcaaatccaggtgtc

SEQ ID NO: 8788 - DNA, 22 bp, Homo sapiens
gtccacaaaacccaggaaacac

SEQ ID NO: 8789 - DNA, 22 bp, Homo sapiens
agctctgaacacaccgcagggt

SEQ ID NO: 8790 - DNA, 21 bp, Homo sapiens
acaggccagtaaggaaatgtt

SEQ ID NO: 8791 - DNA, 21 bp, Homo sapiens
caggaactaatgacagcaggg

SEQ ID NO: 8792 - DNA, 20 bp, Homo sapiens
cgcgcgggtcggggcggagc

SEQ ID NO: 8793 - DNA, 20 bp, Homo sapiens
ggggctgggcctatccacga

SEQ ID NO: 8794 - DNA, 20 bp, Homo sapiens
gacctagatgctggctagct

SEQ ID NO: 8795 - DNA, 22 bp, Homo sapiens
tcagtagaagtcaaatccctca

SEQ ID NO: 8796 - DNA, 20 bp, Homo sapiens
atggggggccggttgcacaa

SEQ ID NO: 8797 - DNA, 21 bp, Homo sapiens
agggaacattactgagctgtt

SEQ ID NO: 8798 - DNA, 23 bp, Homo sapiens
tgcatgggctcatgcaaagtcaa

SEQ ID NO: 8799 - DNA, 22 bp, Homo sapiens
tctataaacggcatctccaccc

SEQ ID NO: 8800 - DNA, 22 bp, Homo sapiens
tcgactgggcatggggcaccca

SEQ ID NO: 8801 - DNA, 21 bp, Homo sapiens
gcccctctagaggagcctaca

SEQ ID NO: 8802 - DNA, 23 bp, Homo sapiens
tggcatggggttcggctgtgtct

SEQ ID NO: 8803 - DNA, 20 bp, Homo sapiens
atgcggaccaggggaatggc

SEQ ID NO: 8804 - DNA, 22 bp, Homo sapiens
acactttgtttttgtaggtgtt

SEQ ID NO: 8805 - DNA, 22 bp, Homo sapiens
tctccaagtaccaccacgctaa

SEQ ID NO: 8806 - DNA, 20 bp, Homo sapiens
ctgcatggattggatggagg

SEQ ID NO: 8807 - DNA, 20 bp, Homo sapiens
taaagtgcacaatacgcatc

SEQ ID NO: 8808 - DNA, 22 bp, Homo sapiens
cttttgaccagacttgggcccg

SEQ ID NO: 8809 - DNA, 20 bp, Homo sapiens
ctctgcaggtagagcaaatg

SEQ ID NO: 8810 - DNA, 21 bp, Homo sapiens
agcagctgttagcagtgacgg

SEQ ID NO: 8811 - DNA, 22 bp, Homo sapiens
tagcctgcatccagtgcagacc

SEQ ID NO: 8812 - DNA, 23 bp, Homo sapiens
caaagtgctgctgacataagtct

SEQ ID NO: 8813 - DNA, 20 bp, Homo sapiens
aggatggataagagccaatc

SEQ ID NO: 8814 - DNA, 20 bp, Homo sapiens
ataacccacaaacgaaccca

SEQ ID NO: 8815 - DNA, 23 bp, Homo sapiens
aacgatgtcagagagattccatc

SEQ ID NO: 8816 - DNA, 21 bp, Homo sapiens
cctcagtgcgccccgggcggg

SEQ ID NO: 8817 - DNA, 23 bp, Homo sapiens
tcacgttattcatgcaaagctga

SEQ ID NO: 8818 - DNA, 22 bp, Homo sapiens
tggaccccgcccaaaagcagct

SEQ ID NO: 8819 - DNA, 23 bp, Homo sapiens
cagaagtttgctgggcgtggtgg

SEQ ID NO: 8820 - DNA, 22 bp, Homo sapiens
tagctttacaggtgtcaaccag

SEQ ID NO: 8821 - DNA, 22 bp, Homo sapiens
ctagcaatgctcaggcggcatc

SEQ ID NO: 8822 - DNA, 21 bp, Homo sapiens
gatctcaaccaggtgcaagac

SEQ ID NO: 8823 - DNA, 22 bp, Homo sapiens
agtcaggggcagtttatggggt

SEQ ID NO: 8824 - DNA, 22 bp, Homo sapiens
cccggggcatggcctgtctgat

SEQ ID NO: 8825 - DNA, 23 bp, Homo sapiens
tagcacaggttgattagtctggg

SEQ ID NO: 8826 - DNA, 20 bp, Homo sapiens
acatcaccccataggtgcct

SEQ ID NO: 8827 - DNA, 22 bp, Homo sapiens
ttgcttatcagagcaggagtag

SEQ ID NO: 8828 - DNA, 20 bp, Homo sapiens
cttgggtacaactttatcag

SEQ ID NO: 8829 - DNA, 20 bp, Homo sapiens
ggagagccggccgagtggca

SEQ ID NO: 8830 - DNA, 20 bp, Homo sapiens
cctcccccgtctccgcccac

SEQ ID NO: 8831 - DNA, 22 bp, Homo sapiens
tagtcattgccagggatggagt

SEQ ID NO: 8832 - DNA, 20 bp, Homo sapiens
tagcttatgtctgtgactca

SEQ ID NO: 8833 - DNA, 21 bp, Homo sapiens
tccgagtcacggcaccaaagt

SEQ ID NO: 8834 - DNA, 22 bp, Homo sapiens
tgtatctgcatgtgtatccaca

SEQ ID NO: 8835 - DNA, 20 bp, Homo sapiens
tcaacggcacctccaccaag

SEQ ID NO: 8836 - DNA, 20 bp, Homo sapiens
aggtatttcatagggatgtt

SEQ ID NO: 8837 - DNA, 22 bp, Homo sapiens
gtccaggggaggcaggaatcct

SEQ ID NO: 8838 - DNA, 22 bp, Homo sapiens
ctaggcaaacagtttatggcta

SEQ ID NO: 8839 - DNA, 22 bp, Homo sapiens
agtcacctgccagggatttcca

SEQ ID NO: 8840 - DNA, 22 bp, Homo sapiens
cctggacggcttgggatagggt

SEQ ID NO: 8841 - DNA, 21 bp, Homo sapiens
tgttagagttctgatggcatc

SEQ ID NO: 8842 - DNA, 22 bp, Homo sapiens
cctgatgccaccccaaaggtgc

SEQ ID NO: 8843 - DNA, 20 bp, Homo sapiens
gaggacgcgagccgagccct

SEQ ID NO: 8844 - DNA, 22 bp, Homo sapiens
tgtcatgggtgacctaacccca

SEQ ID NO: 8845 - DNA, 22 bp, Homo sapiens
cccatgggcacctagcggggtt

SEQ ID NO: 8846 - DNA, 20 bp, Homo sapiens
accccaccgctgccacccgc

SEQ ID NO: 8847 - DNA, 23 bp, Homo sapiens
taccttagactctcagctggtcc

SEQ ID NO: 8848 - DNA, 20 bp, Homo sapiens
tgagatgaaatgtcagctgt

SEQ ID NO: 8849 - DNA, 22 bp, Homo sapiens
tgtcagttttgaaaatattggt

SEQ ID NO: 8850 - DNA, 20 bp, Homo sapiens
cccctccacgcgccccgcgc

SEQ ID NO: 8851 - DNA, 23 bp, Homo sapiens
cgtcagtttgtcaacgcatttcc

SEQ ID NO: 8852 - DNA, 23 bp, Homo sapiens
cgtcagtgatgagcctgagactg

SEQ ID NO: 8853 - DNA, 20 bp, Homo sapiens
gctactacaacctgacacgc

SEQ ID NO: 8854 - DNA, 22 bp, Homo sapiens
gctgtggtgccagaagcctcca

SEQ ID NO: 8855 - DNA, 22 bp, Homo sapiens
tgagtcaggcaaccagcaaaac

SEQ ID NO: 8856 - DNA, 22 bp, Homo sapiens
tgggactctgggaggctgtcac

SEQ ID NO: 8857 - DNA, 21 bp, Homo sapiens
tctaatgatggtcttgacaag

SEQ ID NO: 8858 - DNA, 22 bp, Homo sapiens
ggctcacaaatctgatggataa

SEQ ID NO: 8859 - DNA, 22 bp, Homo sapiens
gcccctgggcctcgaagctccc

SEQ ID NO: 8860 - DNA, 20 bp, Homo sapiens
agtaacagcaactccgggac

SEQ ID NO: 8861 - DNA, 21 bp, Homo sapiens
cccaatggcaagccgtcatct

SEQ ID NO: 8862 - DNA, 23 bp, Homo sapiens
ccctcctctcctgtggccacaga

SEQ ID NO: 8863 - DNA, 22 bp, Homo sapiens
cttgcctgcttgtaaagcagct

SEQ ID NO: 8864 - DNA, 21 bp, Homo sapiens
actggacttggagtcagaatc

SEQ ID NO: 8865 - DNA, 22 bp, Homo sapiens
tggcgttgccgtcatagccagc

SEQ ID NO: 8866 - DNA, 22 bp, Homo sapiens
cccccgtgatgagaaactgagg

SEQ ID NO: 8867 - DNA, 21 bp, Homo sapiens
ctatgagatgctggccatcga

SEQ ID NO: 8868 - DNA, 20 bp, Homo sapiens
gccacttgtggagtatagca

SEQ ID NO: 8869 - DNA, 22 bp, Homo sapiens
aaacatgacaccggttccatgc

SEQ ID NO: 8870 - DNA, 20 bp, Homo sapiens
cgaggatggcggagcggggt

SEQ ID NO: 8871 - DNA, 23 bp, Homo sapiens
tctcttatcagactgagtcactg

SEQ ID NO: 8872 - DNA, 22 bp, Homo sapiens
aaacctttaccaaatgcagacc

SEQ ID NO: 8873 - DNA, 23 bp, Homo sapiens
tctcagtaatggtacgcaggcat

SEQ ID NO: 8874 - DNA, 22 bp, Homo sapiens
tgctgactggtacccgcaaaag

SEQ ID NO: 8875 - DNA, 23 bp, Homo sapiens
gagggctctggtggccgggcaga

SEQ ID NO: 8876 - DNA, 22 bp, Homo sapiens
ctgacctgctcattgatagcca

SEQ ID NO: 8877 - DNA, 23 bp, Homo sapiens
tggctcagttcagcatttgttga

SEQ ID NO: 8878 - DNA, 23 bp, Homo sapiens
cgcacccagctgacaactgtgaa

SEQ ID NO: 8879 - DNA, 20 bp, Homo sapiens
tagaggcgaagcagagcacc

SEQ ID NO: 8880 - DNA, 21 bp, Homo sapiens
gctaggagctcacagtctagt

SEQ ID NO: 8881 - DNA, 22 bp, Homo sapiens
agcatagatcaacaaagcagct

SEQ ID NO: 8882 - DNA, 20 bp, Homo sapiens
cgccgccgtccccaagcggc

SEQ ID NO: 8883 - DNA, 22 bp, Homo sapiens
actctagagtgctaatttgcta

SEQ ID NO: 8884 - DNA, 20 bp, Homo sapiens
agttttctgattagcttggt

SEQ ID NO: 8885 - DNA, 21 bp, Homo sapiens
ctgtctcgcaggccagtagtt

SEQ ID NO: 8886 - DNA, 22 bp, Homo sapiens
atttgtaagccagggattgtgg

SEQ ID NO: 8887 - DNA, 22 bp, Homo sapiens
ggctccaccttcctaggttggc

SEQ ID NO: 8888 - DNA, 22 bp, Homo sapiens
aagctcgctctcacagcaaact

SEQ ID NO: 8889 - DNA, 24 bp, Homo sapiens
tttgctgctctataagtaaggtgt

SEQ ID NO: 8890 - DNA, 20 bp, Homo sapiens
tccaatgcatctctgttgta

SEQ ID NO: 8891 - DNA, 22 bp, Homo sapiens
tcccttcctggggccagtgtga

SEQ ID NO: 8892 - DNA, 22 bp, Homo sapiens
atgatgtgttgttgccatccat

SEQ ID NO: 8893 - DNA, 22 bp, Homo sapiens
agcagcactgtgagattgagag

SEQ ID NO: 8894 - DNA, 22 bp, Homo sapiens
caaaaggcctcttaaaacctag

SEQ ID NO: 8895 - DNA, 20 bp, Homo sapiens
taaaggcatcacgctgtgga

SEQ ID NO: 8896 - DNA, 21 bp, Homo sapiens
ctgcagcacctgcagccgtcg

SEQ ID NO: 8897 - DNA, 22 bp, Homo sapiens
agcctatgatgccgtcctgaga

SEQ ID NO: 8898 - DNA, 21 bp, Homo sapiens
ctgtgctgctcagatcagacc

SEQ ID NO: 8899 - DNA, 22 bp, Homo sapiens
aggctgagacaagctgatcact

SEQ ID NO: 8900 - DNA, 20 bp, Homo sapiens
cctgagaatcgccacaggtg

SEQ ID NO: 8901 - DNA, 21 bp, Homo sapiens
gctggagtgcagtaacgcgac

SEQ ID NO: 8902 - DNA, 22 bp, Homo sapiens
ttgcttatgtcacacggtggct

SEQ ID NO: 8903 - DNA, 23 bp, Homo sapiens
ctgagtgtcccgcggtgcccgcc

SEQ ID NO: 8904 - DNA, 21 bp, Homo sapiens
aagcggctgtgcaaactgtgg

SEQ ID NO: 8905 - DNA, 22 bp, Homo sapiens
aaagatctctgctacaggtggc

SEQ ID NO: 8906 - DNA, 24 bp, Homo sapiens
tgagctgggattagaccacaggtc

SEQ ID NO: 8907 - DNA, 22 bp, Homo sapiens
taggactttggctgcataatgt

SEQ ID NO: 8908 - DNA, 21 bp, Homo sapiens
acactctgatgagacctgaga

SEQ ID NO: 8909 - DNA, 20 bp, Homo sapiens
aataagtgggaggcctttct

SEQ ID NO: 8910 - DNA, 21 bp, Homo sapiens
atgcaagatgctggcaagctg

SEQ ID NO: 8911 - DNA, 20 bp, Homo sapiens
cactctagtctggcatgatc

SEQ ID NO: 8912 - DNA, 22 bp, Homo sapiens
agcagcccactggctcaaatgg

SEQ ID NO: 8913 - DNA, 22 bp, Homo sapiens
aggcaagatgctggcagataga

SEQ ID NO: 8914 - DNA, 22 bp, Homo sapiens
tccttgagaccctacagctgag

SEQ ID NO: 8915 - DNA, 20 bp, Homo sapiens
tgagatgaagcactagaggc

SEQ ID NO: 8916 - DNA, 20 bp, Homo sapiens
tgattggtctgagtggtatc

SEQ ID NO: 8917 - DNA, 21 bp, Homo sapiens
cagcccggagcccggacccca

SEQ ID NO: 8918 - DNA, 23 bp, Homo sapiens
tatatatatatatgtatacgcat

SEQ ID NO: 8919 - DNA, 23 bp, Homo sapiens
atactctgatatactgtcttata

SEQ ID NO: 8920 - DNA, 21 bp, Homo sapiens
cttccttctgagaacaacact

SEQ ID NO: 8921 - DNA, 21 bp, Homo sapiens
cagagcagctactcaggatct

SEQ ID NO: 8922 - DNA, 22 bp, Homo sapiens
tggtgacccaggtttatggggc

SEQ ID NO: 8923 - DNA, 22 bp, Homo sapiens
tgatgatggtgacgtacaattg

SEQ ID NO: 8924 - DNA, 22 bp, Homo sapiens
tgctgctgctgctgattggtta

SEQ ID NO: 8925 - DNA, 20 bp, Homo sapiens
ttcaagtaatccagctgcct

SEQ ID NO: 8926 - DNA, 22 bp, Homo sapiens
cctggcccttagaaagcagatg

SEQ ID NO: 8927 - DNA, 22 bp, Homo sapiens
ctgcaatgtctgccattccctg

SEQ ID NO: 8928 - DNA, 22 bp, Homo sapiens
cgtcagatcactgggcgtggtg

SEQ ID NO: 8929 - DNA, 22 bp, Homo sapiens
ttcactgccttcagagggaacc

SEQ ID NO: 8930 - DNA, 22 bp, Homo sapiens
cggtgttgcccagggctgagcc

SEQ ID NO: 8931 - DNA, 21 bp, Homo sapiens
tagcaatggcctgcaccccag

SEQ ID NO: 8932 - DNA, 21 bp, Homo sapiens
cagctccgtctctgggcacca

SEQ ID NO: 8933 - DNA, 23 bp, Homo sapiens
cgggacatctaggctggggtgtc

SEQ ID NO: 8934 - DNA, 20 bp, Homo sapiens
tcccaggtcctaatgtttca

SEQ ID NO: 8935 - DNA, 23 bp, Homo sapiens
tagcagcaaactgggctggggaa

SEQ ID NO: 8936 - DNA, 23 bp, Homo sapiens
gcccaggtcacagggccaaggag

SEQ ID NO: 8937 - DNA, 20 bp, Homo sapiens
gcgaccactgcgccatccag

SEQ ID NO: 8938 - DNA, 21 bp, Homo sapiens
cctggatacttaactgtaact

SEQ ID NO: 8939 - DNA, 21 bp, Homo sapiens
gctacacattcgaggctaacc

SEQ ID NO: 8940 - DNA, 22 bp, Homo sapiens
tgagtcaccgcactttacccca

SEQ ID NO: 8941 - DNA, 23 bp, Homo sapiens
cccgcgccagggcgcacacgctc

SEQ ID NO: 8942 - DNA, 23 bp, Homo sapiens
ccaaatgctgctgaggtacacag

SEQ ID NO: 8943 - DNA, 23 bp, Homo sapiens
ggcagcaaacatgggccaaaacg

SEQ ID NO: 8944 - DNA, 21 bp, Homo sapiens
ctcaggatatccggtgactag

SEQ ID NO: 8945 - DNA, 20 bp, Homo sapiens
catccagtccattgtacatg

SEQ ID NO: 8946 - DNA, 22 bp, Homo sapiens
cccaagtctactaaaattctgg

SEQ ID NO: 8947 - DNA, 23 bp, Homo sapiens
tatgaagctgacacagcagctca

SEQ ID NO: 8948 - DNA, 20 bp, Homo sapiens
ggttccagctgtgctgtcag

SEQ ID NO: 8949 - DNA, 20 bp, Homo sapiens
cggcggcgggagaagacgcc

SEQ ID NO: 8950 - DNA, 22 bp, Homo sapiens
gagctgcgagagcctgcgctgg

SEQ ID NO: 8951 - DNA, 24 bp, Homo sapiens
agtgggtgatgtttgctgacactc

SEQ ID NO: 8952 - DNA, 21 bp, Homo sapiens
ctaataatgagggtcctgcgc

SEQ ID NO: 8953 - DNA, 22 bp, Homo sapiens
gcgcccaccccccgccccccgc

SEQ ID NO: 8954 - DNA, 23 bp, Homo sapiens
tgcactgggtcccaggaatccct

SEQ ID NO: 8955 - DNA, 20 bp, Homo sapiens
tgcacagtggctaagggaca

SEQ ID NO: 8956 - DNA, 20 bp, Homo sapiens
accaacggaatccagactcc

SEQ ID NO: 8957 - DNA, 22 bp, Homo sapiens
gccaactgtctggtaacagcac

SEQ ID NO: 8958 - DNA, 20 bp, Homo sapiens
caggccagctcccacaccgt

SEQ ID NO: 8959 - DNA, 21 bp, Homo sapiens
ggcttgctgctgggtgttggc

SEQ ID NO: 8960 - DNA, 22 bp, Homo sapiens
tgttcagggacacatgggtggt

SEQ ID NO: 8961 - DNA, 23 bp, Homo sapiens
tagaggcccagaccagcaagctg

SEQ ID NO: 8962 - DNA, 20 bp, Homo sapiens
cccgctgtaccagtatagca

SEQ ID NO: 8963 - DNA, 21 bp, Homo sapiens
ctttcttctgccagcttgaaa

SEQ ID NO: 8964 - DNA, 21 bp, Homo sapiens
ctgacagcggaatgtcactga

SEQ ID NO: 8965 - DNA, 22 bp, Homo sapiens
tgagtgctgcttggtgtgtcac

SEQ ID NO: 8966 - DNA, 21 bp, Homo sapiens
tagagcaggatgtcagcaaac

SEQ ID NO: 8967 - DNA, 22 bp, Homo sapiens
ctactgggtgaccatagcttcc

SEQ ID NO: 8968 - DNA, 22 bp, Homo sapiens
ccacccatcgagattggatatg

SEQ ID NO: 8969 - DNA, 23 bp, Homo sapiens
tgagggctgctgggtgcacctct

SEQ ID NO: 8970 - DNA, 20 bp, Homo sapiens
cgtctcctcgtggggacacg

SEQ ID NO: 8971 - DNA, 22 bp, Homo sapiens
atgactggtgtctttatggaac

SEQ ID NO: 8972 - DNA, 22 bp, Homo sapiens
tgtcagttgtctggtatccacc

SEQ ID NO: 8973 - DNA, 21 bp, Homo sapiens
gtgggggcgggttcaggagga

SEQ ID NO: 8974 - DNA, 22 bp, Homo sapiens
ggcagtaggttgtatagttatc

SEQ ID NO: 8975 - DNA, 21 bp, Homo sapiens
tgactccatctgattagcacc

SEQ ID NO: 8976 - DNA, 20 bp, Homo sapiens
atcccggacgagcccccaga

SEQ ID NO: 8977 - DNA, 22 bp, Homo sapiens
cgatactgctcaggggatgaca

SEQ ID NO: 8978 - DNA, 23 bp, Homo sapiens
gcttctgggtcccaggaatgcca

SEQ ID NO: 8979 - DNA, 22 bp, Homo sapiens
cgtggccggcggcggccgcgcg

SEQ ID NO: 8980 - DNA, 20 bp, Homo sapiens
cgatcgccaggactgcgttt

SEQ ID NO: 8981 - DNA, 20 bp, Homo sapiens
ttcccgcattctccaccagc

SEQ ID NO: 8982 - DNA, 21 bp, Homo sapiens
cctgttgttgcttctctcttc

SEQ ID NO: 8983 - DNA, 20 bp, Homo sapiens
gccagccctgctccctacag

SEQ ID NO: 8984 - DNA, 22 bp, Homo sapiens
ttctcacatctatacatgtggc

SEQ ID NO: 8985 - DNA, 23 bp, Homo sapiens
gtctctgtttcctgaaggctttc

SEQ ID NO: 8986 - DNA, 20 bp, Homo sapiens
cagaacggagctaatatttc

SEQ ID NO: 8987 - DNA, 20 bp, Homo sapiens
acgtgagctggttttagatc

SEQ ID NO: 8988 - DNA, 21 bp, Homo sapiens
tgaaatgaagctattttggct

SEQ ID NO: 8989 - DNA, 23 bp, Homo sapiens
ggggctgatagtcacttccactg

SEQ ID NO: 8990 - DNA, 24 bp, Homo sapiens
ggggccacagctcagctgtgctct

SEQ ID NO: 8991 - DNA, 20 bp, Homo sapiens
ccatattctgctccctacaa

SEQ ID NO: 8992 - DNA, 22 bp, Homo sapiens
tgaactggggaccaggagaccc

SEQ ID NO: 8993 - DNA, 20 bp, Homo sapiens
cctcccccctccccggggaa

SEQ ID NO: 8994 - DNA, 21 bp, Homo sapiens
gggtggggtccgcgcaggccg

SEQ ID NO: 8995 - DNA, 22 bp, Homo sapiens
tggtaacccactgggcgttttc

SEQ ID NO: 8996 - DNA, 21 bp, Homo sapiens
ccccccactgctccggctgtc

SEQ ID NO: 8997 - DNA, 24 bp, Homo sapiens
ccccgggccccagcgcggcaggcc

SEQ ID NO: 8998 - DNA, 22 bp, Homo sapiens
tagaccccgtcttgccctgcag

SEQ ID NO: 8999 - DNA, 24 bp, Homo sapiens
ccgcgcctgtccctttattttttt

SEQ ID NO: 9000 - DNA, 20 bp, Homo sapiens
tctcctcgtgggggcctggg

SEQ ID NO: 9001 - DNA, 20 bp, Homo sapiens
ctgcttctgctactggagcc

SEQ ID NO: 9002 - DNA, 21 bp, Homo sapiens
ggaaggcggctgtgcaccccc

SEQ ID NO: 9003 - DNA, 23 bp, Homo sapiens
tagctgtatgcactgtacttgtt

SEQ ID NO: 9004 - DNA, 23 bp, Homo sapiens
cccggggccagcgccgtggtcgt

SEQ ID NO: 9005 - DNA, 20 bp, Homo sapiens
cggctgtaccatcccaggcg

SEQ ID NO: 9006 - DNA, 20 bp, Homo sapiens
cgtgatgcggaggcgactag

SEQ ID NO: 9007 - DNA, 20 bp, Homo sapiens
tagctgcgactcctgacgtg

SEQ ID NO: 9008 - DNA, 22 bp, Homo sapiens
tctcccaacccttgcgccacag

SEQ ID NO: 9009 - DNA, 23 bp, Homo sapiens
tcgagagggtggtggcgttttgg

SEQ ID NO: 9010 - DNA, 20 bp, Homo sapiens
gcatgatataggggaaaagt

SEQ ID NO: 9011 - DNA, 20 bp, Homo sapiens
atcccaccgctcggtgtgta

SEQ ID NO: 9012 - DNA, 22 bp, Homo sapiens
gactgtggccagggaaaaagaa

SEQ ID NO: 9013 - DNA, 22 bp, Homo sapiens
tctctgctctcaggcaggtgtc

SEQ ID NO: 9014 - DNA, 22 bp, Homo sapiens
tctcaaccacctgggctcaaac

SEQ ID NO: 9015 - DNA, 22 bp, Homo sapiens
gagaacacatggttgcatagtg

SEQ ID NO: 9016 - DNA, 21 bp, Homo sapiens
ttccagttttcccagattagg

SEQ ID NO: 9017 - DNA, 23 bp, Homo sapiens
ttcatttcctcttcttatgaggt

SEQ ID NO: 9018 - DNA, 23 bp, Homo sapiens
tagcggcctctccagatgggctg

SEQ ID NO: 9019 - DNA, 23 bp, Homo sapiens
tgtcagtttgtcaaatattaata

SEQ ID NO: 9020 - DNA, 21 bp, Homo sapiens
cttctatggtagccacctggg

SEQ ID NO: 9021 - DNA, 23 bp, Homo sapiens
gtccagtttcttggaaggctatt

SEQ ID NO: 9022 - DNA, 20 bp, Homo sapiens
gatcacaggctaggtagctt

SEQ ID NO: 9023 - DNA, 23 bp, Homo sapiens
cccaacaggactcagcaagtaaa

SEQ ID NO: 9024 - DNA, 22 bp, Homo sapiens
atacatactttgaaatattcac

SEQ ID NO: 9025 - DNA, 20 bp, Homo sapiens
gacatcagaggctactgttg

SEQ ID NO: 9026 - DNA, 22 bp, Homo sapiens
agcaaacggcttgagatagtag

SEQ ID NO: 9027 - DNA, 22 bp, Homo sapiens
ttctgaaatagacccgcaggga

SEQ ID NO: 9028 - DNA, 22 bp, Homo sapiens
ttatttggtggaacatggttgt

SEQ ID NO: 9029 - DNA, 22 bp, Homo sapiens
agctatgccagctgcaggtgct

SEQ ID NO: 9030 - DNA, 21 bp, Homo sapiens
gatatttgagatgaaagatac

SEQ ID NO: 9031 - DNA, 20 bp, Homo sapiens
caaagcataacagcataaga

SEQ ID NO: 9032 - DNA, 22 bp, Homo sapiens
tagcaagtgttacgttggtaca

SEQ ID NO: 9033 - DNA, 22 bp, Homo sapiens
tcaatggctgctgccgccaccc

SEQ ID NO: 9034 - DNA, 22 bp, Homo sapiens
gagcttatcaagctgtacaaaa

SEQ ID NO: 9035 - DNA, 20 bp, Homo sapiens
gcatgtacaccgcatgcctt

SEQ ID NO: 9036 - DNA, 22 bp, Homo sapiens
aggtatggcttgcatggagacc

SEQ ID NO: 9037 - DNA, 24 bp, Homo sapiens
tacatcagaggcgcggggcctcca

SEQ ID NO: 9038 - DNA, 22 bp, Homo sapiens
acagcaggcacagacaggccag

SEQ ID NO: 9039 - DNA, 20 bp, Homo sapiens
ccccggccccgcgtcctccg

SEQ ID NO: 9040 - DNA, 20 bp, Homo sapiens
aaacctgccggggcttcgtg

SEQ ID NO: 9041 - DNA, 22 bp, Homo sapiens
agcagcaatgttgtcctaggtg

SEQ ID NO: 9042 - DNA, 22 bp, Homo sapiens
attgcatcaggagggatttcca

SEQ ID NO: 9043 - DNA, 22 bp, Homo sapiens
ttcactgccgagtcaggctgat

SEQ ID NO: 9044 - DNA, 22 bp, Homo sapiens
atcatattgccagggattcttg

SEQ ID NO: 9045 - DNA, 22 bp, Homo sapiens
aaattatgttttatggtgatga

SEQ ID NO: 9046 - DNA, 22 bp, Homo sapiens
tccctgggaccctagtccagtt

SEQ ID NO: 9047 - DNA, 20 bp, Homo sapiens
gcattggtgacctgacatgg

SEQ ID NO: 9048 - DNA, 20 bp, Homo sapiens
gacctgagacaagctgaaca

SEQ ID NO: 9049 - DNA, 22 bp, Homo sapiens
ccagtcaacaagtgaggggatg

SEQ ID NO: 9050 - DNA, 23 bp, Homo sapiens
tgctggcttgagtttatgtttgg

SEQ ID NO: 9051 - DNA, 21 bp, Homo sapiens
agatgttgctcagaatattgg

SEQ ID NO: 9052 - DNA, 20 bp, Homo sapiens
gaagtccatgggcataacaa

SEQ ID NO: 9053 - DNA, 21 bp, Homo sapiens
tgcagcatatgccatatcata

SEQ ID NO: 9054 - DNA, 23 bp, Homo sapiens
atgatgcgagaggatcatttgag

SEQ ID NO: 9055 - DNA, 22 bp, Homo sapiens
gcacttactgtgatgtctgaag

SEQ ID NO: 9056 - DNA, 22 bp, Homo sapiens
gtcttggcatccaacatatctg

SEQ ID NO: 9057 - DNA, 20 bp, Homo sapiens
actgtgccattgaactacag

SEQ ID NO: 9058 - DNA, 21 bp, Homo sapiens
aggctgagcactggcaggtat

SEQ ID NO: 9059 - DNA, 23 bp, Homo sapiens
tggctcagctcagaagaggtgac

SEQ ID NO: 9060 - DNA, 20 bp, Homo sapiens
ggatctattgaatcagtcag

SEQ ID NO: 9061 - DNA, 22 bp, Homo sapiens
tagctcatcaggatgatccagt

SEQ ID NO: 9062 - DNA, 20 bp, Homo sapiens
aatggcaatggcaatggtaa

SEQ ID NO: 9063 - DNA, 22 bp, Homo sapiens
gagtggtgacaattttccatgc

SEQ ID NO: 9064 - DNA, 24 bp, Homo sapiens
agaaggttaatttgctaagtttct

SEQ ID NO: 9065 - DNA, 20 bp, Homo sapiens
agccgtaaggcggctgtttt

SEQ ID NO: 9066 - DNA, 23 bp, Homo sapiens
ggccgggagcggcgggggcggcg

SEQ ID NO: 9067 - DNA, 20 bp, Homo sapiens
ctgagggggacaaaaaaaag

SEQ ID NO: 9068 - DNA, 20 bp, Homo sapiens
cgcgcttgtggctgccgatg

SEQ ID NO: 9069 - DNA, 21 bp, Homo sapiens
ggtggggtcggcgggggacat

SEQ ID NO: 9070 - DNA, 22 bp, Homo sapiens
ctggtgatgctgctggtgtgga

SEQ ID NO: 9071 - DNA, 20 bp, Homo sapiens
cagcaggtctccagaactcg

SEQ ID NO: 9072 - DNA, 20 bp, Homo sapiens
gaaaatcttgaccacgccta

SEQ ID NO: 9073 - DNA, 20 bp, Homo sapiens
ctgacagcgtctaatacagc

SEQ ID NO: 9074 - DNA, 22 bp, Homo sapiens
actcagtttgtctttatcccca

SEQ ID NO: 9075 - DNA, 20 bp, Homo sapiens
gcaaggtgccgtcactaccg

SEQ ID NO: 9076 - DNA, 20 bp, Homo sapiens
agcatgctgagatagcctca

SEQ ID NO: 9077 - DNA, 23 bp, Homo sapiens
tgacctatgataaagtgactgag

SEQ ID NO: 9078 - DNA, 21 bp, Homo sapiens
cggctcagttcagcagagctg

SEQ ID NO: 9079 - DNA, 20 bp, Homo sapiens
gctagttgttggactggaag

SEQ ID NO: 9080 - DNA, 20 bp, Homo sapiens
gcattggtggttcatggcag

SEQ ID NO: 9081 - DNA, 21 bp, Homo sapiens
cgtggtgggcccagctaggag

SEQ ID NO: 9082 - DNA, 23 bp, Homo sapiens
tgtgcaaaaaacgtactttcttc

SEQ ID NO: 9083 - DNA, 22 bp, Homo sapiens
gagaggagctcactcagaaggc

SEQ ID NO: 9084 - DNA, 23 bp, Homo sapiens
gtctgacaaatttgaaggctttg

SEQ ID NO: 9085 - DNA, 22 bp, Homo sapiens
cagacatcatgtttgtacagtt

SEQ ID NO: 9086 - DNA, 20 bp, Homo sapiens
tcagtagtctgcacagggga

SEQ ID NO: 9087 - DNA, 22 bp, Homo sapiens
ttgtgaagtggtacagctgctt

SEQ ID NO: 9088 - DNA, 21 bp, Homo sapiens
atccagttttcccaggaaaat

SEQ ID NO: 9089 - DNA, 23 bp, Homo sapiens
cactggtggtgatttattgggtg

SEQ ID NO: 9090 - DNA, 22 bp, Homo sapiens
ccccactctgggattgaacctc

SEQ ID NO: 9091 - DNA, 20 bp, Homo sapiens
tcaagggagttcttcaccac

SEQ ID NO: 9092 - DNA, 22 bp, Homo sapiens
tccctgagacccgccaggctga

SEQ ID NO: 9093 - DNA, 22 bp, Homo sapiens
tacagtatcaaagcagccatag

SEQ ID NO: 9094 - DNA, 22 bp, Homo sapiens
tgtcagttttctccataccttt

SEQ ID NO: 9095 - DNA, 20 bp, Homo sapiens
ttcggggagcccggcggctc

SEQ ID NO: 9096 - DNA, 23 bp, Homo sapiens
cccattgactttgggcttgactg

SEQ ID NO: 9097 - DNA, 22 bp, Homo sapiens
actgaaaagtcaatatggtttt

SEQ ID NO: 9098 - DNA, 22 bp, Homo sapiens
tagcaaacccagaaataaaaat

SEQ ID NO: 9099 - DNA, 20 bp, Homo sapiens
ttagaacattcgaaatcttc

SEQ ID NO: 9100 - DNA, 21 bp, Homo sapiens
tactcacttccttgctaatca

SEQ ID NO: 9101 - DNA, 20 bp, Homo sapiens
ttacaatatggcaggagcat

SEQ ID NO: 9102 - DNA, 22 bp, Homo sapiens
ggctcagttcagcagggactgt

SEQ ID NO: 9103 - DNA, 20 bp, Homo sapiens
gactatttgtaggaatagat

SEQ ID NO: 9104 - DNA, 20 bp, Homo sapiens
cacaataaatgagctacgta

SEQ ID NO: 9105 - DNA, 21 bp, Homo sapiens
caatctattgaactgactgaa

SEQ ID NO: 9106 - DNA, 21 bp, Homo sapiens
ttgacctacaggccagtaggt

SEQ ID NO: 9107 - DNA, 21 bp, Homo sapiens
atccatctcgaaattccactg

SEQ ID NO: 9108 - DNA, 20 bp, Homo sapiens
tgcgtagatataggaagtgg

SEQ ID NO: 9109 - DNA, 22 bp, Homo sapiens
tatggcttttcatttctaatgt

SEQ ID NO: 9110 - DNA, 22 bp, Homo sapiens
actagcacaacagtgtcgagga

SEQ ID NO: 9111 - DNA, 22 bp, Homo sapiens
cattgctgagtacataacctta

SEQ ID NO: 9112 - DNA, 22 bp, Homo sapiens
tctcctggtaggtcatggaggt

SEQ ID NO: 9113 - DNA, 22 bp, Homo sapiens
atttcagatgagatcaggtgct

SEQ ID NO: 9114 - DNA, 21 bp, Homo sapiens
cagagcaggatgtcagagccc

SEQ ID NO: 9115 - DNA, 22 bp, Homo sapiens
acagcagatgtgagtgttgtca

SEQ ID NO: 9116 - DNA, 23 bp, Homo sapiens
atagcagttgtctttatggggta

SEQ ID NO: 9117 - DNA, 21 bp, Homo sapiens
tagcaccagccaggcagcacc

SEQ ID NO: 9118 - DNA, 23 bp, Homo sapiens
agcagtttgccaacgtggatggc

SEQ ID NO: 9119 - DNA, 21 bp, Homo sapiens
ctgataatggagcttgatggt

SEQ ID NO: 9120 - DNA, 22 bp, Homo sapiens
agaggttcagggttgcatagtg

SEQ ID NO: 9121 - DNA, 21 bp, Homo sapiens
gcaggaggatatgcgtaggtt

SEQ ID NO: 9122 - DNA, 20 bp, Homo sapiens
atatcacctgagctgagtaa

SEQ ID NO: 9123 - DNA, 20 bp, Homo sapiens
gtgacctatgaatgtcctgg

SEQ ID NO: 9124 - DNA, 22 bp, Homo sapiens
catccatcatcattgtataggg

SEQ ID NO: 9125 - DNA, 22 bp, Homo sapiens
atcacatttaagactcgggaat

SEQ ID NO: 9126 - DNA, 20 bp, Homo sapiens
ccttccactactggtcagga

SEQ ID NO: 9127 - DNA, 22 bp, Homo sapiens
attggactaggataaattctgg

SEQ ID NO: 9128 - DNA, 22 bp, Homo sapiens
tccctgctcattcgcaggtgga

SEQ ID NO: 9129 - DNA, 22 bp, Homo sapiens
aaggagcttacaatctagtcag

SEQ ID NO: 9130 - DNA, 22 bp, Homo sapiens
accccactcctggtaccaaaaa

SEQ ID NO: 9131 - DNA, 21 bp, Homo sapiens
cctgctgagtacagccaagta

SEQ ID NO: 9132 - DNA, 20 bp, Homo sapiens
atgcctaggtcctctcggca

SEQ ID NO: 9133 - DNA, 20 bp, Homo sapiens
gagcccagcgccgacgactc

SEQ ID NO: 9134 - DNA, 22 bp, Homo sapiens
agggactctgttgggtccagtc

SEQ ID NO: 9135 - DNA, 21 bp, Homo sapiens
cgaatcaaaatataggatacc

SEQ ID NO: 9136 - DNA, 22 bp, Homo sapiens
gtcttgctgcagttgatatccc

SEQ ID NO: 9137 - DNA, 22 bp, Homo sapiens
actggacttggagtcacaagat

SEQ ID NO: 9138 - DNA, 20 bp, Homo sapiens
cagcgccgtggtcatattac

SEQ ID NO: 9139 - DNA, 23 bp, Homo sapiens
tagaggagctcacagtctagatg

SEQ ID NO: 9140 - DNA, 20 bp, Homo sapiens
agcagcattgctactaggaa

SEQ ID NO: 9141 - DNA, 22 bp, Homo sapiens
gtgactacagcactccaggaca

SEQ ID NO: 9142 - DNA, 23 bp, Homo sapiens
aagcagcttactgttatgggcaa

SEQ ID NO: 9143 - DNA, 20 bp, Homo sapiens
gtccagttttcctagggcct

SEQ ID NO: 9144 - DNA, 22 bp, Homo sapiens
aaccgcatctaggtcagaacaa

SEQ ID NO: 9145 - DNA, 20 bp, Homo sapiens
agtcctcgtgttgattgcca

SEQ ID NO: 9146 - DNA, 21 bp, Homo sapiens
atccagaaaatttgaaggctg

SEQ ID NO: 9147 - DNA, 21 bp, Homo sapiens
aacatagatatgtacgttagg

SEQ ID NO: 9148 - DNA, 22 bp, Homo sapiens
agctcctctctgtctctctctc

SEQ ID NO: 9149 - DNA, 23 bp, Homo sapiens
ggccagtttagccagaaatcccc

SEQ ID NO: 9150 - DNA, 24 bp, Homo sapiens
cggaccgggtggtggccgggcaga

SEQ ID NO: 9151 - DNA, 23 bp, Homo sapiens
agtggcacagctatggtgatgag

SEQ ID NO: 9152 - DNA, 23 bp, Homo sapiens
tatgatgggtggtgaaatctact

SEQ ID NO: 9153 - DNA, 22 bp, Homo sapiens
caagcgatctgcacgccttggc

SEQ ID NO: 9154 - DNA, 22 bp, Homo sapiens
tagcagcactatctatagtata

SEQ ID NO: 9155 - DNA, 22 bp, Homo sapiens
tagccaagctcagggctacact

SEQ ID NO: 9156 - DNA, 22 bp, Homo sapiens
tgagtcccacaggggcaggggt

SEQ ID NO: 9157 - DNA, 20 bp, Homo sapiens
atagagacagcaggacgatc

SEQ ID NO: 9158 - DNA, 23 bp, Homo sapiens
ctatctgtggactacttggtgac

SEQ ID NO: 9159 - DNA, 22 bp, Homo sapiens
gcaggacatcttggcggcccac

SEQ ID NO: 9160 - DNA, 23 bp, Homo sapiens
ctatttcactttatggtgagtct

SEQ ID NO: 9161 - DNA, 23 bp, Homo sapiens
agcagcattgtgtgaagagcgtt

SEQ ID NO: 9162 - DNA, 22 bp, Homo sapiens
gtttctttgtctttatggggta

SEQ ID NO: 9163 - DNA, 21 bp, Homo sapiens
cccagtgtagtctgatgtact

SEQ ID NO: 9164 - DNA, 20 bp, Homo sapiens
cagagcaggatgtcaccctg

SEQ ID NO: 9165 - DNA, 20 bp, Homo sapiens
ccacaatatggacttccacc

SEQ ID NO: 9166 - DNA, 22 bp, Homo sapiens
ttcaagtaatccactcgcctag

SEQ ID NO: 9167 - DNA, 22 bp, Homo sapiens
tccagacggcttgactatattc

SEQ ID NO: 9168 - DNA, 23 bp, Homo sapiens
tcgaggagctcacagtctagtag

SEQ ID NO: 9169 - DNA, 22 bp, Homo sapiens
tagactactgtcaaatacaata

SEQ ID NO: 9170 - DNA, 22 bp, Homo sapiens
tggctcagttcacacttcaata

SEQ ID NO: 9171 - DNA, 22 bp, Homo sapiens
tgaggtagtagactgtgtggct

SEQ ID NO: 9172 - DNA, 22 bp, Homo sapiens
ggctaattatttgtatttttgt

SEQ ID NO: 9173 - DNA, 21 bp, Homo sapiens
tgacgtttgggttgcgtttgt

SEQ ID NO: 9174 - DNA, 22 bp, Homo sapiens
aggtgcaatggattacgcctgc

SEQ ID NO: 9175 - DNA, 23 bp, Homo sapiens
atactgccaggctggattcttgg

SEQ ID NO: 9176 - DNA, 21 bp, Homo sapiens
gctagtaatagtttatggttg

SEQ ID NO: 9177 - DNA, 20 bp, Homo sapiens
atgtgttgttgccttgatct

SEQ ID NO: 9178 - DNA, 21 bp, Homo sapiens
ccatggcactcatatatatat

SEQ ID NO: 9179 - DNA, 22 bp, Homo sapiens
atcccattgcctccctaactgg

SEQ ID NO: 9180 - DNA, 21 bp, Homo sapiens
gatggatgtcgagatggctga

SEQ ID NO: 9181 - DNA, 20 bp, Homo sapiens
tatgtcgtgcatggtattgc

SEQ ID NO: 9182 - DNA, 22 bp, Homo sapiens
gctgtcgtgccaggagcccttg

SEQ ID NO: 9183 - DNA, 22 bp, Homo sapiens
tctcaaccacaggggccaccca

SEQ ID NO: 9184 - DNA, 22 bp, Homo sapiens
tgtgcctgtttctgtaccagtg

SEQ ID NO: 9185 - DNA, 22 bp, Homo sapiens
gtctgtgggtgtttatacccca

SEQ ID NO: 9186 - DNA, 22 bp, Homo sapiens
aaatgcaatggtaatgaactag

SEQ ID NO: 9187 - DNA, 22 bp, Homo sapiens
tctcctgaactcaagcgttttg

SEQ ID NO: 9188 - DNA, 24 bp, Homo sapiens
tatgtgaaactaataatagtacat

SEQ ID NO: 9189 - DNA, 22 bp, Homo sapiens
tgatctgcccttctgaatcacc

SEQ ID NO: 9190 - DNA, 21 bp, Homo sapiens
ccagtctcaggatgaggtggc

SEQ ID NO: 9191 - DNA, 20 bp, Homo sapiens
gacctagcctttctgcttct

SEQ ID NO: 9192 - DNA, 22 bp, Homo sapiens
tgtcagtttgtcaaataggaat

SEQ ID NO: 9193 - DNA, 21 bp, Homo sapiens
ttagtcacaatattcagaata

SEQ ID NO: 9194 - DNA, 22 bp, Homo sapiens
tatggcttttcattttccacag

SEQ ID NO: 9195 - DNA, 20 bp, Homo sapiens
accaagttaccatatctgag

SEQ ID NO: 9196 - DNA, 23 bp, Homo sapiens
gttgccttagggtttagtttccc

SEQ ID NO: 9197 - DNA, 22 bp, Homo sapiens
actccgctattgccaatgagtt

SEQ ID NO: 9198 - DNA, 22 bp, Homo sapiens
gttcacaacagtttatggttaa

SEQ ID NO: 9199 - DNA, 22 bp, Homo sapiens
atcacattcccaggtattgaac

SEQ ID NO: 9200 - DNA, 23 bp, Homo sapiens
gagggaggggaggcttaatccct

SEQ ID NO: 9201 - DNA, 23 bp, Homo sapiens
gtgctctgcctgatgactgtgaa

SEQ ID NO: 9202 - DNA, 22 bp, Homo sapiens
aagtgataatctacatactaga

SEQ ID NO: 9203 - DNA, 23 bp, Homo sapiens
agcagttttcagtgatggacaaa

SEQ ID NO: 9204 - DNA, 22 bp, Homo sapiens
ggtcaatttctgggactttcta

SEQ ID NO: 9205 - DNA, 20 bp, Homo sapiens
tcgggtcatggaggtggatc

SEQ ID NO: 9206 - DNA, 22 bp, Homo sapiens
actggacttggagtcagaatat

SEQ ID NO: 9207 - DNA, 21 bp, Homo sapiens
agtctcctcgtggggtttccc

SEQ ID NO: 9208 - DNA, 22 bp, Homo sapiens
cagcttatcagacagacagcag

SEQ ID NO: 9209 - DNA, 21 bp, Homo sapiens
tcagtgatgtggccagtgatt

SEQ ID NO: 9210 - DNA, 22 bp, Homo sapiens
tggagcagggtctacaggtttc

SEQ ID NO: 9211 - DNA, 22 bp, Homo sapiens
tcagtagaacagtttagaaaat

SEQ ID NO: 9212 - DNA, 23 bp, Homo sapiens
gctggataggagatgatcacctg

SEQ ID NO: 9213 - DNA, 21 bp, Homo sapiens
agaaagctcgctcctacatgc

SEQ ID NO: 9214 - DNA, 22 bp, Homo sapiens
ggcagcgccggcgggggcggga

SEQ ID NO: 9215 - DNA, 22 bp, Homo sapiens
gcggtacaggtgaaagaaagtg

SEQ ID NO: 9216 - DNA, 20 bp, Homo sapiens
tgggaatgctgtatcaaatg

SEQ ID NO: 9217 - DNA, 22 bp, Homo sapiens
ctatgtacatcagggatactgt

SEQ ID NO: 9218 - DNA, 24 bp, Homo sapiens
tgtcatctgacgtgtaacaggcat

SEQ ID NO: 9219 - DNA, 20 bp, Homo sapiens
atcacattattgaaacagaa

SEQ ID NO: 9220 - DNA, 20 bp, Homo sapiens
cagcaatgtggtcatattca

SEQ ID NO: 9221 - DNA, 20 bp, Homo sapiens
aaaaccaggctattgcttgg

SEQ ID NO: 9222 - DNA, 21 bp, Homo sapiens
acaaagcagatgcttataaat

SEQ ID NO: 9223 - DNA, 22 bp, Homo sapiens
gcccccatgtagccatttgcag

SEQ ID NO: 9224 - DNA, 20 bp, Homo sapiens
acttcatcatccaatatatc

SEQ ID NO: 9225 - DNA, 22 bp, Homo sapiens
aagtgacttagctcctatctag

SEQ ID NO: 9226 - DNA, 22 bp, Homo sapiens
gaaatgatagctcagtcaatag

SEQ ID NO: 9227 - DNA, 21 bp, Homo sapiens
cattattacttttgtattata

SEQ ID NO: 9228 - DNA, 20 bp, Homo sapiens
atagatcagaggctattctc

SEQ ID NO: 9229 - DNA, 23 bp, Homo sapiens
tgcctcagaagggtccttaggga

SEQ ID NO: 9230 - DNA, 21 bp, Homo sapiens
atctaccttttatctttgtgg

SEQ ID NO: 9231 - DNA, 21 bp, Homo sapiens
tctgtcacttggccagagttt

SEQ ID NO: 9232 - DNA, 22 bp, Homo sapiens
tggagggaaagatgacctgact

SEQ ID NO: 9233 - DNA, 22 bp, Homo sapiens
cataatttactaggaatttttt

SEQ ID NO: 9234 - DNA, 22 bp, Homo sapiens
caagccttagggtttagtgttg

SEQ ID NO: 9235 - DNA, 21 bp, Homo sapiens
cgcgacctcagatcaccgcaa

SEQ ID NO: 9236 - DNA, 21 bp, Homo sapiens
gcttccatgatccactacttt

SEQ ID NO: 9237 - DNA, 22 bp, Homo sapiens
acgaagaaaaagcaaaattggt

SEQ ID NO: 9238 - DNA, 20 bp, Homo sapiens
cttcggcacagctattttga

SEQ ID NO: 9239 - DNA, 22 bp, Homo sapiens
aaaaaatccacaatgttggggg

SEQ ID NO: 9240 - DNA, 20 bp, Homo sapiens
gcatcattgccatacttgtg

SEQ ID NO: 9241 - DNA, 22 bp, Homo sapiens
tcaagtcctggaatcaggtact

SEQ ID NO: 9242 - DNA, 21 bp, Homo sapiens
gcaatcgtggcatcatggctc

SEQ ID NO: 9243 - DNA, 21 bp, Homo sapiens
ttcacagtggctaagctaatt

SEQ ID NO: 9244 - DNA, 22 bp, Homo sapiens
atggtgccattgaaagccattg

SEQ ID NO: 9245 - DNA, 22 bp, Homo sapiens
agcgatgtggtgactgattgct

SEQ ID NO: 9246 - DNA, 22 bp, Homo sapiens
aaacatggcaacttatcagaaa

SEQ ID NO: 9247 - DNA, 22 bp, Homo sapiens
aaatttaaacaagatttttatg

SEQ ID NO: 9248 - DNA, 22 bp, Homo sapiens
tgagatgggatgactgctagag

SEQ ID NO: 9249 - DNA, 22 bp, Homo sapiens
taaggatgtatcatggtgatgt

SEQ ID NO: 9250 - DNA, 22 bp, Homo sapiens
tgtctgtgggaagcagttatgg

SEQ ID NO: 9251 - DNA, 22 bp, Homo sapiens
atcacatcatcagggcttgaac

SEQ ID NO: 9252 - DNA, 23 bp, Homo sapiens
tagcaattcagagcagcacactt

SEQ ID NO: 9253 - DNA, 22 bp, Homo sapiens
tttgactgtgctgcaacctaca

SEQ ID NO: 9254 - DNA, 20 bp, Homo sapiens
gctacactgacagagccaag

SEQ ID NO: 9255 - DNA, 23 bp, Homo sapiens
gatctaccacattggcgtcccaa

SEQ ID NO: 9256 - DNA, 24 bp, Homo sapiens
tgtcacagggcattttaagtggat

SEQ ID NO: 9257 - DNA, 20 bp, Homo sapiens
gactggatacttagctgtgc

SEQ ID NO: 9258 - DNA, 21 bp, Homo sapiens
ctagatatgagcgtattagta

SEQ ID NO: 9259 - DNA, 22 bp, Homo sapiens
tcagattacagcattattgtat

SEQ ID NO: 9260 - DNA, 22 bp, Homo sapiens
atcacatttaagttctaatgca

SEQ ID NO: 9261 - DNA, 22 bp, Homo sapiens
tgatccgctggacactaaaact

SEQ ID NO: 9262 - DNA, 23 bp, Homo sapiens
tataaaatgttcatggcagcagg

SEQ ID NO: 9263 - DNA, 23 bp, Homo sapiens
ggctctactagttctgagctgag

SEQ ID NO: 9264 - DNA, 22 bp, Homo sapiens
tagcttatcaagctgattagta

SEQ ID NO: 9265 - DNA, 24 bp, Homo sapiens
acagcagcgttgagacttactggg

SEQ ID NO: 9266 - DNA, 23 bp, Homo sapiens
tcagtaggtcaggggagggcatt

SEQ ID NO: 9267 - DNA, 23 bp, Homo sapiens
ttggaatagtagcactcaccctg

SEQ ID NO: 9268 - DNA, 22 bp, Homo sapiens
cctaccttttctcctaactaca

SEQ ID NO: 9269 - DNA, 22 bp, Homo sapiens
cactagtttggcaaataccctc

SEQ ID NO: 9270 - DNA, 22 bp, Homo sapiens
gtccagtttattgaggaatcca

SEQ ID NO: 9271 - DNA, 23 bp, Homo sapiens
atccagtttgattgaagaaggga

SEQ ID NO: 9272 - DNA, 22 bp, Homo sapiens
tctatgcatctctgatctgtat

SEQ ID NO: 9273 - DNA, 22 bp, Homo sapiens
cactgacttagaaatatgttca

SEQ ID NO: 9274 - DNA, 22 bp, Homo sapiens
tttctttgtaatataattatct

SEQ ID NO: 9275 - DNA, 20 bp, Homo sapiens
attatatgtacagtatagca

SEQ ID NO: 9276 - DNA, 22 bp, Homo sapiens
aaaccgtttggaaatgacctgg

SEQ ID NO: 9277 - DNA, 20 bp, Homo sapiens
aagagcataagaataacagc

SEQ ID NO: 9278 - DNA, 22 bp, Homo sapiens
taggaattaatgcactatattc

SEQ ID NO: 9279 - DNA, 23 bp, Homo sapiens
atcgtcatttcccaggttaggga

SEQ ID NO: 9280 - DNA, 22 bp, Homo sapiens
catcattctgtctctatgagtt

SEQ ID NO: 9281 - DNA, 24 bp, Homo sapiens
cattcagagtaagggccaagtact

SEQ ID NO: 9282 - DNA, 21 bp, Homo sapiens
gctagggttgagtcagtacag

SEQ ID NO: 9283 - DNA, 21 bp, Homo sapiens
tagtcaatcagtttatttttg

SEQ ID NO: 9284 - DNA, 20 bp, Homo sapiens
gctaaggccagaggagatga

SEQ ID NO: 9285 - DNA, 21 bp, Homo sapiens
agttcagcatgtagtggtgta

SEQ ID NO: 9286 - DNA, 23 bp, Homo sapiens
tgtcagtagtgtgggccaaaaca

SEQ ID NO: 9287 - DNA, 21 bp, Homo sapiens
cagcagttctactttcccgta

SEQ ID NO: 9288 - DNA, 20 bp, Homo sapiens
taatagtgtggtcatagctg

SEQ ID NO: 9289 - DNA, 21 bp, Homo sapiens
gagtgtcctataaaagggctg

SEQ ID NO: 9290 - DNA, 20 bp, Homo sapiens
ttaaaacgctaaggatagtt

SEQ ID NO: 9291 - DNA, 22 bp, Homo sapiens
cgcggcgcctcgcctactagtc

SEQ ID NO: 9292 - DNA, 20 bp, Homo sapiens
gagggcatgagttagcacca

SEQ ID NO: 9293 - DNA, 20 bp, Homo sapiens
aactggatacttataacagc

SEQ ID NO: 9294 - DNA, 20 bp, Homo sapiens
aactactggtctgtacacag

SEQ ID NO: 9295 - DNA, 22 bp, Homo sapiens
gtcatgaactcaaatgccccaa

SEQ ID NO: 9296 - DNA, 20 bp, Homo sapiens
agttatcaagactatcagac

SEQ ID NO: 9297 - DNA, 21 bp, Homo sapiens
gctttaagactgggatatgat

SEQ ID NO: 9298 - DNA, 23 bp, Homo sapiens
gctaggaggtctgtgatgcactg

SEQ ID NO: 9299 - DNA, 20 bp, Homo sapiens
cccccggctcctccactgag

SEQ ID NO: 9300 - DNA, 22 bp, Homo sapiens
tgggactctgggatatccagtc

SEQ ID NO: 9301 - DNA, 22 bp, Homo sapiens
aagcttatcatcatggcaaaag

SEQ ID NO: 9302 - DNA, 21 bp, Homo sapiens
aaagctgtggctgtggtctag

SEQ ID NO: 9303 - DNA, 22 bp, Homo sapiens
tgctcatcatcattgtatagtt

SEQ ID NO: 9304 - DNA, 22 bp, Homo sapiens
atcacattctgaggagccaggt

SEQ ID NO: 9305 - DNA, 23 bp, Homo sapiens
gagctcggagagtcagcaaactg

SEQ ID NO: 9306 - DNA, 22 bp, Homo sapiens
taataatagtagtcagcaaagt

SEQ ID NO: 9307 - DNA, 23 bp, Homo sapiens
gttactgggctttgaaggtccag

SEQ ID NO: 9308 - DNA, 20 bp, Homo sapiens
caaattgctcctaggtagcc

SEQ ID NO: 9309 - DNA, 22 bp, Homo sapiens
tctaggcctgctacagcaccag

SEQ ID NO: 9310 - DNA, 20 bp, Homo sapiens
ccttggtggtataaatttga

SEQ ID NO: 9311 - DNA, 20 bp, Homo sapiens
agagctagtgcagtcagcac

SEQ ID NO: 9312 - DNA, 23 bp, Homo sapiens
atgacagattgacatggacaatt

SEQ ID NO: 9313 - DNA, 22 bp, Homo sapiens
atctgcggtaatccccggtccg

SEQ ID NO: 9314 - DNA, 22 bp, Homo sapiens
tcgtttggtaatttgcatgttc

SEQ ID NO: 9315 - DNA, 22 bp, Homo sapiens
agcatgaatcccaaagatgatt

SEQ ID NO: 9316 - DNA, 20 bp, Homo sapiens
cccataaagtaggggataat

SEQ ID NO: 9317 - DNA, 23 bp, Homo sapiens
gctacttggccagagctgctgtc

SEQ ID NO: 9318 - DNA, 20 bp, Homo sapiens
cctgagaatctaacaagata

SEQ ID NO: 9319 - DNA, 22 bp, Homo sapiens
atatcgcacatcatggatccac

SEQ ID NO: 9320 - DNA, 21 bp, Homo sapiens
agcatgctgacttagagatgt

SEQ ID NO: 9321 - DNA, 24 bp, Homo sapiens
cccactgctgcacttgactagcct

SEQ ID NO: 9322 - DNA, 24 bp, Homo sapiens
agcagcactgctactaggagtgac

SEQ ID NO: 9323 - DNA, 22 bp, Homo sapiens
tttcagtaatcacttatgaaat

SEQ ID NO: 9324 - DNA, 23 bp, Homo sapiens
attagacgttcagaagtccactg

SEQ ID NO: 9325 - DNA, 22 bp, Homo sapiens
catagcgagaccccgtctctta

SEQ ID NO: 9326 - DNA, 21 bp, Homo sapiens
acacttacgtttgaaatgctt

SEQ ID NO: 9327 - DNA, 22 bp, Homo sapiens
agcagtgccacgtgaccgtttt

SEQ ID NO: 9328 - DNA, 20 bp, Homo sapiens
aagtagattaggagtatagt

SEQ ID NO: 9329 - DNA, 21 bp, Homo sapiens
atatgtgttgtgtatgatatc

SEQ ID NO: 9330 - DNA, 23 bp, Homo sapiens
gctctgtagatatcatactgtag

SEQ ID NO: 9331 - DNA, 23 bp, Homo sapiens
gctattatcagactagttggtca

SEQ ID NO: 9332 - DNA, 23 bp, Homo sapiens
catgatgggagacaatattttgg

SEQ ID NO: 9333 - DNA, 21 bp, Homo sapiens
gagaaaccaccttgatggtct

SEQ ID NO: 9334 - DNA, 22 bp, Homo sapiens
ttatatagtggtgagtattttt

SEQ ID NO: 9335 - DNA, 22 bp, Homo sapiens
ctccgtctcaaagctcttgtga

SEQ ID NO: 9336 - DNA, 22 bp, Homo sapiens
tcaagtcctggaattgaacact

SEQ ID NO: 9337 - DNA, 20 bp, Homo sapiens
ttttaaaagatttaatattg

SEQ ID NO: 9338 - DNA, 22 bp, Homo sapiens
tactggtttgtcaaagcaaaat

SEQ ID NO: 9339 - DNA, 21 bp, Homo sapiens
acctctcttcctctcactttt

SEQ ID NO: 9340 - DNA, 21 bp, Homo sapiens
tgatgttgctcaggcgattgt

SEQ ID NO: 9341 - DNA, 20 bp, Homo sapiens
ggaaagtggtggtgggagat

SEQ ID NO: 9342 - DNA, 21 bp, Homo sapiens
gggtgcccttagatctacagc

SEQ ID NO: 9343 - DNA, 22 bp, Homo sapiens
tgtcaacccactgggcttcctg

SEQ ID NO: 9344 - DNA, 22 bp, Homo sapiens
tagcttatgtctgaggtcccac

SEQ ID NO: 9345 - DNA, 23 bp, Homo sapiens
ttgcttgctgagtcagcagggct

SEQ ID NO: 9346 - DNA, 22 bp, Homo sapiens
cagtgcaaatggaaggagatgg

SEQ ID NO: 9347 - DNA, 22 bp, Homo sapiens
aggagggctggagaaattttca

SEQ ID NO: 9348 - DNA, 20 bp, Homo sapiens
cctgttctattttgttgatc

SEQ ID NO: 9349 - DNA, 22 bp, Homo sapiens
ttgcaccatctgaagccagggc

SEQ ID NO: 9350 - DNA, 21 bp, Homo sapiens
aaggagctcacagtcagccag

SEQ ID NO: 9351 - DNA, 21 bp, Homo sapiens
cagcagcaattcatgtgagtt

SEQ ID NO: 9352 - DNA, 20 bp, Homo sapiens
atcagaggctattgtggctg

SEQ ID NO: 9353 - DNA, 22 bp, Homo sapiens
tgctgaccacagtgtatgtgtg

SEQ ID NO: 9354 - DNA, 21 bp, Homo sapiens
ccttccagccgtgtgattcca

SEQ ID NO: 9355 - DNA, 21 bp, Homo sapiens
cgacacggtaactatccaaac

SEQ ID NO: 9356 - DNA, 23 bp, Homo sapiens
actggacttggagtcagaaaatc

SEQ ID NO: 9357 - DNA, 22 bp, Homo sapiens
tctcccttggaggtatgactgt

SEQ ID NO: 9358 - DNA, 21 bp, Homo sapiens
gagtaggtcatctctggagcc

SEQ ID NO: 9359 - DNA, 20 bp, Homo sapiens
atgcacccaccagtatagca

SEQ ID NO: 9360 - DNA, 22 bp, Homo sapiens
tgagatgaagccagtgctttga

SEQ ID NO: 9361 - DNA, 21 bp, Homo sapiens
taagaatagtctgactcacag

SEQ ID NO: 9362 - DNA, 23 bp, Homo sapiens
accacgcctggtccctggcttag

SEQ ID NO: 9363 - DNA, 21 bp, Homo sapiens
acacaacctgatgattctcaa

SEQ ID NO: 9364 - DNA, 21 bp, Homo sapiens
gagcaccagagtcagctaagg

SEQ ID NO: 9365 - DNA, 22 bp, Homo sapiens
gctcttatcagtgtgatgttga

SEQ ID NO: 9366 - DNA, 22 bp, Homo sapiens
gagtctccagtaatggacggga

SEQ ID NO: 9367 - DNA, 20 bp, Homo sapiens
ataagccattgcgtccagtc

SEQ ID NO: 9368 - DNA, 21 bp, Homo sapiens
cttcgcggatctttcccgccc

SEQ ID NO: 9369 - DNA, 20 bp, Homo sapiens
atctatacatgtggcttaag

SEQ ID NO: 9370 - DNA, 22 bp, Homo sapiens
taggaatacagacacaggttag

SEQ ID NO: 9371 - DNA, 20 bp, Homo sapiens
gccaataaggattggctcta

SEQ ID NO: 9372 - DNA, 20 bp, Homo sapiens
ggccaccagacaagattggt

SEQ ID NO: 9373 - DNA, 22 bp, Homo sapiens
aacaataactatgggcgcaccc

SEQ ID NO: 9374 - DNA, 21 bp, Homo sapiens
agcagtcttctcctgggcact

SEQ ID NO: 9375 - DNA, 22 bp, Homo sapiens
gtagaattatttgttattttgt

SEQ ID NO: 9376 - DNA, 23 bp, Homo sapiens
tagcagtggtgctttatgttttg

SEQ ID NO: 9377 - DNA, 22 bp, Homo sapiens
attctgccattgaaagccagtg

SEQ ID NO: 9378 - DNA, 23 bp, Homo sapiens
tagagaactgaataaagaaatat

SEQ ID NO: 9379 - DNA, 23 bp, Homo sapiens
ttgtcatagtagtgtcgtggaga

SEQ ID NO: 9380 - DNA, 22 bp, Homo sapiens
tagatagcacagtttatggggc

SEQ ID NO: 9381 - DNA, 21 bp, Homo sapiens
gaggttgacctgtttcccccc

SEQ ID NO: 9382 - DNA, 23 bp, Homo sapiens
atcattatcatagtgatgttcgt

SEQ ID NO: 9383 - DNA, 20 bp, Homo sapiens
cccatcgttcaggtgaagaa

SEQ ID NO: 9384 - DNA, 21 bp, Homo sapiens
agatgataatagtacaaaact

SEQ ID NO: 9385 - DNA, 22 bp, Homo sapiens
cccagccctgtcttctacatac

SEQ ID NO: 9386 - DNA, 22 bp, Homo sapiens
gcatggcactcattcgcacatc

SEQ ID NO: 9387 - DNA, 20 bp, Homo sapiens
gaataatgtgcagtataatg

SEQ ID NO: 9388 - DNA, 21 bp, Homo sapiens
tgatgatgtatattcaaggtg

SEQ ID NO: 9389 - DNA, 22 bp, Homo sapiens
ggacagtgttggtacggaagac

SEQ ID NO: 9390 - DNA, 24 bp, Homo sapiens
acaatattacaacattattacaat

SEQ ID NO: 9391 - DNA, 23 bp, Homo sapiens
tggacaccaaaggtgcaactgtc

SEQ ID NO: 9392 - DNA, 23 bp, Homo sapiens
cacatgagatgatacatatatta

SEQ ID NO: 9393 - DNA, 20 bp, Homo sapiens
gcgggtcggggggcgggttc

SEQ ID NO: 9394 - DNA, 22 bp, Homo sapiens
tggcaccatctctttagcctta

SEQ ID NO: 9395 - DNA, 21 bp, Homo sapiens
tggagagatctgtagagatca

SEQ ID NO: 9396 - DNA, 21 bp, Homo sapiens
acagtagtctgcaccaattaa

SEQ ID NO: 9397 - DNA, 22 bp, Homo sapiens
tagcaccatcctcctagcactg

SEQ ID NO: 9398 - DNA, 22 bp, Homo sapiens
aaaccgtttggtgattcctcaa

SEQ ID NO: 9399 - DNA, 22 bp, Homo sapiens
ttcatcatttccagagggaaca

SEQ ID NO: 9400 - DNA, 22 bp, Homo sapiens
gtcttcattcggtcagcgagcc

SEQ ID NO: 9401 - DNA, 23 bp, Homo sapiens
gagcttatcagcatcatgtactg

SEQ ID NO: 9402 - DNA, 22 bp, Homo sapiens
gaaaatatcaaagctgaacact

SEQ ID NO: 9403 - DNA, 23 bp, Homo sapiens
taatctatcctgatgaatgtgag

SEQ ID NO: 9404 - DNA, 20 bp, Homo sapiens
gctgaggagccagcaaacaa

SEQ ID NO: 9405 - DNA, 21 bp, Homo sapiens
agcagggagatggagcagggg

SEQ ID NO: 9406 - DNA, 23 bp, Homo sapiens
gtggctgccccccggggccttgc

SEQ ID NO: 9407 - DNA, 23 bp, Homo sapiens
ctggtacccactcaatatttgtt

SEQ ID NO: 9408 - DNA, 22 bp, Homo sapiens
tggctggtaaacttgctggaca

SEQ ID NO: 9409 - DNA, 20 bp, Homo sapiens
atcacattgccaggtcacga

SEQ ID NO: 9410 - DNA, 20 bp, Homo sapiens
atcagaggctattgttgtca

SEQ ID NO: 9411 - DNA, 21 bp, Homo sapiens
ttcttctacaaggggtaattg

SEQ ID NO: 9412 - DNA, 20 bp, Homo sapiens
gtacagtactgtgataattc

SEQ ID NO: 9413 - DNA, 20 bp, Homo sapiens
caaggcacatgctgtgagct

SEQ ID NO: 9414 - DNA, 20 bp, Homo sapiens
ggggttccgagcatgtgcag

SEQ ID NO: 9415 - DNA, 24 bp, Homo sapiens
ttgctaaccctgccttcccacagg

SEQ ID NO: 9416 - DNA, 23 bp, Homo sapiens
gctactgtgcttgtccttaggga

SEQ ID NO: 9417 - DNA, 20 bp, Homo sapiens
tgttcccgctgtgctgtgtg

SEQ ID NO: 9418 - DNA, 23 bp, Homo sapiens
cagctggcccctctgcctgcagc

SEQ ID NO: 9419 - DNA, 22 bp, Homo sapiens
acagcctcccttgcgccacagg

SEQ ID NO: 9420 - DNA, 21 bp, Homo sapiens
cctcgcctcccgcgcgcctag

SEQ ID NO: 9421 - DNA, 23 bp, Homo sapiens
gagcttgctgctgcagcaaagac

SEQ ID NO: 9422 - DNA, 22 bp, Homo sapiens
tagcttatacctatgtcagaag

SEQ ID NO: 9423 - DNA, 21 bp, Homo sapiens
ttcacagtggctaagctatgg

SEQ ID NO: 9424 - DNA, 23 bp, Homo sapiens
tatccaatacctccatactgtgc

SEQ ID NO: 9425 - DNA, 22 bp, Homo sapiens
caaagtgcttacattgcagtgt

SEQ ID NO: 9426 - DNA, 22 bp, Homo sapiens
ggacagtaatgacatctaggtt

SEQ ID NO: 9427 - DNA, 21 bp, Homo sapiens
ggcccgttaacaggataacct

SEQ ID NO: 9428 - DNA, 23 bp, Homo sapiens
catttgggtgcaaattggggtta

SEQ ID NO: 9429 - DNA, 20 bp, Homo sapiens
atcatgcaatggattcccat

SEQ ID NO: 9430 - DNA, 21 bp, Homo sapiens
ctatttggatcggggtttgaa

SEQ ID NO: 9431 - DNA, 22 bp, Homo sapiens
tacctgagaccctagaggtgag

SEQ ID NO: 9432 - DNA, 20 bp, Homo sapiens
atatagttctgagctgatcg

SEQ ID NO: 9433 - DNA, 22 bp, Homo sapiens
aatgtgtcctgcaattcacatt

SEQ ID NO: 9434 - DNA, 20 bp, Homo sapiens
gtctgacccctttgaagaga

SEQ ID NO: 9435 - DNA, 21 bp, Homo sapiens
ggagtctaacacgtggcccag

SEQ ID NO: 9436 - DNA, 20 bp, Homo sapiens
gaatttgtacccctccatga

SEQ ID NO: 9437 - DNA, 22 bp, Homo sapiens
tgtctcaaagagtttatccctg

SEQ ID NO: 9438 - DNA, 24 bp, Homo sapiens
agtatattctcaatgttgtgcagc

SEQ ID NO: 9439 - DNA, 20 bp, Homo sapiens
cattatatagggaaaagtgc

SEQ ID NO: 9440 - DNA, 22 bp, Homo sapiens
tgtggctttaatttgcatgttg

SEQ ID NO: 9441 - DNA, 22 bp, Homo sapiens
tgtcagtttttcaaatgttttc

SEQ ID NO: 9442 - DNA, 20 bp, Homo sapiens
gtctggccttgactctagag

SEQ ID NO: 9443 - DNA, 21 bp, Homo sapiens
ccactgtgagtctgatggact

SEQ ID NO: 9444 - DNA, 20 bp, Homo sapiens
gatatagttctgagctgatc

SEQ ID NO: 9445 - DNA, 20 bp, Homo sapiens
gactatagttctgagctgag

SEQ ID NO: 9446 - DNA, 21 bp, Homo sapiens
tttgcacaagtctgacaaaca

SEQ ID NO: 9447 - DNA, 21 bp, Homo sapiens
acaagttgagatagggatcag

SEQ ID NO: 9448 - DNA, 20 bp, Homo sapiens
acggtcttgaacaggaatta

SEQ ID NO: 9449 - DNA, 20 bp, Homo sapiens
gcagttcgccttacagtgtc

SEQ ID NO: 9450 - DNA, 23 bp, Homo sapiens
agactacaacatactttgatgca

SEQ ID NO: 9451 - DNA, 22 bp, Homo sapiens
caggtcaattcttgaaggcttt

SEQ ID NO: 9452 - DNA, 23 bp, Homo sapiens
tagcagtggcaacccggggggtt

SEQ ID NO: 9453 - DNA, 22 bp, Homo sapiens
acagtagctcaagttatggggc

SEQ ID NO: 9454 - DNA, 20 bp, Homo sapiens
gctaggtgctcaccagagct

SEQ ID NO: 9455 - DNA, 23 bp, Homo sapiens
caccgtgatgaatagatactctg

SEQ ID NO: 9456 - DNA, 20 bp, Homo sapiens
aacgcacaccaggctggctg

SEQ ID NO: 9457 - DNA, 21 bp, Homo sapiens
cttgggcgaggcccctgtcca

SEQ ID NO: 9458 - DNA, 21 bp, Homo sapiens
cgccgcgcgccgggaccgggg

SEQ ID NO: 9459 - DNA, 21 bp, Homo sapiens
cagccaggattatattcctaa

SEQ ID NO: 9460 - DNA, 21 bp, Homo sapiens
gaacgagaactttgatcctta

SEQ ID NO: 9461 - DNA, 21 bp, Homo sapiens
ccaatatggtagccactcacc

SEQ ID NO: 9462 - DNA, 22 bp, Homo sapiens
tgaggttgtaggttgtttggtt

SEQ ID NO: 9463 - DNA, 20 bp, Homo sapiens
cggccgtcggcggcccggcg

SEQ ID NO: 9464 - DNA, 21 bp, Homo sapiens
cgtctcgaggcccagcccgtg

SEQ ID NO: 9465 - DNA, 22 bp, Homo sapiens
tcattcccggctttcggcacca

SEQ ID NO: 9466 - DNA, 20 bp, Homo sapiens
ccctcgagggcggcccgggc

SEQ ID NO: 9467 - DNA, 22 bp, Homo sapiens
cgccgccgccgccgctgagacc

SEQ ID NO: 9468 - DNA, 20 bp, Homo sapiens
tgcccggcacctccaccaca

SEQ ID NO: 9469 - DNA, 20 bp, Homo sapiens
tcagcccggaggagccccca

SEQ ID NO: 9470 - DNA, 20 bp, Homo sapiens
tcagcccggaagagccccca

SEQ ID NO: 9471 - DNA, 20 bp, Homo sapiens
atcccactcctgacaccagt

SEQ ID NO: 9472 - DNA, 23 bp, Homo sapiens
ccaggccagaaagcaacagcaga

SEQ ID NO: 9473 - DNA, 24 bp, Homo sapiens
cgcgcgcgtgtgtgtgtatgaggg

SEQ ID NO: 9474 - DNA, 21 bp, Homo sapiens
atcatgtgaagggacttgtac

SEQ ID NO: 9475 - DNA, 21 bp, Homo sapiens
ggtgtaggtcgaggtttgtgt

SEQ ID NO: 9476 - DNA, 21 bp, Homo sapiens
cggcccgccgcggggctccgg

SEQ ID NO: 9477 - DNA, 24 bp, Homo sapiens
acccgcccaagctaaggggtctgg

SEQ ID NO: 9478 - DNA, 23 bp, Homo sapiens
tagctgagcaacattagtcacat

SEQ ID NO: 9479 - DNA, 23 bp, Homo sapiens
aactaactagttagcctgccata

SEQ ID NO: 9480 - DNA, 22 bp, Homo sapiens
tgaatatatttggggtatattc

SEQ ID NO: 9481 - DNA, 20 bp, Homo sapiens
gggtgcagagcagatattta

SEQ ID NO: 9482 - DNA, 23 bp, Homo sapiens
tacggtcctaaatattgctttgg

SEQ ID NO: 9483 - DNA, 23 bp, Homo sapiens
caactatgatctctcatctcatc

SEQ ID NO: 9484 - DNA, 22 bp, Homo sapiens
gtgccaggatttataagctggt

SEQ ID NO: 9485 - DNA, 21 bp, Homo sapiens
gcggcccgcctcggggccccg

SEQ ID NO: 9486 - DNA, 23 bp, Homo sapiens
atgatttaaaggaaatgaagcta

SEQ ID NO: 9487 - DNA, 24 bp, Homo sapiens
agctgtgatgcccacctgtttacc

SEQ ID NO: 9488 - DNA, 24 bp, Homo sapiens
gcctgggcttcctaggggcatggt

SEQ ID NO: 9489 - DNA, 22 bp, Homo sapiens
aaattaatgaaaatggtgatga

SEQ ID NO: 9490 - DNA, 22 bp, Homo sapiens
ccccggagggggcggggaggtg

SEQ ID NO: 9491 - DNA, 21 bp, Homo sapiens
catctccgcgtgaaacctgcc

SEQ ID NO: 9492 - DNA, 23 bp, Homo sapiens
ctcggatcggccccgccgcgacc

SEQ ID NO: 9493 - DNA, 24 bp, Homo sapiens
atatgtgttttccgtccttacttt

SEQ ID NO: 9494 - DNA, 20 bp, Homo sapiens
gagaaagttcaaaggaactg

SEQ ID NO: 9495 - DNA, 23 bp, Homo sapiens
actattgatgaatgtctgggtat

SEQ ID NO: 9496 - DNA, 21 bp, Homo sapiens
taagcgtgcgccaccatgcca

SEQ ID NO: 9497 - DNA, 20 bp, Homo sapiens
aggaaactctggtggatcag

SEQ ID NO: 9498 - DNA, 20 bp, Homo sapiens
tttaggatttataagagcca

SEQ ID NO: 9499 - DNA, 20 bp, Homo sapiens
ggcccatgtactctgccaga

SEQ ID NO: 9500 - DNA, 22 bp, Homo sapiens
ttactgtgatgaacttctgagg

SEQ ID NO: 9501 - DNA, 20 bp, Homo sapiens
ccgcacccggccaggacacg

SEQ ID NO: 9502 - DNA, 22 bp, Homo sapiens
gacacattttaaataaactata

SEQ ID NO: 9503 - DNA, 20 bp, Homo sapiens
ctctccaggcaggaattgga

SEQ ID NO: 9504 - DNA, 21 bp, Homo sapiens
cgtaacttattctatgaagcc

SEQ ID NO: 9505 - DNA, 21 bp, Homo sapiens
ctgttaatcggggaaaaccaa

SEQ ID NO: 9506 - DNA, 24 bp, Homo sapiens
tcatgaagaggaagaaaaatgaga

SEQ ID NO: 9507 - DNA, 21 bp, Homo sapiens
gtaagccgttttaaaaactgt

SEQ ID NO: 9508 - DNA, 23 bp, Homo sapiens
caggtctccatccactgggggga

SEQ ID NO: 9509 - DNA, 21 bp, Homo sapiens
ttggctatgatgaatcaagtt

SEQ ID NO: 9510 - DNA, 21 bp, Homo sapiens
tctctcctggctggctcgcca

SEQ ID NO: 9511 - DNA, 21 bp, Homo sapiens
ataatattagttgtagaatat

SEQ ID NO: 9512 - DNA, 21 bp, Homo sapiens
actggactaggagtcaggggg

SEQ ID NO: 9513 - DNA, 20 bp, Homo sapiens
ttacaaagtcaaggtctagt

SEQ ID NO: 9514 - DNA, 23 bp, Homo sapiens
tgagctgggtggtctggcagcac

SEQ ID NO: 9515 - DNA, 20 bp, Homo sapiens
cggcggcggcgcagggcggg

SEQ ID NO: 9516 - DNA, 20 bp, Homo sapiens
cccgcctcgcccgccgcgcc

SEQ ID NO: 9517 - DNA, 22 bp, Homo sapiens
gctctggaaatcaaactaacat

SEQ ID NO: 9518 - DNA, 22 bp, Homo sapiens
tcgaatcctgttcgtgacgcca

SEQ ID NO: 9519 - DNA, 22 bp, Homo sapiens
tcatgacagtggccagagagat

SEQ ID NO: 9520 - DNA, 21 bp, Homo sapiens
ctcacctggagcatgttttcc

SEQ ID NO: 9521 - DNA, 21 bp, Homo sapiens
tattctgattcttcggtcacc

SEQ ID NO: 9522 - DNA, 20 bp, Homo sapiens
cgaaccgggcgggaacacca

SEQ ID NO: 9523 - DNA, 22 bp, Homo sapiens
gggctatgcctgtctgagcgtc

SEQ ID NO: 9524 - DNA, 20 bp, Homo sapiens
atacaatatggcaggaacag

SEQ ID NO: 9525 - DNA, 20 bp, Homo sapiens
aggtcggtttctatctactg

SEQ ID NO: 9526 - DNA, 20 bp, Homo sapiens
gcttatacagcataatttta

SEQ ID NO: 9527 - DNA, 22 bp, Homo sapiens
tgtaaccctaaagtggaagcca

SEQ ID NO: 9528 - DNA, 23 bp, Homo sapiens
attccaggagggtattcctaaca

SEQ ID NO: 9529 - DNA, 21 bp, Homo sapiens
gctacatctcttcagctaacc

SEQ ID NO: 9530 - DNA, 23 bp, Homo sapiens
caagatacactctctcgctgtag

SEQ ID NO: 9531 - DNA, 23 bp, Homo sapiens
actggagttggagtcagaagcca

SEQ ID NO: 9532 - DNA, 21 bp, Homo sapiens
tagagaaccatctgaaagact

SEQ ID NO: 9533 - DNA, 22 bp, Homo sapiens
gtcatttttgtgatctgcagct

SEQ ID NO: 9534 - DNA, 24 bp, Homo sapiens
gcggcggcggcggcggcggaggtg

SEQ ID NO: 9535 - DNA, 22 bp, Homo sapiens
ccaggaaatgttccttaaaact

SEQ ID NO: 9536 - DNA, 20 bp, Homo sapiens
aatgagactctggcatggga

SEQ ID NO: 9537 - DNA, 24 bp, Homo sapiens
cagccagtccgaggtccacataag

SEQ ID NO: 9538 - DNA, 23 bp, Homo sapiens
aaggcctcaccgccgataacgta

SEQ ID NO: 9539 - DNA, 22 bp, Homo sapiens
tcaattaacccttataccagtg

SEQ ID NO: 9540 - DNA, 21 bp, Homo sapiens
ccgctcaccgcctcgcaggag

SEQ ID NO: 9541 - DNA, 21 bp, Homo sapiens
tgtgttgcatgtgtgtatatg

SEQ ID NO: 9542 - DNA, 24 bp, Homo sapiens
ttgttcattttgagactacagaat

SEQ ID NO: 9543 - DNA, 20 bp, Homo sapiens
ggttctaatatatgaattgt

SEQ ID NO: 9544 - DNA, 20 bp, Homo sapiens
cttcccgtggatataattct

SEQ ID NO: 9545 - DNA, 22 bp, Homo sapiens
agggaacgtgaactgggtttag

SEQ ID NO: 9546 - DNA, 20 bp, Homo sapiens
ttagctatttccctcatccc

SEQ ID NO: 9547 - DNA, 24 bp, Homo sapiens
accgctctctcctgcgctcggggg

SEQ ID NO: 9548 - DNA, 20 bp, Homo sapiens
atttcaccccataaacacca

SEQ ID NO: 9549 - DNA, 23 bp, Homo sapiens
cctaaaaaccttaatattggaat

SEQ ID NO: 9550 - DNA, 22 bp, Homo sapiens
gacactgttgttaactctcaat

SEQ ID NO: 9551 - DNA, 24 bp, Homo sapiens
ctcgcgcgccggcgcgccgccgcc

SEQ ID NO: 9552 - DNA, 24 bp, Homo sapiens
caatgagatgatatatatataaag

SEQ ID NO: 9553 - DNA, 22 bp, Homo sapiens
tctttgactaaagccaggtgta

SEQ ID NO: 9554 - DNA, 21 bp, Homo sapiens
aaaatgcagaatccatttctg

SEQ ID NO: 9555 - DNA, 22 bp, Homo sapiens
atcccaggatttataagagctg

SEQ ID NO: 9556 - DNA, 21 bp, Homo sapiens
ctcggcgcgcgcgccgccgcg

SEQ ID NO: 9557 - DNA, 21 bp, Homo sapiens
cgcagcccgccgccgccagcc

SEQ ID NO: 9558 - DNA, 20 bp, Homo sapiens
tgatttacaagctattttga

SEQ ID NO: 9559 - DNA, 22 bp, Homo sapiens
tgaggttcattgttgttatcat

SEQ ID NO: 9560 - DNA, 20 bp, Homo sapiens
atgctatcaggactgccatt

SEQ ID NO: 9561 - DNA, 21 bp, Homo sapiens
tggggattgatgaatacctgg

SEQ ID NO: 9562 - DNA, 22 bp, Homo sapiens
atcatggttttgaaatcacaca

SEQ ID NO: 9563 - DNA, 22 bp, Homo sapiens
accggccccatcgcggatgtcc

SEQ ID NO: 9564 - DNA, 23 bp, Homo sapiens
tgcactcaccgcctcgcaggcgc

SEQ ID NO: 9565 - DNA, 22 bp, Homo sapiens
atgcaggtactgttacaataca

SEQ ID NO: 9566 - DNA, 22 bp, Homo sapiens
tttgactaaaataaatgtggca

SEQ ID NO: 9567 - DNA, 22 bp, Homo sapiens
aacttatgatgagattctgaag

SEQ ID NO: 9568 - DNA, 24 bp, Homo sapiens
ggcccgtgatgagttctctgaggg

SEQ ID NO: 9569 - DNA, 23 bp, Homo sapiens
tagcaccatgctcggcactgtgg

SEQ ID NO: 9570 - DNA, 21 bp, Homo sapiens
cagatttcatatctataaatt

SEQ ID NO: 9571 - DNA, 24 bp, Homo sapiens
gttcataccaagggacagttctca

SEQ ID NO: 9572 - DNA, 24 bp, Homo sapiens
tatatataaactccctttattttt

SEQ ID NO: 9573 - DNA, 22 bp, Homo sapiens
agaatcacatagttccatctca

SEQ ID NO: 9574 - DNA, 20 bp, Homo sapiens
ctgatcagcaccggagtttt

SEQ ID NO: 9575 - DNA, 21 bp, Homo sapiens
ccgtcggtcgggccgccagcc

SEQ ID NO: 9576 - DNA, 20 bp, Homo sapiens
gaagggacaagctattatct

SEQ ID NO: 9577 - DNA, 23 bp, Homo sapiens
gccatatgaagacatgccttgct

SEQ ID NO: 9578 - DNA, 22 bp, Homo sapiens
gggccgcggttccgcgcggcgc

SEQ ID NO: 9579 - DNA, 20 bp, Homo sapiens
tgcacagtgctctgaatgtc

SEQ ID NO: 9580 - DNA, 23 bp, Homo sapiens
actggacttagagtcagaaggca

SEQ ID NO: 9581 - DNA, 22 bp, Homo sapiens
ttgactttttattatacaagtg

SEQ ID NO: 9582 - DNA, 20 bp, Homo sapiens
gcagcggcccccggcgcgcc

SEQ ID NO: 9583 - DNA, 21 bp, Homo sapiens
cacaatcgagcttaggtctga

SEQ ID NO: 9584 - DNA, 22 bp, Homo sapiens
tctgagattaggaccaggacag

SEQ ID NO: 9585 - DNA, 23 bp, Homo sapiens
gaggtgggtaggatgccaggaac

SEQ ID NO: 9586 - DNA, 22 bp, Homo sapiens
tacatgaaaatggatctctgtg

SEQ ID NO: 9587 - DNA, 21 bp, Homo sapiens
ctatagccagcaaatcaagtt

SEQ ID NO: 9588 - DNA, 24 bp, Homo sapiens
gctgatgatgaaagatggtctgaa

SEQ ID NO: 9589 - DNA, 22 bp, Homo sapiens
agtgcagagttgattcaacaga

SEQ ID NO: 9590 - DNA, 22 bp, Homo sapiens
ttgtgagatcagaaatgtttct

SEQ ID NO: 9591 - DNA, 24 bp, Homo sapiens
aaaaatgatgaaactgttctgaat

SEQ ID NO: 9592 - DNA, 22 bp, Homo sapiens
tgctgcaaactcaaatacctac

SEQ ID NO: 9593 - DNA, 23 bp, Homo sapiens
ttacatactgagagacggagtag

SEQ ID NO: 9594 - DNA, 23 bp, Homo sapiens
cgtattatgagtcatctagagat

SEQ ID NO: 9595 - DNA, 23 bp, Homo sapiens
gcacaatgatgattttctgagtg

SEQ ID NO: 9596 - DNA, 20 bp, Homo sapiens
aattcggctcagtctaatcc

SEQ ID NO: 9597 - DNA, 23 bp, Homo sapiens
aacattcaggcgatagccactca

SEQ ID NO: 9598 - DNA, 22 bp, Homo sapiens
cctcctttacactacgccccag

SEQ ID NO: 9599 - DNA, 20 bp, Homo sapiens
gagaaagctcacaagaaagg

SEQ ID NO: 9600 - DNA, 24 bp, Homo sapiens
tttcagcattaccttgggaattag

SEQ ID NO: 9601 - DNA, 22 bp, Homo sapiens
gcgcgcgcgcgtgtgttgtgcg

SEQ ID NO: 9602 - DNA, 21 bp, Homo sapiens
ctgtagacctggccagagaag

SEQ ID NO: 9603 - DNA, 20 bp, Homo sapiens
gccccgggccggtcgcgccg

SEQ ID NO: 9604 - DNA, 20 bp, Homo sapiens
tcttcccggcccatgcacca

SEQ ID NO: 9605 - DNA, 20 bp, Homo sapiens
tggttgccatggtttagggt

SEQ ID NO: 9606 - DNA, 20 bp, Homo sapiens
gtgtaagcagggtcgtttta

SEQ ID NO: 9607 - DNA, 24 bp, Homo sapiens
ttgttccaacctgatcagactttt

SEQ ID NO: 9608 - DNA, 23 bp, Homo sapiens
tacacccgccctgggaagggggc

SEQ ID NO: 9609 - DNA, 24 bp, Homo sapiens
ctcactatgtcccttcagcttcta

SEQ ID NO: 9610 - DNA, 21 bp, Homo sapiens
cccatctccaggtgaagggga

SEQ ID NO: 9611 - DNA, 20 bp, Homo sapiens
atattgaagccctattccaa

SEQ ID NO: 9612 - DNA, 22 bp, Homo sapiens
aattaaaacaggatgctatgaa

SEQ ID NO: 9613 - DNA, 22 bp, Homo sapiens
aacaactaaggactgcaaaacc

SEQ ID NO: 9614 - DNA, 21 bp, Homo sapiens
cggcgcgccgggcccgggtcc

SEQ ID NO: 9615 - DNA, 22 bp, Homo sapiens
agagtttataggcccctgtcac

SEQ ID NO: 9616 - DNA, 21 bp, Homo sapiens
ggtcaatgatgagcacctcca

SEQ ID NO: 9617 - DNA, 21 bp, Homo sapiens
ctgaacgcgcccgatctcgtc

SEQ ID NO: 9618 - DNA, 21 bp, Homo sapiens
aaggatttcgcctctaatcct

SEQ ID NO: 9619 - DNA, 23 bp, Homo sapiens
ggtccagagccccgcctctaacc

SEQ ID NO: 9620 - DNA, 20 bp, Homo sapiens
cggcggccgccgcggggccc

SEQ ID NO: 9621 - DNA, 20 bp, Homo sapiens
aattaaaacaaagcaagcta

SEQ ID NO: 9622 - DNA, 20 bp, Homo sapiens
gtaagcaggaaatgaaaacc

SEQ ID NO: 9623 - DNA, 20 bp, Homo sapiens
aaatattgatgaatacctgt

SEQ ID NO: 9624 - DNA, 23 bp, Homo sapiens
cggcgcgagctcccgggcggggc

SEQ ID NO: 9625 - DNA, 21 bp, Homo sapiens
gagtgacaggttaactctaaa

SEQ ID NO: 9626 - DNA, 22 bp, Homo sapiens
cggcaagccaaggaatgccagg

SEQ ID NO: 9627 - DNA, 24 bp, Homo sapiens
ctcctcctcgccgcggccgccgcc

SEQ ID NO: 9628 - DNA, 24 bp, Homo sapiens
ggcgcgcggcggcggcggcggcgg

SEQ ID NO: 9629 - DNA, 22 bp, Homo sapiens
atcgcagcaaatcaatgggttt

SEQ ID NO: 9630 - DNA, 22 bp, Homo sapiens
tctctcggacaagctgtaggtc

SEQ ID NO: 9631 - DNA, 24 bp, Homo sapiens
ggccaacttcacacccagctgcta

SEQ ID NO: 9632 - DNA, 20 bp, Homo sapiens
cggccccgcgggggtcggac

SEQ ID NO: 9633 - DNA, 24 bp, Homo sapiens
acgggcatctgccacactctaaaa

SEQ ID NO: 9634 - DNA, 22 bp, Homo sapiens
caggcggcgctcgccggcgcgg

SEQ ID NO: 9635 - DNA, 24 bp, Homo sapiens
actctattctacagcataatttta

SEQ ID NO: 9636 - DNA, 23 bp, Homo sapiens
gcttgttgcccagggcacacagg

SEQ ID NO: 9637 - DNA, 20 bp, Homo sapiens
agtcagaggaggagaagaaa

SEQ ID NO: 9638 - DNA, 22 bp, Homo sapiens
cgtaattagcccatagggattg

SEQ ID NO: 9639 - DNA, 24 bp, Homo sapiens
aattaagttagatccgagactgcg

SEQ ID NO: 9640 - DNA, 21 bp, Homo sapiens
acaatagaggattttcatatg

SEQ ID NO: 9641 - DNA, 21 bp, Homo sapiens
tcactcacctggccagagaac

SEQ ID NO: 9642 - DNA, 21 bp, Homo sapiens
gcgtatgaattgtctggagat

SEQ ID NO: 9643 - DNA, 21 bp, Homo sapiens
cagtgaaatacaaaacctggc

SEQ ID NO: 9644 - DNA, 21 bp, Homo sapiens
ttgggttttaagtgggaggtg

SEQ ID NO: 9645 - DNA, 24 bp, Homo sapiens
tggcagcttcggaaaggactaatg

SEQ ID NO: 9646 - DNA, 20 bp, Homo sapiens
agtgcacttggacgaaccaa

SEQ ID NO: 9647 - DNA, 24 bp, Homo sapiens
gttccatgatacttcttgctcttt

SEQ ID NO: 9648 - DNA, 24 bp, Homo sapiens
cggggcgggggcgcctcgggcgcg

SEQ ID NO: 9649 - DNA, 20 bp, Homo sapiens
actgaaaaggcttatgacaa

SEQ ID NO: 9650 - DNA, 22 bp, Homo sapiens
actggacttggagccagaaggc

SEQ ID NO: 9651 - DNA, 24 bp, Homo sapiens
tccatatgatgactcccgtttctg

SEQ ID NO: 9652 - DNA, 24 bp, Homo sapiens
cgtcgccgccgccgccagccgccc

SEQ ID NO: 9653 - DNA, 23 bp, Homo sapiens
gggggcccaagtccttctgatcg

SEQ ID NO: 9654 - DNA, 23 bp, Homo sapiens
caggtctccatccacacacaaag

SEQ ID NO: 9655 - DNA, 20 bp, Homo sapiens
cttctgctcgaggccccgcc

SEQ ID NO: 9656 - DNA, 22 bp, Homo sapiens
tacagatgtgtgataactgact

SEQ ID NO: 9657 - DNA, 22 bp, Homo sapiens
ttctgttgcccaggtagtagtg

SEQ ID NO: 9658 - DNA, 22 bp, Homo sapiens
ccaagcgttcaattctcatcta

SEQ ID NO: 9659 - DNA, 23 bp, Homo sapiens
tatgatactgagtcttaagcatt

SEQ ID NO: 9660 - DNA, 21 bp, Homo sapiens
ataaaaagcattagttaatag

SEQ ID NO: 9661 - DNA, 21 bp, Homo sapiens
cataatgatgtggacctgact

SEQ ID NO: 9662 - DNA, 23 bp, Homo sapiens
tctctattcctccctttattttt

SEQ ID NO: 9663 - DNA, 20 bp, Homo sapiens
ctgggagacccgacgcaccc

SEQ ID NO: 9664 - DNA, 23 bp, Homo sapiens
agaattgtggctggaaatctgaa

SEQ ID NO: 9665 - DNA, 20 bp, Homo sapiens
agggcgcgcggggcggggcg

SEQ ID NO: 9666 - DNA, 20 bp, Homo sapiens
acactactgtgaacatgggt

SEQ ID NO: 9667 - DNA, 24 bp, Homo sapiens
gcggcggcggcggcgcgcgggggg

SEQ ID NO: 9668 - DNA, 24 bp, Homo sapiens
cgggaggggggtaggggggataaa

SEQ ID NO: 9669 - DNA, 24 bp, Homo sapiens
ggagctttgtgcccctctcgaggc

SEQ ID NO: 9670 - DNA, 22 bp, Homo sapiens
aggcggaggaggggccgcgggc

SEQ ID NO: 9671 - DNA, 20 bp, Homo sapiens
cccctccccgtgggagcgcc

SEQ ID NO: 9672 - DNA, 20 bp, Homo sapiens
cggcgcgcgcgccggccgag

SEQ ID NO: 9673 - DNA, 23 bp, Homo sapiens
tccccagttataaaacggcgggt

SEQ ID NO: 9674 - DNA, 22 bp, Homo sapiens
ttcctgtgatgagactgaggcc

SEQ ID NO: 9675 - DNA, 21 bp, Homo sapiens
cggccccgcagggctcggccc

SEQ ID NO: 9676 - DNA, 20 bp, Homo sapiens
aagcgatccctttctgattt

SEQ ID NO: 9677 - DNA, 21 bp, Homo sapiens
tattttctgcattctccctgg

SEQ ID NO: 9678 - DNA, 20 bp, Homo sapiens
tggtgtggtctgttgttttc

SEQ ID NO: 9679 - DNA, 24 bp, Homo sapiens
gagcagtgatgtgagctgagctct

SEQ ID NO: 9680 - DNA, 21 bp, Homo sapiens
agcatggaggaaattccatgt

SEQ ID NO: 9681 - DNA, 20 bp, Homo sapiens
taaatgagaccctagtatgt

SEQ ID NO: 9682 - DNA, 23 bp, Homo sapiens
cccacgcctagccctttaaaaaa

SEQ ID NO: 9683 - DNA, 21 bp, Homo sapiens
gcgggccaggggaatccggct

SEQ ID NO: 9684 - DNA, 21 bp, Homo sapiens
agtgcaaactgactacagctg

SEQ ID NO: 9685 - DNA, 22 bp, Homo sapiens
tctccatctgggattgaatgtc

SEQ ID NO: 9686 - DNA, 23 bp, Homo sapiens
gctgatgatgaaagattctgagg

SEQ ID NO: 9687 - DNA, 23 bp, Homo sapiens
tggtatactgtctcttaagtgct

SEQ ID NO: 9688 - DNA, 23 bp, Homo sapiens
cctaacttattttaggaagccaa

SEQ ID NO: 9689 - DNA, 20 bp, Homo sapiens
tttacttgaccactctgacc

SEQ ID NO: 9690 - DNA, 20 bp, Homo sapiens
ccccagctgcggcgggcggc

SEQ ID NO: 9691 - DNA, 21 bp, Homo sapiens
ttaactgtccaatcagagaat

SEQ ID NO: 9692 - DNA, 21 bp, Homo sapiens
cagatcccagacgagccccca

SEQ ID NO: 9693 - DNA, 22 bp, Homo sapiens
tatgtggttttgaaatcggggt

SEQ ID NO: 9694 - DNA, 22 bp, Homo sapiens
gcccctgggcctatccgcccac

SEQ ID NO: 9695 - DNA, 21 bp, Homo sapiens
gaacagcctctggcatcttgg

SEQ ID NO: 9696 - DNA, 24 bp, Homo sapiens
gcagtgggaacaggtgttgtcttc

SEQ ID NO: 9697 - DNA, 24 bp, Homo sapiens
ggttcattattgcaggggtgagct

SEQ ID NO: 9698 - DNA, 20 bp, Homo sapiens
agggcgaggaactggtcacg

SEQ ID NO: 9699 - DNA, 20 bp, Homo sapiens
ccgcgatcccccctcagccc

SEQ ID NO: 9700 - DNA, 21 bp, Homo sapiens
atgccaggattttataaagcc

SEQ ID NO: 9701 - DNA, 23 bp, Homo sapiens
cttggcggatctttcccgcaaag

SEQ ID NO: 9702 - DNA, 20 bp, Homo sapiens
tacttacatgttgtccgtag

SEQ ID NO: 9703 - DNA, 20 bp, Homo sapiens
ataaccgcagcattgagaac

SEQ ID NO: 9704 - DNA, 22 bp, Homo sapiens
acagcatcaccttgggaatact

SEQ ID NO: 9705 - DNA, 21 bp, Homo sapiens
tggaattgcatatgtgcaatt

SEQ ID NO: 9706 - DNA, 22 bp, Homo sapiens
tgatgagatctggctctgagcc

SEQ ID NO: 9707 - DNA, 22 bp, Homo sapiens
aattaaaacacctaattatagg

SEQ ID NO: 9708 - DNA, 24 bp, Homo sapiens
ggtccactccagaacaccactgtc

SEQ ID NO: 9709 - DNA, 21 bp, Homo sapiens
tcacctggcccggacacgggc

SEQ ID NO: 9710 - DNA, 20 bp, Homo sapiens
cccacccccgcgcccggctt

SEQ ID NO: 9711 - DNA, 22 bp, Homo sapiens
tgaggtgactcaccacacaacc

SEQ ID NO: 9712 - DNA, 20 bp, Homo sapiens
ctgatcagcaccggagttat

SEQ ID NO: 9713 - DNA, 20 bp, Homo sapiens
cgcgcagtcgggcccggggg

SEQ ID NO: 9714 - DNA, 20 bp, Homo sapiens
tggcggccaaatacctgccc

SEQ ID NO: 9715 - DNA, 23 bp, Homo sapiens
agcatagaacattgagcctagac

SEQ ID NO: 9716 - DNA, 20 bp, Homo sapiens
tacttacatattgaggcatt

SEQ ID NO: 9717 - DNA, 23 bp, Homo sapiens
agcattcaacatgtgacctgagt

SEQ ID NO: 9718 - DNA, 23 bp, Homo sapiens
agattgatgagtacctgggtata

SEQ ID NO: 9719 - DNA, 24 bp, Homo sapiens
actctagtgcacagcataattttg

SEQ ID NO: 9720 - DNA, 24 bp, Homo sapiens
ggagagggtgtttcctctatatta

SEQ ID NO: 9721 - DNA, 21 bp, Homo sapiens
aggttgtgatgtctctgaacc

SEQ ID NO: 9722 - DNA, 23 bp, Homo sapiens
cggagaggctaccaccttggagg

SEQ ID NO: 9723 - DNA, 23 bp, Homo sapiens
cataattggaaataccaccgaga

SEQ ID NO: 9724 - DNA, 24 bp, Homo sapiens
gcccggcccttcttttttattttt

SEQ ID NO: 9725 - DNA, 20 bp, Homo sapiens
tgggcgcgcgccgcggccgg

SEQ ID NO: 9726 - DNA, 24 bp, Homo sapiens
gaaaaagtcacttcttccattttt

SEQ ID NO: 9727 - DNA, 24 bp, Homo sapiens
cggctcggggcggcggcggcggcg

SEQ ID NO: 9728 - DNA, 22 bp, Homo sapiens
agttctttatatgtaaaataat

SEQ ID NO: 9729 - DNA, 22 bp, Homo sapiens
atctgtcatctgaaatattgat

SEQ ID NO: 9730 - DNA, 20 bp, Homo sapiens
gcgggggcggcgcgcgcgcg

SEQ ID NO: 9731 - DNA, 24 bp, Homo sapiens
aataggcagcaggctggacttggc

SEQ ID NO: 9732 - DNA, 20 bp, Homo sapiens
ttggggaccagcctcatcac

SEQ ID NO: 9733 - DNA, 23 bp, Homo sapiens
tgataactgaattccaagggtta

SEQ ID NO: 9734 - DNA, 24 bp, Homo sapiens
tgggataagctcccttataaaaaa

SEQ ID NO: 9735 - DNA, 24 bp, Homo sapiens
gcagatattatcttttaatattta

SEQ ID NO: 9736 - DNA, 24 bp, Homo sapiens
cctggttgatgagatttctgacag

SEQ ID NO: 9737 - DNA, 21 bp, Homo sapiens
atcatggaggaaaatcatatt

SEQ ID NO: 9738 - DNA, 23 bp, Homo sapiens
aatattgataaatcaagttttat

SEQ ID NO: 9739 - DNA, 22 bp, Homo sapiens
atgccaggatggaaggaagcca

SEQ ID NO: 9740 - DNA, 21 bp, Homo sapiens
tgcaggctctatattaaatta

SEQ ID NO: 9741 - DNA, 23 bp, Homo sapiens
gagctgagtgcccacacatgtgt

SEQ ID NO: 9742 - DNA, 21 bp, Homo sapiens
ccagaatgtataacaaatgcc

SEQ ID NO: 9743 - DNA, 24 bp, Homo sapiens
ggcagtgatgattggcctgagcct

SEQ ID NO: 9744 - DNA, 24 bp, Homo sapiens
gtggcggcggcggcgggggcggcg

SEQ ID NO: 9745 - DNA, 24 bp, Homo sapiens
cttgcaggagccagctccgacctg

SEQ ID NO: 9746 - DNA, 24 bp, Homo sapiens
tggctgagctgagaaccactgtgc

SEQ ID NO: 9747 - DNA, 21 bp, Homo sapiens
catattaatatattttttttg

SEQ ID NO: 9748 - DNA, 20 bp, Homo sapiens
ctaagaatcaccagctgata

SEQ ID NO: 9749 - DNA, 20 bp, Homo sapiens
cgtaacttgccctatgagat

SEQ ID NO: 9750 - DNA, 20 bp, Homo sapiens
cggcggcgggagaacgaaat

SEQ ID NO: 9751 - DNA, 21 bp, Homo sapiens
gctgatgaggtcaacataagt

SEQ ID NO: 9752 - DNA, 20 bp, Homo sapiens
acctagttttagtgttgtga

SEQ ID NO: 9753 - DNA, 22 bp, Homo sapiens
ctcggcctttgctcgcagcact

SEQ ID NO: 9754 - DNA, 23 bp, Homo sapiens
ttaataaaggtcaaaataaacag

SEQ ID NO: 9755 - DNA, 23 bp, Homo sapiens
accggactgggagtcagaaggct

SEQ ID NO: 9756 - DNA, 20 bp, Homo sapiens
cgtgagccaccacgttcaat

SEQ ID NO: 9757 - DNA, 21 bp, Homo sapiens
tctttggttatcttcgactgc

SEQ ID NO: 9758 - DNA, 24 bp, Homo sapiens
gcttctaatagttcttggtgtttg

SEQ ID NO: 9759 - DNA, 22 bp, Homo sapiens
cctgaatgtacttagcactact

SEQ ID NO: 9760 - DNA, 23 bp, Homo sapiens
agaagcattgtacatttgataca

SEQ ID NO: 9761 - DNA, 24 bp, Homo sapiens
cccggccagcttttaaataaaaaa

SEQ ID NO: 9762 - DNA, 24 bp, Homo sapiens
gggcggcggcggccggcgggcggc

SEQ ID NO: 9763 - DNA, 23 bp, Homo sapiens
acatgatgaaacttcggctcact

SEQ ID NO: 9764 - DNA, 23 bp, Homo sapiens
cggcgggcagatcactcgagacc

SEQ ID NO: 9765 - DNA, 24 bp, Homo sapiens
gctgccctgcagatgctgtcctgg

SEQ ID NO: 9766 - DNA, 20 bp, Homo sapiens
atgaagaacgcagctagctg

SEQ ID NO: 9767 - DNA, 21 bp, Homo sapiens
aacatggaggaagttcctgaa

SEQ ID NO: 9768 - DNA, 23 bp, Homo sapiens
cagtgagggtcttgtaacaggga

SEQ ID NO: 9769 - DNA, 20 bp, Homo sapiens
tcctggatttgcggaagcca

SEQ ID NO: 9770 - DNA, 21 bp, Homo sapiens
tagcccaagccaaaagccaaa

SEQ ID NO: 9771 - DNA, 24 bp, Homo sapiens
ctccaatgatgccaggctgaggat

SEQ ID NO: 9772 - DNA, 22 bp, Homo sapiens
tggaatcccacttctgacacca

SEQ ID NO: 9773 - DNA, 21 bp, Homo sapiens
aagcaggattccctctgtaac

SEQ ID NO: 9774 - DNA, 23 bp, Homo sapiens
tccatatgagagacacgctgtag

SEQ ID NO: 9775 - DNA, 24 bp, Homo sapiens
cgggcggcggcggcgggcggcggg

SEQ ID NO: 9776 - DNA, 20 bp, Homo sapiens
cccaccccccgccccccgaa

SEQ ID NO: 9777 - DNA, 24 bp, Homo sapiens
tattattattattttgtgtgtggg

SEQ ID NO: 9778 - DNA, 22 bp, Homo sapiens
caaccccgggctgatcactact

SEQ ID NO: 9779 - DNA, 20 bp, Homo sapiens
ccccgcgcgcgggggagggc

SEQ ID NO: 9780 - DNA, 23 bp, Homo sapiens
gcttaagacaataaacatgttat

SEQ ID NO: 9781 - DNA, 23 bp, Homo sapiens
gagttagcggggagtgatatatt

SEQ ID NO: 9782 - DNA, 20 bp, Homo sapiens
cgggatgacaatccataatc

SEQ ID NO: 9783 - DNA, 21 bp, Homo sapiens
atcgcgtgcacaccccccaga

SEQ ID NO: 9784 - DNA, 21 bp, Homo sapiens
agcagcatcagcagcccctga

SEQ ID NO: 9785 - DNA, 23 bp, Homo sapiens
attaaaaaaaattttcgcccggc

SEQ ID NO: 9786 - DNA, 22 bp, Homo sapiens
gcgggcgtcgcggccgggggcg

SEQ ID NO: 9787 - DNA, 24 bp, Homo sapiens
acttttaatcaaacccagtcctgg

SEQ ID NO: 9788 - DNA, 20 bp, Homo sapiens
cctgagcagcattagccagc

SEQ ID NO: 9789 - DNA, 23 bp, Homo sapiens
gccatgatgctagactcctgagc

SEQ ID NO: 9790 - DNA, 20 bp, Homo sapiens
agcattggactgtagcacca

SEQ ID NO: 9791 - DNA, 21 bp, Homo sapiens
caaaagagacctttgaaggcc

SEQ ID NO: 9792 - DNA, 22 bp, Homo sapiens
tggaatgtaacaggacatgtat

SEQ ID NO: 9793 - DNA, 23 bp, Homo sapiens
actagacttggagtcagaaggct

SEQ ID NO: 9794 - DNA, 21 bp, Homo sapiens
ggggggccggcggcggcggcg

SEQ ID NO: 9795 - DNA, 20 bp, Homo sapiens
agtaacggagcccggagggc

SEQ ID NO: 9796 - DNA, 20 bp, Homo sapiens
cgccaccggagccccgcgga

SEQ ID NO: 9797 - DNA, 20 bp, Homo sapiens
cttcccgaccttcgccccag

SEQ ID NO: 9798 - DNA, 21 bp, Homo sapiens
actgagacttggccagagaaa

SEQ ID NO: 9799 - DNA, 20 bp, Homo sapiens
tactcttctacatttggatt

SEQ ID NO: 9800 - DNA, 24 bp, Homo sapiens
atcagcgtgcacttccccaccctg

SEQ ID NO: 9801 - DNA, 21 bp, Homo sapiens
tccgccgcccggccccgcgtc

SEQ ID NO: 9802 - DNA, 23 bp, Homo sapiens
agacgagaccaagctgagggaag

SEQ ID NO: 9803 - DNA, 22 bp, Homo sapiens
ttaagtacattaacaggcatgg

SEQ ID NO: 9804 - DNA, 20 bp, Homo sapiens
tgaagcattggactgtaaaa

SEQ ID NO: 9805 - DNA, 21 bp, Homo sapiens
ataataatagtctcaagtatg

SEQ ID NO: 9806 - DNA, 22 bp, Homo sapiens
ttgtagacagagagtaaaaaat

SEQ ID NO: 9807 - DNA, 20 bp, Homo sapiens
catcatttctaattagctag

SEQ ID NO: 9808 - DNA, 22 bp, Homo sapiens
aagatatttgcccattattttt

SEQ ID NO: 9809 - DNA, 20 bp, Homo sapiens
ggaacatgtacctcattgag

SEQ ID NO: 9810 - DNA, 24 bp, Homo sapiens
tgtggcgccaacgcctcggacggc

SEQ ID NO: 9811 - DNA, 20 bp, Homo sapiens
cctcggttgccctcggccga

SEQ ID NO: 9812 - DNA, 23 bp, Homo sapiens
acctctgaccttggcctcccaga

SEQ ID NO: 9813 - DNA, 20 bp, Homo sapiens
ggccggtgatgacgctgagc

SEQ ID NO: 9814 - DNA, 22 bp, Homo sapiens
tctgctcctggctggctcgcca

SEQ ID NO: 9815 - DNA, 21 bp, Homo sapiens
tattattattgagacagtata

SEQ ID NO: 9816 - DNA, 21 bp, Homo sapiens
acccaagaacagggtgctggg

SEQ ID NO: 9817 - DNA, 20 bp, Homo sapiens
tcctcccagcggtgcctcca

SEQ ID NO: 9818 - DNA, 24 bp, Homo sapiens
aaacatgagatcttatgatatact

SEQ ID NO: 9819 - DNA, 23 bp, Homo sapiens
tttactgttgctactattactag

SEQ ID NO: 9820 - DNA, 20 bp, Homo sapiens
ctgcactacagaactttgaa

SEQ ID NO: 9821 - DNA, 23 bp, Homo sapiens
ccgcccccggggaggggccgtcc

SEQ ID NO: 9822 - DNA, 20 bp, Homo sapiens
tggtcaaaataggccatttc

SEQ ID NO: 9823 - DNA, 24 bp, Homo sapiens
acccctatgatgatataaagctga

SEQ ID NO: 9824 - DNA, 24 bp, Homo sapiens
gttggctatatataagataagatt

SEQ ID NO: 9825 - DNA, 24 bp, Homo sapiens
cttatcagagatcatatttaattt

SEQ ID NO: 9826 - DNA, 20 bp, Homo sapiens
atgagatggtatatatatga

SEQ ID NO: 9827 - DNA, 24 bp, Homo sapiens
ggccggcggcgggcgccgcggggc

SEQ ID NO: 9828 - DNA, 23 bp, Homo sapiens
gttccggattacaggcgtgagcc

SEQ ID NO: 9829 - DNA, 24 bp, Homo sapiens
gtcctgggaggaggagggggcaga

SEQ ID NO: 9830 - DNA, 22 bp, Homo sapiens
tagccaaggctctttagccaat

SEQ ID NO: 9831 - DNA, 20 bp, Homo sapiens
gaagggtatttggcttgtct

SEQ ID NO: 9832 - DNA, 23 bp, Homo sapiens
gctccccctcctcccccctcccc

SEQ ID NO: 9833 - DNA, 22 bp, Homo sapiens
cctcggccgcgccgccgccgcc

SEQ ID NO: 9834 - DNA, 21 bp, Homo sapiens
aacatagctcaggctacttga

SEQ ID NO: 9835 - DNA, 24 bp, Homo sapiens
ccataggcaggcaggcaggcagga

SEQ ID NO: 9836 - DNA, 20 bp, Homo sapiens
cctgcccggagggggcgggc

SEQ ID NO: 9837 - DNA, 21 bp, Homo sapiens
atgtacccagtcagccaggcc

SEQ ID NO: 9838 - DNA, 22 bp, Homo sapiens
ctgaatgatgagggctctgaga

SEQ ID NO: 9839 - DNA, 22 bp, Homo sapiens
tcctgctgatgacttctgaagg

SEQ ID NO: 9840 - DNA, 20 bp, Homo sapiens
aggcgaatgaatgaatgaag

SEQ ID NO: 9841 - DNA, 23 bp, Homo sapiens
tttaataagctcccttcccccca

SEQ ID NO: 9842 - DNA, 22 bp, Homo sapiens
tagctgagcatgatggtacacg

SEQ ID NO: 9843 - DNA, 20 bp, Homo sapiens
acgaagcccctttctgattt

SEQ ID NO: 9844 - DNA, 23 bp, Homo sapiens
cccagcggatattttttattttt

SEQ ID NO: 9845 - DNA, 24 bp, Homo sapiens
cccgaggggccggcggcggcggcg

SEQ ID NO: 9846 - DNA, 22 bp, Homo sapiens
ccaggtcctaagataagagcca

SEQ ID NO: 9847 - DNA, 21 bp, Homo sapiens
cgagccttgtctccctgcagg

SEQ ID NO: 9848 - DNA, 24 bp, Homo sapiens
cctctcccacattttctcgtatgc

SEQ ID NO: 9849 - DNA, 23 bp, Homo sapiens
ggaaatctggcagcacagacagg

SEQ ID NO: 9850 - DNA, 23 bp, Homo sapiens
caggtctcacagctgaacaggga

SEQ ID NO: 9851 - DNA, 24 bp, Homo sapiens
tccgtaaaggattttattcctcct

SEQ ID NO: 9852 - DNA, 24 bp, Homo sapiens
caacatgagatgcatatatatcct

SEQ ID NO: 9853 - DNA, 20 bp, Homo sapiens
gcccagtgctctgaagggga

SEQ ID NO: 9854 - DNA, 22 bp, Homo sapiens
aggtcctcaataagtatttgtt

SEQ ID NO: 9855 - DNA, 20 bp, Homo sapiens
ctagctagttccctcagccc

SEQ ID NO: 9856 - DNA, 21 bp, Homo sapiens
acaacaaacatgtgccactga

SEQ ID NO: 9857 - DNA, 21 bp, Homo sapiens
ctgttacaatccaggccaact

SEQ ID NO: 9858 - DNA, 24 bp, Homo sapiens
ttgctgtgatgttaacctgagcag

SEQ ID NO: 9859 - DNA, 24 bp, Homo sapiens
gtgatgacctcagacctgaggccc

SEQ ID NO: 9860 - DNA, 22 bp, Homo sapiens
gttgcttaccagaagttcaaat

SEQ ID NO: 9861 - DNA, 22 bp, Homo sapiens
cagttcaatggtgttcagcaga

SEQ ID NO: 9862 - DNA, 24 bp, Homo sapiens
aaagcaggattcagactacaatat

SEQ ID NO: 9863 - DNA, 20 bp, Homo sapiens
accagctttggggggttcag

SEQ ID NO: 9864 - DNA, 20 bp, Homo sapiens
atcccaccgctgccaaaagg

SEQ ID NO: 9865 - DNA, 23 bp, Homo sapiens
attgaaggctaattagcagtata

SEQ ID NO: 9866 - DNA, 22 bp, Homo sapiens
gttctctataggaagccatagc

SEQ ID NO: 9867 - DNA, 20 bp, Homo sapiens
cctcacacggggcaccaatt

SEQ ID NO: 9868 - DNA, 24 bp, Homo sapiens
tgcatccactgatagaccttgaac

SEQ ID NO: 9869 - DNA, 22 bp, Homo sapiens
caaccatagacagtcacacaca

SEQ ID NO: 9870 - DNA, 21 bp, Homo sapiens
agacctacttatctaccaaca

SEQ ID NO: 9871 - DNA, 22 bp, Homo sapiens
aaggtagatagaacaggtcttg

SEQ ID NO: 9872 - DNA, 22 bp, Homo sapiens
tgtcactcttgtgtgttgcaga

SEQ ID NO: 9873 - DNA, 21 bp, Homo sapiens
tgacctgtgctttttcccggt

SEQ ID NO: 9874 - DNA, 24 bp, Homo sapiens
tccctgtcctccaggagctcaccc

SEQ ID NO: 9875 - DNA, 20 bp, Homo sapiens
ttggctgatgaatactgact

SEQ ID NO: 9876 - DNA, 21 bp, Homo sapiens
tgcccggcctcggaaccagct

SEQ ID NO: 9877 - DNA, 20 bp, Homo sapiens
tgcctgtctgagcgtcgctt

SEQ ID NO: 9878 - DNA, 71 bp, Homo sapiens
cagaaggtcagacgtcactggtggccccccagcctcctcagcagggatgccccagggccagcacagccctc

SEQ ID NO: 9879 - DNA, 71 bp, Homo sapiens
gccctgggccacgcccctgtgacgcgggagcccccagactcctcctgtggggaaggagacagggaccgaga

SEQ ID NO: 9880 - DNA, 73 bp, Homo sapiens
tggcaggggggaaaggctgcacctcacacctctctgggtgcagagcggctccgggacggctcccctctcctgc

SEQ ID NO: 9881 - DNA, 73 bp, Homo sapiens
gccgtcatcattaccaggcagtattagagacctgactccatccaatgctgcccagtaagatggccacggctgc

SEQ ID NO: 9882 - DNA, 73 bp, Homo sapiens
cgggaggcttccacagtgctctctggagatgccagtcagtgcctgagagcccggagggcgagggggcagccgg

SEQ ID NO: 9883 - DNA, 73 bp, Homo sapiens
ctcggagacaggtttcaatctgaaagtcgtcctggtcagtttcaagcagtgtctcgatgagaaggaagaggtc

SEQ ID NO: 9884 - DNA, 71 bp, Homo sapiens
gggaatagtctctggagggaagcatccccaagttggacctcagaattgtctccgataacagctgacaatta

SEQ ID NO: 9885 - DNA, 73 bp, Homo sapiens
gacaagtgacttctgtttctaagttagtgaatggccagtctgacctagtgaagtgtcactcagcccagtgagg

SEQ ID NO: 9886 - DNA, 72 bp, Homo sapiens
ggcggcgggggggttggatcacaaggtcaggagttcgagaatagtctgaccaacaggtgaaactccatctct

SEQ ID NO: 9887 - DNA, 70 bp, Homo sapiens
gaacgaggctgaagaggacgcggacggaggagccccggaacctggctgccactgcgccccgaggtggagc

SEQ ID NO: 9888 - DNA, 71 bp, Homo sapiens
ctcttgtccagttttcccgagcacccctgagcagcctggcctgccatgtccgggagaagacagtgagtact

SEQ ID NO: 9889 - DNA, 73 bp, Homo sapiens
ccccttgtcttcggggttagaaaaatgacagtgaaagaaatgcgtcaaaataggctggatcacaggggtgcga

SEQ ID NO: 9890 - DNA, 71 bp, Homo sapiens
tcaccgtgtggcgtcccggtagtgtgtgggaccccagaggcgtccggggcctccccgctgtgtggtgtccc

SEQ ID NO: 9891 - DNA, 74 bp, Homo sapiens
agatccagaggcggcctgcaccccagggggacaccacccacggcacaggagcctcctggaggcagcaggtagga

SEQ ID NO: 9892 - DNA, 70 bp, Homo sapiens
tacatgtgcacgagcgcacgtgtttgcatgtatgtgtgtgcatgtataatgtgtgtacatgtgtgcatgt

SEQ ID NO: 9893 - DNA, 72 bp, Homo sapiens
gggaggaggaccctgagctcccagagcccactggctgaggtcctgtcaggctcatggggcttccagcggcag

SEQ ID NO: 9894 - DNA, 72 bp, Homo sapiens
ggtcccgcgggagcgccgcgtggggccctcaaaagagaggctttctcgccccctgccggcgcgtggtgggac

SEQ ID NO: 9895 - DNA, 70 bp, Homo sapiens
taaggtaaagggaggtcattaggacgggccctaatccaataggacgggtgcccttagaagatgaggatgc

SEQ ID NO: 9896 - DNA, 70 bp, Homo sapiens
cccggagcagcccgcgttagaacaggatcccgacggatcccgtgctgcctccccttcagccagcgccatc

SEQ ID NO: 9897 - DNA, 73 bp, Homo sapiens
gcatggtatgaatagatcccaggttgtctatccactgtcctaggcatgggcgttttgggttgtatcagatgtg

SEQ ID NO: 9898 - DNA, 71 bp, Homo sapiens
ggggaccaggctgaggaggggttctgcagaggtgctgggtctccccagagttctgagctgggtgccagcag

SEQ ID NO: 9899 - DNA, 71 bp, Homo sapiens
gtgttcacagcaggcagaagcccactggtatgggcctcccgccccttccacatccatgttgtgattggatc

SEQ ID NO: 9900 - DNA, 74 bp, Homo sapiens
aaaggtatttttgattcatctataaagtgttcatcagctacatttgagtagctaaatcataggccctttttgga

SEQ ID NO: 9901 - DNA, 72 bp, Homo sapiens
cagaaaggccacttcctgcaagcagccttccttgatcctgagctgggatcaggtgctcggggttcattttct

SEQ ID NO: 9902 - DNA, 72 bp, Homo sapiens
atgggagtccttggagagctggggcccaaaggggggtggccacaggtccagagggcccaggggcttttgaca

SEQ ID NO: 9903 - DNA, 74 bp, Homo sapiens
attggatctgtaaaggctttatttccaaataaggtcacattcatgggctctagatggacatggactgtgggggg

SEQ ID NO: 9904 - DNA, 72 bp, Homo sapiens
tttgccaaaggtcactgacctgaatccaggattccgaattaaataccattggaaagtcagtgtttcagccac

SEQ ID NO: 9905 - DNA, 70 bp, Homo sapiens
aagtaatttgctcaaggtcgcatagctcagtaatggcagaactggggctcaaaccagacaatgagttcaa

SEQ ID NO: 9906 - DNA, 71 bp, Homo sapiens
gaagaactggccttcaccctgtagtaggctgccctgattcttcagttgtgccttggtgtggacgaggaccc

SEQ ID NO: 9907 - DNA, 72 bp, Homo sapiens
atctacaggtaagatcacaagtcccctgtgtggctttcactgcccttgacaatctgacacacttatctgcaa

SEQ ID NO: 9908 - DNA, 73 bp, Homo sapiens
tgccctagctgcgactttcagcacactgcctatcctatgggacagccttagtctgatggagcagtcacagagc

SEQ ID NO: 9909 - DNA, 72 bp, Homo sapiens
tcattgtgaacttaaactgctggggatatgtcggtgaacataatccatgcagtctggtctcactgcgagcac

SEQ ID NO: 9910 - DNA, 72 bp, Homo sapiens
ccatcctggggcccagccctgagagccgagtccacagaatccacttccaagtcggcctgttccctgggattc

SEQ ID NO: 9911 - DNA, 70 bp, Homo sapiens
aggagtctcccagcagctggcctttggctcagaatcccagtccctgccatctgccatcggatcctccagt

SEQ ID NO: 9912 - DNA, 71 bp, Homo sapiens
tccatgggatgtatacatttaaaaagtcagactgctgtatacctggatgtcaaatcccaggaatcctgtgt

SEQ ID NO: 9913 - DNA, 74 bp, Homo sapiens
cgtgaagcagcaaaggatgaaatataggtacgggggcacacagctttgcagggtgggggctgacctcccggcct

SEQ ID NO: 9914 - DNA, 72 bp, Homo sapiens
gaaccctaaaatgacgtaatgcctgtcggagccaccacggtggtttcaggtctccagccctcccattgttag

SEQ ID NO: 9915 - DNA, 73 bp, Homo sapiens
ggtccgtcggttgggcctcacaggcctggggcggacatagctatcccatggtgatgggtgaggccaggccctg

SEQ ID NO: 9916 - DNA, 73 bp, Homo sapiens
tctgagttatcagccacgtaccatcgacatcggcagtaacaattagaatagcctcagcatggtggctcaggcc

SEQ ID NO: 9917 - DNA, 73 bp, Homo sapiens
tcttccgactctgtcgcccaagctggagtgcagtggcatgatctcggctcactgcaagctctgcctcctgggt

SEQ ID NO: 9918 - DNA, 72 bp, Homo sapiens
tggagctggacttcaatacctgttaggagctactatctctaagatataggcttttgggtctcctactcaaag

SEQ ID NO: 9919 - DNA, 74 bp, Homo sapiens
actcaggacacagagtcactcccaaagagccacgtggcacccccctcgcggctctccctgctccactgtgggtc

SEQ ID NO: 9920 - DNA, 70 bp, Homo sapiens
gttatgcatgtagatgtccagttttcccagcaaaacttactgaaaagactgccctttccccagtgtgtat

SEQ ID NO: 9921 - DNA, 72 bp, Homo sapiens
caagacagcggccgcagaggagcacccgctgacctgctccgaggactcagtgacatgggcagtctgtgtggt

SEQ ID NO: 9922 - DNA, 73 bp, Homo sapiens
ctcatgctgctttcttgaggttcatctggtgctctgaggcgctatttgacctccactctgtgctgctgctggg

SEQ ID NO: 9923 - DNA, 73 bp, Homo sapiens
cagcgcgagctgccgcctgcggggcccgaagccgcccgcgtcgcgtagcgtcactcacattttggcagctgcg

SEQ ID NO: 9924 - DNA, 71 bp, Homo sapiens
acacataatactgcctggtaagcatttgctgacatcactgaattggggaaggtgttgttgaaaaggtagaa

SEQ ID NO: 9925 - DNA, 72 bp, Homo sapiens
ttcttcagtgattcataatcagttttgcaatttgaaagcagtttatgagtcattcagtttatgaatttgttg

SEQ ID NO: 9926 - DNA, 72 bp, Homo sapiens
caatagcacatctggactggcagcaaggaaccttgccctgcagggcccgtccgtccgtccatccgtccgtcc

SEQ ID NO: 9927 - DNA, 73 bp, Homo sapiens
ggtggttggaggtgatgaactgtttgcagaagtggatgcgtttaagagacagggtcgtcattgctgccctgat

SEQ ID NO: 9928 - DNA, 72 bp, Homo sapiens
gaccttgggatgtagctcttgccaaaaacatggtcacacacgagccaggggcagaggagctgcatttatcaa

SEQ ID NO: 9929 - DNA, 73 bp, Homo sapiens
tagctcatgttgataactgcactgcatggagttcattctgctccaagcaatgccatgtgaggctatgaagatc

SEQ ID NO: 9930 - DNA, 71 bp, Homo sapiens
ctccgctcctcgacgagatgaggaatgtggaatttactgaaccataaactatgccgggggagctggggagg

SEQ ID NO: 9931 - DNA, 71 bp, Homo sapiens
gttgccaggttggagtgcagtggctattcacaggtgcaaggataatgcactacagcctcaaactcctgggc

SEQ ID NO: 9932 - DNA, 72 bp, Homo sapiens
cagctccgaggggagccatatcctgggaccgtgactcagcacccagccactacgcctcccggccagccgctg

SEQ ID NO: 9933 - DNA, 72 bp, Homo sapiens
tcctgggctcaagtgatccgcccaccttggcctcctaaagtgctgggatgattggtgtgagccacagctcct

SEQ ID NO: 9934 - DNA, 73 bp, Homo sapiens
tatggagcaggaggacacaggagagctggaggcaaagccgagcctgctgtgggtgcatctgggttctcacctt

SEQ ID NO: 9935 - DNA, 74 bp, Homo sapiens
cttgaacccaggatgggggggttgcagtgagttgagattgtgccactgcactccagcctgggcaagaaagcgag

SEQ ID NO: 9936 - DNA, 72 bp, Homo sapiens
gtttctagaaaccaaaggcatagtcacaattaacggaagacttgccatgaagggtgaagggctctgggaagg

SEQ ID NO: 9937 - DNA, 72 bp, Homo sapiens
gaacatctgtgtgactgtattattgagtgtatgcatatctgtgtgtgcacatgttataaatgcacatgtagg

SEQ ID NO: 9938 - DNA, 73 bp, Homo sapiens
ggagaagcccgtggacgcacactcacactcacactggggaacagcagaactgagtgtcagaggcctgctccgc

SEQ ID NO: 9939 - DNA, 70 bp, Homo sapiens
agtaagagcacggaggctgagaatcgggtggatctctcaccctctccaagcctctttcttaagtattcgt

SEQ ID NO: 9940 - DNA, 74 bp, Homo sapiens
agcttgcaaattctggcccaagggtcaaatacagcccttggacatgtttgactcggcctgcagggtgtttgaac

SEQ ID NO: 9941 - DNA, 73 bp, Homo sapiens
attaggtggaaccacagcagcaggtgcacttttatatgacaactgggtcctaacagctgctcatgccgtctat

SEQ ID NO: 9942 - DNA, 70 bp, Homo sapiens
tacctgaaagtgacggggagtgaaatagaaccaagttggaaaacactcttcaggatattatccaggagaa

SEQ ID NO: 9943 - DNA, 71 bp, Homo sapiens
tgcatctccttcggctcacgctgggttgtgagaatcagacaggcacgaagggcggctacagctccctcacg

SEQ ID NO: 9944 - DNA, 70 bp, Homo sapiens
gactggaaaggccaagcgcatatgggatcccgtccatgtccgagacccagccctgcctttctgtcctgca

SEQ ID NO: 9945 - DNA, 73 bp, Homo sapiens
aggcagcgggagccagcggcggcggcagtggcactgggccgctggcagctgttgcgaaagtgccttcaggcct

SEQ ID NO: 9946 - DNA, 72 bp, Homo sapiens
ctacacggagaagccggcgggagcagcgggggagctcgccccgagtccctgcttcatttgatcggatagtcc

SEQ ID NO: 9947 - DNA, 70 bp, Homo sapiens
ggtgaccagtgccactaaaagcagagcttgagtttactctcataaccatcggctgtgggccagacatttg

SEQ ID NO: 9948 - DNA, 70 bp, Homo sapiens
gcctcaccaccaagacgtgtctgaggctctgcaaatgggatgaagcactgagccaacaggcgagatggac

SEQ ID NO: 9949 - DNA, 74 bp, Homo sapiens
gtgagtgtccagccgtccaaaggggctgcccgagccagaggaacacagggcagctctgggcccggggcgtgggc

SEQ ID NO: 9950 - DNA, 73 bp, Homo sapiens
tggaccgagctggccggatgcccctttccctcctgagccgtgggtggtgaaggagggaaggagcactggttta

SEQ ID NO: 9951 - DNA, 70 bp, Homo sapiens
tgcctcttgctggaatgagcctaggaagcctgaagagtgagtttgtgcccagtacctccaccaagcagca

SEQ ID NO: 9952 - DNA, 72 bp, Homo sapiens
acctaaatctgtcctgggctcagaggaagtatttagtaaagacattctaccttgggttgtaggtcacacagt

SEQ ID NO: 9953 - DNA, 72 bp, Homo sapiens
acagacaagcggccccttccccaaatcccaagagtgtcttgctgcttggtgggtgctcatcgcaatgttctg

SEQ ID NO: 9954 - DNA, 73 bp, Homo sapiens
agtctcaggtatgtctttatagcagtgtgagaatggactaatacaatctggatacttaactgctatttgctga

SEQ ID NO: 9955 - DNA, 72 bp, Homo sapiens
atgatcaagaccaatctgcactggaggccaggacaagctacagcaaagcctccacagctgggtctctagaat

SEQ ID NO: 9956 - DNA, 70 bp, Homo sapiens
gcgccacctcaatcctgggcaaagggaatcatcctaacatctaagtaccctgctctgatctgagcgctgg

SEQ ID NO: 9957 - DNA, 72 bp, Homo sapiens
gcatccctgagagccggattttagctttgtgcatcactcagatgcaagcagctgtttacctagaagtgcatt

SEQ ID NO: 9958 - DNA, 74 bp, Homo sapiens
ccgctcaagggaggggacagagggccggcctcggtccaggcgacccctgcccctcgccaggggcgccaccttgg

SEQ ID NO: 9959 - DNA, 71 bp, Homo sapiens
gctctgcaagtatgaggctggtccgataaatttatatccctaccagcttcttcttttcataattatctttc

SEQ ID NO: 9960 - DNA, 72 bp, Homo sapiens
actctggccagggtggcttccttgcagctgtgcagtctctattttaacagtcctggtcacggagccagaaag

SEQ ID NO: 9961 - DNA, 72 bp, Homo sapiens
gagccatgaagggatgttgcctgagggtgggatggtcacatttgccttttggaaggacctctctgagagcag

SEQ ID NO: 9962 - DNA, 72 bp, Homo sapiens
agggatggtaactgccaggtcgttgtcatggcaattgtaaactgtcatggcactggtgagagtgtcccatgc

SEQ ID NO: 9963 - DNA, 72 bp, Homo sapiens
tggctggggcccctttcctttggggaaacatggtcacaccaagcccccttttgaaaagcgggccatctgtgg

SEQ ID NO: 9964 - DNA, 72 bp, Homo sapiens
gggagtggaaacaaacaagatgaaatctacgattgcccccggctggcttgcgctggagagagtttccagacc

SEQ ID NO: 9965 - DNA, 73 bp, Homo sapiens
agtgccaggctcgtcacaaactggttgacagcggcagcgatgacagtcatcctcactgcctctttgacctctg

SEQ ID NO: 9966 - DNA, 73 bp, Homo sapiens
atccccacccctggagaaatcacttgggggcaaacctcagtgacgctctgtgagagggctgcagggcacacct

SEQ ID NO: 9967 - DNA, 71 bp, Homo sapiens
ggagatccctgtgctgatagtgctgaggcgctcaccaggtccctcaaacagccctgtgacacagagctctt

SEQ ID NO: 9968 - DNA, 72 bp, Homo sapiens
tttcaccatgtaggccaggcgggtcgcaaactcctgacctcaggtgatctacccactgggccccccaaagtg

SEQ ID NO: 9969 - DNA, 74 bp, Homo sapiens
ggggtctccaaggaggggtctgtggactaaagagggccggcgggagggggcccagggtctgtgggtgtctcgag

SEQ ID NO: 9970 - DNA, 72 bp, Homo sapiens
agggtcagagaaatgggaaagagcaagagccagaaaatggtttgaatcccagccctgctccttgtgagctta

SEQ ID NO: 9971 - DNA, 70 bp, Homo sapiens
aaccagttttcatttgcacattcatttcaatattcctgacctatgaatgtgactgttcttagctgtcccc

SEQ ID NO: 9972 - DNA, 71 bp, Homo sapiens
ctcaagtttccgtagtggtgtggatctgcagtggggctgcttttcctgacctattggccaggcttaccttt

SEQ ID NO: 9973 - DNA, 72 bp, Homo sapiens
gccccctcgtgccactgggccttggcctcacagatagtcccatcaggacagggtatgaaaggacgaggcacc

SEQ ID NO: 9974 - DNA, 74 bp, Homo sapiens
ctccaggagactccatcccataaggcagcccaggtgggacctggggatctgagatgggaaataaggggatctgg

SEQ ID NO: 9975 - DNA, 73 bp, Homo sapiens
tctctgaccccatcctcgctttgatgcccgggacctgctacccaggtacgtgggtcttctctgccggatgtgg

SEQ ID NO: 9976 - DNA, 70 bp, Homo sapiens
cctctggtgagttaaaattgcaaatgttgacatctgatcccattcaccttgtggttgtggctctccttta

SEQ ID NO: 9977 - DNA, 72 bp, Homo sapiens
tcctggctcctagactgagtgtctctcctgcacctcccaaacctgctgggccacactttagctggagttgtg

SEQ ID NO: 9978 - DNA, 70 bp, Homo sapiens
agaagtaatggaagtgttgggtcagccagacaagaatcccataggactgtggtttccccatatccattat

SEQ ID NO: 9979 - DNA, 71 bp, Homo sapiens
agtccaaaaactgctaacttcctctatacctccagaggagaggaaagaagctaccatctgtggatcatctg

SEQ ID NO: 9980 - DNA, 73 bp, Homo sapiens
cttggagcctggaagggggtggggaacagggttattaagtggtcatggctcagggacacaggacaagacagaa

SEQ ID NO: 9981 - DNA, 72 bp, Homo sapiens
tctagtaggtgccattgaaagccattgctcccaaaggggtatctctctgtcaggtggccttctcaggttgtg

SEQ ID NO: 9982 - DNA, 72 bp, Homo sapiens
ttaacttctctctcactttctggtgtcccccttccagcccatcagcgagtgctgccaggtctgcttcctaat

SEQ ID NO: 9983 - DNA, 72 bp, Homo sapiens
gaaggaaatctggacagagagacagacacacagcgggagaacgccgtgtgatgatggaggtggagtttgggg

SEQ ID NO: 9984 - DNA, 71 bp, Homo sapiens
gcccgaggtccggatctcagacaatggtccctatgagtgccatgtgggcatctacgaccgcgccaccaggg

SEQ ID NO: 9985 - DNA, 71 bp, Homo sapiens
ctgtcattggcacggctaataatgaaaaccatcagcatgcctgtgtctatgatgggctttatatcctacat

SEQ ID NO: 9986 - DNA, 72 bp, Homo sapiens
ttatccccatttgacagcagcggtaactggacctccaagattatgtcaactggcttgtaaatggggactcaa

SEQ ID NO: 9987 - DNA, 73 bp, Homo sapiens
tgcagtgaccactggaccctggcggctccgggccacacggccctctccagcacccaccccctaccagctcagg

SEQ ID NO: 9988 - DNA, 72 bp, Homo sapiens
cagacatccactgaacctgttcccagtcctgcagcacgagactcaaagccaggtgtccctggatgaagggat

SEQ ID NO: 9989 - DNA, 72 bp, Homo sapiens
ctttttttctgtttttgagatgaagcctcaccatctcccaggctggagtgcagtggcaccatctcggctcac

SEQ ID NO: 9990 - DNA, 72 bp, Homo sapiens
ccttggaggatggggccatgccgtcagctcggctgagaaagctggaggtggaagccaacaatgcctttgacc

SEQ ID NO: 9991 - DNA, 70 bp, Homo sapiens
taggggaagagttgctgtgcttggtgtccccaaagagtctccaggcaggaattacactcctgatcacctc

SEQ ID NO: 9992 - DNA, 73 bp, Homo sapiens
ggcgctacttaggagggcacataaggcagcgagttactgtcctgtgtctcccacccccactccacaatatcca

SEQ ID NO: 9993 - DNA, 73 bp, Homo sapiens
tttgctcttgttgcccaggctagagtgcaatggtgcgatctcggctcatggcaacttctgcctcccgggttca

SEQ ID NO: 9994 - DNA, 73 bp, Homo sapiens
ctcagggttgttgctgggggacaataagccaaggctgctcctaggaggcaagatgttggcataaccagattgg

SEQ ID NO: 9995 - DNA, 71 bp, Homo sapiens
ccttgtttggagtaaccagttccttcctgctttggaatggggcaaacttcttactcaacacacgcaacagg

SEQ ID NO: 9996 - DNA, 73 bp, Homo sapiens
tccttatctccgtggtagcaccatccaggactggcaacccatcctgtgacccaggacatgcccaagaaccaga

SEQ ID NO: 9997 - DNA, 72 bp, Homo sapiens
cctgagacctgtgacttgcttaagttcacatagttgatgaatagaagtagacccaggtctagaactgaatca

SEQ ID NO: 9998 - DNA, 72 bp, Homo sapiens
ctcttatccttaactcgctcttctagaattcctagaggacctgtgcaacaacctcttgaggatcgaatcttc

SEQ ID NO: 9999 - DNA, 70 bp, Homo sapiens
cagtacgcgggcccaggactgagcctgggcgcgcccggcggcggcgcgccgcccgacgacctggacctgt

SEQ ID NO: 10000 - DNA, 74 bp, Homo sapiens
gcaagaatatggattctgacaggagcactccagggtgccctagattaactctggtgagaagtagatgaccctgc

SEQ ID NO: 10001 - DNA, 71 bp, Homo sapiens
atcaaccactcccttcctctccaccagagtgacccagcctcctgtgggtggccgagaggggccccagggac

SEQ ID NO: 10002 - DNA, 72 bp, Homo sapiens
accctgtactttggtggcagccaggactgaaagggatgaagtgcttggctcagttcagtgaaggtgggtagt

SEQ ID NO: 10003 - DNA, 74 bp, Homo sapiens
gtggcattgcactccatcccaggcgacggtgggaaactcaggcaaaaaaaatgtcttcacctcctgggaatgca

SEQ ID NO: 10004 - DNA, 70 bp, Homo sapiens
ggcacgctgaggccaccatcatcctgcacgtggagagtaaggcctcatcccttctttgtctgcaccaaat

SEQ ID NO: 10005 - DNA, 74 bp, Homo sapiens
gtgttggcctcgccaggcgggggattagctcagctgggctgctaattgcctccgaagtgccggccgggatgctg

SEQ ID NO: 10006 - DNA, 71 bp, Homo sapiens
ccgagtttggggagatggtgagggaaggacacacacgtatgggtccccccgccccaccccgcatcccagac

SEQ ID NO: 10007 - DNA, 71 bp, Homo sapiens
ctcgtatataaaatgaggaggatgggccgagtaacctcagcccctctccggccctaacttggcgtgattcc

SEQ ID NO: 10008 - DNA, 72 bp, Homo sapiens
agcctctgggtccccattcctttattgggaagtggtagcacttggcactgacccactaaatataaagaacta

SEQ ID NO: 10009 - DNA, 74 bp, Homo sapiens
atgaatgcattataactacttagttgacctcagtttgtgtacctatgaaggaaactgagtggtgtacatgactc

SEQ ID NO: 10010 - DNA, 73 bp, Homo sapiens
tttgcacccttgttctcctccctcataagctctgcttctccacttaaagcagacataggggctgggagtggtg

SEQ ID NO: 10011 - DNA, 71 bp, Homo sapiens
tgagccaccactcccagcccctatgtctgctttaagtggagaagcagagcttatgagggaggagaacaagg

SEQ ID NO: 10012 - DNA, 70 bp, Homo sapiens
gtttcacccacccccgcggggacagcacagtgttaagagcacaagctctggagcaaggcagcctagtgtt

SEQ ID NO: 10013 - DNA, 71 bp, Homo sapiens
gctccgcgccttacacacgcgattccctttaatgcccccggggatcccggcggatccgtgctgcccttctc

SEQ ID NO: 10014 - DNA, 73 bp, Homo sapiens
gttctgaagtaacaggggatctgggttcaaataccaactccaccacttaccttgagccagtcactttacctct

SEQ ID NO: 10015 - DNA, 73 bp, Homo sapiens
acgtcagggtgccaggtggggctaaacagaggaagactgcctgggcgcagtggctcacgcctgtcattccagc

SEQ ID NO: 10016 - DNA, 72 bp, Homo sapiens
aaatggaagcgtgttctggggaaacagtaatgaccctgccgaaggggattctgacctctccatggggcccgc

SEQ ID NO: 10017 - DNA, 72 bp, Homo sapiens
atttttccctgagacagataaggtgtcagcagggctgtgtttcttcctggaggctctgagggaaaaccattc

SEQ ID NO: 10018 - DNA, 74 bp, Homo sapiens
gcaaatataaattgttagccctctcgtttccaaaaaggaattctgctagcatcaccccaatttgtggttactat

SEQ ID NO: 10019 - DNA, 72 bp, Homo sapiens
agcgagcgctgtcactcacctaaggaggtggcttgagccagggcctccctggagaagatcaggtgcaagcag

SEQ ID NO: 10020 - DNA, 74 bp, Homo sapiens
agcaagaccccatctctgttttaagaaaatgaagaaaaaaagaaaacaaaaagataaaggtctttgctcagccg

SEQ ID NO: 10021 - DNA, 72 bp, Homo sapiens
aacacctgagcagtaatcagctgggtctgtagtcaaagcccaacttggctcagcctgatgaggcccaatgtt

SEQ ID NO: 10022 - DNA, 70 bp, Homo sapiens
aggccgggcagtcagggcagccaaagctgattcccatgcctgtccctgacctatgggcactgtcacctct

SEQ ID NO: 10023 - DNA, 70 bp, Homo sapiens
ggggctgtggtagcccgggggacagtgccaggatctggttcttccttgtccccaggactagctgcccgcg

SEQ ID NO: 10024 - DNA, 71 bp, Homo sapiens
ggaaatagcagcacagaaatactgtcctgtgagtgtttctgcgacccattgtatcagttcgctgttgctgc

SEQ ID NO: 10025 - DNA, 74 bp, Homo sapiens
ccctccccccgccacgtgaccccgccccccctcccattcagcgggcagcagagggcccggcctggcgggccggg

SEQ ID NO: 10026 - DNA, 73 bp, Homo sapiens
gagatccagtagaccctctgcccaaagaatgtgaagttgtgccattaaaataacttggccgggcatggtggct

SEQ ID NO: 10027 - DNA, 73 bp, Homo sapiens
gagtaatctggtaatctggtatgttgaccagcctggacaacacagcaagagacccaatctatttaaaaaaaaa

SEQ ID NO: 10028 - DNA, 72 bp, Homo sapiens
gtaggggctggttaagtagacccatcaaatgttttccttaaggggcctgggagaggtttacctggaatatgc

SEQ ID NO: 10029 - DNA, 72 bp, Homo sapiens
aagcataattttttggtatttgggcagctggtgatcgttggtcccggcgccctttctttactgttatatgtt

SEQ ID NO: 10030 - DNA, 72 bp, Homo sapiens
agttaccgtaatggacagcagaggcaaagcagcaatcggaatagtctgactcgttgatagaaagcctactga

SEQ ID NO: 10031 - DNA, 73 bp, Homo sapiens
cctcagaggggagggactgcaggcttcttgcctgccaagcatcacagaacaatctcctccagacactccaagc

SEQ ID NO: 10032 - DNA, 73 bp, Homo sapiens
tatggtggagaaacctgatgaacgtgaccttagccagatgattaaggttaacatcatcagtgataagtcttgt

SEQ ID NO: 10033 - DNA, 70 bp, Homo sapiens
ggcctgcaccccatcgagagggtacagtgctttgggtaggttttgtcccatctgggtcgccaatattgtt

SEQ ID NO: 10034 - DNA, 72 bp, Homo sapiens
ggtggccggcggcacctgcaattactaagaggcattggtgatttactctgcagggaaatgtttgcttctctg

SEQ ID NO: 10035 - DNA, 74 bp, Homo sapiens
gccgctcctgtactgagctggaaggctggtggcagagccacctgcccaggtaattcatcagtgtagatttatgg

SEQ ID NO: 10036 - DNA, 71 bp, Homo sapiens
aaaatagcagtcccttccctgagaccccagtccatgcccagtcctgggcagttagagaaaccctgctgctc

SEQ ID NO: 10037 - DNA, 71 bp, Homo sapiens
aatgcttttcaaaatgttttctgcataattattcaaggatatgttattgtgaagcagaattcatctgaagc

SEQ ID NO: 10038 - DNA, 72 bp, Homo sapiens
tcaggcatataccagagctcaggggaagagccaaggcttgaacccagatctgcctgacctcagaccccatgg

SEQ ID NO: 10039 - DNA, 74 bp, Homo sapiens
gaacatcagagcctgtagctgggtctgggcgttttctaagctcatgagtgaagggcccacctatattctgatgt

SEQ ID NO: 10040 - DNA, 70 bp, Homo sapiens
ggacctagagagactggccaaggaggaggggcctccccttccccacctaggccccttcaccagggcacac

SEQ ID NO: 10041 - DNA, 73 bp, Homo sapiens
aaggctttggaaagcggctgtgcaaatgaagggccctgaagcatcagcttcattttatggcaaatgtgcctct

SEQ ID NO: 10042 - DNA, 73 bp, Homo sapiens
atcgcttgaacccaggaggtggaggttgcagtgagctgagatgaagcactgcctgggaaacagaatgagattc

SEQ ID NO: 10043 - DNA, 72 bp, Homo sapiens
attatttatggtttctagctggctctcagtcatggtgacttgattccttgggagttttgttaacagtgtgat

SEQ ID NO: 10044 - DNA, 74 bp, Homo sapiens
gtggctgtcctgaacagtttatgggaatagacgatgtcaacgtactctacttatgatcccataatggaagggga

SEQ ID NO: 10045 - DNA, 74 bp, Homo sapiens
gtcctgagcccgtggcggcggcggcggcgcgggtgtggggccgcgcggccgggagcgggcggaagagagcgcga

SEQ ID NO: 10046 - DNA, 73 bp, Homo sapiens
gaatatgctgacttgtcgggcctgggtgatatgcacatccttctctgcagccacaccccaacacacggagcaa

SEQ ID NO: 10047 - DNA, 70 bp, Homo sapiens
aaaagcttataatgaaaaccattgctgggcacggtagctcatgcctgtgatctcagtgacttgggaggct

SEQ ID NO: 10048 - DNA, 71 bp, Homo sapiens
ccacctggccgttggccttcgcgggggaagcgcctgctgcctcctcggcggtcacgtcgccccggggagcc

SEQ ID NO: 10049 - DNA, 72 bp, Homo sapiens
ctgcctgagagcaagggagcccggaggtgctccgggctggagactccctagctttggtcctctgccacctct

SEQ ID NO: 10050 - DNA, 72 bp, Homo sapiens
atacattctgagaaatgcatcattaggtaatttcatatttgcatgaacatcatagaatgtacttacacaaac

SEQ ID NO: 10051 - DNA, 72 bp, Homo sapiens
agaaggaagaaggagcccgagtccctgatgactgtggggctgccacaccatcggtttactcagtgacatgct

SEQ ID NO: 10052 - DNA, 74 bp, Homo sapiens
gggcagagtagggaagcggtgggggtgctgggggcagtgaggagactttcagagtcctacaggtgaaaggtggc

SEQ ID NO: 10053 - DNA, 74 bp, Homo sapiens
tgagaacccgagactcagtgaggtcatttacccaaggtcacagagctaggaagttgcagcctgaagccagggcc

SEQ ID NO: 10054 - DNA, 73 bp, Homo sapiens
cttagtccgctgggatttctcttgaggtgtggcacacaacctgagtacagccaaaaacacttcttccatgact

SEQ ID NO: 10055 - DNA, 71 bp, Homo sapiens
ggaggagggactctgggattgtccagccccaaagaccttatgctggacttgcctctaagttctctgatgtt

SEQ ID NO: 10056 - DNA, 72 bp, Homo sapiens
agggcagcgggaggaaaacctttattgctactagacattgtgatgaggacagctggccactccctttctgat

SEQ ID NO: 10057 - DNA, 73 bp, Homo sapiens
gtaaagctgagtggggttctgtgggaggttgagataaatgaaatctcgtctgtggactaccctgtgacagaca

SEQ ID NO: 10058 - DNA, 71 bp, Homo sapiens
ggctgaggaagaattgggacctagctcggcctggtgagaaggggagaggtcaaaagggtctgtagaaaagg

SEQ ID NO: 10059 - DNA, 70 bp, Homo sapiens
tgacaaaggtttagatcactgggtgtgtggaccacatgtgaagggggctggtctgagcctaggtcctggc

SEQ ID NO: 10060 - DNA, 71 bp, Homo sapiens
gcgctgggatggggcgcgaagcgggggtgcggggagcccgccaccccgtacctctcaatcctccctctcgc

SEQ ID NO: 10061 - DNA, 72 bp, Homo sapiens
ttaagaactacagggggccctaatgtctgggcccaagctacagcttgccccaaatgcaaataccccattttt

SEQ ID NO: 10062 - DNA, 73 bp, Homo sapiens
ggtgattaggtcatggaggtggttttccccatgctgttctcatgatagtgagggagttttcacaagatctgat

SEQ ID NO: 10063 - DNA, 72 bp, Homo sapiens
gaaagtccctggagtttcctggttcaacagtgcttggacggaaccaggcactcgtaccccactccggctggc

SEQ ID NO: 10064 - DNA, 73 bp, Homo sapiens
gtctgcaagcccctggggcatatccgaagtctgagccagacgggttatgtgtatctcaacctggaacaggcag

SEQ ID NO: 10065 - DNA, 71 bp, Homo sapiens
aaaagctgcctgttccaggttgagatacacataacccgtctggctcagacttcggatatgccccaggggct

SEQ ID NO: 10066 - DNA, 72 bp, Homo sapiens
ggcgggtggcccgcgccggccgcaggggtcatgcgcttctccttctgccgccggttgcagaaccagacgcgc

SEQ ID NO: 10067 - DNA, 70 bp, Homo sapiens
ctccccatagttctgagctggggctttggttgatctctcacaggcctagcactgcacagcactgggaaga

SEQ ID NO: 10068 - DNA, 73 bp, Homo sapiens
gaaaaaggcggggaggtcagaaaagggtcagagggttcactggcctgaagacccctttgaagtagttgtatcc

SEQ ID NO: 10069 - DNA, 71 bp, Homo sapiens
acattcctatctgaggggggaaaagaggctccaagagcaggatgacctgtccagggtgctacgggctcgga

SEQ ID NO: 10070 - DNA, 72 bp, Homo sapiens
cagatgacttttaggcaagagtccctgcagaagctgagaatctggaaatggactcttttaatgttatctgtg

SEQ ID NO: 10071 - DNA, 70 bp, Homo sapiens
tcactctgatggctgctgccgccacctcccttcctgggcatctgcccctctcagcaggcagagttgttct

SEQ ID NO: 10072 - DNA, 74 bp, Homo sapiens
ttgtttacaaagcctcactggttcactggggacaaaccccaagagccaagacacactaagaaacacggcctttg

SEQ ID NO: 10073 - DNA, 74 bp, Homo sapiens
ctcggcgggcggcgggcggcggggcggggcgggacgggcggcgaccgcggcctcagcgcggtccctggagcgcc

SEQ ID NO: 10074 - DNA, 73 bp, Homo sapiens
cccttagtccagtcaagatgacacgtaaaatcagtacacaaaattaacagtcactgctgggcgtggtggctca

SEQ ID NO: 10075 - DNA, 70 bp, Homo sapiens
tggttaagcgtaacctctgatttccattaccaactttagcaactggatttggggggcggggggcttccct

SEQ ID NO: 10076 - DNA, 71 bp, Homo sapiens
gtacagaacagcctttgattccctgtagccagctgtccctgtccagatcactggctaatggggtggatgct

SEQ ID NO: 10077 - DNA, 70 bp, Homo sapiens
gggattggagtggagagtgctcagggggtgatggcatcacattattgacctttgggaacccacctctact

SEQ ID NO: 10078 - DNA, 71 bp, Homo sapiens
tcctaatctatcctgctccctacagcctgctcttcctgctaggattcacctcatggaagagtcactctgtg

SEQ ID NO: 10079 - DNA, 70 bp, Homo sapiens
aaaaggctaggatcagactgatcattaatttattcgataaatgactgttgaacacttatctgacctggag

SEQ ID NO: 10080 - DNA, 72 bp, Homo sapiens
caaccctgggatccaatatactgcctgacagtagcaggcatcagatccatgtttgctgagctgaatttaaat

SEQ ID NO: 10081 - DNA, 70 bp, Homo sapiens
agagaggaggttgaggccagaccacaaggatcttgaataccaagcggaggacctgaccttttcctgagtt

SEQ ID NO: 10082 - DNA, 70 bp, Homo sapiens
acagctgagttttatgaagcacttactatgtgccacgtaccgtgagtacttcataggtagcatcttggtt

SEQ ID NO: 10083 - DNA, 72 bp, Homo sapiens
caagttctggtccccagatgctgagccacttgggcagctctctcctggctcagcctgaactcccacgagacc

SEQ ID NO: 10084 - DNA, 73 bp, Homo sapiens
ccgccagctcagcagaggtggggaggctggatctgacacaccctgagcctccccaccacttcctccctcctgc

SEQ ID NO: 10085 - DNA, 72 bp, Homo sapiens
tattctgaaggtatgctctggtaaggcaagattctggtgatgcggagttaggtcatactgaggattggggcc

SEQ ID NO: 10086 - DNA, 72 bp, Homo sapiens
gtttctgctgagaggtccactgttaaactgataggcttccctttgtaggtgacctggcctttctggctgctc

SEQ ID NO: 10087 - DNA, 73 bp, Homo sapiens
aaacagaagtgaggaccttgaagaaactgcatggttggatcagtctgatgaagcacttgaggcttcctgagcc

SEQ ID NO: 10088 - DNA, 72 bp, Homo sapiens
cctggatctcgaaaggtttcagcaataaggccaggggtaccttccaggcaggagtagtagcatctcaaaggc

SEQ ID NO: 10089 - DNA, 74 bp, Homo sapiens
accccacagttctctcgctgccacttcaagtcacgaaatgacagcattattcacatccttgtggaggtgaccac

SEQ ID NO: 10090 - DNA, 72 bp, Homo sapiens
ccagcacgatattcctgagtcaggcagggtatggagtcattctccactgtgcaggatcgtcccggactccca

SEQ ID NO: 10091 - DNA, 71 bp, Homo sapiens
cacctcacagaccacatggaccacaggagccatctgggacgcatggcttctggggaaacttcagggctctg

SEQ ID NO: 10092 - DNA, 73 bp, Homo sapiens
agatgggaaggatgctaatatgatgttagtaactgcaatcaggaactgagatgaagcagtgttgctctgcaag

SEQ ID NO: 10093 - DNA, 73 bp, Homo sapiens
ctgtccctgtggtctaggtctgggggatgcaatatgctagtatcatcagtgacttgacttcagtgacattttc

SEQ ID NO: 10094 - DNA, 71 bp, Homo sapiens
acggggcagggacctcggcaaggcgcgggctgccccgagcgcctgtccccggcacctccaactcaggcccc

SEQ ID NO: 10095 - DNA, 73 bp, Homo sapiens
ccggcccctcccttcccccgctgccccttggccatgtgtccatctcttgggacccagcggagggacagtggga

SEQ ID NO: 10096 - DNA, 70 bp, Homo sapiens
tcatatatcccccataaaggctgtggtcatcagtgagcgttgtcatattgcccacctgaagagtcagcat

SEQ ID NO: 10097 - DNA, 73 bp, Homo sapiens
aacccggtcccgcctgacagatgcctttcaggaagggcagtctggcttgtcagagcgagggcgagatgaattg

SEQ ID NO: 10098 - DNA, 72 bp, Homo sapiens
tgtacccagttctctccagagacttctcaggtctaccttacactagcatacctgaaacaagtcctgcttcct

SEQ ID NO: 10099 - DNA, 72 bp, Homo sapiens
tgtcatgtttttttagcttcttgtaaacatttaggaagctaaatgtttataagatttttttttttaaaagaa

SEQ ID NO: 10100 - DNA, 71 bp, Homo sapiens
ccggcctggccgcacgtgtatgatgacaactcggtaatgctgcatactcccgagtgcgcggtggggaagcc

SEQ ID NO: 10101 - DNA, 74 bp, Homo sapiens
ctgggagaggtggtgggaagtatgcagcaagtcaggtttatagagctgcccatactttcacccctctctcaggc

SEQ ID NO: 10102 - DNA, 71 bp, Homo sapiens
attttctattcctcattgtgtggcatagcctaagaccataactgaataggcttttcattccagtgaaatca

SEQ ID NO: 10103 - DNA, 73 bp, Homo sapiens
attgcctggattagagaatgagagcaataggctattggtccctggatgtcatttttaaatacccagagagcaa

SEQ ID NO: 10104 - DNA, 73 bp, Homo sapiens
ggtgcctaaccaacgggctgttaaaactagttgaaagaagctctcacacaggtggttgggtataggtccgacc

SEQ ID NO: 10105 - DNA, 73 bp, Homo sapiens
aggtagttcacaaaggatgaaattaaagaagtcgctgggcacggtggctcacacctgtaatcccagcactttg

SEQ ID NO: 10106 - DNA, 73 bp, Homo sapiens
cttccttaccatctgtaagtctggaccctgtaaagccagataccaggccagttttcccaggaaggttttgtaa

SEQ ID NO: 10107 - DNA, 74 bp, Homo sapiens
agccacttgccccacccctgggctgcttcttcttgagatcaggaggggcgttgcccagggctggtgttgccagg

SEQ ID NO: 10108 - DNA, 74 bp, Homo sapiens
gaaaccaagagcaaagaccacaacgccggctgcgatgaggaagtagcccacgttgacaaactgcatggcactgg

SEQ ID NO: 10109 - DNA, 70 bp, Homo sapiens
agagttaagctggagaggaggtagttaaaactctccacctaactgctcagaatccctcccagatcaatcc

SEQ ID NO: 10110 - DNA, 72 bp, Homo sapiens
tgacacatttttaccctccaattaattcttaggctcctgctctagcggtggattcctgagaggcaatgggag

SEQ ID NO: 10111 - DNA, 72 bp, Homo sapiens
cccacaggctgccccatgcttcctaaatccttccggggcttctccaccgaggcccagccccacctgctgggt

SEQ ID NO: 10112 - DNA, 74 bp, Homo sapiens
attggccgcggcgcccgcccggggcacccgggagcccctctggcctcccccagcccaaggctggatctgggcca

SEQ ID NO: 10113 - DNA, 71 bp, Homo sapiens
ctcagctacagggagagacatgtcagtgtagtgacagggagctcatcacctgcctggctgctccatgccct

SEQ ID NO: 10114 - DNA, 71 bp, Homo sapiens
aactccctacaaggtcaccactctgctggtaaggatgaggggaagtgagaactgaattccactggagggag

SEQ ID NO: 10115 - DNA, 74 bp, Homo sapiens
tttgagactatttgagcaatggtggtgactgttgtaggagacaaagggctcatcaacagcctctggggactggg

SEQ ID NO: 10116 - DNA, 73 bp, Homo sapiens
cacaacaaacctattaaaatccttgtttataacctataaacaaggatatattgtcatccttgtttatagatta

SEQ ID NO: 10117 - DNA, 72 bp, Homo sapiens
gaaaatgaggtagtagatcagggagggaaactcacacaacttggcagatgatgctgagttccagctggggtt

SEQ ID NO: 10118 - DNA, 71 bp, Homo sapiens
atagttgggcaggagagaagtagaagaaccacagatgaagaaccagtccagttttccctggccaccagagg

SEQ ID NO: 10119 - DNA, 73 bp, Homo sapiens
ggctagtcaaccaggtacctttttaagtggataggctgaggcctaaacttaacagaataccactattccagtg

SEQ ID NO: 10120 - DNA, 72 bp, Homo sapiens
agtgctaggattacgggcgtgaagcacacccggccaacggtgtgaatctttacaagctattttgtttcttcc

SEQ ID NO: 10121 - DNA, 72 bp, Homo sapiens
tgcatgtacagttcaaaagtgagccaaggatttgaggggcatttatatacaaatttggggctctgacatcca

SEQ ID NO: 10122 - DNA, 72 bp, Homo sapiens
tgagaggctgaggtagactttctgttgccaaggacctgttcagatcatgttacatcattgctacttccctaa

SEQ ID NO: 10123 - DNA, 74 bp, Homo sapiens
aagctgaggcagctggagctgaacacttgttacaagacatcaaagatgctacagtggacagtctttaccagctg

SEQ ID NO: 10124 - DNA, 74 bp, Homo sapiens
aataatgacagtaataacttataaagtgggagagatggcaagccctcagggtttactgctgccacccaattggg

SEQ ID NO: 10125 - DNA, 72 bp, Homo sapiens
gtgatctgcctgcctcggcctcccaaagtgctgggattacaggtgtgagtcaccactcccggccccacacat

SEQ ID NO: 10126 - DNA, 73 bp, Homo sapiens
tgtttcagctcattattgactacttagctgagttcaattccacaccagctgtctttacaatgataactgagca

SEQ ID NO: 10127 - DNA, 73 bp, Homo sapiens
caggcgctcgccagtgtacccagctttttttgttttgagacaggatgtcacgctgtcatccagtcctgagtgc

SEQ ID NO: 10128 - DNA, 74 bp, Homo sapiens
ggggccggggcggggcgctgcgggatggtctggtccggtcaggtcctcacagtggcgcctgagggctgaggctc

SEQ ID NO: 10129 - DNA, 73 bp, Homo sapiens
cagtcaagactaacacattcacaggcagagtacttacacattctgatgactgtctagtccttatggactgatc

SEQ ID NO: 10130 - DNA, 72 bp, Homo sapiens
agaaattagctgggcgtggtggtgtgcgtctgtagtcccagaagctgaggtaggaggtttgcctgagcccag

SEQ ID NO: 10131 - DNA, 74 bp, Homo sapiens
tgcgctgctctgaggacgcaggatcagccagggtgtctgtgtggcccctgtggcaagcctgggagccatggagc

SEQ ID NO: 10132 - DNA, 71 bp, Homo sapiens
ccaggatctgcaggccttgctcttggggctgattttctaggagacacagcaggcacagaacctacagtcca

SEQ ID NO: 10133 - DNA, 74 bp, Homo sapiens
ggcaacatgatgagaccgctcttctacaaaaaatacaaaaaattagcccagcatggtagcatgtgcctgtagtc

SEQ ID NO: 10134 - DNA, 72 bp, Homo sapiens
atgccatagccaagttgtcagtttagcattatggggccaagaagggagggactcagttggagttggcctgga

SEQ ID NO: 10135 - DNA, 72 bp, Homo sapiens
gccttgacatcttaggtcggctgcgagaatgccgtgagatgatgtgtatgaagccccacctggtgtctgtgc

SEQ ID NO: 10136 - DNA, 73 bp, Homo sapiens
gagaagctcttggcaggccagtgatttataaatttctgtgccctctgcaagtggctggcatgtcatatagagc

SEQ ID NO: 10137 - DNA, 70 bp, Homo sapiens
gctgcggcagcgtccgatgggagggggcgcagacccccaagcggtcgccgctcgctccctcccgccccgt

SEQ ID NO: 10138 - DNA, 73 bp, Homo sapiens
gctccaggaaacaggctatatatatcattggccacagcatacccagcactggctaactgttaatcccccagta

SEQ ID NO: 10139 - DNA, 73 bp, Homo sapiens
ttcctggggccctacaaccctgtgagcccgtgccagaacattctgcgggtgatcgaggtgactgcctggtgcc

SEQ ID NO: 10140 - DNA, 70 bp, Homo sapiens
gaccaccgccgtgccgggccagcgcgcttgcgcctcgagcaagcccgctcctaagccccgcctcctgccc

SEQ ID NO: 10141 - DNA, 73 bp, Homo sapiens
taggctgctgggaggatcaactgtcatacagtggaagcagcaggaggtcctcgagggagcactgcagagtgaa

SEQ ID NO: 10142 - DNA, 72 bp, Homo sapiens
cacagatgagtggattggagagaaaggcagaaaagttctctgtgcttccagccctcccacccttgccctttc

SEQ ID NO: 10143 - DNA, 71 bp, Homo sapiens
ataacggaaaaagttccatgcctgcaggcatcgttctgccatcactcaccgagcttcctggtctgtgttcc

SEQ ID NO: 10144 - DNA, 73 bp, Homo sapiens
catcagatagaaactcaggccaggctgggaggatgctgtaaatgcagcctcccagtctggcctgagttttgct

SEQ ID NO: 10145 - DNA, 71 bp, Homo sapiens
tgtgttttccccatgtgagagtgaacagtggaggtgcagcagatgtgtggccgtcagtgtgtgttggggtc

SEQ ID NO: 10146 - DNA, 72 bp, Homo sapiens
ttgagtacctactgtctccctggtaatgtgctatgtttattcattcacattcctacttatcacagatgtgct

SEQ ID NO: 10147 - DNA, 74 bp, Homo sapiens
ttatctgtgattatctgtttccatttagtggttgctctgtgaaatatttgaaatcagtgtagtggtgagtggat

SEQ ID NO: 10148 - DNA, 71 bp, Homo sapiens
caaaaaataaaataagataggcagtctctaccctcaaggagctcacagtccattgagagagacagccatgt

SEQ ID NO: 10149 - DNA, 72 bp, Homo sapiens
aacttcaacagtggctttgacattgggaccaagcaatgatgcagatgaggtgatcaaaggggaggtctgagg

SEQ ID NO: 10150 - DNA, 72 bp, Homo sapiens
tcttccctcccacccgccctgagcaaagccagtgtgagcagaaatgcactggctgacacctgacatgtttat

SEQ ID NO: 10151 - DNA, 70 bp, Homo sapiens
ttctcctcaaatattggagcatatttacaataacacttttaatgttcttgtatgctgattccattatttc

SEQ ID NO: 10152 - DNA, 73 bp, Homo sapiens
gtgatctttctcgtaaatactcataaataccactactcctgaggactatttgagaaggatgaccaaataattc

SEQ ID NO: 10153 - DNA, 74 bp, Homo sapiens
cacttttatcaagcgtctactacatgcatagcaccgggttacatgctctggaaagacagtggtcactgagatag

SEQ ID NO: 10154 - DNA, 72 bp, Homo sapiens
tagagactgtttttgcatggcgtctgggaaagctggtctgcaaagcaagacgatgtgaatacatctccccaa

SEQ ID NO: 10155 - DNA, 71 bp, Homo sapiens
atttgccgatattataagataaaaaacactgcatacatgtttatgccttgtattttgatggggtgggaggc

SEQ ID NO: 10156 - DNA, 70 bp, Homo sapiens
ctgctttccaattctggttcagccacccgagaccttgggcattttattccacttctcttgagcttgagtt

SEQ ID NO: 10157 - DNA, 73 bp, Homo sapiens
cagccaagtagggcttttaagactatgatgagggttcagcttttactctattatgaaaaggtcttacagagtt

SEQ ID NO: 10158 - DNA, 71 bp, Homo sapiens
ccagttactttttcatggtgatgtagcaataggttgattcaaccttgggccttgtcctgtcagtgtgttga

SEQ ID NO: 10159 - DNA, 72 bp, Homo sapiens
gatgctccagtggaccagctgaacactttacaggagactcgttctggctctgcatttggacggctgagctcc

SEQ ID NO: 10160 - DNA, 74 bp, Homo sapiens
tatggtttgtttacaaaagggaatttcctcttctttcccctaaaatgaggtagtattggtgtgaatgctcccat

SEQ ID NO: 10161 - DNA, 72 bp, Homo sapiens
ttaatccagtttcatcacccttgtaataatccaagcaagaaatgatgaagggctggactaacgtagtggcaa

SEQ ID NO: 10162 - DNA, 71 bp, Homo sapiens
ctaggtactgaccaaggggtgggaactgcggggtgggcatggttctgactagctgggaagatagaaaagta

SEQ ID NO: 10163 - DNA, 72 bp, Homo sapiens
agcaagatgttagccaagctgcagttggtcttatttggtgagtgatggcagccatgcaattagtatacagtt

SEQ ID NO: 10164 - DNA, 72 bp, Homo sapiens
aaaatatattctataaatgctattgaagtcatattggattttaataagtatttattgagcctttaaaagagc

SEQ ID NO: 10165 - DNA, 73 bp, Homo sapiens
taaaaagctttaagtgtgagagtttggggccctgtagctctgaacattttatgaaaccaagtataataatact

SEQ ID NO: 10166 - DNA, 71 bp, Homo sapiens
accagaatgatgccatatgattactgaaagggcactgggttatgactcatttacgttgttttggttttacc

SEQ ID NO: 10167 - DNA, 72 bp, Homo sapiens
gtgggatctggcaggtttatttaaggaacataaatttgaattcagcagattcccaagtttataagctattaa

SEQ ID NO: 10168 - DNA, 72 bp, Homo sapiens
acagaacaccaaacaccaccatgttctcactcataggtgagaattgaataatgagaacacttggacacaggg

SEQ ID NO: 10169 - DNA, 74 bp, Homo sapiens
cctctttgataatcatggtaatctcatttcaagagccagcaacggtttggcaatggtaatgagtgatgcaggag

SEQ ID NO: 10170 - DNA, 73 bp, Homo sapiens
tgcccaggctggagtgaagtagctattgttcataggcaccatcttagcgcactgtggcttcaaactgctaggc

SEQ ID NO: 10171 - DNA, 74 bp, Homo sapiens
actcttacagcaggcaactcacttcctacttaggatgctacagcatggaggcttatagatgggagggccagagt

SEQ ID NO: 10172 - DNA, 70 bp, Homo sapiens
tctggggttaagtgtgcggactctggagccaggtgaccctgttacaactctggctttgcaacttagttgt

SEQ ID NO: 10173 - DNA, 73 bp, Homo sapiens
gggtactggcctggttcttgaggccataggggtgggctttgatctactgggtctgcaaataccaacctggtgc

SEQ ID NO: 10174 - DNA, 72 bp, Homo sapiens
ttttttcagtctccacctgtgctgctcactccacgaacaaggatggtggcaggagttgtggtgagtagtgaa

SEQ ID NO: 10175 - DNA, 72 bp, Homo sapiens
ttacttggctcatgtcagcaggacacatcttagatgagatgctggggtatgtgaaggcagggcaatgaaaag

SEQ ID NO: 10176 - DNA, 72 bp, Homo sapiens
ccaaatatggcttttcatgaagctgtccagtgtgcaaagtagagcaaacctggaataccaaaatcccatatg

SEQ ID NO: 10177 - DNA, 72 bp, Homo sapiens
taaaatgttttgctagagtagccagtggtgagagaccgctactgctgtatgttgctcagggctaacctgtta

SEQ ID NO: 10178 - DNA, 72 bp, Homo sapiens
gaacactaaagtaatatcatcttattagtagccctcactggtgacattgaggtttattttagacatattcta

SEQ ID NO: 10179 - DNA, 73 bp, Homo sapiens
ttttgggctttggattttcagatttgggatgcttaatctctatcatactgatggtgagggcaccaaccggaaa

SEQ ID NO: 10180 - DNA, 74 bp, Homo sapiens
atctgaatctgctgggggcaggcggggggcatggggggacacaaacattcagaccgtagcacctagaaacagaa

SEQ ID NO: 10181 - DNA, 72 bp, Homo sapiens
tcagataggcatagatagcactacactgccggctttgtaaaagggttgcagggaggtcccaggcctcataga

SEQ ID NO: 10182 - DNA, 72 bp, Homo sapiens
ttttctggtgaagttattgcttgagaagggaaagaggatgggacagtccttgtttagccttttctggataac

SEQ ID NO: 10183 - DNA, 71 bp, Homo sapiens
ggtacagaaggaatcactggacttggagtcagacaacgtgagttcaaatccccactcatcctctacctaag

SEQ ID NO: 10184 - DNA, 74 bp, Homo sapiens
aactttggtcttttccaatcctaaaagctaccattctagactctgagctgagtacagaaacctagagggaaaga

SEQ ID NO: 10185 - DNA, 70 bp, Homo sapiens
tgtaggtatcactccttaatcttgtaagctttagattaaaaaataaatttaaagtggagactacccttaa

SEQ ID NO: 10186 - DNA, 73 bp, Homo sapiens
cacttgaattaaaactagcaccattcagtgagcacctactctacactgatgagtgctaagggcttcatatagt

SEQ ID NO: 10187 - DNA, 70 bp, Homo sapiens
attctggaccaatttcatgcagctacttctgtatgcaggctgtctgtcctcagcaatagcacatgtggtt

SEQ ID NO: 10188 - DNA, 74 bp, Homo sapiens
caaagcaatgttgtgctgacccgtgaattgacagtttaatgcatggaaaagaacagatgttcagaaacatgctt

SEQ ID NO: 10189 - DNA, 73 bp, Homo sapiens
agtcaagatgtttttccactgcagtctgtaagtaagagggtacttgaagaatttcctgatgatgatccattaa

SEQ ID NO: 10190 - DNA, 72 bp, Homo sapiens
gttgcagtccctttgtcaaataccccagagctggaatatgtaaagctctgagggttgcaaaggtttgtggga

SEQ ID NO: 10191 - DNA, 71 bp, Homo sapiens
gtgggagtgtgcattatctcattccagttcccaaagttatttggagatccaatagtctgacccactcccac

SEQ ID NO: 10192 - DNA, 72 bp, Homo sapiens
taaaggttaaatgatccttaaaggcagctggaagtacaattgtaggcagagatgagggattttcttagtctt

SEQ ID NO: 10193 - DNA, 73 bp, Homo sapiens
atcattctagtatgtgctgtgcaccagttctgtggagagggcactgcaggaggatacgagtcaacatgcttct

SEQ ID NO: 10194 - DNA, 72 bp, Homo sapiens
atcaagttgctttttccatatattcttctctgacttagaaaatgagagatagaggggagataggtactagct

SEQ ID NO: 10195 - DNA, 73 bp, Homo sapiens
ttcacaggtaaataccatgctaactacttaatctgggttacttacttaggtgactgttaggatcccttgattt

SEQ ID NO: 10196 - DNA, 74 bp, Homo sapiens
gttgccaggggcgaggagaaacagggaacatggagtgactgctaatagatatgggcggtttctcaaagggtgat

SEQ ID NO: 10197 - DNA, 72 bp, Homo sapiens
gttaaatagtttggctatctgatatagtaaagaataataaggtttgttctctaaaggctcaagagtcaaata

SEQ ID NO: 10198 - DNA, 71 bp, Homo sapiens
cacctgctacatgctctcctagccaggtctgggtaactggtccagttaccctgaaataaggagcaagaatt

SEQ ID NO: 10199 - DNA, 72 bp, Homo sapiens
ctgcaagctacattgtctggagttgggggaagggcagtgcaagcactccctcggctgcctgcactggtgtct

SEQ ID NO: 10200 - DNA, 72 bp, Homo sapiens
tgaattatatctgtatatatgaaagtagtataactttagttgttatattgctgcgttactggaaaattcctt

SEQ ID NO: 10201 - DNA, 70 bp, Homo sapiens
aggggaggggttggtcttgctgtcttagcggtggcacaggtggaagaaaatccaagtataagtggatcca

SEQ ID NO: 10202 - DNA, 74 bp, Homo sapiens
aaggaaagaggtttaatagactcacagtttcacatgattggggggggctcacaatcatggcagaagacgaagga

SEQ ID NO: 10203 - DNA, 72 bp, Homo sapiens
caggatagctaaagtctgactatgctgcatggcatctgcttggctcatatgaaacgtatgcatccatttcat

SEQ ID NO: 10204 - DNA, 70 bp, Homo sapiens
tgtacacataagctgtgcatatgcatgtgtgcacacacacacacacacatacacagacttgcatcttaaa

SEQ ID NO: 10205 - DNA, 71 bp, Homo sapiens
cgctttctccttgcaccatatgctgttgcttctctcgggtttcagtgaaatcaggcttcactggaagtgtt

SEQ ID NO: 10206 - DNA, 70 bp, Homo sapiens
ctggataaaggcgactaccatacagctaggggctccagccagacctaagtagttatccttgattcctctt

SEQ ID NO: 10207 - DNA, 74 bp, Homo sapiens
tctgagatacaagccaaatttgacaaaggagaaagggctgacttgtcaaatattttatttgtctagtaatttgg

SEQ ID NO: 10208 - DNA, 73 bp, Homo sapiens
gagtcacagtagaggtctctagggtgttgaagaaaatccatgtttttttcagaaaataactattcttcttttg

SEQ ID NO: 10209 - DNA, 72 bp, Homo sapiens
cagacgtgggagctgtcaattctgttgcctttatcaaccagtagctatagataacttgactactttcaggtc

SEQ ID NO: 10210 - DNA, 70 bp, Homo sapiens
ctaagccttccaggaagcagtgaaccattgtcagtgcccccctacccttttgtcatattgcttgctggga

SEQ ID NO: 10211 - DNA, 72 bp, Homo sapiens
tgaagtgtcagtttgagtttattgatgtcagtggctgcttttggttgtagagctgttcacagtgtttgcttt

SEQ ID NO: 10212 - DNA, 73 bp, Homo sapiens
aaacattatagcaagtgttggcaaaggtgcggaggtaagggaacccttgtacactgtcaatgggaatgtaaat

SEQ ID NO: 10213 - DNA, 72 bp, Homo sapiens
ccctctacatgagagcctagtccacagtaagctccaaataaatatttactgaagaagaggatactacttgta

SEQ ID NO: 10214 - DNA, 70 bp, Homo sapiens
atgtagaaatcattctgacaatacctgagcgtgataactattatgatgttcattgtgtcttaaagatatt

SEQ ID NO: 10215 - DNA, 73 bp, Homo sapiens
cagccaaactccacttcctcccgggcgatggcctgcctgcatgctggcgtctgtccgtgtgctcttgtcagtg

SEQ ID NO: 10216 - DNA, 71 bp, Homo sapiens
gttggcatgtaagttctttcatggtctaaccactgaccacttttctagcttatctctggccattcaacatg

SEQ ID NO: 10217 - DNA, 72 bp, Homo sapiens
gaagttgggttttatatttaattttgccctggggcattattactttgaaagtaatccaaatattttgcttat

SEQ ID NO: 10218 - DNA, 70 bp, Homo sapiens
gctcaaaggctaatggtgtacacaaattgactagggtcaacaaaggcagtgcactacagaattggcagta

SEQ ID NO: 10219 - DNA, 74 bp, Homo sapiens
ccaaacattgctgatgaaagtcacaaagccaggttgactggttccactacagttccaagctacctaaaatcagc

SEQ ID NO: 10220 - DNA, 72 bp, Homo sapiens
catcaataatatgcatttcagtaatctgggatgtttgaactaatgcaccatctgaaaagcatgacagaagcc

SEQ ID NO: 10221 - DNA, 70 bp, Homo sapiens
attgctaataccctttaaaacctggatgtgcccatgtctctggggaaacttctcctgatgaggtaagcca

SEQ ID NO: 10222 - DNA, 71 bp, Homo sapiens
ctgtctcagccagcaggctggacttgctcccaggagcacagggcaaagagagcaagtgatacggtttggct

SEQ ID NO: 10223 - DNA, 74 bp, Homo sapiens
gacctggaagtagtagtggtttgagttactcatgccttcccttactcccagtatctcagtggctactgtttcct

SEQ ID NO: 10224 - DNA, 73 bp, Homo sapiens
ctttgtaaagagagctataaagcaccctgcatgtgtaaggtgcaactaactactcaccctccttttacatgct

SEQ ID NO: 10225 - DNA, 73 bp, Homo sapiens
ctgttgaggtggcagctgctgctgctgtgtcagagctcgaggtgtcactgacctgctgccgcttttgctactg

SEQ ID NO: 10226 - DNA, 73 bp, Homo sapiens
acacttactatttttactggaacccttcatatggggttttcttaagacattttggtggtagtagaggtggtga

SEQ ID NO: 10227 - DNA, 72 bp, Homo sapiens
cactgatttgggaaaagcacttctaaactgactgccaagggaggtgtctgaaacagtggcgtggggggaaaa

SEQ ID NO: 10228 - DNA, 74 bp, Homo sapiens
gcctcccaagtagctgcgactataggcgtgtaccaccacgcccggttagttttttctgttttttttgtagatat

SEQ ID NO: 10229 - DNA, 74 bp, Homo sapiens
ttacttagtctggctgtttagtagaatttacctctactcattcatcagcctctttatatatatgattttaagtc

SEQ ID NO: 10230 - DNA, 72 bp, Homo sapiens
caatagcgagttatgtttctgctctgaaggtaggtcagcagtgtacaggcattgcgcagaggaaactcaccc

SEQ ID NO: 10231 - DNA, 70 bp, Homo sapiens
ccagcccacgggttcattttctaacaagagctcagcagcacttatgttatgagttgaattgataccctct

SEQ ID NO: 10232 - DNA, 74 bp, Homo sapiens
tagccactaaaccagtccccttctgcctccttcccctaactcaaaaagcagtggcatgggctgggcacggtggc

SEQ ID NO: 10233 - DNA, 70 bp, Homo sapiens
ataccacgacgtcagtgctcctgtggcctccaccccggggctggcggaggcttgcgagtcctttgcggta

SEQ ID NO: 10234 - DNA, 72 bp, Homo sapiens
ccactacggaagttacctgggaccagaaatagatcatggagatcatctagtccacagatatttccctgaaag

SEQ ID NO: 10235 - DNA, 74 bp, Homo sapiens
tagtccattttcacattgctataaagacatacctgagactgggtagtttataaaggtaagaggtttaattgact

SEQ ID NO: 10236 - DNA, 74 bp, Homo sapiens
ggagtctggactttatcctgagggccacagggaaccattaaagggttttaagtggggggactgattaatctgat

SEQ ID NO: 10237 - DNA, 71 bp, Homo sapiens
tttgagtaacataaacttcagtttaccctcctatgcagcagcataagtcagaaactgttcctgtgtctcag

SEQ ID NO: 10238 - DNA, 72 bp, Homo sapiens
atcttctagtccagtggctactatgggatacttgtgttttctagaaatactgaactgaacgctttcatgatc

SEQ ID NO: 10239 - DNA, 73 bp, Homo sapiens
aggtgggtgtagctactctaatgggcagcagagacaaagcagcaataagaatagtctgactcatgaagagctc

SEQ ID NO: 10240 - DNA, 71 bp, Homo sapiens
cttgcagcatagaaccatagtgagtctggtcttgagacagagaccattagttcggaatcataataatgcac

SEQ ID NO: 10241 - DNA, 72 bp, Homo sapiens
ccatctttgaagccaagagcagctctcaccagccaccaaatctgccagcactctgtcttggatggcccagcc

SEQ ID NO: 10242 - DNA, 71 bp, Homo sapiens
gcagcagcgctctgagccatggcacagtaataaagacaggttgatagtgctcccgctaatctatgtcacct

SEQ ID NO: 10243 - DNA, 73 bp, Homo sapiens
ttcaaggtatttcagtatgcaatagagcatgcacatactccacttacagtgcatctctaaatctgattgttac

SEQ ID NO: 10244 - DNA, 72 bp, Homo sapiens
ttgattggcccgagttgagtcaggtgacccatccccaaatactactcacctgccctacctcaaacaagtcta

SEQ ID NO: 10245 - DNA, 70 bp, Homo sapiens
ggggttgttgtgtggtcaggatgataagataatgtgtgtaaagcacttagatcaggatctggcaaataag

SEQ ID NO: 10246 - DNA, 72 bp, Homo sapiens
ccctaagctacaactctgaaatcagaaagactcttgttgcatatgagtatggtttcatcttttgtgatggga

SEQ ID NO: 10247 - DNA, 73 bp, Homo sapiens
gaagagaagggaatgatagcatagaccagcagtggtcagagtagttgctagaagatcttccctggctatgaaa

SEQ ID NO: 10248 - DNA, 70 bp, Homo sapiens
agacggggtttcaccgtgttagccaggatggtctccatctcctgacttcgtgatcttcgtgatctgcccg

SEQ ID NO: 10249 - DNA, 73 bp, Homo sapiens
aaatgagacttttcttttacagctcatgaagcagtcaaagactgtggatgtactgtctagaaagttagcaaca

SEQ ID NO: 10250 - DNA, 72 bp, Homo sapiens
ctttgctgacctgtgagccagtcagttccctcaccaacgggagatgacctttccaggcagagtgtccacctt

SEQ ID NO: 10251 - DNA, 72 bp, Homo sapiens
tcatcttgaaaacgtctgcttgtcctagggctccaagtctacagaccttgcaggagagaatgctcaagtttg

SEQ ID NO: 10252 - DNA, 72 bp, Homo sapiens
ttttttgagaaggtgtcttgctctgtcaccaggctggagtgcaatggtggcatctaggctcactgcaacctc

SEQ ID NO: 10253 - DNA, 74 bp, Homo sapiens
ggctatactgaataggggctgaataatagtcatctttgtcttattcccttattccagggaaatatttttagttt

SEQ ID NO: 10254 - DNA, 70 bp, Homo sapiens
cccaaggctggtaggactccagcccactctgtgatcagcctatcccccataggagtcttatcctttggtg

SEQ ID NO: 10255 - DNA, 73 bp, Homo sapiens
atgtgagcgaatacagtactaatctcttctgcccttgccttagaaaggtagtctaaggaagggcaggaggatt

SEQ ID NO: 10256 - DNA, 71 bp, Homo sapiens
ggcctctgtgctggcagcctcttgcccattatttctaagtgccatgggtcaggttgtctgggaaacagact

SEQ ID NO: 10257 - DNA, 72 bp, Homo sapiens
cttttacttcttcttcagccttctccttttcagagctttcagagtttcttatggacaggaagacctagagaa

SEQ ID NO: 10258 - DNA, 72 bp, Homo sapiens
gaggactatgtgaagcaataactgtcatacacgcagcatggcacctgcatagtgcacagtaagagcttagca

SEQ ID NO: 10259 - DNA, 74 bp, Homo sapiens
agctatcgcagccagcagcaatttttccaacctggattccaccaggggagcttggccggtgtctgagtgccact

SEQ ID NO: 10260 - DNA, 73 bp, Homo sapiens
gcaccctaggccagctgactcagaatctctgggagtgggggccaggcatttgtaggacacattgaatcactgg

SEQ ID NO: 10261 - DNA, 72 bp, Homo sapiens
aggtaaatttgtgtcacaggggtttgttttacagattatttcgtcacccaggtattacgtctactacctatt

SEQ ID NO: 10262 - DNA, 70 bp, Homo sapiens
aaaggaactgccctgctgtaaggctttggagatgaatcaggagaaaaaggctaggggcaggatgccattt

SEQ ID NO: 10263 - DNA, 72 bp, Homo sapiens
tcactaacaccatgctgacttgattactgtcgctttatagttaagtcttggaaatgggtagtgtgagtcctc

SEQ ID NO: 10264 - DNA, 71 bp, Homo sapiens
tgggtgagaatccactccataccccagccagccaggttcctctggctgcctttatcacctttgttatctta

SEQ ID NO: 10265 - DNA, 71 bp, Homo sapiens
ttttggtctagttttccaggaatccactataggcaaaactgtctattgacatccttcagtcatctaggcgg

SEQ ID NO: 10266 - DNA, 72 bp, Homo sapiens
tttggagtccctgagtccctgagaccctgacttggttacaacagccagagagaactgtgggaatccctgaga

SEQ ID NO: 10267 - DNA, 72 bp, Homo sapiens
tggaagtaatatttgccacaggaattaaatcagccaatgcatacagagttcggcatagtgaatgtggctaga

SEQ ID NO: 10268 - DNA, 73 bp, Homo sapiens
ttgtattgctgcatcaccaaataccccataaacataacccagaatctgctctgattctggcagccacagagga

SEQ ID NO: 10269 - DNA, 73 bp, Homo sapiens
ttctccagcatttataagggaagtcaatggattaagcatgttgtacgtgatggagaactgcttatttcacatt

SEQ ID NO: 10270 - DNA, 72 bp, Homo sapiens
ttggatctagagctccttctttttatttagagttatttgagaaggacttttttctgcttgaaaatctcactg

SEQ ID NO: 10271 - DNA, 70 bp, Homo sapiens
actttggaattattagcctgggttacactcagattccagtgagatttggctgcaatcactattccaattg

SEQ ID NO: 10272 - DNA, 73 bp, Homo sapiens
ttttgtgtttctggacaggaatactcacaattctcaagatgttggttctttccaaattgttccacagattcag

SEQ ID NO: 10273 - DNA, 74 bp, Homo sapiens
ccaaactgtagggatatgtagcaaatgggttagaacaactccctggccggtttcaacacctgtaaaatggaacc

SEQ ID NO: 10274 - DNA, 74 bp, Homo sapiens
cagaggagaattgatgatcatagtggtctgaaattgagttccctcaaacctcaccatgatgagctatagcactc

SEQ ID NO: 10275 - DNA, 71 bp, Homo sapiens
actccagggtgtgacctgtaagtgggcagcagggactgacctatcttaacttggaaaagctggaggagagg

SEQ ID NO: 10276 - DNA, 72 bp, Homo sapiens
aattacatctgaggtgggatgaagacactagggctcaaagtgcttactcacgtagcaaccccccaggtgtct

SEQ ID NO: 10277 - DNA, 70 bp, Homo sapiens
tttgggagtgagagcaatggaagtagatgtgactatatcgttaacaatttaatgctcttaccaaaagtct

SEQ ID NO: 10278 - DNA, 70 bp, Homo sapiens
gtgttcagcattgtacagggtgttcttggaagacagggcaaaaaccatcgccagattggggcacctagat

SEQ ID NO: 10279 - DNA, 72 bp, Homo sapiens
tatgatggcttggtagagtccaaatataaaatatggctgtgccattgatagctggtttttcccttccacatt

SEQ ID NO: 10280 - DNA, 72 bp, Homo sapiens
caggctaggtggaactgtgggggttggaggcaatctagcagcacagccacgccagtgatagccacacagccg

SEQ ID NO: 10281 - DNA, 72 bp, Homo sapiens
tttctgtgggtcttgatttagttttatttgtttatgcaaatcaatgaataaatatacatccatggagacaat

SEQ ID NO: 10282 - DNA, 73 bp, Homo sapiens
aaaggtagcttatgttcacagtactgtctctggttttccagtctgtctcctagtcataggcccctaaagtcca

SEQ ID NO: 10283 - DNA, 70 bp, Homo sapiens
caaagaatataaggtagaggaatttcccaaccctgttaaggccccactaggccatccttccctgagttct

SEQ ID NO: 10284 - DNA, 74 bp, Homo sapiens
taccccttgaaaacatgggctaaggaaggagggggtaactccttcatctttccctggccttggtagtacatgtc

SEQ ID NO: 10285 - DNA, 74 bp, Homo sapiens
ataatgcataaaatatagatacaggtgaaatatttgtataacctcctggtgagtgaggttatacaaatatcaag

SEQ ID NO: 10286 - DNA, 71 bp, Homo sapiens
gaccatagcaccatttgattatctctctgccctgttcttcatccgaggttacaacattttctggtgctggt

SEQ ID NO: 10287 - DNA, 72 bp, Homo sapiens
ttatcctcatacaactgctatactgccttgaataaggtagatttgtagcaggttttgaaatcagtaagtgtg

SEQ ID NO: 10288 - DNA, 73 bp, Homo sapiens
atagctgcttgattcagtgcgggcttgcatggctgcattttctgaacagtagtctccagatgttccagtagat

SEQ ID NO: 10289 - DNA, 73 bp, Homo sapiens
aggtagttggtgggcaaagatagttataatcctgcctcgtagtgattatggtctacttgaggagacagtaatt

SEQ ID NO: 10290 - DNA, 71 bp, Homo sapiens
ttgtcttagattctctaatgagactcttttaaattgaaaggggtttagcaggtagagaagctacatgatca

SEQ ID NO: 10291 - DNA, 73 bp, Homo sapiens
gaggggcctgactgttagaaaggaaactaacaaacagaaagtaatagcatgtccactcaaataccccatccaa

SEQ ID NO: 10292 - DNA, 70 bp, Homo sapiens
gcaagttcaacagtgtcattggcattccatgaaggagtgtaaatgaaatattctgctccctacacctaga

SEQ ID NO: 10293 - DNA, 71 bp, Homo sapiens
aagggtgttgccaaaagagattaacatttgagtcagtgggatgagacctacccttaatctaggaaggcaca

SEQ ID NO: 10294 - DNA, 73 bp, Homo sapiens
aggtgattagatcatgggggtggtttttaaatgtttagcaccatcctcctagtctgtgttcatcatataattt

SEQ ID NO: 10295 - DNA, 72 bp, Homo sapiens
gagacggtttctctcctgttgcccaggctggagtgcaatggcacgataacggctcactgcaatttccgcctc

SEQ ID NO: 10296 - DNA, 73 bp, Homo sapiens
aacaagtcttgtgtaagtcggagaattagagaccgcatggtggggaaaaactcatatttaaactgaggctatt

SEQ ID NO: 10297 - DNA, 73 bp, Homo sapiens
gctatattaacggtggaagccagaatagaaagcaagacaggcagccactgacagtgaccagcaaaaacagaga

SEQ ID NO: 10298 - DNA, 73 bp, Homo sapiens
tatacttagtggaactaccatacaaactgatgaatcatatggtagttttatttttagttttttgaggaattgc

SEQ ID NO: 10299 - DNA, 73 bp, Homo sapiens
cttgaatcagctaaacagtttatccccctttagcaggaaacctagcacatgcaggagcctctggatctgatca

SEQ ID NO: 10300 - DNA, 70 bp, Homo sapiens
aggctaaaacaatgttccctgagacaagccatggaccacttttccaagaattgcttggggtgctggttaa

SEQ ID NO: 10301 - DNA, 72 bp, Homo sapiens
tctgtatcatgccattgacccaaaggaaaatagagtgcaacctctctggtttagtagcctctgtgggcaatc

SEQ ID NO: 10302 - DNA, 74 bp, Homo sapiens
atggttgaattgtgtttccatagcaaagtaatttataataattgctttatggatgcaagtgcaattttcattat

SEQ ID NO: 10303 - DNA, 73 bp, Homo sapiens
taggtgtaagtcaccactggtatgggttaaaaaagaatatcgactgggcacagtggttcacacctgtagtccc

SEQ ID NO: 10304 - DNA, 72 bp, Homo sapiens
gctcaggcatacaggtggactgaaacccattatgggtataaagccacattttgattagcagatgaaaatagt

SEQ ID NO: 10305 - DNA, 72 bp, Homo sapiens
attagataacttaccatcatggggtaacctaactgaaacactgcaaaaggtctatctaatggggtttcctag

SEQ ID NO: 10306 - DNA, 74 bp, Homo sapiens
gatgatatgctgagtgatatataatcagtcacggaaggacaaatactgcatgattcaatttatatcaggtacct

SEQ ID NO: 10307 - DNA, 73 bp, Homo sapiens
ggctctatctaggcagagggcatggtgaacctgttgggtgattacctaattcgacatattcatactcttgagt

SEQ ID NO: 10308 - DNA, 73 bp, Homo sapiens
tggcctctcgctgcccatctcccaaccctggtacctcagcctcatgttccgcacgcgccaggccgacggtgtc

SEQ ID NO: 10309 - DNA, 71 bp, Homo sapiens
ccacaactgaggaacctcggccaatgcggcgcctgcatattgagtgcgcccaagaaaacgaatttcctccc

SEQ ID NO: 10310 - DNA, 73 bp, Homo sapiens
cgttctatccatcattccccgcacttgcatttaacggacttagagtgggagctgccccttgtctcttgcgtgc

SEQ ID NO: 10311 - DNA, 73 bp, Homo sapiens
tctggtccctgcagacaattgagtttaggacccctgcccacaggctaaaatccaaactcctcagtcaggcccc

SEQ ID NO: 10312 - DNA, 74 bp, Homo sapiens
ggtatttatctttatttcatcattcttgactttcttgttttcttcaactggtcttggagaggaacagaagtacc

SEQ ID NO: 10313 - DNA, 71 bp, Homo sapiens
ctgttttggctcagttcaggtcccttaatccaggaggcttcgtccgtggagttggctgactcaacagactc

SEQ ID NO: 10314 - DNA, 70 bp, Homo sapiens
ttatagctctcccaccagccaaaccagcctaccgcttgtgtttgtgtagttcacaagctaagaatggttt

SEQ ID NO: 10315 - DNA, 73 bp, Homo sapiens
tggagatagggggtgctgatgttgcccagaatattccatctttaatgaggcaaccctagaaggattgtttcca

SEQ ID NO: 10316 - DNA, 73 bp, Homo sapiens
ggtcaaatatccacgtgaggtttggtggggtcaaatatccagaccatagcaccatatgattagctactttggt

SEQ ID NO: 10317 - DNA, 73 bp, Homo sapiens
gatcttggactgggagcaaagcaaaactgcaaaaccagcagatggggtgttgtagaaggtgcaccccagtaga

SEQ ID NO: 10318 - DNA, 71 bp, Homo sapiens
tggaggatgcctgcctccaggggcacaaaggctgaccagcagaggcaagctgaggacagtggagagaggtg

SEQ ID NO: 10319 - DNA, 70 bp, Homo sapiens
ccactacaggaggggaagcaggggtctactggccgtgagcacagcagtacatgccgcatgtctgccagac

SEQ ID NO: 10320 - DNA, 73 bp, Homo sapiens
gagagaagtagatggggctattctgctaaagcactgttttcttaggaggaagtgtgcagcttcagctccagct

SEQ ID NO: 10321 - DNA, 71 bp, Homo sapiens
cctatttttgtcttgatggcacctactgaaccagctaaacctgggcttatggtttcattgccttcgcagac

SEQ ID NO: 10322 - DNA, 72 bp, Homo sapiens
ttagatatcatttattccaatcctctcatttcacagtgaaggagataggtggagataggtgatgtgacttgt

SEQ ID NO: 10323 - DNA, 74 bp, Homo sapiens
ggctctgtgtcaagtgataacaaggtccctgctctctttcccatgtgggagctggactgtcctcactttcaaag

SEQ ID NO: 10324 - DNA, 72 bp, Homo sapiens
gcagagtgactgaatgaccttaccccagctctccctttgtggtgtagatccctcgatctctctgatctcatc

SEQ ID NO: 10325 - DNA, 72 bp, Homo sapiens
tatgagctagttacagaaatatttgttagctctttctagaagtagttttatagtttgtcaactactcactgt

SEQ ID NO: 10326 - DNA, 71 bp, Homo sapiens
caaaacgttatggcagggacagtaaggaaatgttgtttcccaagccaaggttcaggcctatttgaaggttt

SEQ ID NO: 10327 - DNA, 70 bp, Homo sapiens
tcacagaggttaagtactttctcagggttaagcagctaccaggttgatcctgatccactgtctaagctct

SEQ ID NO: 10328 - DNA, 70 bp, Homo sapiens
gtactgggattacaggtgtgagccactgtgcctggccaaaactgatttttaatgttcctgttgttctctg

SEQ ID NO: 10329 - DNA, 73 bp, Homo sapiens
agctactgtaatggacagcagaggcaaagtggcaattagaatagtctgactcatgcagagctctggcattgga

SEQ ID NO: 10330 - DNA, 74 bp, Homo sapiens
accaggctgggcctgcctgtggaaaatggaaagtgacagagcagcggctacagctgggggtggggtgttgagta

SEQ ID NO: 10331 - DNA, 74 bp, Homo sapiens
tagcattagattgcctgtgcgctgaaaatcctataatcagcttccttgcttatcctcagtatgccaggtcctct

SEQ ID NO: 10332 - DNA, 72 bp, Homo sapiens
ctcacagttttcatgaactctagggagcctttgcttctaggcgtctcacatactttcagggactaggaaggt

SEQ ID NO: 10333 - DNA, 72 bp, Homo sapiens
tgtgaaaaggaaagtagccagctgaaagattcagtatctgtatgctgaaagccgttaagttgctcggactag

SEQ ID NO: 10334 - DNA, 74 bp, Homo sapiens
ttaccgcggagtgggcaacggaataaaccctcgtttccttctccctttcgccctaccgcccgctgccacgctgg

SEQ ID NO: 10335 - DNA, 72 bp, Homo sapiens
gtcctggaaagccacagagctgcccaaggctttgggagaccaccccttgtaccagtgtgccctggatatgag

SEQ ID NO: 10336 - DNA, 70 bp, Homo sapiens
tgagaggaggcccggggagagtatcaggtactgtaattcttagttctggacttgattctgtttgccaacg

SEQ ID NO: 10337 - DNA, 72 bp, Homo sapiens
tcttgcccctgctctggaagggacccatcatacctggactgttgcctctccagcaacaagtaggcctagaga

SEQ ID NO: 10338 - DNA, 70 bp, Homo sapiens
ttagcctcctaaagtgctggaattacaggcatgagctgctagacccagcccaaataatcttctgagagct

SEQ ID NO: 10339 - DNA, 70 bp, Homo sapiens
aaattatggaaacatgtgtctgcagctgtaagagagaaaattatagaggtggtctaatgttgctttccaa

SEQ ID NO: 10340 - DNA, 74 bp, Homo sapiens
gggccgcgcgcaggaaccccgccaccccaccgccctctcaggcgctgccctcccgcccagcgcggcaacccctg

SEQ ID NO: 10341 - DNA, 71 bp, Homo sapiens
tgaggccggccggcgaccttgacgctgccggccgggcccaggccaccgcgcggcgcctcgcccctgcccca

SEQ ID NO: 10342 - DNA, 73 bp, Homo sapiens
agtaatgtaatggtgctgaaaggaaagatgctggaaaccaaaaggcaggagttttcccaggagctttgctact

SEQ ID NO: 10343 - DNA, 70 bp, Homo sapiens
ctaagcctggaaacccccagcacaaatcacttctggggctaccaaatagcacggtgatgctgtgtgggta

SEQ ID NO: 10344 - DNA, 72 bp, Homo sapiens
gttggttgatgtttcagaatctagtgccactctcctaggcaagtttcgattttgctcaggtagctgctcctc

SEQ ID NO: 10345 - DNA, 71 bp, Homo sapiens
agaagcagaaatctatcccacacagtctgcctgggcatgtgtgctgagaagtggttcccttccttccatat

SEQ ID NO: 10346 - DNA, 73 bp, Homo sapiens
aggtgcccataactggcttttacaggttccctgtggctctcgttatacatgagtggcatggagatttcagtta

SEQ ID NO: 10347 - DNA, 74 bp, Homo sapiens
tccttccccgccgcctctcctcctcctcctcttccagctccggctgctccagagtcggcgctcctccgcctggg

SEQ ID NO: 10348 - DNA, 70 bp, Homo sapiens
gagaagtcgaggaacctgcctcgagtcatcagtagtagagccaggactcgagcaggagtatgtctgactc

SEQ ID NO: 10349 - DNA, 74 bp, Homo sapiens
aggctgctgtgtcatttcaagtaaaagctgatagtgggatgaactaatgtagaggcagtgggaataaagacaca

SEQ ID NO: 10350 - DNA, 73 bp, Homo sapiens
tcagagcctttcccctgaataagctagtcctagaatgtaacagcaactccaggcagggaagcccaggggtgct

SEQ ID NO: 10351 - DNA, 73 bp, Homo sapiens
tggaccccctatagtctttttcaactcagcaggcagagtaatttgcccacatagaatagctacaggcttttca

SEQ ID NO: 10352 - DNA, 73 bp, Homo sapiens
atactagttcttggcttgcagagcttgaagcaggtgacataaatccatgcaaagcacttagcacagggtgcta

SEQ ID NO: 10353 - DNA, 74 bp, Homo sapiens
gtcccaaactacttggtagcagtctggagcagggcccaggtctcccaacaagacatggcatatgcgtttgctac

SEQ ID NO: 10354 - DNA, 74 bp, Homo sapiens
cattccaaccaagcaccacatgctgaagctagtgaatcacattgccagttgggctttaaaaagaacaggtttga

SEQ ID NO: 10355 - DNA, 74 bp, Homo sapiens
aggaattaataaatgaatccttaggaggaaaagtgaaaatgaagtttttctctcaggatgaggtgtatttctcc

SEQ ID NO: 10356 - DNA, 73 bp, Homo sapiens
agtgctcagcaaatgtgaggtaggctgggtgccctggttcacgcctttaatcccagcacttcgggaagccgag

SEQ ID NO: 10357 - DNA, 71 bp, Homo sapiens
tggagcaatgaccaatgtatgactctgtctcttgtgtgaccatgtgctccagttttcccaggacataataa

SEQ ID NO: 10358 - DNA, 72 bp, Homo sapiens
gtcacttacttttaatgcaagatgcttgagataggctctcgttctgtcacccaggctggagtgcagtgctga

SEQ ID NO: 10359 - DNA, 71 bp, Homo sapiens
acagtagattgctgcttggtaccctgcctgaggatgtgcagtggcaaagccaagctttgtttttgttggta

SEQ ID NO: 10360 - DNA, 72 bp, Homo sapiens
atttcccaaataactgtgcactgggggagaggaaattctcagaccttttcagagtttattgaacactagctc

SEQ ID NO: 10361 - DNA, 71 bp, Homo sapiens
aaaaaacagactgggtgagaaggtaagcagaacctctgtgaaactacctcagaaggtctcactttcatgtt

SEQ ID NO: 10362 - DNA, 74 bp, Homo sapiens
cacagggacctcaggctccccagcataagaataggacactttgagagatatatttcaggaggcctgaaggctgt

SEQ ID NO: 10363 - DNA, 72 bp, Homo sapiens
tgtgttgtcagtcccagttgatgtttttggcttcacgtctggttaactttaggagagcacacaacaccaagc

SEQ ID NO: 10364 - DNA, 71 bp, Homo sapiens
atcctcttagcacagagctctctagacactgggctgtggaagcccagtgaggactctatgcaggtttcctc

SEQ ID NO: 10365 - DNA, 74 bp, Homo sapiens
tcgcctcccaacccgcgttgtcctcgcgccttcgccctgggtaggtgaggccgagaaggcaaccgcgaaaagga

SEQ ID NO: 10366 - DNA, 72 bp, Homo sapiens
ataaaaggggaaaggggcggcagcttccggagggttgcgcacggcacctaccagctgcccggccgggccggg

SEQ ID NO: 10367 - DNA, 71 bp, Homo sapiens
atttcattccctagatagatgctttaaactgtagaacctgccaaaccactctggtcaggttggagtaaagc

SEQ ID NO: 10368 - DNA, 72 bp, Homo sapiens
cttattcacattttgcttttcttgtttataaaatggggtatatacctaatgactcaggaaatttaggcagga

SEQ ID NO: 10369 - DNA, 72 bp, Homo sapiens
agctggagcgttgctcagggagccaatatcttgcctgctgttccttctccaaccagctcataggtagaaata

SEQ ID NO: 10370 - DNA, 72 bp, Homo sapiens
gtggcgggggcggggagcggtctgggcctgggcctgagccgaggttataagacgcagttcggaagcaaggcc

SEQ ID NO: 10371 - DNA, 73 bp, Homo sapiens
aaggtactcattgaagcagcactgcccagggctaaggccctggtctttgtaacatctaaagaactttctatta

SEQ ID NO: 10372 - DNA, 70 bp, Homo sapiens
atcttttcttgtaggtgaattactgccctgttaattataggccatttcgcttttaataacatctgtggga

SEQ ID NO: 10373 - DNA, 73 bp, Homo sapiens
ggggaagaattgaagccctattctcttgcagctatgaagcggatagccttgggcaagttttcaagcccctctt

SEQ ID NO: 10374 - DNA, 73 bp, Homo sapiens
tcctagagctggagccatggtgagatgagcctggaagaggacttggagctggtcaaaggtagtcactttagaa

SEQ ID NO: 10375 - DNA, 73 bp, Homo sapiens
gcctatgtcaacccactgggattttacaacagataatgataacaggaatagcttgtgagatagccctgggtat

SEQ ID NO: 10376 - DNA, 72 bp, Homo sapiens
agccctcctagcatgcaagagagtgcaagatctcccaagaaagagagatggagcatcaatggcatctagaag

SEQ ID NO: 10377 - DNA, 72 bp, Homo sapiens
tcctcacctattacttcccttctcaaagctgaatgctgggaacaagaagggaaatgagggctacaagctgtt

SEQ ID NO: 10378 - DNA, 71 bp, Homo sapiens
gctacctgcacatgctggagtagagggagaaggatgatagtatgaaattttgtcttcagtaccaaggagta

SEQ ID NO: 10379 - DNA, 70 bp, Homo sapiens
agctgcatttgtctttctgacctcatgcaattcctaggaaactctgtgttctgtgatttagtcaggcaat

SEQ ID NO: 10380 - DNA, 70 bp, Homo sapiens
cattaacacagcacctgccccagttctcccaggagggactggcggtggctaacattcacaacctcttcca

SEQ ID NO: 10381 - DNA, 74 bp, Homo sapiens
gattgttataggcgacaaccacgtggtcacttctcgcccggaaatacgggggccggaccttagcccacggtcgg

SEQ ID NO: 10382 - DNA, 73 bp, Homo sapiens
ggaagtggcatggagcgggtgcatggaggtggtaccctccatgcttttgtttgcatggccctgcctccaggcc

SEQ ID NO: 10383 - DNA, 72 bp, Homo sapiens
cagcccatccgcttggggccctgcccaagtcctggtagcaccaaccagggcgcccagcaaaagcaaagggta

SEQ ID NO: 10384 - DNA, 72 bp, Homo sapiens
actgtgtacggacaggaagatcaggtgcagctttgtaggccatttttagaatttgagttgcgttttcctccg

SEQ ID NO: 10385 - DNA, 72 bp, Homo sapiens
cactgagttctagcctgtttattgtaagtggtgattagttgggtctcagtcacccagccatacttttttgtt

SEQ ID NO: 10386 - DNA, 72 bp, Homo sapiens
atgttgggcttgggataccagggtttcgcatatctggagaaagcctggctcatggaccgtctttgtcttgct

SEQ ID NO: 10387 - DNA, 71 bp, Homo sapiens
ttatgctttttcttatggtatttggcaggattgagaagtaaatgaccagcatgcatataggaaggaggtgg

SEQ ID NO: 10388 - DNA, 73 bp, Homo sapiens
actggaagaccttgtgctgatgccctgacaggctgtcagggaccagatttaggtcaagggccttcaggtaaac

SEQ ID NO: 10389 - DNA, 73 bp, Homo sapiens
taaaatccttggagcagggaggcagaggttgcagtgagccatgatgataccactgagctccagcctgggtgac

SEQ ID NO: 10390 - DNA, 72 bp, Homo sapiens
gctggtgtgtggctgttgggtgcattatgtcttactgacctgggtctactatccttgcccccagcccactcc

SEQ ID NO: 10391 - DNA, 72 bp, Homo sapiens
gccccgccctgaaggccgccccccattcttccctgctgagatgaagcactgcctctcaccctgatggggcca

SEQ ID NO: 10392 - DNA, 72 bp, Homo sapiens
actagggatcatggttccccggtaatccatggtcttgccaatgtagcggtaatgctgtccaagagaggggag

SEQ ID NO: 10393 - DNA, 73 bp, Homo sapiens
cagaatgggacagggagatggctttgtccttaggaaatagcctctttacacagtacctggcctccagatgcta

SEQ ID NO: 10394 - DNA, 70 bp, Homo sapiens
gcagcctaggagggcctgaaggattcgacccccattatgcttctgtcttcaatgtctgccaccatgctcc

SEQ ID NO: 10395 - DNA, 71 bp, Homo sapiens
cctagatctgtatgactagccctgacctctggctcaagcttcaaggtcatgggtccaaatgcccactgagc

SEQ ID NO: 10396 - DNA, 72 bp, Homo sapiens
gctgcctaagttcaggactggatacataactgaaaaggccctatgcagaatgaaaataggaagcccttgttc

SEQ ID NO: 10397 - DNA, 73 bp, Homo sapiens
gtctgataagtgaagtttgctggcttcaccgcaaagtttgctggcacccagataagggcttagaaatgtaaac

SEQ ID NO: 10398 - DNA, 74 bp, Homo sapiens
tttgttatagctggaatatggtgatgagattttaaaagatttcttttaaaggagctcagtggctaaaagtcagc

SEQ ID NO: 10399 - DNA, 74 bp, Homo sapiens
tcttaatgatagtagcactgggcttatgtttttattggatgaatttgctcagcttcatactgttgtgttacaaa

SEQ ID NO: 10400 - DNA, 74 bp, Homo sapiens
caaggctaaggtgccggcagattgggtgtcttggaggcctctgtcttcccccagtgtcttaaccaggtcttcat

SEQ ID NO: 10401 - DNA, 72 bp, Homo sapiens
tctcctgaaggcccactctccctttgtgtggtaagaccccctctgtgggggtgtgatgagagcagtactcag

SEQ ID NO: 10402 - DNA, 71 bp, Homo sapiens
acttttgaaaacagatgtggtccagcctagtgccatgatggctgctattgctattacctgcccctcaaaac

SEQ ID NO: 10403 - DNA, 74 bp, Homo sapiens
tcagtctttttttaggcggggaggaggatgagtaatagacacctctagtcagccatcttgccgacatcaccgac

SEQ ID NO: 10404 - DNA, 72 bp, Homo sapiens
atgggggctgcttgtccctgagagtaaggcataagcccagtgttcagactcctgaggggatgagggagtagt

SEQ ID NO: 10405 - DNA, 74 bp, Homo sapiens
ggggaaccaggaaggtcctgaccacagacatacagtgaaaacagaccattgctgggtcaaattctggcagctcc

SEQ ID NO: 10406 - DNA, 70 bp, Homo sapiens
tgagagttctgggggtgagacaggatgtcaagatggaaggtccccagcctctggagtagagctcaggcta

SEQ ID NO: 10407 - DNA, 71 bp, Homo sapiens
tgactcattcactttccaaatatgcgcctctgtcttaaacagtaagtgtaagatgacagtgtgtacctgga

SEQ ID NO: 10408 - DNA, 70 bp, Homo sapiens
ctctcctgttttctggcaaggtgggtgggaaaaaaaccccggcatttaacaattttgttttaaggagcca

SEQ ID NO: 10409 - DNA, 73 bp, Homo sapiens
tcagccagtgcaattggccaaagatggggcagctgtgctgtgggcccaagccagagggtcccggtttggtgaa

SEQ ID NO: 10410 - DNA, 72 bp, Homo sapiens
agtaatagtaaatgacttataagctaacttatttgttggttcttaaggcagttaccaaataggagttctaga

SEQ ID NO: 10411 - DNA, 70 bp, Homo sapiens
atgggggtgtgaagatgatggtccaggcgaataatggtcatgataatcacattgccagagagagtcagca

SEQ ID NO: 10412 - DNA, 71 bp, Homo sapiens
gccaaggtatggggattgcaccatctgaagctatgacctgagctgtaccttggtcccttttaaccatggct

SEQ ID NO: 10413 - DNA, 72 bp, Homo sapiens
ggaaatgagggggaaccaggagcgtggctccctttagagcctttatctcaaccactcaccccaccacgccac

SEQ ID NO: 10414 - DNA, 70 bp, Homo sapiens
ctgctggcttttaactcagttccctaattcactgtgtgatatagggaaaagtcacttcctctccttctga

SEQ ID NO: 10415 - DNA, 72 bp, Homo sapiens
tcagttgaaataactaaatgatgtgagaatattggcatcctgtaaaaatgggaaaccaatgatccaggtctg

SEQ ID NO: 10416 - DNA, 71 bp, Homo sapiens
gtgaggtggggatggcggagcggtctccagtggcaggtgggggcgagggcctagccctcccgcacgctcac

SEQ ID NO: 10417 - DNA, 70 bp, Homo sapiens
atttgaacagctcctgccttgctgctgggtgctggagaggctaaatgtatgactaaggagcatcaagtga

SEQ ID NO: 10418 - DNA, 73 bp, Homo sapiens
ggctctacacacatccctgtcttacagaggataaatccaacaaggggacactgcggccagccaaaagcatgga

SEQ ID NO: 10419 - DNA, 70 bp, Homo sapiens
ggtggaaggatggccctttgctagtaaggcaggacattatggtagaggcaagatgagttcatagatagga

SEQ ID NO: 10420 - DNA, 70 bp, Homo sapiens
agaagaataaatcaaaactattagtgtacaacagatggcccaagaatgagccaaggtttacactttgaca

SEQ ID NO: 10421 - DNA, 70 bp, Homo sapiens
ctcctaatggatttatctttgtacggggaaatcaagaaccttgcactttgtcagaagatgagccacttca

SEQ ID NO: 10422 - DNA, 72 bp, Homo sapiens
tgcccctggaagcagtatgtgctgctaggggttgaacaccatgcctctagtcctgctgccttcagaatccac

SEQ ID NO: 10423 - DNA, 72 bp, Homo sapiens
gcgggcccaggccggctcctcccgccgggctcagaggccccgcccgccgccgggtccgcccccgcgctgccc

SEQ ID NO: 10424 - DNA, 72 bp, Homo sapiens
gacaataggaggctattccagtaatccagatatcggagggacctaaatctgtcttgcagcctgttctcttgc

SEQ ID NO: 10425 - DNA, 70 bp, Homo sapiens
attcagataaatgatggaacctccagggagtacaaactgctgcccagctggagcattgtaagacaccaag

SEQ ID NO: 10426 - DNA, 71 bp, Homo sapiens
gaaaaagatggcaaaaccttggaagggagatccaggctctggtcactgtggataaggccagtcaaatttta

SEQ ID NO: 10427 - DNA, 73 bp, Homo sapiens
tgtttaaaatgtatccttaattgtaaatacctgatgctagatctcttgatagtgggtttcaatgggaggagga

SEQ ID NO: 10428 - DNA, 72 bp, Homo sapiens
gtgatgttttagggccttcatagattaaaatcttgaaaaacagcaggctagtaatccagctccatgcatcag

SEQ ID NO: 10429 - DNA, 72 bp, Homo sapiens
ttggtcatattatgggatacaatttaatgtttcaatacatatatatatatatgtcttataatgatgatcaag

SEQ ID NO: 10430 - DNA, 72 bp, Homo sapiens
ttcacaagcagtggccatggtttagatgaacagtgcatcactcttgtccagttttcttgaagccaaatagtc

SEQ ID NO: 10431 - DNA, 73 bp, Homo sapiens
gtttggctggctcagaaaactggtgcacagatcttctttgttcctccagctgaactcaaatacaaaccttcat

SEQ ID NO: 10432 - DNA, 73 bp, Homo sapiens
tcaggtagctcgctgaacaccctaggaaatgatgccatatcaggaactcagtgtggtctccgatgctggtaga

SEQ ID NO: 10433 - DNA, 72 bp, Homo sapiens
tgcagtaaggctgtagaggagagaaggatcaggtcaggaaggggtttgtggtccaatctatggcacttttaa

SEQ ID NO: 10434 - DNA, 73 bp, Homo sapiens
aaaaggaggtgtctatgggctgacctgatggagtgaaccagaaattcagacggcagcacagctagatacttta

SEQ ID NO: 10435 - DNA, 74 bp, Homo sapiens
ttagttccagcacattccccaagaattggtttggatctgtgtgtatgaagcaggcagtttatatccaattgtgt

SEQ ID NO: 10436 - DNA, 72 bp, Homo sapiens
tgccatcttaactgcttgatctttctacatgtttctcctatgaagacagtgctagagagcatgtgagagaga

SEQ ID NO: 10437 - DNA, 73 bp, Homo sapiens
ggcaaggaggctggagtctctggtgtgggtgttttgtaagacacccccagcaggggccagaagtctgtttgct

SEQ ID NO: 10438 - DNA, 74 bp, Homo sapiens
ttacaaaccaagggtgcaaaaaaaggggtacagtgaagtctgcctccagtccctgctctctgcccagctctccc

SEQ ID NO: 10439 - DNA, 73 bp, Homo sapiens
tctcatttaggcagtagtgatctttgtcaaatacaaagatgactgggtgtggaagattgggaagaagaaggaa

SEQ ID NO: 10440 - DNA, 74 bp, Homo sapiens
tgtatgtgtccagggactgtataccctgcctgaccctcaattcaccaggctagacaagccttcccataaacaac

SEQ ID NO: 10441 - DNA, 72 bp, Homo sapiens
ccagcagattccagggtttgatttttctcaggactctggacttggagtcagaagtcctgtatttagatcctc

SEQ ID NO: 10442 - DNA, 71 bp, Homo sapiens
aacccatgcctgctgagttaatcctttgctgcaaactgacagcaaggcaccactagtacacagattgtggt

SEQ ID NO: 10443 - DNA, 74 bp, Homo sapiens
ggaataggggaacctctctagggccacgcacctgcaggttagctgtggtgacctaggcaggatgactctgtccc

SEQ ID NO: 10444 - DNA, 73 bp, Homo sapiens
gaatgagatgttttttcgcttatcagactggcaaatagcgaacagtttgagaatgctctgtgttggagaaata

SEQ ID NO: 10445 - DNA, 74 bp, Homo sapiens
ggagagacaagggaggagctgttactgggcccctagagacacagagggctatgtggaggggctgtcttaagagc

SEQ ID NO: 10446 - DNA, 70 bp, Homo sapiens
aaagcccaagaaaaccagggagaggccactggtgcaggtcctgacctgacctaaaggccagtaagtctgg

SEQ ID NO: 10447 - DNA, 74 bp, Homo sapiens
tatcctctctggaattgaggtagtaggttgggagtaagagactctggagcctcttggttaaattccatgtggga

SEQ ID NO: 10448 - DNA, 70 bp, Homo sapiens
accaagcctcttgcataagtggcaaaagaaaataattttctagcacctctgtaagagtcatcaaggataa

SEQ ID NO: 10449 - DNA, 74 bp, Homo sapiens
tgtgctgacagcgagaatttcaagccagtagttcttagcttgctggactgcgtgggagtgggaactgctgagcg

SEQ ID NO: 10450 - DNA, 70 bp, Homo sapiens
gcccaggaggcctgacctgagagctattgaagcagcaactagaacgtgatgtccctggaggtaagacaaa

SEQ ID NO: 10451 - DNA, 74 bp, Homo sapiens
tgtttttcacagtggctaaaccaatttacattcccacagtcatgtataatacgttattgacatttggtttagcc

SEQ ID NO: 10452 - DNA, 73 bp, Homo sapiens
ttcatcaaaacatatctgtaaaggatgacaagccaggaacctgaatcctgggaatgtgcttcagagatggagg

SEQ ID NO: 10453 - DNA, 74 bp, Homo sapiens
cttccccttggcacagagacaccaaattgggggaacgagggtaaaagggtccttagggaggtgttaattcttac

SEQ ID NO: 10454 - DNA, 74 bp, Homo sapiens
tcattcccacctcctagcctttgaactagctgttctgatgttgcccagggctggctcctttccatcacagaggc

SEQ ID NO: 10455 - DNA, 74 bp, Homo sapiens
gggctagtatattttagcagatcgggttgttagtacattctctccctgtgctgagatagattgttctcacaaga

SEQ ID NO: 10456 - DNA, 74 bp, Homo sapiens
aaatgttgtgcttactccgcagaggcggatggatccactacttctccccccactgcaaaatttggttaagatgt

SEQ ID NO: 10457 - DNA, 74 bp, Homo sapiens
ctttaagaaagaaaactttggggaagagtaaaagcactgggcttggagtcagaagtcctaggttctctcattta

SEQ ID NO: 10458 - DNA, 73 bp, Homo sapiens
tctcttgggtgggcaagtgcagtgagagggagggttgtcatcagacgtgtagtcctcaagcagcatcatatct

SEQ ID NO: 10459 - DNA, 73 bp, Homo sapiens
ttcctgatggcactcaggatgcagctggcagaaatcagtgtcatgtcacactggaactccctgtgcctgaacc

SEQ ID NO: 10460 - DNA, 73 bp, Homo sapiens
ccgccccgccccccccacgcccggccgggcccctccggcccccggagccccgagccgcctccccgcgccccgc

SEQ ID NO: 10461 - DNA, 73 bp, Homo sapiens
caccttcgcatggctcttttctatagttgcattcatggctcagttcagggaatactgggtctagcattaggga

SEQ ID NO: 10462 - DNA, 73 bp, Homo sapiens
aaatgctctttgtcttccactgaatgcaaataccccaaggaaaggtagtatattcattaagggaagggataat

SEQ ID NO: 10463 - DNA, 80 bp, Homo sapiens
gtgtggattgaatgtgatgatgcttatgaaataggtagtcctacattaagcaataattattaccattatcactggtctca

SEQ ID NO: 10464 - DNA, 80 bp, Homo sapiens; identical to SEQ ID NO: 10463

SEQ ID NO: 10465 - DNA, 71 bp, Homo sapiens
actgggcagtggtgctttgggatggggttgctatccttccaggtgccccttgtaatgcagatagggatggc

SEQ ID NO: 10466 - DNA, 73 bp, Homo sapiens
ttagatgcacgttttctcatgggaataatgctgtcgtaggtctcaccactattatatgagaaaaaagcaaacc

SEQ ID NO: 10467 - DNA, 74 bp, Homo sapiens
ggggcttaatctcttggagagggttgttccataccagtggcccttctacaggtatttctaatggtaggttccac

SEQ ID NO: 10468 - DNA, 71 bp, Homo sapiens
aatgatattccatcttcccttaatgttgagcacatagcagcaccacacagggatgagtatatcacactgac

SEQ ID NO: 10469 - DNA, 72 bp, Homo sapiens
caggttttgtctgcctcgtttcccggtcagggaaccaagaaatgtagcatgaccagccggagacaaaacctc

SEQ ID NO: 10470 - DNA, 72 bp, Homo sapiens
tggagggcgattaggggaggagtgggaaacttccgagaaccgctcgggactgggcgccgcgccggagtgcgt

SEQ ID NO: 10471 - DNA, 71 bp, Homo sapiens
cacagctgctacccggtgttctcaggactaagtggtttaccacactgatgaagctcaggtagccaaggtgc

SEQ ID NO: 10472 - DNA, 72 bp, Homo sapiens
tctagatgctttgtttttgtcttgtttttatacccttgaacattattaatgactgcagagctttctaagtgg

SEQ ID NO: 10473 - DNA, 70 bp, Homo sapiens
aaataaagcatggtgaggaagttggatgtgccagcactagatggcaagctgcaattcaacccagtgggca

SEQ ID NO: 10474 - DNA, 73 bp, Homo sapiens
gccccagtatctcacctcagctggtgctctgtgtaggatgtaacctgtgcaaatctatgcagtggtcctgaga

SEQ ID NO: 10475 - DNA, 70 bp, Homo sapiens
ctttcagcggctggtacaaaaaaaatccgctgtaaaaccatttacaatggtaccagccagaaatgtgata

SEQ ID NO: 10476 - DNA, 70 bp, Homo sapiens
gcctggtgggaggtgattggatcatgggaacagtttctaatggtttagcaccatctgccttcggtactgt

SEQ ID NO: 10477 - DNA, 73 bp, Homo sapiens
caaagacataccaattttgtcaaggtgtttgttgctgcgagctttcagcagctgtgacaaggtcactgtggct

SEQ ID NO: 10478 - DNA, 70 bp, Homo sapiens
aagtgtgatctactggaaattagcttctgactaaggcagaaacaggatctcagtagtcatcaaaaggttt

SEQ ID NO: 10479 - DNA, 74 bp, Homo sapiens
aagaattgctagagctgtacctttatgtaggcaagaggcaatggaggctggttcgagtgcagtggtgtttacaa

SEQ ID NO: 10480 - DNA, 73 bp, Homo sapiens
tgcctgaatgtcccaccgctttgttaggaaataatttgttgactcagctgcaaacagtggcatcttttggaga

SEQ ID NO: 10481 - DNA, 72 bp, Homo sapiens
catgcccttaccctcctaactggggaaacttctcaaattaggcaggcagcgttacaaaactgcatgtgtttg

SEQ ID NO: 10482 - DNA, 73 bp, Homo sapiens
tctgccccagaaaagtctgatggatattaaaaggctagatatctaggaaagagctgctgagtagagtgatgaa

SEQ ID NO: 10483 - DNA, 74 bp, Homo sapiens
cccaaacagccacatccccagagagcccagctgtgtggagcagagagaggccggcgggagggggcggggtgggg

SEQ ID NO: 10484 - DNA, 72 bp, Homo sapiens
ggcagcactgaagagagcagggagatgctcgtgggagcatcatttgtagtggtttctctggtggtaactgcc

SEQ ID NO: 10485 - DNA, 72 bp, Homo sapiens
ataaatatatggaggtctctgtctggcttaggacagctggctaagtctgatcgttcccctccgtacagcctt

SEQ ID NO: 10486 - DNA, 72 bp, Homo sapiens; identical to SEQ ID NO: 10485

SEQ ID NO: 10487 - DNA, 73 bp, Homo sapiens
ttcactgagagttaaatgacaaatagtatccatttactggatacttatgacatgtcaggcataatgctaagtg

SEQ ID NO: 10488 - DNA, 73 bp, Homo sapiens
ccacacacatgtgggctcatgttcaggaatatgctaaatgcagatggttcctgagtttagccttaaaaaacaa

SEQ ID NO: 10489 - DNA, 73 bp, Homo sapiens
tatcacattattacttttggccatgtgttattttaaataggtagcagaggtctttcaaaggtttacagaggta

SEQ ID NO: 10490 - DNA, 73 bp, Homo sapiens
tgagttttagtatgaactgggtatgctatagcttaaatgtagtccacaaaagttcatgtcttggaattttgct

SEQ ID NO: 10491 - DNA, 74 bp, Homo sapiens
aatatattcactccaatatgttcatggatatatggagatagatatgtagaactaaactaggcaaagacgtttca

SEQ ID NO: 10492 - DNA, 74 bp, Homo sapiens
ccatagcacagttgttcctcagagtttcacaggtggaggtagtatagcctagtggcaaaggctgtgtgtactgg

SEQ ID NO: 10493 - DNA, 73 bp, Homo sapiens
gtaatgaatgtgctggaagccagctgctgagtagaggaaggtaggtggcaggtgtcgtagcaccaacaaaaga

SEQ ID NO: 10494 - DNA, 74 bp, Homo sapiens
agttggccatgagttctgggggtctggagccggtaaattgctttatatctgaaatgatatcataggtttttact

SEQ ID NO: 10495 - DNA, 70 bp, Homo sapiens
aatctgagtcattgccatgttcggtgggtggggcctagcatttggcatctccaggcaggaatcaagttca

SEQ ID NO: 10496 - DNA, 73 bp, Homo sapiens
gcacatgacagtaatccagctacttgggaggctgaggcaggagaattgcttgaacccaggaggcagaggttgc

SEQ ID NO: 10497 - DNA, 86 bp, Homo sapiens
cttacatcacacacagagttaactcaaaatggactaatttttccactagttagtccatttcaagttaactctgtgtgtgatgtagt

SEQ ID NO: 10498 - DNA, 73 bp, Homo sapiens
gtggcctacttaaagctagcaccatttgatgcagtgtgactgttaacggaaggttttaagtgagccgcctttg

SEQ ID NO: 10499 - DNA, 72 bp, Homo sapiens
gtgaagatgctttactgctgttttagtatacaatatataacaacatataattaaaagaatagggtaaggtaa

SEQ ID NO: 10500 - DNA, 70 bp, Homo sapiens
ttcttccttttcgtggagaacagagtcttgctatgttgcccaaggcaggtctcaaactcctgggctcaag

SEQ ID NO: 10501 - DNA, 74 bp, Homo sapiens
agtgtgtctgggagccggcatgagagcgtgggggaggccgggggtggggtcggggcggggtgggtggcggacgg

SEQ ID NO: 10502 - DNA, 72 bp, Homo sapiens
tacatctcatcagtctaagtatattctgctctaaagaatgtctcaaagccaggtgtcactgattggagagat

SEQ ID NO: 10503 - DNA, 73 bp, Homo sapiens
taacttatgaaattgacacagcaggttagcagtcccagagaagaagtttttttccctgttacctgtcttcctg

SEQ ID NO: 10504 - DNA, 71 bp, Homo sapiens
atatgtgctgctccctacgtgtgtgtgcgtgtgtgagtgtgtgtatgagtgtgtgtgtgacagtgtgtgtg

SEQ ID NO: 10505 - DNA, 70 bp, Homo sapiens
ctcttcagtatctgctggcctgtactcaatgctgcccaaaaccaagatataggcatcagtgcagacagag

SEQ ID NO: 10506 - DNA, 73 bp, Homo sapiens
ctggctgatttgatcctgtgtctgatcccattgcaccctgactgggcagtccctacagaaccagtgttaattt

SEQ ID NO: 10507 - DNA, 71 bp, Homo sapiens
ttctggtctggaaaaattgggtagctcagctggtcagggatgagtagatgagatgctggcatatattactt

SEQ ID NO: 10508 - DNA, 74 bp, Homo sapiens
tcagagctgcctcatgcctatttccatgcctaggttatgctgtaggaagcattggcatatccaaggctagatct

SEQ ID NO: 10509 - DNA, 73 bp, Homo sapiens
gctgtcacatgggcttgcatcccactgaacttgctgcacacaatgaagcaggttggggggagggtggccaagg

SEQ ID NO: 10510 - DNA, 70 bp, Homo sapiens
acactgaagcaaacatctccggtctatgtatcagagggttaggggtaggatgggatgggccacatagcaa

SEQ ID NO: 10511 - DNA, 73 bp, Homo sapiens
gaaaagggtgaggagtggtacaatctatgcaaggccaggtgtgtgagaaaaccatggtacctgaaagcctggg

SEQ ID NO: 10512 - DNA, 71 bp, Homo sapiens
cacatttaacttgtttaaattcagggtctgtgtcactttgattaaaatttaaatgagatctaggtgccact

SEQ ID NO: 10513 - DNA, 74 bp, Homo sapiens
aagagcggagcgtgtgagcagtactgcggcctcctctcctctcctaacctcgctctcgcggcctagctttaccc

SEQ ID NO: 10514 - DNA, 72 bp, Homo sapiens
ataatgcatgtgcggcatactgggaggtccactggggaaggagacccagttcagcaagtgaaatgggaaaag

SEQ ID NO: 10515 - DNA, 71 bp, Homo sapiens
cccagcatttccgcagagctctgtgagtgcttaactcacttctccatgcattggagtcagctatttaaatc

SEQ ID NO: 10516 - DNA, 72 bp, Homo sapiens
tggcacgcgctctgcgcatgcgtacgctcgctggccccgccccctagcgccgcggtcggagccatttcgccg

SEQ ID NO: 10517 - DNA, 70 bp, Homo sapiens
cgcctgggggttttgaactgtttgggtacagataactctttttagtctggatacttacagtgatcctgaa

SEQ ID NO: 10518 - DNA, 72 bp, Homo sapiens
gcattttgtcatgggtaagatccaggccatggaagtgagtcaggcagtttttgccctggagatcttcagtaa

SEQ ID NO: 10519 - DNA, 74 bp, Homo sapiens
tcagtgcatgagtggttcagtggttcattgggcatcctggttgagggaggggctgggtaaccaactgtattcac

SEQ ID NO: 10520 - DNA, 72 bp, Homo sapiens
gaggcctataattggcttcaaacttgcattgacccactgtcaagccaataaggctttgccctacataacaca

SEQ ID NO: 10521 - DNA, 74 bp, Homo sapiens
taccctccagtctcaaagcacatgtatctcttgttccatgatccaaaagaaggagaaggggcttaagtgtgatg

SEQ ID NO: 10522 - DNA, 73 bp, Homo sapiens
gtctcccccgtctgcgggatgtagatatgtacactgacaattacatactacaaatactgtaatggaagtggga

SEQ ID NO: 10523 - DNA, 73 bp, Homo sapiens
gattatcttggttaaccaggttttgattacccaatgcaatcaaaagggtccttaaaagtggaagaggcaggca

SEQ ID NO: 10524 - DNA, 74 bp, Homo sapiens
ggataggcagagccctgtactgggagaggtatccagtttgaagaactggggtccctcctactctagtttgcact

SEQ ID NO: 10525 - DNA, 73 bp, Homo sapiens
agcaaagagtgcaagtcagattattccaaagggaatagcagttgacatcctgtagtgccaaaaccgttcctag

SEQ ID NO: 10526 - DNA, 71 bp, Homo sapiens
cctttggaataatctgacttgcactctttgctgatggctgtgggtgacaggattaggcatgtacaggattg

SEQ ID NO: 10527 - DNA, 73 bp, Homo sapiens
caggaaaagtaattcagaaggtccctgccctgaggagccaccagtctgacctatcttaattgctacattttcc

SEQ ID NO: 10528 - DNA, 72 bp, Homo sapiens
tcttgcaatttttttttacatgtaaagaggataggttctagctactccattccatgtaatgggcaagtttcc

SEQ ID NO: 10529 - DNA, 72 bp, Homo sapiens
tttcttttaaacgattggctcctcaaagctgaacactcacaatgttgtgcagccaatctacagaactctttt

SEQ ID NO: 10530 - DNA, 70 bp, Homo sapiens
acccaggcaaacagggtctggagtgaacctccaacaaacgccagtagacctacagcagagggacctgaaa

SEQ ID NO: 10531 - DNA, 73 bp, Homo sapiens
cgagtaaatatcttggttcgaggaggagaagtttacgaacgctctcctgagccagtgtttcaaactttctatg

SEQ ID NO: 10532 - DNA, 74 bp, Homo sapiens
tttaaacctgcaatggtggcatgtgttattgttctcttggctataatttgttcaggtgcttttatcaggcaagg

SEQ ID NO: 10533 - DNA, 71 bp, Homo sapiens
cagaggttggcaactctgacctatgagccagttctagtgtgaggcctggttttttttatgacttgcacact

SEQ ID NO: 10534 - DNA, 73 bp, Homo sapiens
tccatcctatttttcttcgaatacatcaatcacttgacctgtactgtgtttaatcgagattaaatgggacaca

SEQ ID NO: 10535 - DNA, 70 bp, Homo sapiens
gcagactggggtatttgtggctgagagtgtttgcctatttgcaagtagagtgatacacatagtgagtgct

SEQ ID NO: 10536 - DNA, 71 bp, Homo sapiens
agagtccttgaagatgcagctagttaggatgaggtcatcctggactggggcgggggagtaaattcaataag

SEQ ID NO: 10537 - DNA, 70 bp, Homo sapiens
gtcctttgttttattggcaagtggatgagaaaataagatctaagtgctagttgtgttcagtggtacaaaa

SEQ ID NO: 10538 - DNA, 74 bp, Homo sapiens
ttttgcctttaggggttgctgtcagcctgagtgttggaagaagacatagcaaaactcacagcaaacttacaagg

SEQ ID NO: 10539 - DNA, 73 bp, Homo sapiens
gctactggtctcactagagtgtgaagcacagtcaatagcaccatttgacctcagagcgcacaagcaacccagt

SEQ ID NO: 10540 - DNA, 72 bp, Homo sapiens
tgtagctggggtttttatttttgtttttggttttcatgtggcagcttcaggaatcccaaaagcagcaaaggt

SEQ ID NO: 10541 - DNA, 71 bp, Homo sapiens
ttgatatcgccctcagggagagtgttttttgtgttgaatactctttgtgcttaacgaaattgattgctctc

SEQ ID NO: 10542 - DNA, 70 bp, Homo sapiens
agttggaacggatcctacttctacaccatgcctttggtattcaggatcttgaggttcccttactaaaagc

SEQ ID NO: 10543 - DNA, 72 bp, Homo sapiens
ccctccccctgtgggctcaggctcagggaaatccaggttctgtccctgagaccctagctgaagttgttggag

SEQ ID NO: 10544 - DNA, 70 bp, Homo sapiens
gtctctatggactaacaaatctaggtagcctttgtggcactagatttgtaaaaaggtttgacatgacttt

SEQ ID NO: 10545 - DNA, 72 bp, Homo sapiens
gggaatgtggcactgagatgtattttgtaattaattaggtgattatgatgtagtagattgtatcagtgcttg

SEQ ID NO: 10546 - DNA, 74 bp, Homo sapiens
gatgtccatgtctaaaagggtcttgagagactaagtagcaatagctaaaatccaaacaaaacttaagtagatat

SEQ ID NO: 10547 - DNA, 71 bp, Homo sapiens
cgtcctttactaatttcagaaacaaggcataaatgtaatcatatatttgtgccattgaagattggtaacat

SEQ ID NO: 10548 - DNA, 73 bp, Homo sapiens
tcttacatggcattcaggttgctgcatggtacgctgagtttcaggttattcagatccctaaaagcgagagaga

SEQ ID NO: 10549 - DNA, 70 bp, Homo sapiens
aacggcatgaacccaggaggtggagcttgcagtgagctgagatagcgcaccactggactccagcctgggc

SEQ ID NO: 10550 - DNA, 72 bp, Homo sapiens
aatactatccagccataaaaatgaatgagatcatgtcctttgtgggaacatgggtgtggctggattccattg

SEQ ID NO: 10551 - DNA, 74 bp, Homo sapiens
gtgtccttcagtgtctaaatgaatgaataaattggttcatccagacagtgcaatgttatttggcacttaagagc

SEQ ID NO: 10552 - DNA, 74 bp, Homo sapiens
atgaatcagagtttgtcaaatacttttactctttgcatctattgagatgatcaagtggtttttgacctttgttc

SEQ ID NO: 10553 - DNA, 74 bp, Homo sapiens
taaagctgggaacaatacaaactcgagactaccaaagctgggagaaagagaggaggtgttggctggaaaactac

SEQ ID NO: 10554 - DNA, 72 bp, Homo sapiens
ttgttccctggcgggcaggggcgggggacacaaggtgctcagtgggggagcttctgagccaggagaaggaat

SEQ ID NO: 10555 - DNA, 73 bp, Homo sapiens
gtggctagtttttgtgggatgagtctcacaggtgatatgaatctttgtgcaaatccatgtgaatgtgagtttt

SEQ ID NO: 10556 - DNA, 73 bp, Homo sapiens
aaaacatggaaatagctggttgcttcttgaccaaaaaatggaaaggaaactggctcccaggaatccctatgct

SEQ ID NO: 10557 - DNA, 74 bp, Homo sapiens
gcgcagggtgggtgccccgcgcctgcagcgtccgccggggcggcgcggcgggaggtggccgacaggctccgggc

SEQ ID NO: 10558 - DNA, 71 bp, Homo sapiens
gacccagcctatttctagcttatcaagtcacactaggcttgaagggacaaagagtacatgctggctttatc

SEQ ID NO: 10559 - DNA, 73 bp, Homo sapiens
taaactgaggcttgccgagatgacccaagccaaatagcttctaggtagcagggtaagaaataaaaacagctta

SEQ ID NO: 10560 - DNA, 73 bp, Homo sapiens
cctcagtctattcacagcagcatttatgtcaatcatgagtgttaaaagatgtgaacttttaatttataaagca

SEQ ID NO: 10561 - DNA, 70 bp, Homo sapiens
tctatgagttgacaaatatcacagtgttgctgggtatgggatgccccaaatgtagatatggctgcaatga

SEQ ID NO: 10562 - DNA, 72 bp, Homo sapiens
attctccccctgccctgagcctctcccttatgtccacataggctctagcattggaagaaatattttaagatc

SEQ ID NO: 10563 - DNA, 74 bp, Homo sapiens
tcctggcataccagagtctagtctgtactctcttggatgttaattgcattttagctgtgaccagactctgtttc

SEQ ID NO: 10564 - DNA, 70 bp, Homo sapiens
ctctgtatgtaggttttacagctgtattgggctgttataagccatggcccttgaaaatcctgatctttat

SEQ ID NO: 10565 - DNA, 72 bp, Homo sapiens
gagtgtactgttttggatttatttttggttttgttttcactcagccctacaagaccaggattggagacactt

SEQ ID NO: 10566 - DNA, 71 bp, Homo sapiens
ttgcccgagttcacactgatctgctggccactggtggagcctgtttctgtaccagacctgtctgattttgc

SEQ ID NO: 10567 - DNA, 73 bp, Homo sapiens
tagtcagtagcaaacatgttatttttgggaagtctcttttctgacttgttaaagcaagtatgcatgggcctat

SEQ ID NO: 10568 - DNA, 70 bp, Homo sapiens
cgctggactctaatttgaacctaggattagcactgcggcatcagaggctatgggggctgttcagctttca

SEQ ID NO: 10569 - DNA, 73 bp, Homo sapiens
cgtttcctgtccagactggtcccagctcccacactgagctgcgtggagagccagtgaggcaaaacaagtgaga

SEQ ID NO: 10570 - DNA, 73 bp, Homo sapiens
tcagatccacgctcagcctcgagtctcatgttccaaccgaccgtctggctcagtgactgtggacactggggag

SEQ ID NO: 10571 - DNA, 73 bp, Homo sapiens
gttcaagaatgaccgcagcctggaaggaaaccccgcggtgtacagcactgacctgctgggcgtgtgctccctc

SEQ ID NO: 10572 - DNA, 74 bp, Homo sapiens
gagacatagtcaaacacaaatacaaaaagccatcaaagtgggggctcctgaggcgagctccttcactgtgcagg

SEQ ID NO: 10573 - DNA, 74 bp, Homo sapiens
catgaatgggatggccaatgtgaatcccgccagccgccctcactacgcctccgccatcccggtgcctcgtgcct

SEQ ID NO: 10574 - DNA, 72 bp, Homo sapiens
gctgtggcttggaaaggggcagtgacagccagatgataagctctgtccctgatcttctaataacactcagca

SEQ ID NO: 10575 - DNA, 74 bp, Homo sapiens
gcccgagcctggccgcgggctgggccccgccgcagctccagctggccggcttggtcctgcggtcccttctctgg

SEQ ID NO: 10576 - DNA, 73 bp, Homo sapiens
agcccccatgtggtgtactgaaaactcaaaaaactgtgagatatagccactgcccttgaggggctttcagtcc

SEQ ID NO: 10577 - DNA, 71 bp, Homo sapiens
taagggtaattgaattgtttctacagctattttacatctgtgtcaaacattcaatatccctagtgatgctg

SEQ ID NO: 10578 - DNA, 71 bp, Homo sapiens
cagggagaccaatgtgtacaagaggctgcttccatccccttgctgcactgatgagattccccactgtcagc

SEQ ID NO: 10579 - DNA, 71 bp, Homo sapiens
tgggaccctcagaattcactcctccccagggcagaaccttcagtaaattctgttggtggtgttccatccaa

SEQ ID NO: 10580 - DNA, 72 bp, Homo sapiens
caggcagcaaccattggctggcagcagcccagcaccacatgccctacaggctgagtacagccagatacccca

SEQ ID NO: 10581 - DNA, 73 bp, Homo sapiens
tactggtgtacccgccctgctccactgaatcccaaagcttctgaataacattctgagctgtgttcttgccagg

SEQ ID NO: 10582 - DNA, 70 bp, Homo sapiens
gatctgctcctggggtctccatgtgacatccagcttcccgctggatcgtggtgggtcatagcaggaccca

SEQ ID NO: 10583 - DNA, 71 bp, Homo sapiens
tgtcactgaatgaggagctggaagagatgcccagtagcacaccattatctagagtttcccccatacagaca

SEQ ID NO: 10584 - DNA, 71 bp, Homo sapiens
tccacttagggcctgggttagccttgaagctctcccctgagggctgtgtttccagcctctgcgtttaataa

SEQ ID NO: 10585 - DNA, 73 bp, Homo sapiens
ccgtctagctacaggtgagatcaggttttgttttttttgagacggagtctcgccctgtcgcccaggcaggagt

SEQ ID NO: 10586 - DNA, 70 bp, Homo sapiens
cctcctcactgcacttggctcagggactactgtaggcctagtctccagggcatgcctgtgtgtgtgatgt

SEQ ID NO: 10587 - DNA, 73 bp, Homo sapiens
gcttagttagcatggtgctctgggcaggaagcaaaagtcacagcttctagacctgactactagtgtcatttat

SEQ ID NO: 10588 - DNA, 72 bp, Homo sapiens
ggcttggccctgtgacccctggagcaggcagaggctgatgagaaacagcactgctcagggctaacatcaaaa

SEQ ID NO: 10589 - DNA, 72 bp, Homo sapiens
tgacctgagttgggtgacaatactctgagagattgggctgtcatcctataggataccacatatgctttaaac

SEQ ID NO: 10590 - DNA, 71 bp, Homo sapiens
ctgggcaatttgaactttagtttttgtatcatgctgaatgagatgagttaggctagagtagagggttccac

SEQ ID NO: 10591 - DNA, 72 bp, Homo sapiens
ctggtgcgagggcaggttgaaccaggagaagttgctaggagatgctgctgagcactcaaataccataatgac

SEQ ID NO: 10592 - DNA, 73 bp, Homo sapiens
tctttctgaaggctgctcccacagcagccttggccaaacagggcaacggcagctgggctgagcccagattcag

SEQ ID NO: 10593 - DNA, 73 bp, Homo sapiens
ccaatacttgaccctcccaggaatagaagcttcagggcactgaaagagctaaaaggactggagtggaggcaag

SEQ ID NO: 10594 - DNA, 72 bp, Homo sapiens
ggaggcagaaatgaattcttactttgtttttattttctatgggggaagaaaccaaaggtgcaagtgtttatt

SEQ ID NO: 10595 - DNA, 74 bp, Homo sapiens
tatttttgtcttattcctaggttcctgacacaagaacttctaaggacccttggaatctctggagctacaagagt

SEQ ID NO: 10596 - DNA, 73 bp, Homo sapiens
tattcacacatagtctcatttattcctctcaacagcctcatttcatagggatgtggactgagacttagagagg

SEQ ID NO: 10597 - DNA, 73 bp, Homo sapiens
tgtgagaggcactggtgctgacggtaaaaataaaaacaaaacaccatccagtccagaggcagcttacagctca

SEQ ID NO: 10598 - DNA, 73 bp, Homo sapiens
gccttggattagctacagcttaagcctgcagcacctcatgcctcagttgtttgctctgaggttaccaaggtaa

SEQ ID NO: 10599 - DNA, 70 bp, Homo sapiens
atgtccattctcaccctctctcccccgctcccagtgtccgtaagatggtgaagttcaagggagacgtttc

SEQ ID NO: 10600 - DNA, 72 bp, Homo sapiens
taacaagtctttattgagcagatactatgtatcaggcattgtgttaggtgttttacttacattcttgttaat

SEQ ID NO: 10601 - DNA, 70 bp, Homo sapiens
cagcacaagaccaggccctgtcagcctcttctagctcatagcttctgcccagccctggaagtgccattct

SEQ ID NO: 10602 - DNA, 71 bp, Homo sapiens
gatgaaaataaaccagccaccactggaataggctgcaaaggaagcagtaccttcagggaaggggctgtttt

SEQ ID NO: 10603 - DNA, 72 bp, Homo sapiens
ttttatacaagagactatctgagcacccaaaacttgaaagtctctaagctaggtgctatagtgttaaatatt

SEQ ID NO: 10604 - DNA, 73 bp, Homo sapiens
tagcttggcagtccagcagtgtcacatcttggtgcctttgctcaccttgcttcctctgctctgaatacccttc

SEQ ID NO: 10605 - DNA, 70 bp, Homo sapiens
gggtcccttgggtcagccccttgcaggacagcaggcacccccagcagctcccacataaacccatctccaa

SEQ ID NO: 10606 - DNA, 74 bp, Homo sapiens
ccagagttgctttgctcttctggaacaggcacctctgtcctcagaactagcagcaggtctcactccacatctgg

SEQ ID NO: 10607 - DNA, 73 bp, Homo sapiens
ggttgtggactttcctgctttcctgaccatctccttcactagaatgtgaggacagaaactaaactgggtcctg

SEQ ID NO: 10608 - DNA, 73 bp, Homo sapiens
aaaggtgatgatggcatggggtggggtgataaggcagggatgccccctacctactcattcctactcattcatt

SEQ ID NO: 10609 - DNA, 71 bp, Homo sapiens
tctttgccaagtactgcactaaaagatgaacacaactgacctcacttaacttttggagcaacgctgcaagg

SEQ ID NO: 10610 - DNA, 72 bp, Homo sapiens
gaactactttccacacagagagcagagcttagagcttctctctattagcaccacctctggctatggcatagc

SEQ ID NO: 10611 - DNA, 71 bp, Homo sapiens
catgcaatgtggaaattggagaaaacttttatatttagtgcaatgttccccttcacatattttgcattaat

SEQ ID NO: 10612 - DNA, 73 bp, Homo sapiens
ttaatttctccaggctttcctgggtgtccatctttcaccaacccatcaaaatgtttggcacagaattgtgatt

SEQ ID NO: 10613 - DNA, 72 bp, Homo sapiens
agcattctttgagcatagtagcacatcatggttatgagatgctgttgctattggcaggcgaaagattgctta

SEQ ID NO: 10614 - DNA, 72 bp, Homo sapiens
tttactgagtccctgcctactacatgccaggaatcatgctaaatgctaaggatattctggtgagcaaatcag

SEQ ID NO: 10615 - DNA, 73 bp, Homo sapiens
cctgcctgcggatccccgccgggcgcatggggcgcttcgagccgggactgcgtgcgggccccgaggccagttt

SEQ ID NO: 10616 - DNA, 74 bp, Homo sapiens
tatcttgagatgaagcactcatcctggatgatctaggtgggccctaaattcagtgaaaagtgtcctcataagag

SEQ ID NO: 10617 - DNA, 74 bp, Homo sapiens
cagccccggttcccgcccgcgcctctccctccgcccctcccggcaaactgagggagccggctccggccttggcc

SEQ ID NO: 10618 - DNA, 73 bp, Homo sapiens
aaaagctgtgtgggttgattagcacctagacggtcaatcccacaagcatctcaaactcaaatacccaaaactg

SEQ ID NO: 10619 - DNA, 73 bp, Homo sapiens
cctcacggccacatctcagcgctggaggttcctggtccccggcgcgcggcgagctcccggggctgacggaggg

SEQ ID NO: 10620 - DNA, 74 bp, Homo sapiens
tattcacacaatgatgaaactgcctgaggatgcattctcagaatgtatttctgtcattttaagtgatgcatgac

SEQ ID NO: 10621 - DNA, 71 bp, Homo sapiens
aatggcaagccttaggcaaatctcatctgccttcaagttggcttctccctccactgtagggctaagccacc

SEQ ID NO: 10622 - DNA, 70 bp, Homo sapiens
ttgtgagcctgtctccttcaaacaggggcatcttatgggcccagcacactctcctacagtgaccaaactt

SEQ ID NO: 10623 - DNA, 70 bp, Homo sapiens
ggttattaaccatgaatatagttctgagcgtttttaacaaaaaggagcagagtggtctctaactgatatc

SEQ ID NO: 10624 - DNA, 74 bp, Homo sapiens
ctgggttttctctattagcagcaatgaaaatactttgggggaaataggcccattaaatgctgttatgaattgcc

SEQ ID NO: 10625 - DNA, 72 bp, Homo sapiens
aattgcacctcccctttataaatctttccatttatttctgactcaggtttatggggagggtgaagacctagc

SEQ ID NO: 10626 - DNA, 71 bp, Homo sapiens
ggaaaaggacagatgcaaagaaagtggcgcaaattggagatagtttagcagcataactttatacagtctga

SEQ ID NO: 10627 - DNA, 73 bp, Homo sapiens
gagatgcaccaacaacctgactaccaaggcctgaagtgggaagacagacagggagtgaggagcctgtggctgc

SEQ ID NO: 10628 - DNA, 73 bp, Homo sapiens
gttgattctccccttggttgccgttttatctgtagtgtcattttgagtaattggggtatggtagctgatcaac

SEQ ID NO: 10629 - DNA, 72 bp, Homo sapiens
atctctgtatgggcttgcatggagcattcttaaatgttaaagatagttcctgtctgggaagaaccaagtgga

SEQ ID NO: 10630 - DNA, 72 bp, Homo sapiens
aaaaggtgccacattctgttcagtgtatagggaacttagcttcctcacacatataccagatgcatgtttgag

SEQ ID NO: 10631 - DNA, 74 bp, Homo sapiens
gaatgaaaacctttcttagacttgactgaattttctcgagaagtttcacaaagtcaccatgatctcacaggttt

SEQ ID NO: 10632 - DNA, 74 bp, Homo sapiens
caatgaaacataataaattactgtcaagttttgggtggtttgttacacagcaacagataactaaaacaatggca

SEQ ID NO: 10633 - DNA, 71 bp, Homo sapiens
acaccagaacaaactcagcagcaattcatgtgttgtgaatttccatgagtggaagtggatttaatgtgctg

SEQ ID NO: 10634 - DNA, 72 bp, Homo sapiens
aagaatagcagtgctccttatgcccatagatgatggtgtttatccagagaagggacatggagatgcccagtg

SEQ ID NO: 10635 - DNA, 73 bp, Homo sapiens
ttaaggattatttttcactgtgggtgacccgtttttgtgtgcctgagtgagattcttacaggtttctttcttt

SEQ ID NO: 10636 - DNA, 74 bp, Homo sapiens
tatattttcagcaacaccccactcctggtaccattttactgtattagtgcgttttcatgctgctgataaatatg

SEQ ID NO: 10637 - DNA, 74 bp, Homo sapiens
aaaaaaaatgcaatggtaatgattggatcccagggtggcaggggacaagcggcagcattcaatcatccataaca

SEQ ID NO: 10638 - DNA, 72 bp, Homo sapiens
caagtgcatgggcattttctgatgaccttagatcatgtaaacatccttgtgcccttcccaccttgtgcactt

SEQ ID NO: 10639 - DNA, 73 bp, Homo sapiens
ctatgctacaggagaacgtgaatatacttcagcaccctgatgctggagaagtttccacaggagtctgtagaga

SEQ ID NO: 10640 - DNA, 74 bp, Homo sapiens
tggggggttgccctatgcattataggatggttagaaacatccctggctgacccactaaataccggtagcacccc

SEQ ID NO: 10641 - DNA, 73 bp, Homo sapiens
atacactgtgctaattagcagcacagaaatatgcaaagcattttgtaaaaatgcactgttgcagattagctag

SEQ ID NO: 10642 - DNA, 70 bp, Homo sapiens
ccaggtggaaagcaaaaggcagtgactaggagaacagaaggtcctcagtgaaaaggcttagtcacactca

SEQ ID NO: 10643 - DNA, 72 bp, Homo sapiens
tgcaagagaggctgggaagtgtagtctacctatgtgcccaggatcagagggaaagggtgtagcagctttcca

SEQ ID NO: 10644 - DNA, 70 bp, Homo sapiens
ccccagccttccgagtagctgggtgcagatgcatgccactgcacgtggctaactttaaaaaattgtttag

SEQ ID NO: 10645 - DNA, 72 bp, Homo sapiens
cacttgagcctcggttgcggaggttgcagtgagctgagatggctccactgcactccagcctgggtgtcagag

SEQ ID NO: 10646 - DNA, 71 bp, Homo sapiens
aaaatattggcaatggtggcatgatggatgatttttgtttattttggcatttttctccatttcctactttt

SEQ ID NO: 10647 - DNA, 70 bp, Homo sapiens
ccttgagacaggcaagctgagtttgaatactcttggtatttttgcatatgcagtaattgtagttttaccc

SEQ ID NO: 10648 - DNA, 71 bp, Homo sapiens
aggcttgatggctcatgactgtaatccaaatactttgggaggccaaggcgggcagatcacctaagtccagg

SEQ ID NO: 10649 - DNA, 74 bp, Homo sapiens
ctgggttgggaggatatattttgaagaggaatctctagggaaccaagttcaagtcccttctcatatgaaagccc

SEQ ID NO: 10650 - DNA, 72 bp, Homo sapiens
gctaagttttgggatgctttgttatgtaacaacagatacccaatggagtgactgacaaatcccccccagtgc

SEQ ID NO: 10651 - DNA, 72 bp, Homo sapiens
cttcaaagcccatgttataaccaccaagtcaccaagatgactcgtggtaatcctttgttcacaggtttagag

SEQ ID NO: 10652 - DNA, 72 bp, Homo sapiens
ctgtttttcagagcttcctcctccggaaaggccccaattcagggggcggactctgggattgaacttcgcctt

SEQ ID NO: 10653 - DNA, 73 bp, Homo sapiens
aaggcaggaggatcacttgaggcgaggagttcgagactagactggactacttggtgaaactctgtctttacta

SEQ ID NO: 10654 - DNA, 73 bp, Homo sapiens
cctcctgctgccactctgttgggactaaataccccaataatacaagttgtgttgcagcccagcagaggggtat

SEQ ID NO: 10655 - DNA, 73 bp, Homo sapiens
cttggcctaggtgttgggattgattacaggcatgagccaccatgcctgtccccccattttttttttttgaggc

SEQ ID NO: 10656 - DNA, 72 bp, Homo sapiens
agagacagggtttcactgtgttgcccagggtggtctcgaatcctgagctcatacaattcgcccacctcagcc

SEQ ID NO: 10657 - DNA, 72 bp, Homo sapiens
ctttccatattttgatcctgggcaagtgatacttgtgtcagtaacagaaataaaacaaattggaggaagatc

SEQ ID NO: 10658 - DNA, 73 bp, Homo sapiens
ggatgtgacactgtgggacttctaaagctaggtcataaaacgtgatatgacttccatttggctctctctctct

SEQ ID NO: 10659 - DNA, 72 bp, Homo sapiens
cagtgagggtcacggaggattctggagtgaaccctacatttgtaggatgttgtgatttcagagtggtggtgt

SEQ ID NO: 10660 - DNA, 74 bp, Homo sapiens
gctggcccggctctttctacgagttttataagatcatcccactcctgactgaccccaagaaccatggcctgagc

SEQ ID NO: 10661 - DNA, 73 bp, Homo sapiens
tgcctgtgcctgtccgctggcctggggggcctgggcttatctgggccttctcactcagggactctcttgacgc

SEQ ID NO: 10662 - DNA, 73 bp, Homo sapiens
atcatgagaaaccaatagctttttgagtagatgccagttgagtgagtgtttggctgttatctcattgattcat

SEQ ID NO: 10663 - DNA, 70 bp, Homo sapiens
tcaatgaatggtgccccctccaccctgcctgatctatgccatgggtccaggcaagtgcaaggtctggccc

SEQ ID NO: 10664 - DNA, 72 bp, Homo sapiens
ttcaattcacagtggctacattccaggtgcttaatagccccgtgtgactttgagctcctgtattaggcagtg

SEQ ID NO: 10665 - DNA, 74 bp, Homo sapiens
tcaccgccatcaaggcagtggcaggatgggtgtgtctgtcctgcagtgcaggggtcttgaaggctttcttgggt

SEQ ID NO: 10666 - DNA, 70 bp, Homo sapiens
ctggaccagcagtcagaatggtcagtggttaggagaccctctgccccccaccgctgccaccattggctct

SEQ ID NO: 10667 - DNA, 72 bp, Homo sapiens
agaacttgagccaagccttcaagcttgaaggtcatggagcgtttgctcacatcattgatctattccactaca

SEQ ID NO: 10668 - DNA, 72 bp, Homo sapiens
tcagtggattggagcgtccagtgggattgaagggttactggaattagggtaccagagagacggagagctgaa

SEQ ID NO: 10669 - DNA, 72 bp, Homo sapiens
ggcaaacagcaggcactctgttcctcacctgtgtcagagtgtgggtccaaagtgagtgcctgtctcttttta

SEQ ID NO: 10670 - DNA, 71 bp, Homo sapiens
ctgtggcccggcagtgcccaatcacagccagcctcagtcatgttggcactctgctgcagcactgtcggctg

SEQ ID NO: 10671 - DNA, 71 bp, Homo sapiens
atttgttcctttggcaccccactcctggtaccaaagtctgaatttgtttgcttgggttgccataaagaaag

SEQ ID NO: 10672 - DNA, 73 bp, Homo sapiens
tcaggtgacagtttaggtccatgaatgaaggtgccagagagtgtatgggcccagaggtgcctggctgtcagcc

SEQ ID NO: 10673 - DNA, 71 bp, Homo sapiens
ctgggatgacatggagaagatctggcaccacaccttctacaacgagcttcgcgtggctcccgaggagcacc

SEQ ID NO: 10674 - DNA, 70 bp, Homo sapiens
gtgtcgcagcctgtccccggggggattacaatgttctccctgccgcagaattctaaaggtgccttgtatt

SEQ ID NO: 10675 - DNA, 72 bp, Homo sapiens
gcagtggctcaggcctatagtctcagctactccacagactgagataagaagatcgcttgagcacaagagttt

SEQ ID NO: 10676 - DNA, 74 bp, Homo sapiens
aggacctctgtgctgtgcactgtcctggagggggacattttccagcctgccaggaggatgcacagtgtatgcct

SEQ ID NO: 10677 - DNA, 70 bp, Homo sapiens
tcatcaagctctacacacaccctctcttctccatcctgacagccaggcccttgatctggggggcagcttt

SEQ ID NO: 10678 - DNA, 73 bp, Homo sapiens
acagagagcacacagaaggatacaaatgagggctataacatcagggtttgcaaagcagaggtctttctggggc

SEQ ID NO: 10679 - DNA, 71 bp, Homo sapiens
ggtgactaaagtgtcaaactaaataagggtgttcccctaattgtttgaataggccaatgggttaaccaatc

SEQ ID NO: 10680 - DNA, 72 bp, Homo sapiens
aggaatatctcatttcagaatatctgaaggtgacatttggagtcgctcattgattcaattattctgaatctt

SEQ ID NO: 10681 - DNA, 73 bp, Homo sapiens
ctcctattccccccaggctccactccgaggataaaaggaagacccctttgaaggtattggaagaatggaagac

SEQ ID NO: 10682 - DNA, 73 bp, Homo sapiens
atactggcttaggtatgcatccgtatgaagcactccattctgtgttgatctgtggacgcagtttgtcactggt

SEQ ID NO: 10683 - DNA, 74 bp, Homo sapiens
gtgctgtgggtaacattcactgcctccaggaaagccaaggttggtgggtgcagtgggtgggcgggaatgctggc

SEQ ID NO: 10684 - DNA, 74 bp, Homo sapiens
gacttctcgtgcccatgaagactcctgcacttccactgctgttggaagctgaaggccatcagaagcccgctgtc

SEQ ID NO: 10685 - DNA, 74 bp, Homo sapiens
gctcttcagtcgggtgaccatgtgggtgagcccctgtgagtcccgagaggccatttaggacatccaggaagagc

SEQ ID NO: 10686 - DNA, 72 bp, Homo sapiens
gactatctggacggcttcaatgcttagttacctaagtaataaacccacttacagtgctgtgcagagaaagga

SEQ ID NO: 10687 - DNA, 72 bp, Homo sapiens
ttaagcaatttatgtcacgtcgtgagattatatccaccttggtctgaatctaaagtatgacattaaaagggt

SEQ ID NO: 10688 - DNA, 73 bp, Homo sapiens
ttcattatcaaagaatcagtgtgcactgaggtccctgcaagactataactctactggatatctttctttgatg

SEQ ID NO: 10689 - DNA, 74 bp, Homo sapiens
agctcccagacttgaggcggaggggccgcgggccggagctccctgcagccgctagcctgggaagactggagtgc

SEQ ID NO: 10690 - DNA, 72 bp, Homo sapiens
agccaacccacaaaggaaagtctcaaagccaggtgcctcctctgtcagtgtggatgcttgtgtgggtctacc

SEQ ID NO: 10691 - DNA, 70 bp, Homo sapiens
agtaaggaagtctctgcagcgaacatctccgcgagggaagtcagctacaggaagcgtccgagtgacctgg

SEQ ID NO: 10692 - DNA, 74 bp, Homo sapiens
gcatgacccacagtgaacgcttcagaggatgagaggtgagtcattgagtccatggggagctgacgggactttgt

SEQ ID NO: 10693 - DNA, 73 bp, Homo sapiens
tcacttgaacccgggaggtagagcttgcagtgagccaagatcgtgtcagtgcactacagcctgggtgacagag

SEQ ID NO: 10694 - DNA, 74 bp, Homo sapiens
ttctagtcctagtactggtattaaccagctctgagactagagcaaagcccttaatatttctaagcctctttttt

SEQ ID NO: 10695 - DNA, 73 bp, Homo sapiens
ggtctctttggggacgctattataagggcaccactaaggccattcattagggcccccctttcatgacctagtc

SEQ ID NO: 10696 - DNA, 73 bp, Homo sapiens
ttgtgtggctgtaaaagagccccagtcagcttttatggccttttcttggggcctctcagatgagctcagacag

SEQ ID NO: 10697 - DNA, 71 bp, Homo sapiens
cctgatcttgctgtctcccttcactgctttgtacgtggctcagttcacgtctctaccaggctcaggtggaa

SEQ ID NO: 10698 - DNA, 71 bp, Homo sapiens
tccataggaaccatagcatcctgctcaaaatgagggaggagaaatgcccctttagcaaggtttaggatccc

SEQ ID NO: 10699 - DNA, 71 bp, Homo sapiens
tgatttcattcctgtcgactgagaataaacacaatcaatggataaggccagttgataagtttgaggttaaa

SEQ ID NO: 10700 - DNA, 72 bp, Homo sapiens
cggaggcggcgggcggcgggcggcgggcgcggggtgaccttcgcgcggctcctctcggggcgacacgcctgg

SEQ ID NO: 10701 - DNA, 71 bp, Homo sapiens
atgtttttattatattttttcttgggcttccacgaagttggataaatatatctctttttggaacaggaaag

SEQ ID NO: 10702 - DNA, 71 bp, Homo sapiens
gactaccccataaacatgagatgataggcaatttgggggacgcctcattaggaagatctcagaggactgga

SEQ ID NO: 10703 - DNA, 72 bp, Homo sapiens
ttcccagagatactactcagcaaaacagcccttactgaggtgagctgttgaatagttcttggccctctaaga

SEQ ID NO: 10704 - DNA, 71 bp, Homo sapiens
gccatcagaattaggtccattttgagatccctcattcccctgggagatttggtgggcgttatcagcatcgc

SEQ ID NO: 10705 - DNA, 72 bp, Homo sapiens
aatagagagaagatttagcttatcagtcactatccagcatagagaattctgctgacaaatttctctcaccaa

SEQ ID NO: 10706 - DNA, 73 bp, Homo sapiens
atgctgcataaaatatcactgagttcatgatatctatctacaaactttgaaggctttcatgaatctcagactg

SEQ ID NO: 10707 - DNA, 71 bp, Homo sapiens
tgttccaactgggaaacctgcctcttttcaccactgaagtatggttgagacaaagcactgcctagatatgt

SEQ ID NO: 10708 - DNA, 73 bp, Homo sapiens
agtgatgaaaagggtgcacattttggagggagaggcattggagggcagactccaactttgctatttcccacct

SEQ ID NO: 10709 - DNA, 74 bp, Homo sapiens
ttgtgaaagtgaataagtctcatgagacctgatggtttcataaaaagaagttttattgcacaagctctttcttt

SEQ ID NO: 10710 - DNA, 72 bp, Homo sapiens
acgtagatcttcctgtttctggggcccaggaatccagcaggacttatctgggtgcttctgccatggtatctc

SEQ ID NO: 10711 - DNA, 72 bp, Homo sapiens
tctcttatgggcgtctgctgcagtctggctgcggtcgaactgaaagcggcggcgggagaccaaacttagacc

SEQ ID NO: 10712 - DNA, 70 bp, Homo sapiens
ttgaaaacttcgggataaggatgagtgagtgtgcaaatctccatctctggctttctcttgtgttaccaac

SEQ ID NO: 10713 - DNA, 72 bp, Homo sapiens
tctagacccaatagattcttcattgtcaattatccaagttgactgtgtagaatgcttaactcactctcggtt

SEQ ID NO: 10714 - DNA, 70 bp, Homo sapiens
gagagctcaagtcctctctcggggccacatagtatgtcggcaagtcgggggttcttgggtctcagtgatc

SEQ ID NO: 10715 - DNA, 74 bp, Homo sapiens
tccgcgggcgcagggcggccgcccccgggagccccgcgccggggctgggctacgggcgccgcgcgcaccccgcg

SEQ ID NO: 10716 - DNA, 73 bp, Homo sapiens
ttatgtttagctttgtaagaaactggcaaactgtcttccaaagtggctgtgccattctgcatttccaccagca

SEQ ID NO: 10717 - DNA, 73 bp, Homo sapiens
gctccttcacagtggctaagcactgctgaaaaaaactaaacagtgctatttggcacaattatgaacttcgggt

SEQ ID NO: 10718 - DNA, 72 bp, Homo sapiens
ggacttctagcctccagaactgtgaagcaatacattccagttgtttaagccaatcagtttatggttgttaca

SEQ ID NO: 10719 - DNA, 71 bp, Homo sapiens
aacgttttacatgtttagtatctccttttagttgcattcaattaaaaggagaggagtggtaatgaatgctt

SEQ ID NO: 10720 - DNA, 72 bp, Homo sapiens
ggtggtgaaacaacaggttggaaactggattagggtataaggaaatgcagcaaccctacctcctcatcctgt

SEQ ID NO: 10721 - DNA, 74 bp, Homo sapiens
ccggggcggcggcggcggcgggggtggggtgcggtgggaggggccgcggctggcccagccagcccgcgcctgca

SEQ ID NO: 10722 - DNA, 70 bp, Homo sapiens
ggaattaattatttctggggccccagatgccaagattggcaggacaattgatgggtgctaccattgcttt

SEQ ID NO: 10723 - DNA, 74 bp, Homo sapiens
tgaaagaggcaacaagtgcttgctaatcacttgaatatacataattagctgcagtctggtgcactggattcttt

SEQ ID NO: 10724 - DNA, 71 bp, Homo sapiens
aaaccaggggccgtggattgttgcttggtttaaaacaaggagatcggccgggcgcggtggctcacgcctgt

SEQ ID NO: 10725 - DNA, 74 bp, Homo sapiens
ctgctctggggggattttatcagcagggtcaacacacagagacagtgtacaacattcaaaacctctgcagcaag

SEQ ID NO: 10726 - DNA, 72 bp, Homo sapiens
attctacatggcttcttggaggagctcagcaagattgtgctctagtggtccacggcagtgatagcctaaaaa

SEQ ID NO: 10727 - DNA, 71 bp, Homo sapiens
ccggaccccagagcagcgtccccgggcggcccgcgcaggccgcccccgcgcgccagccccgccgccggtca

SEQ ID NO: 10728 - DNA, 73 bp, Homo sapiens
ccatctggcagagattaaaggtttgttcttggagagaataacacccagggcatctaggctagaacacactagg

SEQ ID NO: 10729 - DNA, 73 bp, Homo sapiens
aggcgcgaggccacttgcaccagcagcgcgcgtcagcgagaagcagaagcaggaagagggccggccggaagac

SEQ ID NO: 10730 - DNA, 74 bp, Homo sapiens
gccctccgccgcgcgggcccaaccccctccctcccttccccctacctgaacggggcgggtgagcgcgccgccgc

SEQ ID NO: 10731 - DNA, 73 bp, Homo sapiens
caaaagaaatgctgtgatcctcagtctagagaatcttaggcatcttaggtatagtagctgatgaacacaatat

SEQ ID NO: 10732 - DNA, 70 bp, Homo sapiens
cagtgcatttgaattattcattaaatcacatggatctttaaatgcataatcatatttaccaatttggaaa

SEQ ID NO: 10733 - DNA, 70 bp, Homo sapiens
gccgcgcggacgtgtccggccaatcgctcgccccgcagtatccccgcgtcactcgcagcccgggcggcgc

SEQ ID NO: 10734 - DNA, 70 bp, Homo sapiens
cctgaggggtaagaatacaaggagaagccagcagaagaatcacctctcctgatgcagctacaactcccac

SEQ ID NO: 10735 - DNA, 72 bp, Homo sapiens
gagaagctgtgagggattgtgccattgagaggtgacagcgtgctggcagccctcgcagccctcgctcactct

SEQ ID NO: 10736 - DNA, 72 bp, Homo sapiens
ccctgtgagcaccgcaacagccccagtggaaccaccatcccggccccgatgcaactgtttccccacagggtc

SEQ ID NO: 10737 - DNA, 74 bp, Homo sapiens
tttcaaatcattttagtacggaggtgtgcggacgcctgtgaaatattttacatcctgcatctttccttttgaga

SEQ ID NO: 10738 - DNA, 74 bp, Homo sapiens
agtccttggggtgcccatgggtctgtttggggggtccacatgtgggtgtcctgggtgatttatgggcgggcttc

SEQ ID NO: 10739 - DNA, 71 bp, Homo sapiens
cagatgcataaaccccagcgaagggtgagcgcacggcatggcacctgcagcatggggttcacgttctggaa

SEQ ID NO: 10740 - DNA, 72 bp, Homo sapiens
ccaggcctcagacagtagcatcacggccacgccagctgagaggtgcaggagaggaaaactgaagttccttac

SEQ ID NO: 10741 - DNA, 73 bp, Homo sapiens
gagaggacaccagttttcctccatgcagtagtgacagagagccattgaggattcttgaggagggaggggactg

SEQ ID NO: 10742 - DNA, 70 bp, Homo sapiens
ttgctaggctcttcctcaggaaatgctgattcctgtctaagggaagatgcaatgtctgctataaagaata

SEQ ID NO: 10743 - DNA, 73 bp, Homo sapiens
caatccactgcatgactgggcgtattactctgagctccagctcccttcttatgctgggatctgacacataaaa

SEQ ID NO: 10744 - DNA, 72 bp, Homo sapiens
cctggctccccgctgactgatgtgtgatgctgaaaaattattggctaacactgtctgtgcctccgtgacccc

SEQ ID NO: 10745 - DNA, 71 bp, Homo sapiens
tttcctgtctgaaagcattattacttttgtccatgtggcaaaataattagcatacagatgagaagtggccc

SEQ ID NO: 10746 - DNA, 73 bp, Homo sapiens
ccagtcattgcacttgtcttaactgcattttgtgtgtgtgtgttgaaaactgattacaagtgtaaagagatat

SEQ ID NO: 10747 - DNA, 72 bp, Homo sapiens
tgttaatcgtgccggtcaggatctcagcggaaaacgcatggcacctgccaccgtgcatcagaggcactgttc

SEQ ID NO: 10748 - DNA, 72 bp, Homo sapiens
gggacacagagcagacgtgtaactagtcaagctccccgtggtctgagtggaggagctgggggttcacaccag

SEQ ID NO: 10749 - DNA, 70 bp, Homo sapiens
gacacttaactgctgccctgtataaaatttatttgtaagaattttgtcttaggcagggtgcggtggctca

SEQ ID NO: 10750 - DNA, 72 bp, Homo sapiens
tctgctgtctgctgactggactctgggatgcttgtgaggcagttgtggggtggagcaagtaacaaaggcttt

SEQ ID NO: 10751 - DNA, 70 bp, Homo sapiens
aaaacagaggccgtagaggtggttcatttgatcatagctcagaaaagatgggttttgtaattctacagct

SEQ ID NO: 10752 - DNA, 71 bp, Homo sapiens
ctctgagggcgctgggggtgctgaggggaatggggacatgtgtttaatgcacccaaagtttcagtctggga

SEQ ID NO: 10753 - DNA, 71 bp, Homo sapiens
tcaggctacttgatcctgaagatgtattgctttaattcatcatttccaggataaaaacagcaaagctctcc

SEQ ID NO: 10754 - DNA, 73 bp, Homo sapiens
agtggagcatagtgaaatcaacagcagattctgtttgttagatggtgttgggttcacaaggctctgctcttcc

SEQ ID NO: 10755 - DNA, 72 bp, Homo sapiens
agctttggagctgtcaagcaattacatgacttgtccaacgtcacatagctgagagactaaggcacccttccc

SEQ ID NO: 10756 - DNA, 72 bp, Homo sapiens
atggtgtgtgtcatccaccaacaggatgtcccaggcttggtttcatgctgacggtgatttatcaacactgta

SEQ ID NO: 10757 - DNA, 71 bp, Homo sapiens
taggagtgagggtgagtattgaagagcttagcttgcaaaattggctgttcatatctgccatccttttcaaa

SEQ ID NO: 10758 - DNA, 71 bp, Homo sapiens
aggaagcagacctcaaaatgctctgaagatacttcatgccagcatttataaggatttttttctgcattgcc

SEQ ID NO: 10759 - DNA, 72 bp, Homo sapiens
ctgcagcatccataactggaagaagctaatgccatgtccgtgggagtctaaggctttgtcagcagctgttct

SEQ ID NO: 10760 - DNA, 71 bp, Homo sapiens
aaagctattttttccccagaaacaatagtgcaggtgcatcgcacttcagtgtgcaacatattcatcctggg

SEQ ID NO: 10761 - DNA, 71 bp, Homo sapiens
tttcccttccacactgctgtagcagaggttctccatgagggcttagcccatacagcagacttctgcctgga

SEQ ID NO: 10762 - DNA, 72 bp, Homo sapiens
ttacccagcctggggccttgccacatacttacaggaagaggctcgactctgtcgcaggccagtgaataccat

SEQ ID NO: 10763 - DNA, 72 bp, Homo sapiens
ctgccaccacattgccaggcatttcttctgtccggtgggctgggaagagttagcagatcctagggaatggtg

SEQ ID NO: 10764 - DNA, 71 bp, Homo sapiens
cttggcatattacaaaggctgtgtgatataatacccaataggaaagtgtagtggtcaggctccctcagaaa

SEQ ID NO: 10765 - DNA, 73 bp, Homo sapiens
gagggagaccccgtctctgctccctgggtttgccctagagtctgggctagggctgagggtaggggtggggctt

SEQ ID NO: 10766 - DNA, 71 bp, Homo sapiens
gggagcggcgggcggggctggggcgcgggatacctgcggccggagccgccgcgcaggccgcctcacctcct

SEQ ID NO: 10767 - DNA, 71 bp, Homo sapiens
agctaggtgtggtggcaggcacctgtaatcccagctactcgggaaccagccagctcccacagttgcccaca

SEQ ID NO: 10768 - DNA, 70 bp, Homo sapiens
cattctcttggttagcgtagaagtaactgcgctacagtaactgaccaacaaaagtgccttccagttcaaa

SEQ ID NO: 10769 - DNA, 73 bp, Homo sapiens
tctggaggtcagaagtccgcagcaggtctccccgggcaacaactggggcaccagcaggccatcttccttccgg

SEQ ID NO: 10770 - DNA, 72 bp, Homo sapiens
cctggccatggagcctgaagtcagtcctataactgtttggattccaactgacggcttgaatacaggttcagc

SEQ ID NO: 10771 - DNA, 71 bp, Homo sapiens
tgtcactgtctccagcagatcgtgtgagtgtgtgcctgcattctcagagtcggctaggttgctaccacgca

SEQ ID NO: 10772 - DNA, 72 bp, Homo sapiens
ttgtatttttcaggctgtcagtaatccaggatttttggagagggtagtgaatgcaggagagaggcagcagct

SEQ ID NO: 10773 - DNA, 73 bp, Homo sapiens
tttgtgcccacagtatttctggctctggtttcccaacagccagattacaccaggtctggtatgtttcaagtac

SEQ ID NO: 10774 - DNA, 73 bp, Homo sapiens
caaatttagcggatgacctgtagtttgtctggcagctctaccccccgggtttctgaaatggcaggtctgtgct

SEQ ID NO: 10775 - DNA, 73 bp, Homo sapiens
gctgctttcttattctattactccctttttaccccatggtttttggtgctatgatggaaaaactgagctgaca

SEQ ID NO: 10776 - DNA, 72 bp, Homo sapiens
cggggttggcggcggcgcggggaggagggggccggatttgggagaccaccgcccgtccccgtcccgtcccgg

SEQ ID NO: 10777 - DNA, 70 bp, Homo sapiens
cgggggcgcggggctgtgcggggctgctcggggcgggcactcggcgcccggcggggaaggtgcgccccgc

SEQ ID NO: 10778 - DNA, 74 bp, Homo sapiens
atcacatcacattgcacttagctcttgcatctctgtccatacacaagactgtgacattgatgacagcagagggc

SEQ ID NO: 10779 - DNA, 74 bp, Homo sapiens
ctggggttgtggtatctgagggttgcaaagtgtcagcgctggaggagctgagtgatcactcatctgaccttccc

SEQ ID NO: 10780 - DNA, 70 bp, Homo sapiens
gttgggccttggtggctcagtggtggccaattctgaacgcagtggacacgtgactgcctgggtttaaaac

SEQ ID NO: 10781 - DNA, 72 bp, Homo sapiens
tgagcagagcagactggctgataatttatgaagtctagattatgcctccagcaaaactgcaaaaggcaacat

SEQ ID NO: 10782 - DNA, 71 bp, Homo sapiens
ttctagagttgactgaacctttggattgaatggcccacgtaaaatccttccataatggtgatttccattct

SEQ ID NO: 10783 - DNA, 73 bp, Homo sapiens
cttaacacgtatttgaggcccagttctatgaaccactggccagacaaggactccagcctcccaagactgaaga

SEQ ID NO: 10784 - DNA, 74 bp, Homo sapiens
acattagctactaacaagagagtcagcctgtcctttgggactctgaagccaggcactgacatttcctctctagc

SEQ ID NO: 10785 - DNA, 73 bp, Homo sapiens
tgttgtgggggctgccctgagtaatccaggatatttagcaacatctctggcctccaccagccaggtgccaata

SEQ ID NO: 10786 - DNA, 70 bp, Homo sapiens
ttttaatagatgaaggtctcactttactgccaggctggtcttgaactcctggcctcaaatgatcttccca

SEQ ID NO: 10787 - DNA, 74 bp, Homo sapiens
acttgactacatcatctaacctatcatgcaacatacacctaaatccggttttaccagcttgtggtagatgatgt

SEQ ID NO: 10788 - DNA, 74 bp, Homo sapiens
agctcctggggcattctctagtttccagagcccagaggctgagcttgagtcattgagtttatggcttcaggggc

SEQ ID NO: 10789 - DNA, 73 bp, Homo sapiens
agtacatgggagctctgggactctgggattgaacatttcaactccacagacacagaactagaaattgggtgct

SEQ ID NO: 10790 - DNA, 72 bp, Homo sapiens
tatctttctgactgctcaaatattttcataagaatgtgatatgtgtttatgagcagttttcattgacatata

SEQ ID NO: 10791 - DNA, 72 bp, Homo sapiens
gaaggttgaatttcactggggacctagccctgtctgcctaagaaattacctgcctcctgtcgctatcaccag

SEQ ID NO: 10792 - DNA, 72 bp, Homo sapiens
aggggtccctctctgggatcaggcctcctcagcccagaggcagcaggttcttacccagttaggattattcta

SEQ ID NO: 10793 - DNA, 70 bp, Homo sapiens
gagccaactcaatcttggctcagttcaacagactcttattgagtgtctactctgagccagcaactgattg

SEQ ID NO: 10794 - DNA, 74 bp, Homo sapiens
tccctcgcagagacgtggggctctaggggctttaataagatgtttgaggtcaaaagggtcaggtctctgactgg

SEQ ID NO: 10795 - DNA, 74 bp, Homo sapiens
ttcatttaatcctcactttgaatccatgttggaaactccatagcaacatggagttcaggtgaggattaaatgag

SEQ ID NO: 10796 - DNA, 72 bp, Homo sapiens
gtcactgagagtttgagccataggtgtgagtgttggccacatccctaagattaggagtagcatctctcaaga

SEQ ID NO: 10797 - DNA, 72 bp, Homo sapiens
atgggacactacgccactacgcctggctaatttttgtatttttagtagagatggtgtttcaccatgttggcc

SEQ ID NO: 10798 - DNA, 70 bp, Homo sapiens
agggggctgcctgtggtgtggtagtttaggacagatggacaagcctacagccaccaagtcaccaactcaa

SEQ ID NO: 10799 - DNA, 71 bp, Homo sapiens
aagggatccagtttcagctttccacatatggctagcactatatgtgtccagttttcccagcaccaataatg

SEQ ID NO: 10800 - DNA, 74 bp, Homo sapiens
ctagcacacatggatttccttaactcctcacaagctagcatatatgcccccttgcatctgtgtaggagtgaagg

SEQ ID NO: 10801 - DNA, 74 bp, Homo sapiens
gctgtgtggagcacttgaagagtgggtagctcaaattgagatatgcagtaatgtgaaatacccagcagattttg

SEQ ID NO: 10802 - DNA, 72 bp, Homo sapiens
acttttggtgtcttagtctcttttgaggggcaaaaatagaaaaggagagaagatgtcagtatgtttagtaaa

SEQ ID NO: 10803 - DNA, 70 bp, Homo sapiens
gcccaagagtagtagaagaagaatttggccctaaactccagttttcccaagaagctctattgcctctctt

SEQ ID NO: 10804 - DNA, 72 bp, Homo sapiens
tcaatgacattatttctttgtggagctgacttttaagcagctgttagcagttgctgtaataaaaaacaagaa

SEQ ID NO: 10805 - DNA, 74 bp, Homo sapiens
tgcagggactgaaccataaagtagtgacactgttttcatagttggaaagaagtgggctacatttgtaagtacct

SEQ ID NO: 10806 - DNA, 71 bp, Homo sapiens
ggactaatgacacatgttgccatgcctggctaatttttttatttttactttttggcagaggcaggggtgtc

SEQ ID NO: 10807 - DNA, 72 bp, Homo sapiens
ttgaagagaggaccctagcagccatgcttcattgcacagccttcgggggccctgaagcccactggctgatgg

SEQ ID NO: 10808 - DNA, 72 bp, Homo sapiens
tgttacgcagaaggctagcaattctttcgctggaaactccatcatctaactacgcgaggttgagcaagttgc

SEQ ID NO: 10809 - DNA, 72 bp, Homo sapiens
cagccttttgggatacctggtttcagagttgggggcattcttctctccctgactcgggccaggtgtcttttc

SEQ ID NO: 10810 - DNA, 73 bp, Homo sapiens
ggaattatagagatgctcagaggtttgcatctctataaaaatgagatgcaaagtgagtttatgtttgtaactc

SEQ ID NO: 10811 - DNA, 71 bp, Homo sapiens
aatctggctccgtgggcaaaaggactgaatagggtcagctgtctgagctgatgtgtgaagtttttaggtta

SEQ ID NO: 10812 - DNA, 70 bp, Homo sapiens
cattccaaccatttcagcctggttaagaaccattgctggggaactagtgtagttatgtggaagaatgaaa

SEQ ID NO: 10813 - DNA, 72 bp, Homo sapiens
accctaccagtactatgttaaaatatgagattcccaaatggaatgctggcatagactgatgtatcctgtaac

SEQ ID NO: 10814 - DNA, 70 bp, Homo sapiens
aatacctcactccttcctacaggcagatatccttctgagttcatagttttgcttgttcagaggtttcttt

SEQ ID NO: 10815 - DNA, 70 bp, Homo sapiens
cgaggctgtggggaaggccaacagcgcggtattgcggcagctgctgagcagatgccaagcctccaggcag

SEQ ID NO: 10816 - DNA, 74 bp, Homo sapiens
gatagtagcaccattcagggcagacattctatgcctcatgcggcaggtgcagcagcaggaggctgctcagaggt

SEQ ID NO: 10817 - DNA, 73 bp, Homo sapiens
gctgcctaaagaccaggaaatggagcagccagctgtgctggaaggcccagtgttcagacacctcactttacag

SEQ ID NO: 10818 - DNA, 72 bp, Homo sapiens
tttcctccttcttactcatggcactcatgtaagtgctacttctggagtggtcccagccagataggtgcctgg

SEQ ID NO: 10819 - DNA, 73 bp, Homo sapiens
tcaggctggagactatgtgctaatccatgcaggactgagtggtgtgggcacagctgctatccaactcacccgg

SEQ ID NO: 10820 - DNA, 72 bp, Homo sapiens
tggtccgtggtttcatagaggttgtctgactctggtcctgatgctcctctgccctaaatctgaccaaaaagt

SEQ ID NO: 10821 - DNA, 72 bp, Homo sapiens
caacaaacattctcatagcacctatcatgtagcaggcacctttcttggccatgagaatatgtgttttttttt

SEQ ID NO: 10822 - DNA, 74 bp, Homo sapiens
gacttcaggctgccctacccagagtgtggctggtggggctgtggactcagcatcacccgtgctcatcagggtgg

SEQ ID NO: 10823 - DNA, 71 bp, Homo sapiens
cggcagcgcctcggggcccggccggagcgcgatctcccgccgtcaggcccgggatccgaccgggagaggcg

SEQ ID NO: 10824 - DNA, 72 bp, Homo sapiens
ttccagacatctttggggagaatgaatgaaccctcacacaagccccagccataggagtcagtaccaggtgcc

SEQ ID NO: 10825 - DNA, 73 bp, Homo sapiens
agagggaagaaagatgctctgggttgttaaggggacacctttgagcctaggcttccttttgcttgttgggaag

SEQ ID NO: 10826 - DNA, 72 bp, Homo sapiens
ctgcctggaaggggatcatcagagaaagggccaagtggtcaggtgtcctcagcaaccccccacccatgtgaa

SEQ ID NO: 10827 - DNA, 72 bp, Homo sapiens
gtacatgtggtaacgtgttttagaatgttttctgcttaagcacacgattatatgcttgatttttagaatctt

SEQ ID NO: 10828 - DNA, 74 bp, Homo sapiens
aaatgggtcctgggcttgttttggtgatggtcaggccataactggatgagggtgggggtgaggtaaatcgggac

SEQ ID NO: 10829 - DNA, 71 bp, Homo sapiens
aacgtttagtaacttttcgtagtgtactgatgagaaaaccgttaccttgcagttactcattagcatcacca

SEQ ID NO: 10830 - DNA, 73 bp, Homo sapiens
ttactcaagaaacttttgcccagggtaatgtcctagagagtttctcccagtgttttctgatagtagtttcata

SEQ ID NO: 10831 - DNA, 71 bp, Homo sapiens
aaaaataagctttaaaataagctgctttatgtgtggatttgtttttagcttgctgaactgacattgtgcta

SEQ ID NO: 10832 - DNA, 71 bp, Homo sapiens
caaaggttccttcaagtatttcaatgctcacagaagtagctcagttcagcaggagggaaaatatttttgaa

SEQ ID NO: 10833 - DNA, 73 bp, Homo sapiens
acaggcctgagccaccatgcctggccctggataagcatattcttgaactgcaatggtttatactcaactccgt

SEQ ID NO: 10834 - DNA, 72 bp, Homo sapiens
acgcattcatcttattcagtggtgatgtctacaatgttaaagttgccacaagatacactgaaagcaacattt

SEQ ID NO: 10835 - DNA, 74 bp, Homo sapiens
taatgaggggagcaggcctcctggggctgtggcaaattggacagcctgggcccaagcaaagggggcacccccca

SEQ ID NO: 10836 - DNA, 72 bp, Homo sapiens
caaggtgctgctcttgactccctggtgaaggcagtctgcctgtcttggctcagttcagcaccaatcaccttg

SEQ ID NO: 10837 - DNA, 71 bp, Homo sapiens
ggccagggaagcaatttcccctaagtcttttagccatatctgaagtccccacatttcttgttgcccctgcc

SEQ ID NO: 10838 - DNA, 74 bp, Homo sapiens
aagcctggctggagaaggaattgctgggccctggtccattccaccaagtcaccatgcaacttctctagggccag

SEQ ID NO: 10839 - DNA, 73 bp, Homo sapiens
accaagcaaagcacacggcctgcagagtcagccctgatgggtcccactctgagctgcctgaccttggagaagt

SEQ ID NO: 10840 - DNA, 74 bp, Homo sapiens
gtgtccctgtcattagcaaggcatgactgtccccgagggtttgacacagcaggcacaggcaggcaggtgggcat

SEQ ID NO: 10841 - DNA, 73 bp, Homo sapiens
tcccgagaacttggaggtgtgcccaaacaagtatcagctgcaaacatgggcgtcatggtcctctctcacctac

SEQ ID NO: 10842 - DNA, 70 bp, Homo sapiens
cagctggcttgaatttctcctcagaaaatggggtttttcttttctatcacattgccaggctggaaatttt

SEQ ID NO: 10843 - DNA, 70 bp, Homo sapiens
tggctgttatttgctagagttggatctgtacctatttagatcctaatttagggtttggcacattatggct

SEQ ID NO: 10844 - DNA, 72 bp, Homo sapiens
cttttgatggtcaaagatgatgccaggtgaaatgcctggtacatagtgagaactcaataacttgtagctatt

SEQ ID NO: 10845 - DNA, 73 bp, Homo sapiens
gtatatccttcctttatcacatcattgaagatctttggttttacaaagatataagtgactgatacaagtttgg

SEQ ID NO: 10846 - DNA, 71 bp, Homo sapiens
aagcagcaatacaacaaccttcccattgattagcatagcactgcccaggttgtcagtgtgtgaagcttata

SEQ ID NO: 10847 - DNA, 73 bp, Homo sapiens
gctggcccgcccacgccccgctcgaattctcgctgggcctcagccgcctccccgcggggcagggctcgggacc

SEQ ID NO: 10848 - DNA, 74 bp, Homo sapiens
ttctggtgcaatgatgatgatctgagccatgaaaaatgtgttattagcactgtcagtttacattccccaccaga

SEQ ID NO: 10849 - DNA, 73 bp, Homo sapiens
tattcccatcacagcaagaaggcccaagtggccagagcagcatgggccagggcaatgatgggaaatgaatctg

SEQ ID NO: 10850 - DNA, 72 bp, Homo sapiens
gggtactctaggaagcatgctggaggatgagcttagtttgcaggatgtctgctagagaaaacccttgggatc

SEQ ID NO: 10851 - DNA, 72 bp, Homo sapiens
agattaagtacaaagggatgtggagtctactatccgctccgctggaagcttgctgagtactacccaataatt

SEQ ID NO: 10852 - DNA, 73 bp, Homo sapiens
gactagggatagatttggggttatccatgcaggtgactgttaaatgtggaagtaaatgaggttacttaggggg

SEQ ID NO: 10853 - DNA, 73 bp, Homo sapiens
caagttggcagtgtcttgtagtaccactttgtttataataatatggcaaaaggtatcattattggaattgcca

SEQ ID NO: 10854 - DNA, 72 bp, Homo sapiens
gcaacacagtacagtggtttagttttgaattcctgagctaggctgcttaggaatcccagctctgctattctt

SEQ ID NO: 10855 - DNA, 70 bp, Homo sapiens
attattagagttgcccagggttgactgctgactggtgtttttgcttgtttgttccacagaggtctctctg

SEQ ID NO: 10856 - DNA, 71 bp, Homo sapiens
ttggcccacactgtcttctagcttgtagggtttctgcagagagatcccctgttagtctgatggacatccct

SEQ ID NO: 10857 - DNA, 72 bp, Homo sapiens
gtcaagtgtgtttgctgccattcacttacagaccttcagtagtcactggtatggggcagagattatctcttc

SEQ ID NO: 10858 - DNA, 71 bp, Homo sapiens
gtggctttgctaaacatttttaggttgcaaataatgaaatcaagatgaggggcagagagagagaaagagag

SEQ ID NO: 10859 - DNA, 71 bp, Homo sapiens
gcaggatggagccagcaggtataaaatagctatgttagatactggttagcgtcctacagtgcaaaaaaact

SEQ ID NO: 10860 - DNA, 73 bp, Homo sapiens
caattttgaccagtggagaaggcaacaccttaaggagcagcatggtacagggaggaaagctctgggctgggag

SEQ ID NO: 10861 - DNA, 73 bp, Homo sapiens
gctgtcaggccctccatgcttggaatagtcgggatctgctgacttgacaaaatggggtaggggctgggccaca

SEQ ID NO: 10862 - DNA, 73 bp, Homo sapiens
ccaaaggaagctaaccaaggatgagcggtttcaggctctatttatctgaccgattggctccacactggtggta

SEQ ID NO: 10863 - DNA, 73 bp, Homo sapiens
gcaccatcacaaccagtgtcatagtcagtttatgggatgacactgcatgaaagtgaagaaatgggagcttttt

SEQ ID NO: 10864 - DNA, 71 bp, Homo sapiens
aaagagggaaatttggacacagacacacacacaaggagactgccttgtgaagacgaaggtggaggtgggcg

SEQ ID NO: 10865 - DNA, 74 bp, Homo sapiens
actcacgagaagctgaattgacaatggcagggaggagagggagataaattgaagcaagaagtctttctgctctc

SEQ ID NO: 10866 - DNA, 73 bp, Homo sapiens
ccacccagctaataagtgcagggccaggatttgaatctgaatagtctgactccacaggctctatacaagtggc

SEQ ID NO: 10867 - DNA, 74 bp, Homo sapiens
gacaagactgactcctagagtgaggatcagagagtgtccagttttcctgagagtccactgctagcccaggtcag

SEQ ID NO: 10868 - DNA, 73 bp, Homo sapiens
ctgcatatatgtaatgacactaccaagtccaaccaaggtttaaagtgttatcagcttgggccgggtgtggtag

SEQ ID NO: 10869 - DNA, 73 bp, Homo sapiens
gggtagccatctggttgagatgaagcactctggcaacttcctgtcattagagcctagtctcccttagacctgg

SEQ ID NO: 10870 - DNA, 72 bp, Homo sapiens
atatgcttctgttactctcaaggttacacttcacctctgtgaaatgcctctttaggttttgagggaatcatg

SEQ ID NO: 10871 - DNA, 72 bp, Homo sapiens
caaagtgctaggattacaggcgtgaaccaatgtgcctgaccttaaggccagtatttttttcactgcctggct

SEQ ID NO: 10872 - DNA, 71 bp, Homo sapiens
tgagaccaaccttgatcactgtaggatcccaagccctcagagtggggccaggcctctggggtaggccctcg

SEQ ID NO: 10873 - DNA, 70 bp, Homo sapiens
ctccagttctcctcagtcctctttacagtgaaccagatggaggtaaagaccagatggaggggaaaccaag

SEQ ID NO: 10874 - DNA, 74 bp, Homo sapiens
ccgatttttattgtcccctagaatgttccctctgtggtgaagagatagtattgaaaatactagagatcggctgg

SEQ ID NO: 10875 - DNA, 73 bp, Homo sapiens
aagggctgcagctcttttctccttctcaaggtctgcagcatggcaggcaggagggcatgtttcagccctgttt

SEQ ID NO: 10876 - DNA, 73 bp, Homo sapiens
ccactggtgctgaaggttggccgaggacccggctttcttccgcaggcgcgtggtgggctggctgtgtgtgatt

SEQ ID NO: 10877 - DNA, 70 bp, Homo sapiens
agtgtcccagacttgaccaaacttgacctagaacactccttcccattgtaggtcatggtgagagaaagac

SEQ ID NO: 10878 - DNA, 74 bp, Homo sapiens
cctggtacctggttgatcccgccaatagaaaaaataataataaacagcctgtggctgtacctgggcattaagcc

SEQ ID NO: 10879 - DNA, 71 bp, Homo sapiens
ctctgtgtgcttctagtgcctcgtttataatatagagacaatgatagtacctcgtagggcattaggatgaa

SEQ ID NO: 10880 - DNA, 71 bp, Homo sapiens
atatgtacatatatacacatatatatatacacacacatatatatcaaaggtgtatatatatatacacacac

SEQ ID NO: 10881 - DNA, 74 bp, Homo sapiens
ggcctcctaggccaagctccctgtgtgcctcctggacagtgtccctgcagactcctgagtcctcactgaaggtc

SEQ ID NO: 10882 - DNA, 72 bp, Homo sapiens
atggcttccttctccccaaagctaaagaaaggtgctttgggagtggcagtgtttcctaaatataaaccccat

SEQ ID NO: 10883 - DNA, 70 bp, Homo sapiens
attctgatgtatttgtatgaccaaataacaagttacatgctctccattgcatggtggtgtgttttggtta

SEQ ID NO: 10884 - DNA, 72 bp, Homo sapiens
gtttctggtcagagatgtcagttgtggtttatggtcatactgacattagccattaggctgatgccctttggg

SEQ ID NO: 10885 - DNA, 72 bp, Homo sapiens
tcaaaatagcaaaaccctaaatccagctttagatttattgatttgtctttatggggttttggtttttttttt

SEQ ID NO: 10886 - DNA, 70 bp, Homo sapiens
aagaaagggcgtccgccgcttggggatcccgaggcgaagcgcggcggcggcggcggcggcggctgaagag

SEQ ID NO: 10887 - DNA, 70 bp, Homo sapiens
gttattttaatggtgcagagggagctctgctgcccttggatgacttccctatctactatctaaaatctga

SEQ ID NO: 10888 - DNA, 73 bp, Homo sapiens
ctgctcttcccgctgtaggcatagtctgactgcaattacttaagagaccctaaggcaaaacctctagctgagc

SEQ ID NO: 10889 - DNA, 70 bp, Homo sapiens
agcatcagatcttctgggctcatcatggacctggggcctggtcctcagctcattaggtcagccagataca

SEQ ID NO: 10890 - DNA, 73 bp, Homo sapiens
agcatcttcacaaaagtaaggatcttccatataactgtcagtggtgatttataggatttcactgtgtgagatg

SEQ ID NO: 10891 - DNA, 74 bp, Homo sapiens
cctccttctttttttagtttgtgaccttattgcagtgacaaagaccctcagtacaatattgaatagaaggggtg

SEQ ID NO: 10892 - DNA, 74 bp, Homo sapiens
acaggtggggaggcatgctgttaccctggcccgagagaggtggtttccagcaactgggcttttaatcttctcac

SEQ ID NO: 10893 - DNA, 72 bp, Homo sapiens
ccaagtgacatgttagttcacagtggctaaactcataaaaggaggattcacttgtgctgttgtcactatagg

SEQ ID NO: 10894 - DNA, 71 bp, Homo sapiens
aactctatttttttcacattcgtatattagcatgtatatgtgtgggaggtatagttctgagatgtttatgt

SEQ ID NO: 10895 - DNA, 73 bp, Homo sapiens
cagaggcatgctgagaaagcggaggtttaagacttcagagtgaataaactaaaagaaataaaatgacttctgc

SEQ ID NO: 10896 - DNA, 73 bp, Homo sapiens
ccaggtgagagatgaactgtgcatagaccttgttgttaacactctcctggaaaaaagaagaagatcatttctg

SEQ ID NO: 10897 - DNA, 74 bp, Homo sapiens
cacttgagcccaggagttccaggctgcagtgagctatgattgtgccattgcacttgctccagtctgggtgacag

SEQ ID NO: 10898 - DNA, 72 bp, Homo sapiens
gctgcatctgccctgacctcagctcagtgagttcagccagccctgaaccagctttggttttggcacagtagt

SEQ ID NO: 10899 - DNA, 72 bp, Homo sapiens
cgcgggtctgacccagaaataccccagaccctttggagctgtgggagtagttgcagggtccaggacccatca

SEQ ID NO: 10900 - DNA, 72 bp, Homo sapiens
tcctcttacgtataaaacctctttatacgtaaagaggtttgctttaatcccacttctgacaccaatctgctt

SEQ ID NO: 10901 - DNA, 73 bp, Homo sapiens
gaaaatagcttatcagacgggcaccgtgactcatgcctataatccccgcactttgggtggctgaggcgggtag

SEQ ID NO: 10902 - DNA, 74 bp, Homo sapiens
acatgcactgggtactcagctaagggagggggcatcccttcctcccagcagcaattcatgaattctcagggagc

SEQ ID NO: 10903 - DNA, 74 bp, Homo sapiens
cattacttaagaggggccgaatgatgatgatgactgacagcccttcaggggatttatcttatttcagcctctgt

SEQ ID NO: 10904 - DNA, 74 bp, Homo sapiens
cattgtgctctgtgtgtttgacccctttgaaggtgtcttctgctcagaactttcacccagtgtctcacaactgc

SEQ ID NO: 10905 - DNA, 110 bp, Homo sapiens
agtataattattacatagtttttgatgtcgcagatactgcatcaggaactgattggataagaatcagtcaccatcagttcctaatgcattgccttcagcatctaaacaag

SEQ ID NO: 10906 - DNA, 70 bp, Homo sapiens
cctgctcagtgatgtttttggtggctgccgaggcaactaaattgacctcctaatatttttctaggggtgg

SEQ ID NO: 10907 - DNA, 71 bp, Homo sapiens
gatgtcgagtccagtttttgagtggtttcatttgtccgtgaaacagggtgaggtgcagctcacagaggagt

SEQ ID NO: 10908 - DNA, 73 bp, Homo sapiens
atgttgaatggctggtaactttctcatgacataagtaatacttattgatttggtttccatcaactacttcaat

SEQ ID NO: 10909 - DNA, 70 bp, Homo sapiens
cttacctctgcccctcctgcaaataactcctcacctagtcagtgagttgccactgattaggggggagagt

SEQ ID NO: 10910 - DNA, 72 bp, Homo sapiens
agtttggttccaaggctagcccataaaaaccaagtctgtcatcacgtagctgagctaaaatccaaactgctt

SEQ ID NO: 10911 - DNA, 73 bp, Homo sapiens
ttcattatctgtaacagtgtgcaaaacaccatccaaatgatgcttgctccatgcaaactcttgagatcctgaa

SEQ ID NO: 10912 - DNA, 70 bp, Homo sapiens
atatatatttctatgtgtgtatacatatatatgatgctacatatatatgatgcacatgtcaatcatctta

SEQ ID NO: 10913 - DNA, 73 bp, Homo sapiens
tgtaaaagcaaaagcattggaatgttgtccttctgagggggtgggaggcaagatgctggcagctgaacacctt

SEQ ID NO: 10914 - DNA, 70 bp, Homo sapiens
acggtctggtgaatcaataggcaattaatacatacgcaagtacctggttctaataatacttgtaccagat

SEQ ID NO: 10915 - DNA, 72 bp, Homo sapiens
ctgtgacagacaagtgcgtcagaggggaccaggtgtcccttcccctgctcagccttcatagggcagaagatc

SEQ ID NO: 10916 - DNA, 72 bp, Homo sapiens
acatcacctatgaagagatctttggctttggtcttggataaactattcaagtaattcaggatgtgatgggtg

SEQ ID NO: 10917 - DNA, 71 bp, Homo sapiens
ggctcaagtaagcagcccttggaactggagtggttaagttaaataagggtgttggttgcagtgttcctcct

SEQ ID NO: 10918 - DNA, 73 bp, Homo sapiens
ctgaatacatgtaagatagcatgactgaaatgactaagcagtggtctaagttaaactgctaaagaggcttgca

SEQ ID NO: 10919 - DNA, 74 bp, Homo sapiens
gcattctggtaggtattgggaatgcagcacataaaaaagacaaaatccctgtcctcctggagctcatatttctc

SEQ ID NO: 10920 - DNA, 72 bp, Homo sapiens
gttgactcctcctatgaagaatggtatgctgctctgacatcattgctaagtcccaatggcatacacatggga

SEQ ID NO: 10921 - DNA, 73 bp, Homo sapiens
actttttatttcttttccatgtataattgcactggctaggatttccagtgctgtgttgaatagaagtgataag

SEQ ID NO: 10922 - DNA, 70 bp, Homo sapiens
tgactagtagtggtgaaagcgaacatccttattttgttcccaatcttaggcggaaaccactcagccattg

SEQ ID NO: 10923 - DNA, 72 bp, Homo sapiens
tcttgccctgtcacccaggctggagtgcaatggtgcgatcatagctcaactatagccttgaactcctaggct

SEQ ID NO: 10924 - DNA, 74 bp, Homo sapiens
cccaatgtttaccttgcgacgacgtgagcaaacagtagcagcagcatttggccatgtttgttgagccggcttgg

SEQ ID NO: 10925 - DNA, 74 bp, Homo sapiens
agccacatggtaactacttagttcaaggcagagttaggactcaaactcatctgactgactccagtgccagtgct

SEQ ID NO: 10926 - DNA, 71 bp, Homo sapiens
aaattcatttttcttctcccacccttttcagatagttccattttgtgggcacattaaaggtggcatgagac

SEQ ID NO: 10927 - DNA, 74 bp, Homo sapiens
agacttatcccaggtgctgtgggggcataaagatgaaaaaggtattccctgtcctccaggagcttgtagcctaa

SEQ ID NO: 10928 - DNA, 72 bp, Homo sapiens
caaagctcttcctgccagccactgctattgtatagtttaaatctggtctggcacaaagctgaccatcttttg

SEQ ID NO: 10929 - DNA, 72 bp, Homo sapiens
cactcacacaaaatgttgaccagtaaaacatccagtgtgccaggaagaccctgggtgcggcttctcaaccca

SEQ ID NO: 10930 - DNA, 73 bp, Homo sapiens
tgggcttcgctccgcccctgaaggaccgtccacctgagagcgtctgggctgcttggccgatgggggttggggg

SEQ ID NO: 10931 - DNA, 72 bp, Homo sapiens
cctggggagccctggcaggccagcgacttaaactctatctgtccatctgtccctgcctggctttcttcagca

SEQ ID NO: 10932 - DNA, 70 bp, Homo sapiens
agtaagtatgggcggctaatatttttttaacactgcaagaaagcaggcactattatttgggttgcctata

SEQ ID NO: 10933 - DNA, 72 bp, Homo sapiens
catagcctgaatgcatagtagttgagtcctgcatcctcgcacatgctggaatcaaaagaaggaagggtggtg

SEQ ID NO: 10934 - DNA, 70 bp, Homo sapiens
catttaaagtctctttctttcagaatttatagtataacatagttctgagatgagaagttactgtagatgc

SEQ ID NO: 10935 - DNA, 73 bp, Homo sapiens
gataaaggtctaatttcacttgtttgcatgtggatgtccagttttcccagggccatttgttgcagattgtcct

SEQ ID NO: 10936 - DNA, 73 bp, Homo sapiens
tgagtgtatcaatgaacaaactgtcttttcagagttctgtattttccagtcatagtctgtgatattgagctca

SEQ ID NO: 10937 - DNA, 70 bp, Homo sapiens
gtgagtatattctgttgacatagcagatatgagctctgaggttgggttaagtgtaaagaaatttctcacc

SEQ ID NO: 10938 - DNA, 70 bp, Homo sapiens
ccagaaggagcttatttgggatgacagactctagaaccttctggagccagaacaaaatcccgagaaaggc

SEQ ID NO: 10939 - DNA, 71 bp, Homo sapiens
cttgggtggtgcttgcaggactggggcttgagcgggggatgaacccttgcggcccgttctgagaagcaagt

SEQ ID NO: 10940 - DNA, 73 bp, Homo sapiens
agaggaagtgggaacctggcatcagtgaaaggcaatggcagttcctaacactgtctgggaacctatggctctg

SEQ ID NO: 10941 - DNA, 72 bp, Homo sapiens
cacttaagcccagaagctggaaactgcagtgaaccatgttcatgccactgcactctagcctgggcaacagag

SEQ ID NO: 10942 - DNA, 70 bp, Homo sapiens
caattcagtaagtacacgattctggctcctttcactggggagccatgagtctttccaatacctgctgaca

SEQ ID NO: 10943 - DNA, 74 bp, Homo sapiens
ggatccacattcgtgatggggtagcccctgaatctttagaggatttatctcctacatgccttaccaaggtctcc

SEQ ID NO: 10944 - DNA, 74 bp, Homo sapiens
ctccgcctcccgggctccgccagcaaccgccgccgggccccgcccctcggcgcgcagcgcgccgccgcccgtag

SEQ ID NO: 10945 - DNA, 71 bp, Homo sapiens
tttttttttaatctaggaagccaaggaaaaccagctgaacatattccattggctgcagccttcaatttaaa

SEQ ID NO: 10946 - DNA, 70 bp, Homo sapiens
gcccatgcctatgtcctgaaacggattgcctaggttttcttctagggtttttatggttttaggtcttaca

SEQ ID NO: 10947 - DNA, 72 bp, Homo sapiens
ccactattcaatttatgtacctcacaggaggccacaccccgagtgttacagccccccaggaaaataaataaa

SEQ ID NO: 10948 - DNA, 72 bp, Homo sapiens
aggaagcttccctgaattcaatttgtgggaatgagatgcacctgcttagagctcctacagtgctcacctcta

SEQ ID NO: 10949 - DNA, 70 bp, Homo sapiens
tgacttgaaaactgctcccccacccctacaccctccaccacgttcccgtaggtcttgtgggggtggtcac

SEQ ID NO: 10950 - DNA, 71 bp, Homo sapiens
gagtgaccattatgtaccaggaaccattttaggtgctttgtgcttattagttatctcatttaacctttgca

SEQ ID NO: 10951 - DNA, 73 bp, Homo sapiens
tacatgtgcagaacatgcaggtttgttacataggtatacacgtgccagggaaatggacagttttaatgcatat

SEQ ID NO: 10952 - DNA, 73 bp, Homo sapiens
aagacacactgacagtgaccatacccctcttccccaggggtgattttctttacatgcatgttttcgcttgaac

SEQ ID NO: 10953 - DNA, 71 bp, Homo sapiens
attaagtcacatgctaattcctaaatcagttcctgttatcaagggaatttcagttgctaattggctgagac

SEQ ID NO: 10954 - DNA, 73 bp, Homo sapiens
catctggtccagctgcagccttgcgtggcgccagcaccagtgccagcactggagctgcctgccctaccacagc

SEQ ID NO: 10955 - DNA, 70 bp, Homo sapiens
ttatcctctcctagctccccagtacctccactccatggtggcctgggtgtagtggcaagctgaaaggacc

SEQ ID NO: 10956 - DNA, 72 bp, Homo sapiens
tcagtagacatgatatgactaaagattgatggggaactggataatcacatggtggtgaagtattgcctgaca

SEQ ID NO: 10957 - DNA, 72 bp, Homo sapiens
ttatccatgtctgtgaagtcatagtctgactccatctctatcttcacctgtggcaccatgaacactgggttc

SEQ ID NO: 10958 - DNA, 72 bp, Homo sapiens
gaggacaggttctgtgttggtttcttagatgtcttttttagccttcagtgcacatggccccttgcatataat

SEQ ID NO: 10959 - DNA, 73 bp, Homo sapiens
agctccagcacctgttgcgcggtgaacgcagtgcgtgacttgcgccgtttgcggccgaagggaccagggccca

SEQ ID NO: 10960 - DNA, 70 bp, Homo sapiens
tttcagtgtcttagaaaatagaccagaaaacacagctgttcattgtgtctgcctttgataactgcattaa

SEQ ID NO: 10961 - DNA, 71 bp, Homo sapiens
gtagtatccaactcctgacaccattttctgtattagccagaaaatactaggcgatgctatggtcaggaata

SEQ ID NO: 10962 - DNA, 72 bp, Homo sapiens
cttcagcccagaagagtaacacatgtctcctaagaactgtattattgaatcttctggacactcaaggaggta

SEQ ID NO: 10963 - DNA, 72 bp, Homo sapiens
agccgtctttcctcaaagctgaacacttacacttcctgtgtcagttggcaaacagcagatggcaaacagcag

SEQ ID NO: 10964 - DNA, 72 bp, Homo sapiens
ggccatactaaggatgcatttgacaacaaaactctcaaaaagataaattgaaggtgtatctctttcttggct

SEQ ID NO: 10965 - DNA, 72 bp, Homo sapiens
atggtctttttcctgtgagaaaaaagatagaattctttacaaggatagcttataggatgtgaggatcttata

SEQ ID NO: 10966 - DNA, 70 bp, Homo sapiens
ttctttaggcctccctgggatttatctatgttatgaaccataacatagcacgaaataatggctttagcaa

SEQ ID NO: 10967 - DNA, 70 bp, Homo sapiens
tgaacaggggtccacttacttggtgcagtaagaccagatatccacgctgacctttgcagcaggaaaaagg

SEQ ID NO: 10968 - DNA, 74 bp, Homo sapiens
ttctttctaatccccacccagcctgactggaaaacattcccagtcagatttggtttggtgcaactgactagggg

SEQ ID NO: 10969 - DNA, 71 bp, Homo sapiens
ttgtgctccatgatgaacacttcttagggtttttccagtattttctgtgagtgtgaagtgagatttgtgca

SEQ ID NO: 10970 - DNA, 70 bp, Homo sapiens
tttagacatcctgtggtttctggaacatttaaagtattgaaggatccagaaacattatatcaaaaaactt

SEQ ID NO: 10971 - DNA, 71 bp, Homo sapiens
gtgaggctggtcttgctccctgccctgctaatagcacgaagtttagatccagacagcctgcctgcagaaca

SEQ ID NO: 10972 - DNA, 72 bp, Homo sapiens
tgccctccctggagttctaataacatggttggttcctctggtaaccagtccttagcctaaagctaggcaggg

SEQ ID NO: 10973 - DNA, 72 bp, Homo sapiens
tggttagttccgtatgtccccaggccttaccagttgtgaagctggtgagtcaaatagttttcaaaacctaaa

SEQ ID NO: 10974 - DNA, 74 bp, Homo sapiens
tggcaagatggatgtaattggtaaccttgagatttggagggtctggagcttattcagtttatggggacttctat

SEQ ID NO: 10975 - DNA, 71 bp, Homo sapiens
aaaatcttgaagcacaaaaaccagatctgcttcatgctgatttctgctgtgtagtgacattcttctggttt

SEQ ID NO: 10976 - DNA, 74 bp, Homo sapiens
tcaccctctgggctgctggtcaccatgagagggccctgacatgtccactcctgggtcatgcacagtgtctgcag

SEQ ID NO: 10977 - DNA, 73 bp, Homo sapiens
ccattggctcagtggtttatctttatatcactatcatactatagtgatgtctgaatcactgtcgtttaacatt

SEQ ID NO: 10978 - DNA, 74 bp, Homo sapiens
ggctgtattactcacataatattttccaggggccattttggatgccccaatcattgtgaagtaattaaaaggcc

SEQ ID NO: 10979 - DNA, 72 bp, Homo sapiens
tgggagtcatcagaggctattcgatgggacagtgacatgatgtcattcatatttgcgaaaaccattatggct

SEQ ID NO: 10980 - DNA, 71 bp, Homo sapiens
tgattgaagtttctactgaccaaggggccagtgattatttccttggactgtggattcaggctctgtttttt

SEQ ID NO: 10981 - DNA, 70 bp, Homo sapiens
atctcatttgatccttaccagatccttgtgaagcaggctgagcaaggattgttttctgaattttatagac

SEQ ID NO: 10982 - DNA, 72 bp, Homo sapiens
gtccctggagtgccctgggcaggggatttttgttgggcatctctctgtagacaccttcacttacactcatag

SEQ ID NO: 10983 - DNA, 70 bp, Homo sapiens
accacgaagggcaaagtggggagcctagaccctcctgcttcagaggctattgtgaggtgcccccagacct

SEQ ID NO: 10984 - DNA, 74 bp, Homo sapiens
ttgggtgagagatacgggtctagtgtcattcttctgcaaatggatgtccagttttcccagtaccattcattgaa

SEQ ID NO: 10985 - DNA, 72 bp, Homo sapiens
tgggtccttaacatgtaaagttagggtttttttttgagacttttaattttctttatataggcctttatggct

SEQ ID NO: 10986 - DNA, 73 bp, Homo sapiens
tgtagtaaatttccttgtgtaagcatattcctaattagataattaggaattcaataaatgagttatataaatt

SEQ ID NO: 10987 - DNA, 73 bp, Homo sapiens
ttttcatttcaccttctagtcaggtgcaaatatgggtatcttatactaggaggttacattaggaatggatact

SEQ ID NO: 10988 - DNA, 73 bp, Homo sapiens
tggcacaaatagtgatggacaagtgcattgctctaaaattcttgttggcttatcatcacagcatttgttccat

SEQ ID NO: 10989 - DNA, 74 bp, Homo sapiens
tgagcattgtgaggtggatgatgtgctgcatgctacaatccttgcttagccactgctgccaccacttcaactgt

SEQ ID NO: 10990 - DNA, 74 bp, Homo sapiens
taaaaaggccaggaccaagcctatctgtttatggggttgtgtggacccatctagacattttcagtgtcttgctt

SEQ ID NO: 10991 - DNA, 73 bp, Homo sapiens
ttgactttacagtggctaagcctgacatccactacccagagaggtgtcaggttaacatccacagtaatcaaca

SEQ ID NO: 10992 - DNA, 74 bp, Homo sapiens
ccactgtaataagatagatatgttttttaatttgtgcacctagaccactggggctcaaagtgattactaatata

SEQ ID NO: 10993 - DNA, 72 bp, Homo sapiens
gaggttacctctcctgacagttagatcagccaactgagctatagtctgactgcacaatgaacaggagcccag

SEQ ID NO: 10994 - DNA, 73 bp, Homo sapiens
gaatttgtactttaactgagatgaaagttcagctagagagttggagtttaagaggggagaggagtcatcattt

SEQ ID NO: 10995 - DNA, 73 bp, Homo sapiens
tcttctgtgccttaaagtttatggggtttttttaatcaaatattttatttgatcctctctattatggcaggaa

SEQ ID NO: 10996 - DNA, 73 bp, Homo sapiens
ccttctagaagatggtagctgtggtccatgatgttgaattctaacttggtgctcagtgccacttaggaattcc

SEQ ID NO: 10997 - DNA, 71 bp, Homo sapiens
tatctgggctctgtttcgaaatagtcttgggcttaggggtggatgagcaaggagtgggtgggggatggatg

SEQ ID NO: 10998 - DNA, 74 bp, Homo sapiens
gaggttgaggtgggaggatcgcatgagcccaggaggccacagtgagccatgttcgtgccactgcactccagcct

SEQ ID NO: 10999 - DNA, 74 bp, Homo sapiens
ggtcctcacagatctgctgggcagtttctccggccacgaggccctgggtaactctagactgatacctcctcatg

SEQ ID NO: 11000 - DNA, 74 bp, Homo sapiens
acacttgatacaaccaggctgtgatgattggcgcaggggtacggacctcagctgagtcatgggagctgaatgta

SEQ ID NO: 11001 - DNA, 73 bp, Homo sapiens
aaggctgagtcactggaggatgggttttatgggactatagttctgagctgggccactttctcctgttacctca

SEQ ID NO: 11002 - DNA, 70 bp, Homo sapiens
tgccactttactaatccctgagccatgagatggcacaaagttgctgtgaggattaagagagatggggagt

SEQ ID NO: 11003 - DNA, 70 bp, Homo sapiens
ggatgactggactgcggctccgcgggaagatgaaggcgaccactgtctttatagaggagttgtctcttat

SEQ ID NO: 11004 - DNA, 72 bp, Homo sapiens
aggcattccagccaagaggtggcagagccagggccagcctggcctgaggactctgaagcttccacaggcaca

SEQ ID NO: 11005 - DNA, 74 bp, Homo sapiens
cagaaaaacatgtatatctgatttgttcgtagcaggtttattcatgatagcctcaaatcagaaactgcttttgt

SEQ ID NO: 11006 - DNA, 72 bp, Homo sapiens
aatgtttgtgccctctcaaaatttacatattgaatctttaaaccctaatgtagctaaatttggagacagggc

SEQ ID NO: 11007 - DNA, 70 bp, Homo sapiens
tttcctgtagccattttcacagtggctaacctcttcagcctgggaccccacccagctgccacggctgcgc

SEQ ID NO: 11008 - DNA, 71 bp, Homo sapiens
ttcaggctctgcaactcctgccgtagcttgttggtatactgggagagcaggcgcagggtgggagtcatgcc

SEQ ID NO: 11009 - DNA, 72 bp, Homo sapiens
gcagccacagggctcccgggtgctggccaccctacgtggccaggtgctcctgggcaggggcgtgggtgctat

SEQ ID NO: 11010 - DNA, 74 bp, Homo sapiens
gccctgagggagaacagttgctcatagcgctttgaaggcgagtggggggccttagtctgaagtttctttttacc

SEQ ID NO: 11011 - DNA, 72 bp, Homo sapiens
agacaacccactttagaaatgagaaaagggccaagtgtggtggtaatcccagcactttgggaagttgaggtg

SEQ ID NO: 11012 - DNA, 73 bp, Homo sapiens
tacagagagagaatcttgagactctaattcagcttttagcttatactcagtcttaagaatagaaatctgtgct

SEQ ID NO: 11013 - DNA, 73 bp, Homo sapiens
aagcactaggctttggggctctcttctcaggcatcctcctcaattcccagaggagggacctgagactcaaaac

SEQ ID NO: 11014 - DNA, 70 bp, Homo sapiens
cagctaatttttatattcttggtagatatggtttcaccatgttggccaggctggtgtcaagctcctgacc

SEQ ID NO: 11015 - DNA, 74 bp, Homo sapiens
tagatgtagggcaactctctcctgggaacatggtcacccagacaggttggtggcagggggaggttgaccatgtc

SEQ ID NO: 11016 - DNA, 72 bp, Homo sapiens
cttggtcctgggtggccccggagggggcgggctgccgggaggaggcggcctcccccgcgggcgagtggcgcg

SEQ ID NO: 11017 - DNA, 72 bp, Homo sapiens
ggctagtccacaaaatttgaatgctttaggaacaggcttctaaccctgacaaatgcctgtagaagttggata

SEQ ID NO: 11018 - DNA, 70 bp, Homo sapiens
tctcctcaggatcttccctggatacttatctgtggacaagaaacttcagtctgtgcccttggggttccag

SEQ ID NO: 11019 - DNA, 72 bp, Homo sapiens
cagttccgctcgctccctcccccgcgctcccggcccaggactctgctcggcgactgctgaaggagcctgtgg

SEQ ID NO: 11020 - DNA, 72 bp, Homo sapiens
aaatagtcccctgggttggggggcagtccttcgccgctgccttcccccggccctgctccctccaggccactg

SEQ ID NO: 11021 - DNA, 74 bp, Homo sapiens
aatgatgtcctgacctgagtcctgtgagaaacactgttgagttacttcacagtcattccacacaggagaaaagg

SEQ ID NO: 11022 - DNA, 73 bp, Homo sapiens
gctggtcaccttgggcttggccattctggagttactgctcctgttctctctgttggccttgccttgtccctgc

SEQ ID NO: 11023 - DNA, 72 bp, Homo sapiens
gaggactcctttccacctcttttgcaggttctctcctgcaagctagctcccacactctaggccgtatcttca

SEQ ID NO: 11024 - DNA, 72 bp, Homo sapiens
tttaacacctcccgaacagcaggctgtctcaggctgtgcagcagagatagctggaggcatacctcaaacacc

SEQ ID NO: 11025 - DNA, 71 bp, Homo sapiens
gaggcgctgactgaattcactgggcatgggcgtgggcatcaggctgtgttcaagctccccaggagattccg

SEQ ID NO: 11026 - DNA, 71 bp, Homo sapiens
caagtggcaaagcagttttgaaggtttcatggtttcactggatagccggtcactacatattatacaaagta

SEQ ID NO: 11027 - DNA, 73 bp, Homo sapiens
agcacagctttactaaaatacactctgccaacagcagaaggccctctgaggtgagcaggtgggacgaggctgg

SEQ ID NO: 11028 - DNA, 73 bp, Homo sapiens
cactcccaagcatttcagataagagatactcaaatcattaaagtacttattgagactattaggtgggtgctac

SEQ ID NO: 11029 - DNA, 72 bp, Homo sapiens
caccccaccaaagtgtctcagtttggacaataaccacagttattatccttgggaaaggacatttgggctctg

SEQ ID NO: 11030 - DNA, 72 bp, Homo sapiens
tgcctaagtatgtatggcagaataagctcttgctgtctggacggtaatctgctcttggccccttttactggc

SEQ ID NO: 11031 - DNA, 72 bp, Homo sapiens
tagcttaaggaggtgcttggcagtggttcagccagtaaaaggggccaagagcagattaccgtccagacagca

SEQ ID NO: 11032 - DNA, 73 bp, Homo sapiens
gctatggctcccacctagagacacagccctacagctcccacggccctggcggagcttgtctgtgtaacacagc

SEQ ID NO: 11033 - DNA, 72 bp, Homo sapiens
aaaaataaccccagcagctgtgggttcaagtaccccaatggcaggaccggccctcgactcattgttgcgact

SEQ ID NO: 11034 - DNA, 73 bp, Homo sapiens
actgagctgtcaaatccagaattagaagaatccgggtctgggtcactgagaatactggggaagctcgctttgc

SEQ ID NO: 11035 - DNA, 72 bp, Homo sapiens
ctccctccagctactgaggaatgatgacaagaaaaggccgaattgcagtgtctccatcagcagtttgctctc

SEQ ID NO: 11036 - DNA, 77 bp, Homo sapiens
gggggctgcctggcgggcctgagcctggggaatgcagggcctcgggtccacagcggctgtgcagacggcggagcaga

SEQ ID NO: 11037 - DNA, 70 bp, Homo sapiens
aagccccagatgaacttggacgttatgtctgtcttcgctctttgaggcggggcccactgtattctggggt

SEQ ID NO: 11038 - DNA, 70 bp, Homo sapiens
agatcttctccctctaggcaagatgctggaagcttctcctcaggggaattagatggcccaggaagagaaa

SEQ ID NO: 11039 - DNA, 74 bp, Homo sapiens
tcactgccccctaccctttggcaagctccacttttgatagcgctgatgtgatagcagacaacgtgtaattgcca

SEQ ID NO: 11040 - DNA, 73 bp, Homo sapiens
tttggttttttatcttttacttcttttcttggcttcccttattggaatatccagcatgaggttggagtgggaa

SEQ ID NO: 11041 - DNA, 73 bp, Homo sapiens
cccagctactcaggaggctgacatgggacgataacttgagcccaggaggacatcatgtctgcagtgagttatg

SEQ ID NO: 11042 - DNA, 70 bp, Homo sapiens
aggaaggagcaggaccgcagctcgaatacaagctgagctgacaggcggtcggagtgctgctctgaagtgg

SEQ ID NO: 11043 - DNA, 72 bp, Homo sapiens
gaagcaaggttagcaagaaagtcctgagaaatctcggtgtcaatttcctgtgggttctttatttttgcgtca

SEQ ID NO: 11044 - DNA, 72 bp, Homo sapiens
tggtgacccagccaggctccagcaccttcctgcagccttccccaggccaggaggcaaaggcaggtcagcagt

SEQ ID NO: 11045 - DNA, 73 bp, Homo sapiens
aaacctggagtcccatgagtgctgctattgtgccattagtcaggggagcgccttgtcagcctctaggggctcc

SEQ ID NO: 11046 - DNA, 71 bp, Homo sapiens
ggagtcatatctgggtttgcttgtaataattcctttgtctctcagacccttctctccctctctttccaaca

SEQ ID NO: 11047 - DNA, 74 bp, Homo sapiens
agctccattattacttttgagggatagctatgttgttaacttaaggtctaacttagttgattctagaagttgtg

SEQ ID NO: 11048 - DNA, 72 bp, Homo sapiens
tgggtggggacacggagccaaatcacatcattcacatacgctttcacagtgcccatcaaataccccatttat

SEQ ID NO: 11049 - DNA, 72 bp, Homo sapiens
ctttcctcagagagctgcatacggcttgaaatatatatatagtttgtgtgagttcatcaaggattgaggaga

SEQ ID NO: 11050 - DNA, 72 bp, Homo sapiens
tgcttctatttaccttactttaaacattggttatttttgtgacttacttgtaaggtagaaagcactatggtt

SEQ ID NO: 11051 - DNA, 71 bp, Homo sapiens
tgacttgggggcagaaaggaatctaggaagttgggtggcacatctgccctgtgtggccttcttacctcaag

SEQ ID NO: 11052 - DNA, 74 bp, Homo sapiens
aaaggcccattgagtggaactgagaaggactagcccatcaacaacattttatggggtggactcttctcagcccc

SEQ ID NO: 11053 - DNA, 73 bp, Homo sapiens
tcctctgcgctttggtagctggctggcaacaactgtgtttgccagtttcccttctccaggtctgcagttgatc

SEQ ID NO: 11054 - DNA, 73 bp, Homo sapiens
gtcaccaaagaaaaaggcagaatggccgagcggctaagaacctgggcttcggtctctgctatttataattgtg

SEQ ID NO: 11055 - DNA, 72 bp, Homo sapiens
gggggcaaagtgctgttatgtagtggttgcctacttctatactgcaaacactaccagctatggccaagttga

SEQ ID NO: 11056 - DNA, 72 bp, Homo sapiens
ttccagcttaagcccactcaaggcaggcatttccagctctgggtagtttatggcacctctctcagcctcagt

SEQ ID NO: 11057 - DNA, 74 bp, Homo sapiens
catactgcagcatctatgctagaaatgaccacagtgtgggctccaccgggcccattctggggtgaattgggcat

SEQ ID NO: 11058 - DNA, 72 bp, Homo sapiens
gaaatatctgatttacgaaataccccaataggttttttcaattgaaagcaaaacctatctgcggttttcttt

SEQ ID NO: 11059 - DNA, 73 bp, Homo sapiens
ttcttcaatgtggctttgctaatatcaattagaatttctcaaaagttacattactaagaaatcaacggataaa

SEQ ID NO: 11060 - DNA, 71 bp, Homo sapiens
ttgcccatctctgggaaagtattaccattactgaatagctctttccctgaagagtaaactgcataaagaag

SEQ ID NO: 11061 - DNA, 72 bp, Homo sapiens
ctcaactctaaccacacctgcctctggcaccaccctcacacctaccctaacttgtgagggctgtgctcagat

SEQ ID NO: 11062 - DNA, 73 bp, Homo sapiens
cttagtgccaaggcccatttatagaccctccctgtagaggagcacttttttagattgaaaggcaataagtggt

SEQ ID NO: 11063 - DNA, 74 bp, Homo sapiens
tggttatgacctaatgcttgcttggaccggttcaggcatgccagggcaaatatctaggctagaatgtgggagct

SEQ ID NO: 11064 - DNA, 70 bp, Homo sapiens
tagatggagggcaaaataaagatatctttcaaacaaataaaaatggagatagtttgcctccaacacagtt

SEQ ID NO: 11065 - DNA, 74 bp, Homo sapiens
ggagggacctctaggctgctctaaacagtaataccccaaataacattctatgggggttctccttcaagaccatc

SEQ ID NO: 11066 - DNA, 73 bp, Homo sapiens
ggtccagtgagttagggtgggatcgctgggccagtgtacctctgtgctcccacatttcagcccacattccagc

SEQ ID NO: 11067 - DNA, 72 bp, Homo sapiens
tagaagggccattttattctgggcagggttgaggcagggactctgttaggtccacaggagaagagatggtgg

SEQ ID NO: 11068 - DNA, 74 bp, Homo sapiens
tttatccttttgctttatcttttgcggctctgcccagtcctaaagtggcaatggctcaatgtggtgttctgcaa

SEQ ID NO: 11069 - DNA, 70 bp, Homo sapiens
cccaaccccgccgcgccggggaatggctgcgaggtctctcccctgaggaccttgaagggaccccgcgcct

SEQ ID NO: 11070 - DNA, 71 bp, Homo sapiens
tcacctcctcctccaatatttagcattagttaatagttggagctgaacaaatgcctggtgagttgaaagta

SEQ ID NO: 11071 - DNA, 70 bp, Homo sapiens
tgtgtctgcaggtgcctgccaccagccccagtctgctgcacgggccctggcaagtagaaagcacttgcct

SEQ ID NO: 11072 - DNA, 72 bp, Homo sapiens
ggggtcaccgcccccggggagccgggatgggggtcaccgcccccggggagcccggatgggggtcaccgcccc

SEQ ID NO: 11073 - DNA, 73 bp, Homo sapiens
gaatggctgacatcatcagtgcaggtgggatcgtgtgttttcttccccttggagtgctctgctattttatctc

SEQ ID NO: 11074 - DNA, 70 bp, Homo sapiens
gtccccacgctgtagtcttttatatcattgcccattcagttcgcaggcattgagagcataactagtagca

SEQ ID NO: 11075 - DNA, 71 bp, Homo sapiens
aaaacccagtgcgatgcggatgtggtggaattgtatgcattcgtattgaaaagggtatgaaagtgagaaaa

SEQ ID NO: 11076 - DNA, 72 bp, Homo sapiens
tgcagtggtgtgatcttggctcactgcaacttctgcctcacgggttcaagtgagtttcgtgccacagcctcc

SEQ ID NO: 11077 - DNA, 72 bp, Homo sapiens
atttgcgttgtgacatacctatatggtaatgactgtttggtgggtattttcaatgttgattttccagagttg

SEQ ID NO: 11078 - DNA, 73 bp, Homo sapiens
ttctggatacattttgtagacagagccattagcatgtgctgacttactgaatacaaagtgtgacaaaaagagg

SEQ ID NO: 11079 - DNA, 74 bp, Homo sapiens
tataattattctatactaatgcacggtaatactaatagaggaaacttggtatggggtgtatgaagactgtgtgt

SEQ ID NO: 11080 - DNA, 70 bp, Homo sapiens
caaactcaagcaccattatatctgggtgaggtatgataggttataacttcaattaggtatgaatcctatt

SEQ ID NO: 11081 - DNA, 73 bp, Homo sapiens
agtttcttgtacaggtccacagccccgtgggctgggaacccctgatgtgttctgcttatcaactctgccaatc

SEQ ID NO: 11082 - DNA, 73 bp, Homo sapiens
atctggcaaggaggccatgatgagtgaatcgacatttgactgaatctggccgtttctatatatggtgcccagc

SEQ ID NO: 11083 - DNA, 71 bp, Homo sapiens
gaccggtgtgccaatcaatgcaatgagaaagggcattctcacttataagatggtaaacagccttggaattt

SEQ ID NO: 11084 - DNA, 74 bp, Homo sapiens
ataagtctggaggcaatgagtgggactaagtcctgagaaggatcaacagtaactcatgtgccacttaaaggctt

SEQ ID NO: 11085 - DNA, 73 bp, Homo sapiens
acagcctcttcaaagcatccttatcaagggctattagtcagtccacttttattgggtgccttaatgtcttggg

SEQ ID NO: 11086 - DNA, 73 bp, Homo sapiens
gtatctggaaaatagcttcacaagttgggaccaaggttaaaactgctgaggacaacagtaataccccactgat

SEQ ID NO: 11087 - DNA, 73 bp, Homo sapiens
gttttaagccagaaagctgtgttgttcaggtgatatacctggttgcagtgccatagcgggtgagggaattact

SEQ ID NO: 11088 - DNA, 73 bp, Homo sapiens
cctgccctagagatttgtggaactttgaacttgagtgagatgacttaaggtatctggtggaagaaatttctaa

SEQ ID NO: 11089 - DNA, 71 bp, Homo sapiens
ctagtggggtggtcagtgctcctgtctcatggtattgctcctgttaccttgcttgcctttcctgatcttca

SEQ ID NO: 11090 - DNA, 71 bp, Homo sapiens
ctcagcagagggagggtcagaccatggcaggaaaggccaccagagctttccataatgcagatgactctgcc

SEQ ID NO: 11091 - DNA, 71 bp, Homo sapiens
gtgcttttcctgctactcctgatggtgattttcttgcttatttgcatgtacctcaggggcttgtgcctgaa

SEQ ID NO: 11092 - DNA, 72 bp, Homo sapiens
gtccttcaagagcttcctggtaaccatgcccaaagatcacaggtaactaagcagttgaggtgacagtcactg

SEQ ID NO: 11093 - DNA, 74 bp, Homo sapiens
ctaatttttgtattttttagtagagacgaggtttcatcacattgccagcctggtcttgaactcctgacctcaag

SEQ ID NO: 11094 - DNA, 73 bp, Homo sapiens
tctttccagggtgtttagataaggcaggaaggtgggcctagtgatgtgtgtctgaaatcccaccagcctgatc

SEQ ID NO: 11095 - DNA, 73 bp, Homo sapiens
aggattctctccacactggagctggagtgcagtgctagagcgctgacacagcaggatgaagcaggatgaaggg

SEQ ID NO: 11096 - DNA, 74 bp, Homo sapiens
gcggagcctggcgggaggcagcgccgcggagccagcgccggacgccgcaagcagactccccggccagcgcaagc

SEQ ID NO: 11097 - DNA, 71 bp, Homo sapiens
gcgtctggagctgggtggtttcttgctttccagggagacctggagctgcacaaaccctgggactggtgggt

SEQ ID NO: 11098 - DNA, 74 bp, Homo sapiens
acccacttctcatcactccatacccaccctcagtggactggaagcagagcacggtgaggctgggccagtgatgg

SEQ ID NO: 11099 - DNA, 73 bp, Homo sapiens
gtgatctactctgatgatttcctttaattggtgcagttagactactgatgttcacagtgattactgatatagt

SEQ ID NO: 11100 - DNA, 74 bp, Homo sapiens
ttgggtagagcaggaacagtgctgactcgaaagcctgttacagggtttatgaagtagctactcaccaatcccta

SEQ ID NO: 11101 - DNA, 72 bp, Homo sapiens
gaggaatacatacctgatctagatttcacctggaatgtcacctgagatcagtaagtcagataccccacttct

SEQ ID NO: 11102 - DNA, 73 bp, Homo sapiens
gtcgggggatgatgttgggggctcgggacggcgggcaggagttcttagcactgctctcagctttgacactggc

SEQ ID NO: 11103 - DNA, 74 bp, Homo sapiens
gggcttgtgcttttcaccaacgtttcatggttgccatggaggtggtgggtggaagggggagtggtgaagatgta

SEQ ID NO: 11104 - DNA, 72 bp, Homo sapiens
taggggctagaggcctggatctagcggctttcttctacctctccgactctcccactccctacccccaccacc

SEQ ID NO: 11105 - DNA, 73 bp, Homo sapiens
gtggttctgttagcgctaggaggaattccatggaaggagaacgaggagatattccaagattttagttagggct

SEQ ID NO: 11106 - DNA, 72 bp, Homo sapiens
tgggaggtcgaaaagtgtttgtgggacgggacgtccgcctggccctgggcctctgctgacctctctgaagat

SEQ ID NO: 11107 - DNA, 73 bp, Homo sapiens
cctgcggccggcctcccctctggcgctgacgcaggtaacctgctgccagccgcaccaccttcctccagctagg

SEQ ID NO: 11108 - DNA, 73 bp, Homo sapiens
tggtgtcatcttgtcatttacctctgggtccatctctttcaaggtggtgagtccccaagagagggagagaggc

SEQ ID NO: 11109 - DNA, 71 bp, Homo sapiens
ccagaatggtcttgatctcctggcctcgtgatccgcccgtctccgccccccaaagtgctgggattacagcc

SEQ ID NO: 11110 - DNA, 70 bp, Homo sapiens
ggcaaatggaaggttcacctggcaaacaaacatggcatcagaaggcttcccttccattgtacaacctatt

SEQ ID NO: 11111 - DNA, 72 bp, Homo sapiens
ctaactgcgacagacttagaggtacagttgcttgttatgacaggtattaacctagggatgtgtgtgtgctgt

SEQ ID NO: 11112 - DNA, 73 bp, Homo sapiens
cccaggcttatgtgtccaacaaaaaggaaaacgcacggtcccccggctccctcctgctgtcccgctatgtttc

SEQ ID NO: 11113 - DNA, 73 bp, Homo sapiens
acttcaggtcttgatgttgccttagggtttctatctgaggcatagcatcaccagtctccactttctttgcaat

SEQ ID NO: 11114 - DNA, 74 bp, Homo sapiens
gcgagattcttctgggttctggtttgagttttgttttgggaagggcaatagattctggcccctggtctgctaat

SEQ ID NO: 11115 - DNA, 72 bp, Homo sapiens
aaaaggcacaatgcctagtgagagtctttggatttggaggaaatgtatggctcatttgagtgtgttgtctca

SEQ ID NO: 11116 - DNA, 70 bp, Homo sapiens
aaagatctattgtaaggctggtctagcggtaacaaactcccttaattgcttgcttgcctggaaaatattt

SEQ ID NO: 11117 - DNA, 72 bp, Homo sapiens
tgtatctggcgtaggcatgtagtgcagatgctaaagcatgattttacaggccagatacacggtgaatatgct

SEQ ID NO: 11118 - DNA, 74 bp, Homo sapiens
ctttgaagaaaatagaatgaagggcctagaatcctaccatccagcctgcccttcttctgattcttcatgtaggt

SEQ ID NO: 11119 - DNA, 71 bp, Homo sapiens
aatagcatggaaggctgccccaatcaccaaacagaccaccctctgttcagaaccatcttgtagccactggc

SEQ ID NO: 11120 - DNA, 73 bp, Homo sapiens
tttagaactgaggccatgattaagatttatttttataaatatatgttcctaaatcattttgtggcattttcta

SEQ ID NO: 11121 - DNA, 74 bp, Homo sapiens
ttgacctgttcagctgatttgcagacctggatacaaacctcatggttcttgagtgaatgttctcatctgggttt

SEQ ID NO: 11122 - DNA, 70 bp, Homo sapiens
agggatcaaagaaggatggggcatgtccaaggacataggagcacgtaggagccaactaaggagctcccag

SEQ ID NO: 11123 - DNA, 72 bp, Homo sapiens
tcccagcactctgggagcctgagacaagctgatcacttgagctcaggagttcgagaccagccggggcaacat

SEQ ID NO: 11124 - DNA, 73 bp, Homo sapiens
gctgctgtgtggagatgagcatgccacctacctacagaccccatgcgcggccctcccccaccccaccccaccc

SEQ ID NO: 11125 - DNA, 74 bp, Homo sapiens
aggcctggcaacatccttgactccttcgcgccccttgtccaagactcggtgctgctgtcccatgtgtttggtgt

SEQ ID NO: 11126 - DNA, 70 bp, Homo sapiens
gctgaggcggggcctccccgctccccgcccccttcgccgggggcgcctgtcttcctctgccattggctca

SEQ ID NO: 11127 - DNA, 72 bp, Homo sapiens
gaatgtgaggtctgcaaaacgtatcaggcccagggagacatgagcatgagattttagtcctgcaccctgcac

SEQ ID NO: 11128 - DNA, 70 bp, Homo sapiens
aggtcctgcaattcaacccacatccctgaccctcggccctggagactctggggggcagtgagctgtgcac

SEQ ID NO: 11129 - DNA, 74 bp, Homo sapiens
ctgctctgtgcaatgacgccactgagggcccagcggggccgtgaccctcaggggacccaggagcagagctgggg

SEQ ID NO: 11130 - DNA, 71 bp, Homo sapiens
gccaccttcaggtaaccaggaggcaggtaggttggggtgtggtaagagcagagagtgtgaggacctggtag

SEQ ID NO: 11131 - DNA, 74 bp, Homo sapiens
aagatggtatagtgagtcgctgagccggttttgatgtgagccagtcttcatagctcacccactccctgtatcca

SEQ ID NO: 11132 - DNA, 70 bp, Homo sapiens
ccagctaagtgcactgagtacctgaaggtccatcatccacccttgggcttcatacttttagactaagccc

SEQ ID NO: 11133 - DNA, 73 bp, Homo sapiens
atcttcaggatcagggagggtccctgtctgcttgggtagggtgcctagtgacccctttgaagactttccatta

SEQ ID NO: 11134 - DNA, 74 bp, Homo sapiens
gtacgtgaggtagtaggatgtgcacagcatgggaggccaggcagggcctggtctatatcctgctgtgctcattt

SEQ ID NO: 11135 - DNA, 74 bp, Homo sapiens
ttttggccaggacctttctgacggcttgggcagaagtgatactgctcagtgctgttaataaagtgaatgggact

SEQ ID NO: 11136 - DNA, 74 bp, Homo sapiens
tgggacggttcagctgtaaaaaagactcccatggaggaagctcttagctctgtgctccacccatgctgggcctc

SEQ ID NO: 11137 - DNA, 71 bp, Homo sapiens
ctcctgatgggtggctatgggtggctatgggtgtctggctcagggactccttgctcattcctagtgggggt

SEQ ID NO: 11138 - DNA, 72 bp, Homo sapiens
aatgtaagtgtaggctgggctgagctgtgatgttctgtgcgttaggtgtactgagtacattttcagctgatt

SEQ ID NO: 11139 - DNA, 70 bp, Homo sapiens
gaatcatcttagagggcagggctatcccactggtcactctgtcccagcatatctaccatgaagtcagcag

SEQ ID NO: 11140 - DNA, 74 bp, Homo sapiens
ttgttaccatctgctgtggaaacaacagttttgccagcataaatccatatggctagctcctcccatctcacagt

SEQ ID NO: 11141 - DNA, 72 bp, Homo sapiens
acttttctggatgtgctgtggtttacaatatctgcttctttaagagaagctactctgaaatatcatggaaca

SEQ ID NO: 11142 - DNA, 70 bp, Homo sapiens
agtattagcaatatgatggtatgttacctccccaccccagtagggagagaacctgtacagaaataaccat

SEQ ID NO: 11143 - DNA, 71 bp, Homo sapiens
agcttcctggttcctagatggtggcttcttgctgtgtcctcacatggtgaaaggggcaagggagctctctg

SEQ ID NO: 11144 - DNA, 70 bp, Homo sapiens
ttaaacagtgcttgcctctgtgacagctggaaccagttccatgtgtccagaaactcagttcacaagattc

SEQ ID NO: 11145 - DNA, 72 bp, Homo sapiens
tttcctctgcttccctgggactctgggaaactggactttggccatgattgcagttgtccagcagagggcacc

SEQ ID NO: 11146 - DNA, 71 bp, Homo sapiens
ggccaagtgggtataggccaaggtaaacatcctgtgtgactctgagtttagagccccggtgtataactcca

SEQ ID NO: 11147 - DNA, 72 bp, Homo sapiens
attaatcttcagagtttcctaacctgtaatcctagggtctggcctagggctcagattaaactcctgatataa

SEQ ID NO: 11148 - DNA, 72 bp, Homo sapiens
tggacaggtgctggctttccttattaggcagtaaagcagtggatatcaacactttgctccaacatacatttc

SEQ ID NO: 11149 - DNA, 73 bp, Homo sapiens
tttttagagggtttcagaccccacttcttaaacaaactaagctggagtaggtattagaaacatatcaaaagga

SEQ ID NO: 11150 - DNA, 74 bp, Homo sapiens
ttctgggaccagggagcccctctcactttcggggccagttgggtgacccgcagcacctgaactcctaggtagaa

SEQ ID NO: 11151 - DNA, 72 bp, Homo sapiens
ctaggtctccacacttccagcacagtggccacaagccacacgtggccatgagcccttgaaatatgcctgggc

SEQ ID NO: 11152 - DNA, 74 bp, Homo sapiens
catatatgaaatatatatttctatatattatatataaaaatatatataatagatataaaatatatatataatat

SEQ ID NO: 11153 - DNA, 72 bp, Homo sapiens
aatggctccaggctagctttccctcagggtctgcatcctgtcccagtaaaccctagaggttcagaccaagcc

SEQ ID NO: 11154 - DNA, 71 bp, Homo sapiens
cctgctttgccagggactgtggaagaataaaaacgcaggaccaagaggcaagacatcagcacagctctctg

SEQ ID NO: 11155 - DNA, 70 bp, Homo sapiens
tgcaaagaacttccactttattcttctacttagctagatttactggtggtgcagggatgctagtggaggt

SEQ ID NO: 11156 - DNA, 72 bp, Homo sapiens
ctgcatggtggtcaggcattggtggttctcacagttctgcaagctggaaatccaagatcaaggaaatagcca

SEQ ID NO: 11157 - DNA, 71 bp, Homo sapiens
ctaagtgagatgaagacagtctgagtttgcctttgagaaaggcaggctgcatgccgtgacaagtcctccta

SEQ ID NO: 11158 - DNA, 72 bp, Homo sapiens
ttcaatcaaatgagtatgcacctgctgtgtgaattaagcttacattggaaggcatatagaagtggcagagca

SEQ ID NO: 11159 - DNA, 73 bp, Homo sapiens
tgaattggcagcctaagtaaaactcatttcttaaataatatctaggaagttgggatattaaatgagcttgtca

SEQ ID NO: 11160 - DNA, 70 bp, Homo sapiens
agctctttttttggtagagtgacgtctggacaattgccctttgaactaatttgagagagagagagaaaga

SEQ ID NO: 11161 - DNA, 73 bp, Homo sapiens
atgttgttgttcaagggtcagttgtagtttatgttgatctatagaaataccatctggcacctatcagagatgt

SEQ ID NO: 11162 - DNA, 74 bp, Homo sapiens
tgatgataacttaaggctgctttcagtttatggggtaataactgtaacctgggagaaataaaacctaaagctat

SEQ ID NO: 11163 - DNA, 71 bp, Homo sapiens
aactctggccaggtactgttttttcaggaggaggtgaacaactttagctccagcccctagttgctgggctc

SEQ ID NO: 11164 - DNA, 73 bp, Homo sapiens
caaagctacagaggcagagctgtgcaaggctttgggagcttactccttgtaccagtgtgccctaggtataaga

SEQ ID NO: 11165 - DNA, 74 bp, Homo sapiens
cattttgtttgtttgtttgtttgtttgagctctagtaccaccatttagggctacttagatattgaatcattcag

SEQ ID NO: 11166 - DNA, 73 bp, Homo sapiens
aaaattgagtcaaagatgtataccctgggtaaggatcggagtagctagggtagtatctaaatttagaaaatat

SEQ ID NO: 11167 - DNA, 74 bp, Homo sapiens
cagtgactttcaattctgcctttctatcaaatagaatttttatggttttggcataaacctttgaaaagctggaa

SEQ ID NO: 11168 - DNA, 72 bp, Homo sapiens
cttactggaagcaacatgctgctttttctccagaaaaaaaaaagcatgcaatgtagtaataataatgatgac

SEQ ID NO: 11169 - DNA, 73 bp, Homo sapiens
ccttgaactcctgggctcaaacactcctcttgccttgaggtaggcaggactacaggtacaccacgatgcccag

SEQ ID NO: 11170 - DNA, 73 bp, Homo sapiens
agagaaagcagctgctgagatgaaatgtgtgccaactgtctgaagacagaaacataagaaacattccttctgt

SEQ ID NO: 11171 - DNA, 72 bp, Homo sapiens
tctgtatacaagattaaagggataaagcaattggttttattccaccctaaaaatgatagatcaatactactg

SEQ ID NO: 11172 - DNA, 72 bp, Homo sapiens
ttaaacacctctaatctgaatagtaataataataataattattattattactgagttacagatgatttggaa

SEQ ID NO: 11173 - DNA, 72 bp, Homo sapiens
aaagtaactcatgacaattaggaagatggtattcacctcctccttggtatataccatcgctttgtaatggag

SEQ ID NO: 11174 - DNA, 72 bp, Homo sapiens
gccaggcctacttcttgatgagggttttgatagcggtgtcctttaaggaatggaaaggtactgagttactga

SEQ ID NO: 11175 - DNA, 73 bp, Homo sapiens
gttgcttttagaattagaaagatagaggacataaaagataatacagcaatgccttctgaaagtgacaaataat

SEQ ID NO: 11176 - DNA, 74 bp, Homo sapiens
tgtggcttctggtactggctctcttcagcagacacagggtgttgccctcatccatgaagagatggtccaagtta

SEQ ID NO: 11177 - DNA, 73 bp, Homo sapiens
taccatttagacacctgatcttcactccaaacctgccaaattatcatctctgggatgcaggcccagggatctt

SEQ ID NO: 11178 - DNA, 70 bp, Homo sapiens
tccagagaaataattacaggttttatttatggatggttagtacttcccctgagtaatgcctaggagatca

SEQ ID NO: 11179 - DNA, 72 bp, Homo sapiens
ttcttattttgtaaaagggaatgctgtggtttgtaatactaggctattgtctagtttgattcaaagcaccct

SEQ ID NO: 11180 - DNA, 74 bp, Homo sapiens
ttgtacactatttctttgtacaataaaagataaagtgtgcattaggtacgcttgtacatgacaatactgtacaa

SEQ ID NO: 11181 - DNA, 74 bp, Homo sapiens
gactttggcagtggcttagctggtggttcagtcatgatattgcagtccagatgttcgtcagggtcatccaaaag

SEQ ID NO: 11182 - DNA, 71 bp, Homo sapiens
caagatgtcttatttaaggggaacgagttggtgatcatagtgttattaatatagccttgaagtaagagcca

SEQ ID NO: 11183 - DNA, 72 bp, Homo sapiens
agtagacacaggtgggaaactgtttagacgggctcacatcaccccataaacaaataggtttggtcctagcct

SEQ ID NO: 11184 - DNA, 71 bp, Homo sapiens
tgctaaagaaccacctacacattttaaagatgcaagtggccaccctttggccagtatccctaacttatgca

SEQ ID NO: 11185 - DNA, 71 bp, Homo sapiens
aaaccaattgttttttgtatacatgtctgctaagttgattagctgtcatatatacatagtaagaaaggtca

SEQ ID NO: 11186 - DNA, 70 bp, Homo sapiens
gatagtggtccagggtgtgagagcccaataaagaaggtggttggatagttggagctgtgagctctggagt

SEQ ID NO: 11187 - DNA, 73 bp, Homo sapiens
tatatggttgtaaattacctagggattgaggtttgcagggggacttcagctttcagtagcaaacaaccttgtg

SEQ ID NO: 11188 - DNA, 71 bp, Homo sapiens
gattatagactacatataaatttggtttggcatctttttccaaatcaaactgaactggtattctgtgaaac

SEQ ID NO: 11189 - DNA, 70 bp, Homo sapiens
aggtagagaataaggtagacattgccagggaagccctggcacccttataccatttctttttcagcttttt

SEQ ID NO: 11190 - DNA, 70 bp, Homo sapiens
acttcctccgtcctcctcctcccccccccccatgcaggcgacgccgagtgaggctgaggctgggggcgaa

SEQ ID NO: 11191 - DNA, 71 bp, Homo sapiens
gtagaggactcatttccaaagcgaaatggtttttgtgatcttcaggcaggggaaaaaaaggagccacttca

SEQ ID NO: 11192 - DNA, 72 bp, Homo sapiens
tgcatcgatgtacatcagggatatttgcctgaaattttctttttttgttgtgtctctgccagtttttggtat

SEQ ID NO: 11193 - DNA, 71 bp, Homo sapiens
gccaacatggtgaaaccccatctctactaaaaattacaaaaattttccggtcatggaggtgtgtgcctgtt

SEQ ID NO: 11194 - DNA, 74 bp, Homo sapiens
ggatcacccagaagctgctagccagttaaaaattggaacagccttatgacagtgtagctaagacagttgcttgg

SEQ ID NO: 11195 - DNA, 72 bp, Homo sapiens
ctcccagtaggagggatgggtcagagtccaacctatagaggcagtctgaccatggtctgccaatgctggtgt

SEQ ID NO: 11196 - DNA, 72 bp, Homo sapiens
gatggtaatctatgagggaaggtgaataagcaaggtgagtaccgtgaccgtacccattctctgcctgccgtg

SEQ ID NO: 11197 - DNA, 70 bp, Homo sapiens
ctgggtacaagtaacacagatggcccacccctttgtctcactgttaaacaccctgtacctatccactcca

SEQ ID NO: 11198 - DNA, 73 bp, Homo sapiens
ccgtagcgttcaggactaaaattctactgaaatctttgcttctaaatcagtaatatattcggtggtgtcacgt

SEQ ID NO: 11199 - DNA, 73 bp, Homo sapiens
ctctgttcctctcctctgcttgctgcatggctcttccaagtatgtacatctggggagaacgcacaaccccatt

SEQ ID NO: 11200 - DNA, 70 bp, Homo sapiens
tggcagataactcacagatgccccttccttctctggagaattgctatggaccaactaggagctgcctctc

SEQ ID NO: 11201 - DNA, 74 bp, Homo sapiens
ggtaaagaggtagtaggttgcaggtgacccatttttgctgtgtctctaaatgtttgtgctttgtcctgcttgcc

SEQ ID NO: 11202 - DNA, 74 bp, Homo sapiens
tcaaatacctgaggtttcccaggacaggctcataaaagggagagggccctggcagccaggaagggaatcgtctc

SEQ ID NO: 11203 - DNA, 71 bp, Homo sapiens
aatgcagaacctagggatagagttcaggcctagacactaaagttggtgattcgcaggccaatgttctttcc

SEQ ID NO: 11204 - DNA, 71 bp, Homo sapiens
ttcaccagcagcaatgacgtatttttctgcattatgctcgtccttggcagaggatgcttcagctgctccct

SEQ ID NO: 11205 - DNA, 74 bp, Homo sapiens
tcagtgaaaataatttactaggaacaaattaggacacttgtatcctgaattaattttttaagtattatttttac

SEQ ID NO: 11206 - DNA, 74 bp, Homo sapiens
gggaacaaagcgcgttgcggcggcgggaggcaggccggtcttgcccccacaggctaggctgcagcttggccctg

SEQ ID NO: 11207 - DNA, 73 bp, Homo sapiens
aagggctgaagctcttctctccttcttgtcacttgcaacatggcaagcaggggggcatgttgcagccctgttt

SEQ ID NO: 11208 - DNA, 73 bp, Homo sapiens
gatgatcctgggggtcactagaagctctacttgggatcccacttctgacactgactgttaaaaactttaggca

SEQ ID NO: 11209 - DNA, 73 bp, Homo sapiens
aactggagttcttggatcgaacagtagttgcgtttgtcaggttgtctccagctgtattgcttcaaggactggc

SEQ ID NO: 11210 - DNA, 74 bp, Homo sapiens
tggcccaggacacttacagtacaggtcagaatttggaggctccagagctactcagaaatgtgaatgactggact

SEQ ID NO: 11211 - DNA, 74 bp, Homo sapiens
ctgtggctagaggttagctcaggatgccatagaatcacaaaagaaaggtgcagggaggtgtaacataggcacag

SEQ ID NO: 11212 - DNA, 71 bp, Homo sapiens
agtataatcctttaaaatggcaatggtataatgagtagaacagttaaggtaccatttagctgcaaacagga

SEQ ID NO: 11213 - DNA, 70 bp, Homo sapiens
atacaccagttcagataattatttctttttaaaactctgaaaagttttttttaattgaagtggaaaaaga

SEQ ID NO: 11214 - DNA, 72 bp, Homo sapiens
aggacacacagagcacagattcactagaagcatcaaatcttctctggagaagtagctcagtttctgcattac

SEQ ID NO: 11215 - DNA, 71 bp, Homo sapiens
attacagcagttccacttaagaatttttgactttacgatgatgcgaaagcaatatgcattcagtggaaact

SEQ ID NO: 11216 - DNA, 72 bp, Homo sapiens
atttatagcttcagtctctgatgtgaggcttgtgactttgcctccaatggctgacttgaagattttacccat

SEQ ID NO: 11217 - DNA, 73 bp, Homo sapiens
gagaatagcttatcaaggtggcaaacttcaatgttttcttgtcataagaaattgccacagccaccaaaacctt

SEQ ID NO: 11218 - DNA, 71 bp, Homo sapiens
tgccacactggataaggccactacccccgacccttcttgtcagggacatggcttcctaataatggttttgc

SEQ ID NO: 11219 - DNA, 73 bp, Homo sapiens
tctgcttataagaggagctactattaagagcctagtgagtcagattcattataggttttatataagttccctt

SEQ ID NO: 11220 - DNA, 73 bp, Homo sapiens
aataggatatatatatcctattatatattattattatcctatataataatatatattatatattatcctatat

SEQ ID NO: 11221 - DNA, 73 bp, Homo sapiens
agggaccaagctgattgtgaggtttctctcttcaatccttccaccagtagatctcattgcagctgagtgaact

SEQ ID NO: 11222 - DNA, 72 bp, Homo sapiens
cgtggctatatccatgcggaacatgtggctgcattcatgccactttgtgttgcagtagaccgacaccaaccc

SEQ ID NO: 11223 - DNA, 71 bp, Homo sapiens
attcgcgaaggtcggcacactaaaagcaggctaccctgaagctaggtattgaagactttttgtaacctgtg

SEQ ID NO: 11224 - DNA, 74 bp, Homo sapiens
agctggtgatggatagtaaacaaaacaaatggctttggttcagctgatttattctaatcctgcctttccccagc

SEQ ID NO: 11225 - DNA, 70 bp, Homo sapiens
atggaggccaaaaattgggctgccttggtccactaatataagtgccagtatatgcagccctgggatccag

SEQ ID NO: 11226 - DNA, 73 bp, Homo sapiens
tagccatttattgattacaagtaattcaggatagggccaagaaaaaggcacaggtgagatacatgctgtcagt

SEQ ID NO: 11227 - DNA, 72 bp, Homo sapiens
tcactgcttcacaaatgaggaaaagattctggtgtttcagtaacttgaactaaaaactgaagagatgaatgc

SEQ ID NO: 11228 - DNA, 70 bp, Homo sapiens
attcaaggcgttctgctagtctgcagggaagagaatgacaggccacaaattctctgtttaaggaggttat

SEQ ID NO: 11229 - DNA, 73 bp, Homo sapiens
actcacactggtgaatcaaataaaatgtatgatgtaaagcattttaaccacttctgatacaggccagtgtagc

SEQ ID NO: 11230 - DNA, 73 bp, Homo sapiens
ctcgctctctctctcaggtcttggccacacttctgagcagcaaactatgaaggctgagtgtgcatgggctgag

SEQ ID NO: 11231 - DNA, 71 bp, Homo sapiens
gataaaaatctgccccacgggaatctttcgttcaaaccatttggaaaaatacagggacctgtaggtttctg

SEQ ID NO: 11232 - DNA, 72 bp, Homo sapiens
gcccaggaggtcaaggctgcaatgagctatattacgccactgccctctagcctgggcaacagagtgagaccc

SEQ ID NO: 11233 - DNA, 71 bp, Homo sapiens
tggtaaatgagcaatggcttcaacttaaagtcaccagctacattagctgctaacaagggagtcagtctgcc

SEQ ID NO: 11234 - DNA, 74 bp, Homo sapiens
agtggcacccagacttgacctatgggccagtcaagattgctttcaggttcttaatgtctttataggaaatggtg

SEQ ID NO: 11235 - DNA, 70 bp, Homo sapiens
caatgaacttacgtggcatgcctatagatggattcttaaaagccaagtgtgccaagtgtatttttattca

SEQ ID NO: 11236 - DNA, 72 bp, Homo sapiens
acatcctctgggactcatccacttccttactagtcgattgctgtcttctgtggttcatcctagaatatggtc

SEQ ID NO: 11237 - DNA, 73 bp, Homo sapiens
ccttttaaacctagtcttctacatgctcattatgcatatggcatggatttacagttatgattgggaagggctg

SEQ ID NO: 11238 - DNA, 72 bp, Homo sapiens
ataatgtccacatttaacacttggcacccagggactgacactgtctggtagtggcaaatttgggggaattag

SEQ ID NO: 11239 - DNA, 72 bp, Homo sapiens
acttcaggctccccttatttacccccaccgttctctatgttcctgcggagcaaaagaatgccgaagtcagag

SEQ ID NO: 11240 - DNA, 72 bp, Homo sapiens
gcaaagtgcttagcctggggtccatggacgccccacccaatggcaaccatgaccacagaaagccaacagtct

SEQ ID NO: 11241 - DNA, 73 bp, Homo sapiens
agatagtatctgaggcagcaggatgtcatgcttgcgagcaccttcctggaattctgctctactgcccaagtgg

SEQ ID NO: 11242 - DNA, 74 bp, Homo sapiens
ataagacttgctgttaccctgagacaagccaactgtcattgctttagcaaccactacggctacaggttgttgca

SEQ ID NO: 11243 - DNA, 71 bp, Homo sapiens
cctcagaccatgatgcagaactgagtcttgactaacaggaggagctcaggagcgaagactgcccatgagga

SEQ ID NO: 11244 - DNA, 74 bp, Homo sapiens
tggggagagggtctatcactttcatcaggatctcaaaatagttttggacactgttaattcaaggctttccctta

SEQ ID NO: 11245 - DNA, 71 bp, Homo sapiens
atgttactgcccacggctatcgggagcagagatgaagttacctaaatctccgctgagtcagggggggaata

SEQ ID NO: 11246 - DNA, 70 bp, Homo sapiens
catcgatcccagtgctttacacacagtgggcacattcctactagtcgcagctgctattgttgcattaaca

SEQ ID NO: 11247 - DNA, 74 bp, Homo sapiens
tttttgtgtgtgtggaaaagagacatttttcttggcaaacagcatccatgctgagaatctaacacagttcatga

SEQ ID NO: 11248 - DNA, 73 bp, Homo sapiens
gaggagaggtctttctcctgtctaatttgacgccacagtcaaatgacaataccagtttgctggaggaagcctt

SEQ ID NO: 11249 - DNA, 72 bp, Homo sapiens
gccactccctgagaccctccaggtagcccccaacccaacgggcaaaagatgaatgcctgccttggcagaggc

SEQ ID NO: 11250 - DNA, 72 bp, Homo sapiens
aacttgaagcaggacatctgaaatggatttcactcagcatagtgtaaatcatagttcttgatggggtatatt

SEQ ID NO: 11251 - DNA, 70 bp, Homo sapiens
gatttgtaggcctgtggtatccaaggtatctatgatatcttggtatcttggatacctgtggtatcttgtg

SEQ ID NO: 11252 - DNA, 73 bp, Homo sapiens
cactttgacttgcctcactggactcttaagtattttatactattgagtcatacaaacaaatcaaaactatcca

SEQ ID NO: 11253 - DNA, 71 bp, Homo sapiens
aatttctttatatctttcctgttggagagtgtttgcattaatagcaggaggactctgttcaggactctttt

SEQ ID NO: 11254 - DNA, 70 bp, Homo sapiens
acagttcatttgtgatgagagtcctacagtcagctttactgctcggacagacaggtgcacagagagagcc

SEQ ID NO: 11255 - DNA, 70 bp, Homo sapiens
ccactgggcctggcccccaatttcatctttatgtctttccgtgggggtgggggggaatggaatgccaaga

SEQ ID NO: 11256 - DNA, 72 bp, Homo sapiens
atatggcaggagctactgagaacataaaatcttggcgagtcattaaacttatgaaaatcaccgctcttggat

SEQ ID NO: 11257 - DNA, 73 bp, Homo sapiens
tgggtccctctagctcagtttctccaaagaataaacctttgtctcctgctagactgggggagggctaattgtc

SEQ ID NO: 11258 - DNA, 73 bp, Homo sapiens
agggtgcagggagggttggttttccaagaataggagctctgaggcttctcatatggtagcagtctggcttagc

SEQ ID NO: 11259 - DNA, 72 bp, Homo sapiens
tcatctaaatcttcttccctggtggtctagtggtattaaataatcggtaccacatgtattcatcatttgctg

SEQ ID NO: 11260 - DNA, 72 bp, Homo sapiens
gaaacttctgttgctcaggtagcccctgttgatttagacggtatgcaacaggacattgagcaagtttgggag

SEQ ID NO: 11261 - DNA, 70 bp, Homo sapiens
cctctaacggtggatgcaacagaagaatggaatcagtccagttttcccaggccagtctgcctgtttatta

SEQ ID NO: 11262 - DNA, 73 bp, Homo sapiens
gtctccaaagagagaagcaaatggaaaatccctgagaaaacagggtctgagatgaagcactttggccactggg

SEQ ID NO: 11263 - DNA, 72 bp, Homo sapiens
agtacaagacttgaggaatgtagctgaaaggccttagtaggactgaatgtgtctgcatgtgtctctgggatt

SEQ ID NO: 11264 - DNA, 73 bp, Homo sapiens
gattcttcctgtttcagttttcactcttcagaatggattggagaataggactctgggaaataggacactggag

SEQ ID NO: 11265 - DNA, 71 bp, Homo sapiens
acaatgtcagaacggctctagagctatattaaggaatttgttgtcaccatggaggcaatggggagctgctg

SEQ ID NO: 11266 - DNA, 71 bp, Homo sapiens
gcatctctcttatactcagtctgagatctgcagaaagagggggtcttcagaacagttctgagtatttcagc

SEQ ID NO: 11267 - DNA, 73 bp, Homo sapiens
tgaaaccatatcaagccaccacagctggattctctgctaggcaggagtcagcaaactgcagtaggtgcccacc

SEQ ID NO: 11268 - DNA, 70 bp, Homo sapiens
atagggatgctgaggagacatgtatatctgattttatgattctttacagacactcctgggcctgtgtctg

SEQ ID NO: 11269 - DNA, 73 bp, Homo sapiens
acttgccaagcaaccaatgatgttggcaaagacatgtgctcagctcagctcagtgtaaaaggtatcattccat

SEQ ID NO: 11270 - DNA, 70 bp, Homo sapiens
aggtcctgggcttagtgaggctcctgctggagcctcccaagtagctaggatacaagtgtacaccacctca

SEQ ID NO: 11271 - DNA, 74 bp, Homo sapiens
aggccaccatagccctcctttaccttggagggtaacaagccttagggtgaagcagagcctgtagttggtggatc

SEQ ID NO: 11272 - DNA, 71 bp, Homo sapiens
atttgtgcactagaatgtccagcacgaggagtgatggccccgagcctctgtcgctggccagtgattggttc

SEQ ID NO: 11273 - DNA, 71 bp, Homo sapiens
acaaaatccagagcaaaaaatggatgaatccaggggaactacctatagcaccatctgaggcttaggatgtt

SEQ ID NO: 11274 - DNA, 74 bp, Homo sapiens
atcagagtgacaaagggcactattgtacttcagtacaaatgtagtacagtgcagagagaaagagattgcctgtc

SEQ ID NO: 11275 - DNA, 74 bp, Homo sapiens
aaagaagcatttgcaaactgaaatgaagcacaaatcacttcaatagcttagatttgtgctttgaaagtgtcaaa

SEQ ID NO: 11276 - DNA, 74 bp, Homo sapiens
ggaatgacagatgatatcacatgattgaactaactggcatttttgtcaattgtctttgatgtgattattagtca

SEQ ID NO: 11277 - DNA, 73 bp, Homo sapiens
tcaaagggtgacctgttgtcgtattgccatatcaaggaaaacatggcaagcagagaaactgattgtatctttt

SEQ ID NO: 11278 - DNA, 71 bp, Homo sapiens
tcattaaatggcctaagactttgctgctaattttctcctgtaagagattataaaaggcgtatttgaggcca

SEQ ID NO: 11279 - DNA, 72 bp, Homo sapiens
aagtgatgggattacaggtgtgagccaccgtgcgcagcccagtatttcatcattaagtactatccaaaagaa

SEQ ID NO: 11280 - DNA, 72 bp, Homo sapiens
aattatcatcttttttctcaggtttgggatgccctctcttgattatcaagtccgatatgagtttgatgcata

SEQ ID NO: 11281 - DNA, 72 bp, Homo sapiens
acctatagcttgctgagtgttatactgatttttacactaggttgtgtgagataacccagagaacaggcacat

SEQ ID NO: 11282 - DNA, 70 bp, Homo sapiens
aattacttcgcggtgctcttagacttcactgctggagggggtcgggggaatgtatgtggaggtcggggtg

SEQ ID NO: 11283 - DNA, 73 bp, Homo sapiens
cgtcatctaaaaatagaaaatgaagacctcgagaggtagagtgacctgtctatatgcacttggtcaggtgatg

SEQ ID NO: 11284 - DNA, 74 bp, Homo sapiens
ggaagccctcgcaaccgcatggaatcggtttcttaagtatctggtggtaactggggaaacttctgagaaagtaa

SEQ ID NO: 11285 - DNA, 72 bp, Homo sapiens
tcttcacaaggagtctagctgtagtccagtcctggtagggtggtttcatgttgtcaggctccttctagctta

SEQ ID NO: 11286 - DNA, 71 bp, Homo sapiens
ctcaaaggagccagtttccagaaagcccaggaaaggacgatggtttagggaacaaaatttggagtcttgaa

SEQ ID NO: 11287 - DNA, 74 bp, Homo sapiens
caggtttgacattttaaaaaagtgatgatgtgtgacagcagcaagagtacttttgaatgtgactatatgacctg

SEQ ID NO: 11288 - DNA, 72 bp, Homo sapiens
ttttaattttagtcatcctaatagggtttagtagcttttagtcatcctaatagggtctagtggtatctctca

SEQ ID NO: 11289 - DNA, 73 bp, Homo sapiens
agtcaaactactttgagactgccaggctagaaaggatttgtctagttgcccagttcagcagtcacagatgaaa

SEQ ID NO: 11290 - DNA, 73 bp, Homo sapiens
ctcactgcacccctctgtggtgagcgccgaggctcccccgcctccgcatgctcgccgcgctctcccctcagtc

SEQ ID NO: 11291 - DNA, 72 bp, Homo sapiens
tgtgttttcctcatgaaatatttacctatgcctacatcctgaatggcattgcgtagattttgttctagggtt

SEQ ID NO: 11292 - DNA, 72 bp, Homo sapiens
agcagaggatcatgtagggactcgtttcaacttgacttctccctatttccttcctctatccaaactccactg

SEQ ID NO: 11293 - DNA, 74 bp, Homo sapiens
aataagctatagcagcttttaaagattactacctgaggaagatttttaaccaggctattgctgcaactaaggaa

SEQ ID NO: 11294 - DNA, 72 bp, Homo sapiens
ccctccttcctccaactaataatcccagattacctctgggattattagttatgttacctctgggattattat

SEQ ID NO: 11295 - DNA, 74 bp, Homo sapiens
aaagtatgctctgattggagtctgttgccatggaaaagctgtaggcaggctaactacaatcaagggcatgctct

SEQ ID NO: 11296 - DNA, 73 bp, Homo sapiens
tagggtgttaattggagatctgtctagctttttgatgttggtatccagtgcaataaattttcctgtgaacact

SEQ ID NO: 11297 - DNA, 73 bp, Homo sapiens
caacaaaaaaaagttgtattgctctttgaaaaaattcgttggcacagtaagaatgtggagagctggcaggttt

SEQ ID NO: 11298 - DNA, 73 bp, Homo sapiens
tgctttagcttatccagtctgcattctgtgttactcaagtgcaactgagcaccaacttagagcaagggttatg

SEQ ID NO: 11299 - DNA, 72 bp, Homo sapiens
ataaacacagggcaatattaagaatacgaaccttctctcagtaatctggaataggctccttccctccctgca

SEQ ID NO: 11300 - DNA, 72 bp, Homo sapiens
ctttttgacctatgaaaactggattattctcaaggccttattgatgccattgtggtcataggttccagtgcc

SEQ ID NO: 11301 - DNA, 72 bp, Homo sapiens
tgtgaaggttgctgaggtaaacacagttctggctgtcgaggagctcacagtctcacagctcacaggggaaaa

SEQ ID NO: 11302 - DNA, 72 bp, Homo sapiens
ctttgccctctgcctcagggtcagagaacagctgccttcagctattctcccccaaaggtatgcagagccaga

SEQ ID NO: 11303 - DNA, 73 bp, Homo sapiens
cagacaggataatcacatgcccatgtttccttcctgttatagctcaagggaagcatgagactactcaatgtga

SEQ ID NO: 11304 - DNA, 73 bp, Homo sapiens
cccttcaagtgggcgcagctgctacctggtatgacagtacagggccaggcagtgggctgtttaaggcgcatgc

SEQ ID NO: 11305 - DNA, 72 bp, Homo sapiens
tgtagcaaataatgaaaactatgtgtattggcctgctcgagcaagggtggcttaaacaacaggaaatttatt

SEQ ID NO: 11306 - DNA, 74 bp, Homo sapiens
tgtggactttatcttgtagctgtagttctcagcaccagtgagtgcaagaatcaagctgtgagtgtcagacatga

SEQ ID NO: 11307 - DNA, 72 bp, Homo sapiens
gaccacagattcaccagctgattgcagaaagcccttgttttttgagttatccatgccccgtggacttggtaa

SEQ ID NO: 11308 - DNA, 74 bp, Homo sapiens
aagaatgggttgggctattccaggggtggtttctcaatcataaggatccctgccctttgaaggctttggtttgt

SEQ ID NO: 11309 - DNA, 72 bp, Homo sapiens
aaaatacagcattaatattgtatggcagtaaactgtgttattctagtgctggtttactgctgtagtattggt

SEQ ID NO: 11310 - DNA, 73 bp, Homo sapiens
gcaacaacacagcaataaaaagacagagaaaaatcccagttgggaagtttattttgttttctaaaaccatgtt

SEQ ID NO: 11311 - DNA, 71 bp, Homo sapiens
atcaattgttgctgcttggtctatcacctggccatcaaagtctgtgcatggcaccatcaaaacaccagctc

SEQ ID NO: 11312 - DNA, 74 bp, Homo sapiens
tccatatgctcttgaggttttaattttgttggtaggctatttattactgactcaatttggaagcttgttattgg

SEQ ID NO: 11313 - DNA, 70 bp, Homo sapiens
ctcagcattagatgttttctgcctgtgttaaagcagcatcaggtcagaggaacaggaatcccctatgcta

SEQ ID NO: 11314 - DNA, 72 bp, Homo sapiens
ttgtcttagtctgtcttagtctgagctgctataacaaaatgcctgagactgggtagtttataaacactaaaa

SEQ ID NO: 11315 - DNA, 70 bp, Homo sapiens
aaaaaaaaaaacagtagccgggcgtggtggtgcgtgcctgtaaacccagctgctcctgacgctaaggcag

SEQ ID NO: 11316 - DNA, 71 bp, Homo sapiens
cttctattcacaggctttgtactgggctgcacagtttgacctataggccagtagatggtgtttgaagagaa

SEQ ID NO: 11317 - DNA, 72 bp, Homo sapiens
gtatagattcatattccctctggtttccagttatttttggccagtagaaagccctggcagaagatcagaggg

SEQ ID NO: 11318 - DNA, 72 bp, Homo sapiens
catagtgctcacatgggggtagggctgtaattggggcctgtcactgaagcaggcaagcctcctttaatgggg

SEQ ID NO: 11319 - DNA, 73 bp, Homo sapiens
cctgaatgtaaaatgcaaaattatgtaactcctataacataggagaaatcttgtgtatggtgagcatgacttt

SEQ ID NO: 11320 - DNA, 72 bp, Homo sapiens
gtgtctaaccacccacttgactgaatccactttaattagtcattcagtttatggttgaacaccctaggaggt

SEQ ID NO: 11321 - DNA, 72 bp, Homo sapiens
tttggagaacactttgcttggtgcttggaacataacaagtagccaataaaggttaatgtgtcgctttttctt

SEQ ID NO: 11322 - DNA, 71 bp, Homo sapiens
gtatgcccacgttcataggagcactattcacaatagccaaaaggcggaagcaaactgagtgtccattgaat

SEQ ID NO: 11323 - DNA, 73 bp, Homo sapiens
gataaggagttccttcttatgggtgagtaaagaaagtggtttcctgagataaaatctactcctgataaagaag

SEQ ID NO: 11324 - DNA, 73 bp, Homo sapiens
aggatcaatccacctaaacatccgtcctttctccatgatgttgctcaggactgactggtaggagacaggatcc

SEQ ID NO: 11325 - DNA, 72 bp, Homo sapiens
tgagatggttaaatccatgcagtctttggctgttctcttagaagaccgtgtgtgtcagagtcaaattatcta

SEQ ID NO: 11326 - DNA, 72 bp, Homo sapiens
agtgtggccaggacctgtgacttgcttctaaccagtagaatatggcaaaggtagtggatgtcactcctgtgg

SEQ ID NO: 11327 - DNA, 73 bp, Homo sapiens
ggcaataaagtgcatagcagcagttcagtgaactttctccattcttcagcctgcgcaaagcactggctgatgt

SEQ ID NO: 11328 - DNA, 74 bp, Homo sapiens
ggaatttagttggaagctttttcaataaccctgacaagacaatgataggtgatacaagtagatgacagaattct

SEQ ID NO: 11329 - DNA, 70 bp, Homo sapiens
tgtggtcactgttgtaacacgagaggataatagctaggtctttttggtttcaaacaactgatttatgatg

SEQ ID NO: 11330 - DNA, 73 bp, Homo sapiens
aatttctagctgctagttagcttcagctgagagggttgtagacttcctgctcttccccagttggtgctaatgc

SEQ ID NO: 11331 - DNA, 74 bp, Homo sapiens
agtggagctactagtgagctgaacagtggagctcacaaaggccaggaggcatttgagttccaatcagacagagt

SEQ ID NO: 11332 - DNA, 72 bp, Homo sapiens
aggcccggggacacttgtctcaaactcaacggaaggagagtcagtagcaagtaacctgcatttgacctagtg

SEQ ID NO: 11333 - DNA, 73 bp, Homo sapiens
tggaaaataaattgctagggggggttaaaaaaaaaaaagatatccccaaagtccctgtgtacactctcctcta

SEQ ID NO: 11334 - DNA, 73 bp, Homo sapiens
agttaactgctgaacctcagtcctccttcaggacacccattttgggtgaggatgtgcaaactggggcagcaaa

SEQ ID NO: 11335 - DNA, 72 bp, Homo sapiens
ttgcatttatccttgtaaaattttactgatctgggcccagttttctagctgttcaggatgattgtgagtcct

SEQ ID NO: 11336 - DNA, 73 bp, Homo sapiens
gctcctcagagagctgggttcagaacgtatcgatgcttgagagttctcacttttccagctgagaggagtccac

SEQ ID NO: 11337 - DNA, 70 bp, Homo sapiens
gcaaatatttttggcaagtagacgtgactttccagtgagaggccccattcgctggagtttcccccagagg

SEQ ID NO: 11338 - DNA, 73 bp, Homo sapiens
cacttccaggtaaacctgaatgcgggccctgggatagagcagggaagcagcatcatcactaatctggatagaa

SEQ ID NO: 11339 - DNA, 72 bp, Homo sapiens
gggcatagtaatccttcaagtctcaaagggcaccttgtctatgctctgtttgtgctccatagacttggaggg

SEQ ID NO: 11340 - DNA, 70 bp, Homo sapiens
ggcctaaggcttgtgactacatcagctgctccatatctggggcataacaggaaggcattgtggagtttca

SEQ ID NO: 11341 - DNA, 71 bp, Homo sapiens
gagagtctgtttaaaagctcctcgagtgagtctactgtgcagtcaggatccaaagtagctgatgagaagac

SEQ ID NO: 11342 - DNA, 70 bp, Homo sapiens
tttagttgtggttctgtcatgtcaaaactgccttataataggcagtgagaactgaattcccaggggaagg

SEQ ID NO: 11343 - DNA, 74 bp, Homo sapiens
gtagatgatatgtgggagatcactaagggccaagtgttcaatgatgatttctatttgtttgcctgatttccttt

SEQ ID NO: 11344 - DNA, 70 bp, Homo sapiens
tctttgggacatctaggcttatctattttgtttggctgcaaaaaagtcaggtaagaggaaacacttggaa

SEQ ID NO: 11345 - DNA, 72 bp, Homo sapiens
tctcacttaagtagattacagtaataagaaagtcagtctctggtttcaatattttgtgactggatatctata

SEQ ID NO: 11346 - DNA, 74 bp, Homo sapiens
gcagcggcggcggcggcggcggccgtggggggctcccgcgagctccaggcgcggcgctgcgcgtggggctggtg

SEQ ID NO: 11347 - DNA, 73 bp, Homo sapiens
atctttagcaccattgtcctgatggcctccacttctagctatacattgcctctttgaaatgagccatttggga

SEQ ID NO: 11348 - DNA, 72 bp, Homo sapiens
caaccacaacttgtgtacagaaatgattgttgccatagatcattgtcagtagtcttacacgattggcacagg

SEQ ID NO: 11349 - DNA, 72 bp, Homo sapiens
acattgtggggagggtgtcgtgggtcaaatatgggactatttacccttccctttctgtttatttctccttga

SEQ ID NO: 11350 - DNA, 72 bp, Homo sapiens
acactcagtattaaccatctcagtctccaagaggtagtcctccccagtttatggggtttaactagttgttgg

SEQ ID NO: 11351 - DNA, 70 bp, Homo sapiens
agccaagttctcctgcttcacttggaactagctgctctctagtactcagatgaagcactgaagtctgtcc

SEQ ID NO: 11352 - DNA, 71 bp, Homo sapiens
tggttgtccagttttcccagccaccattcattgaagatggtggtctgtccccaatgtatgttcttggtgcc

SEQ ID NO: 11353 - DNA, 71 bp, Homo sapiens
tatgatagtaatagtctgacttagaaaaggctacttcttaaggcaatgagtgtggacagtttgtcggatta

SEQ ID NO: 11354 - DNA, 71 bp, Homo sapiens
gcagagaactgaacattctccttcctcaccttggttggaatggagacacatggtgcatggttgtcactctg

SEQ ID NO: 11355 - DNA, 74 bp, Homo sapiens
tcttatctttgtgggcttatctacctctgatctttgaggttgctgacctttggatggggtatttgtggtttttt

SEQ ID NO: 11356 - DNA, 70 bp, Homo sapiens
gctaggcaaagggatagtggcattaccctggggttaccactaccagtgccaataacctgacaaacaagtg

SEQ ID NO: 11357 - DNA, 73 bp, Homo sapiens
atcaggagtggtgaatgcagtagtattattgtccttaagaatagtctgaagcaggagtcaaaaaactttgtcc

SEQ ID NO: 11358 - DNA, 71 bp, Homo sapiens
ctggggcaccgagcaggagggaaagaactttgtgctgagttgaggggttcaggtccctgtttgatcccagc

SEQ ID NO: 11359 - DNA, 72 bp, Homo sapiens
gcacttcccccatagtatggtaactaaaaatgttctcagacattgtcaaatacccactggggtcagaatcac

SEQ ID NO: 11360 - DNA, 73 bp, Homo sapiens
ctgatccccaccctcacagggctgtccaaacttaagcccagatgggtccacaaaagggtcccaacggaaagaa

SEQ ID NO: 11361 - DNA, 72 bp, Homo sapiens
tgacctcccaaaatgctgggattacaggtgtgagccaccacacccagcagcattaggtctttaaatccaggt

SEQ ID NO: 11362 - DNA, 70 bp, Homo sapiens
gagttgaaagcatgctcgcgagacacttggtacttgtccagttttcccagagctgctcaccagacatcca

SEQ ID NO: 11363 - DNA, 73 bp, Homo sapiens
agcaattgtgcaattgtaggatggcctctactgattgaatgacagtagcaccatcctcccagttgtgacatcc

SEQ ID NO: 11364 - DNA, 70 bp, Homo sapiens
agggcacaatttacacttggccctgctccctacatggagcctaaacattaaagtagttgtgtctataatc

SEQ ID NO: 11365 - DNA, 73 bp, Homo sapiens
acactgtcagcccactggtatggaatcggttgcatattaacaactgtctagacaggttagagaagggaatctg

SEQ ID NO: 11366 - DNA, 70 bp, Homo sapiens
attcggtgcttaagagatgagaaacttcgttctaccagtaatggaagaaacgcttcaccttaatcaccct

SEQ ID NO: 11367 - DNA, 71 bp, Homo sapiens
agaaagtactggaactagagaatttaagtagcaggaagtaatagtctctttagggaagtaccagtgtttca

SEQ ID NO: 11368 - DNA, 71 bp, Homo sapiens
tcattagacggacctctctctttcgtgctgcttcttcagcaggctgtgtaggaagtgctggggaggatgcc

SEQ ID NO: 11369 - DNA, 72 bp, Homo sapiens
cagctaagcgtccttacagagttcagtgcttctttgaaagaactgctcaaggaatcactcttaggcgtggct

SEQ ID NO: 11370 - DNA, 72 bp, Homo sapiens
ttgtccagaacagtagattgtgccaccagctgcacctgaggccacagggcttcccatttgtgtcttgctggc

SEQ ID NO: 11371 - DNA, 71 bp, Homo sapiens
cagttactgacctttggttagaaagagcaggtgcgctcagctcttccatcaccccatgggtgtttgctgca

SEQ ID NO: 11372 - DNA, 72 bp, Homo sapiens
cactttactctgttggcttgctcttgaattccttaatgtgcgaaggcaaatatcacagggcctttggtgttc

SEQ ID NO: 11373 - DNA, 71 bp, Homo sapiens
cggggctgcgagtcaagtccaggactcgggccagtctctccggaagacaagaccaacctcgcgccgcggcg

SEQ ID NO: 11374 - DNA, 72 bp, Homo sapiens
cactccttgagagcatatgatggtcagcgtgacaagagtcaaagtcaaatgccaaccattgcttacttccaa

SEQ ID NO: 11375 - DNA, 74 bp, Homo sapiens
cctctgagctgcgactctgagcacactgcctgtggggtagccctgccacaaggagcagtacctctgctgctgct

SEQ ID NO: 11376 - DNA, 72 bp, Homo sapiens
agctattggtgttctgttttcaaaagggtccttgaagacgtttattatgatgaccatagttggtgagctgta

SEQ ID NO: 11377 - DNA, 72 bp, Homo sapiens
aactcaggagtcattacaatacagcctaggccaaatgaggttcatcgtttgtgttggctaaagatggttttt

SEQ ID NO: 11378 - DNA, 71 bp, Homo sapiens
ccagtcctacataaattccttcagaaaatcaaggaggagagaagacttctcgttttatgagggtagcatta

SEQ ID NO: 11379 - DNA, 72 bp, Homo sapiens
aaacaaatgttgtagataggtttgacttcaattatttcaataacaatgagtttatatctatctaaaataggt

SEQ ID NO: 11380 - DNA, 74 bp, Homo sapiens
gagatagaaacttttgtagggaagatgctgtgaacatcacattgttgaaataacaacaaaagattttaattttt

SEQ ID NO: 11381 - DNA, 73 bp, Homo sapiens
ctctcgaagtctttaaaacacagattggtgagccttctctccaaagtttctgattcagcaggtgtgaggtgga

SEQ ID NO: 11382 - DNA, 72 bp, Homo sapiens
taatacaaattgccagaccataccccagagattccaattcactgatataggaagagatctaggcatctgtat

SEQ ID NO: 11383 - DNA, 74 bp, Homo sapiens
ttttgtggggagatttgcatctgtaaaggaaatctatattagtgaaataaacagcagatgcaaacaggctttct

SEQ ID NO: 11384 - DNA, 72 bp, Homo sapiens
tgtctgccctgagtggagctgaaccagtttgagtgagccaagttatctgtcagtggctccgtccaagcatct

SEQ ID NO: 11385 - DNA, 72 bp, Homo sapiens
agacctgctgactctcagcttatcagactgactggtctgtaaggcatgaataagatcgtgcaagaatagagc

SEQ ID NO: 11386 - DNA, 70 bp, Homo sapiens
atctaactgtggtaatgagctgttaaggattccactaatggcagtttagtagctgtagctaaggttttcc

SEQ ID NO: 11387 - DNA, 70 bp, Homo sapiens
ttctgatgctcagaatgttaggaccagaaagatctttagagatcattaagtccagattatgcatatagat

SEQ ID NO: 11388 - DNA, 70 bp, Homo sapiens
aaacgagtcccattttcctgactcatgccattctttggatggcggtcctattaaaatgataaagaatgta

SEQ ID NO: 11389 - DNA, 73 bp, Homo sapiens
ataacttccttctttctctacattctttatcattttaataggaccgccatccaaagaatggcatgagtcagga

SEQ ID NO: 11390 - DNA, 73 bp, Homo sapiens
ggccttaagcacagatagatccagggctgaaaccatgtctcatgtcagcaggacactcttactatcttaaaat

SEQ ID NO: 11391 - DNA, 72 bp, Homo sapiens
attcacccttgtcaggggaacttcaggaagaaatatctcaaccaaaggtgcaagggagagagagactgttga

SEQ ID NO: 11392 - DNA, 74 bp, Homo sapiens
catattgggtggttgactcagggactgagtcagactaaattagctctcagtctgaagaggagtaaaactgacaa

SEQ ID NO: 11393 - DNA, 73 bp, Homo sapiens
cccagggagtcaggaatagaggataacttttctgcttggtgctcttctgaatcctgtctcccgttggttagaa

SEQ ID NO: 11394 - DNA, 73 bp, Homo sapiens
tattaagaactgtggaaactgaatcccaaacttcttttctgatatgctattcagatttgaaggctggaagtca

SEQ ID NO: 11395 - DNA, 74 bp, Homo sapiens
atttgttaaagctcagggaccagcaatgtgggttttcgcgttacactgcctacactatcacttgttgactgtgc

SEQ ID NO: 11396 - DNA, 73 bp, Homo sapiens
ttaggaggattattttgagagtacagaccagcacccacgtagctgatctgctgattatgctcccaggttcaag

SEQ ID NO: 11397 - DNA, 72 bp, Homo sapiens
ttcctgacaaaatgaagctgacaaaagttgccggctaatgttgtttgaagctacaatttttgttaatctata

SEQ ID NO: 11398 - DNA, 70 bp, Homo sapiens
tgatgttttaaattatttttagccccagtcccatcctattagtataaatggttgagactgtggtgtttcc

SEQ ID NO: 11399 - DNA, 72 bp, Homo sapiens
gaggatgatggacagaccttatctccaagcagtctggctgcacagtaagtctttgtttatttctaaataggt

SEQ ID NO: 11400 - DNA, 70 bp, Homo sapiens
agggaggtcccccgatccgagtcacggcaccagatttcgtgcacgtctgtgtgaagagaccaccaaacag

SEQ ID NO: 11401 - DNA, 72 bp, Homo sapiens
ggcagatggaagggagctctggggtcttccttgctcaccagtgccttccagttttcccattccgatccatat

SEQ ID NO: 11402 - DNA, 70 bp, Homo sapiens
agtatggaagaagcaggactgattttccctcagggcctcccaagggaacatggtcctgctgttatgtgct

SEQ ID NO: 11403 - DNA, 74 bp, Homo sapiens
gccagaggactcagtaccaatcctatattcacatctagcttatcagcatgctgggtgtgctttgtactacgttt

SEQ ID NO: 11404 - DNA, 70 bp, Homo sapiens
ataagcctgtgacttgccacgtggtggtttagtccctctcaccaactcacagttcacagctacctgactt

SEQ ID NO: 11405 - DNA, 71 bp, Homo sapiens
gaccagctgtgtgaaatgggaggcaaagctcataaatgacctatgaattttactcactgccataaacacat

SEQ ID NO: 11406 - DNA, 73 bp, Homo sapiens
aaaggtgagggtgagagatgtctaatatctgttacgcttccatcaagtgtacactgtacgtctcttctgagct

SEQ ID NO: 11407 - DNA, 74 bp, Homo sapiens
tttaaaaagtgtacaatgtgtttgcaaatgcaagcttgtgcggtgatttaagaatggtaaagattggcttattg

SEQ ID NO: 11408 - DNA, 70 bp, Homo sapiens
cttgggtccagtttctttggcttagaggggaggaaagggaggtcctccctggtgaagaggcctactcagg

SEQ ID NO: 11409 - DNA, 73 bp, Homo sapiens
atgcaccgcagcaggtctccaatatacctatacaggctgtcctccttccgagccctcctggtagcatggctgc

SEQ ID NO: 11410 - DNA, 73 bp, Homo sapiens
tcaggactggagtggaatggaattagattgggaggaagctgccagttgaaaagtcactttttctaaaaagcct

SEQ ID NO: 11411 - DNA, 74 bp, Homo sapiens
ccatgcagcggaggtcaggaatagtctcgagcaggtcagctgtttgctgagctggaagagggttgttgaaaggc

SEQ ID NO: 11412 - DNA, 74 bp, Homo sapiens
ctctactgaatcacgaaccactctgagcctcagtttctcctcgtggaaaaaaggaaaacaactggcacccaggg

SEQ ID NO: 11413 - DNA, 74 bp, Homo sapiens
ggagctgcagactggagctattcctattcagccatcttggaacctccccccgagtgttacagctcttaaaggtg

SEQ ID NO: 11414 - DNA, 73 bp, Homo sapiens
ttatatgagtatgtactaaatattccagttaaagtatacacaggatttaatggaagaagaaaatgtatgtgct

SEQ ID NO: 11415 - DNA, 71 bp, Homo sapiens
agaaccggggtgctgtgtagagggcctagggctatttgcatcagggtgccactaccagaacccaaggatca

SEQ ID NO: 11416 - DNA, 72 bp, Homo sapiens
gaaagggcgaaccgaggacgacccaggtcctatctagggaacatatgccctttgatccggcttagtataatg

SEQ ID NO: 11417 - DNA, 72 bp, Homo sapiens
atttgatcatgggggtggatccttcacaaatggcttagcaccatttcttggtgatgttctctcccagttagt

SEQ ID NO: 11418 - DNA, 71 bp, Homo sapiens
cccccaccgccgggtcccccggggctgcagtagcagcggcgccgcccgcggctcccgctggggcctgggcg

SEQ ID NO: 11419 - DNA, 73 bp, Homo sapiens
cgcggtctgcgcggccgctggtcccggcgcccttacctgggcacgcagaacggcggcagggcgatgacgcgtg

SEQ ID NO: 11420 - DNA, 70 bp, Homo sapiens
ccattcttaattctttgttctctgcacagatttggaccagcagagcctgccaagtgaaccagaggagacc

SEQ ID NO: 11421 - DNA, 73 bp, Homo sapiens
ctggagccccgggtcgggcctggagcctcggcctctgacttctggccgcccgctccagaccccacgctcccac

SEQ ID NO: 11422 - DNA, 72 bp, Homo sapiens
agttcttgatgcatctgatcatagtctcgtgctccagtagagcctttggttgcacggtctggcttgtgccac

SEQ ID NO: 11423 - DNA, 70 bp, Homo sapiens
cctaccgcagaagagaccctagaacatccttggttcaaagtgagtctagtctgcaaagtggtggcacaaa

SEQ ID NO: 11424 - DNA, 70 bp, Homo sapiens
gccgggggcactgagggacttgggtgctcgggtgggatttgaacccgcgacctcagatccccagccaggc

SEQ ID NO: 11425 - DNA, 73 bp, Homo sapiens
atggaggcaagaagaaggcagaccagctagggaccttgggacccaaggaataatacattactgagttccttgt

SEQ ID NO: 11426 - DNA, 73 bp, Homo sapiens
tggaggcatgtgaggtgaggtgacttcccatggctgtcgcacagccagtggtgagagctgagccagatgcact

SEQ ID NO: 11427 - DNA, 73 bp, Homo sapiens
tgtgaaagggcttaaacagaacactaataacagctaaagatctagctgcaggtggctgtctaattccaatcaa

SEQ ID NO: 11428 - DNA, 74 bp, Homo sapiens
agctctgagcttgctcctggctttggggggtttctgtggatccccctcatggccttggacctagacttagagaa

SEQ ID NO: 11429 - DNA, 72 bp, Homo sapiens
ccaaaggtggggctgtgaattttttaggcacagtcaatttaattctgtactggaacttaataccccaacaaa

SEQ ID NO: 11430 - DNA, 71 bp, Homo sapiens
tatatttctcagtggctaaaccttcacaaatggctcataaatattttgtgaatgaaggtttggggatgata

SEQ ID NO: 11431 - DNA, 73 bp, Homo sapiens
gtagtgtcacatggtagcagcatacaacaggaactataaaaatgtatgcatataaatatacatgggtacatac

SEQ ID NO: 11432 - DNA, 70 bp, Homo sapiens
acaagaagctcaactttactaaagacaccagggtacttcgtcacttatagttctgagctgagctctggca

SEQ ID NO: 11433 - DNA, 73 bp, Homo sapiens
gagtcaggagtgctgatggttgtgtcggagatgaaatcatagggaggtgaagctatcttacactgagttagtt

SEQ ID NO: 11434 - DNA, 74 bp, Homo sapiens
gtgtctttcaacaagaattctttctcagaaggaaggactaaaatcctgggcgttttcagagaatcacgattgtt

SEQ ID NO: 11435 - DNA, 71 bp, Homo sapiens
tggtagagggcccctgtaaaatttaccactgagcaaattggggtgtgcacagttaaatgggggcagagggt

SEQ ID NO: 11436 - DNA, 70 bp, Homo sapiens
ggtggtccccggcatctccacagttgaacttcggccttgactgctgttatgagtggccacttaggtaaaa

SEQ ID NO: 11437 - DNA, 72 bp, Homo sapiens
ggaggtgggagagctgcattacaatgtggaaactgcaggaatagtctgactgcagagtggccatacttggca

SEQ ID NO: 11438 - DNA, 70 bp, Homo sapiens
atagagatacaggtagtagctcagtcaagaagaccaggcagaggcctgacctatgaatttaatcacacat

SEQ ID NO: 11439 - DNA, 73 bp, Homo sapiens
gaggtggttagtggaagatctgagtaaaaagcatggtttcattggaccctcagatatcgccacctagtgggtt

SEQ ID NO: 11440 - DNA, 73 bp, Homo sapiens
tggcaaaatctgggcttctgaccacagtttatgccactgtgccagattgtttcctatggccattattttatca

SEQ ID NO: 11441 - DNA, 74 bp, Homo sapiens
atggtcatgtggacaaagtctttgcatagtggcctgaccattttgtgtaacaattcatacttccagactggcca

SEQ ID NO: 11442 - DNA, 73 bp, Homo sapiens
ccttttggctcagggactacaagtcagtgccaagaaaaatctcatgccccttcttgtttttgcagagcacaca

SEQ ID NO: 11443 - DNA, 71 bp, Homo sapiens
ccctgtggtgtcaagagagatgcagggggcttctgcatcccctgacccataaagatctttctgtatcatac

SEQ ID NO: 11444 - DNA, 74 bp, Homo sapiens
tgagtaagcattgcccagggctgagatgcacatggccaatgaaaccaggtgtaaaatgccctgagaactttgtt

SEQ ID NO: 11445 - DNA, 73 bp, Homo sapiens
gacagagtggggcaggagggagtgggagctgcaatttggatccactggtgcttttcctacttgttttgtcagt

SEQ ID NO: 11446 - DNA, 71 bp, Homo sapiens
gattgtgtttggctctggagtaaacactctgagtgaccatcataatgtaaacatcctcgaatgcttcttaa

SEQ ID NO: 11447 - DNA, 71 bp, Homo sapiens
tctgatagggtttggctgtgtccttactcaaatctcctcttgaattcccatgtgttgagggagggacccgg

SEQ ID NO: 11448 - DNA, 70 bp, Homo sapiens
gtttatgcgtatgctgaagagagctttgtgcagtactgataacgccaaggttacagtgagctagtttgca

SEQ ID NO: 11449 - DNA, 73 bp, Homo sapiens
tcaaatgaaaacaatttcaaagatttgtgtgtggagaacttgagaatcgctacctagtcctttgaaatgtggt

SEQ ID NO: 11450 - DNA, 72 bp, Homo sapiens
ctgaaatgcaaggagaaaagaggtgagagcagctagccatgctcttccctgctagggatccttgtgagttcc

SEQ ID NO: 11451 - DNA, 72 bp, Homo sapiens
agggtcttcctcagggctcaggacatagggtggcagtcaccctggaagcaccatccagggctggcagaagaa

SEQ ID NO: 11452 - DNA, 72 bp, Homo sapiens
tgctcttgtggtggtacaatgcaggagaaatgccaaggcaagatgctggcaccttgatattgtacttcccag

SEQ ID NO: 11453 - DNA, 70 bp, Homo sapiens
taaaacactagcatgaccgaggttagtgctcttagatggtcccactcttttggtttccatgttgttttgg

SEQ ID NO: 11454 - DNA, 74 bp, Homo sapiens
acatggtgaaatcctgtctctactaaaaacacaaaaattgtaggacgaggtggccgagtggttaagatgataga

SEQ ID NO: 11455 - DNA, 72 bp, Homo sapiens
agaaggtgggagccgtatgagttcagctgtggatcatccaggcagaagaacaggatgtcacgatgctcaaga

SEQ ID NO: 11456 - DNA, 72 bp, Homo sapiens
gtggtctcgaactttcccccagggagcagtggtgcactgcaaactcaagcaccccaaggactcaaggaacct

SEQ ID NO: 11457 - DNA, 74 bp, Homo sapiens
tctacatgctgcacttcaatcttccctccaaggggatcctttttcttctagggctgatgcgcaaagtctcagga

SEQ ID NO: 11458 - DNA, 72 bp, Homo sapiens
acgtaggcacaatgaccagctactgctactaaaattccagactccctaaaggaaagcagttgttcagtgccc

SEQ ID NO: 11459 - DNA, 74 bp, Homo sapiens
gatggaggggagagggtatgtgatgaagcaccgatactaacaatgtttgacgcacatggccctgcctccctaca

SEQ ID NO: 11460 - DNA, 74 bp, Homo sapiens
aaggcttataccatctgaagctatggcccaagctgtacattggccccttttagccatagctagagctggaatgg

SEQ ID NO: 11461 - DNA, 74 bp, Homo sapiens
tctcaggctgacttcgattgggaaggaggccagcagcagctctgggctcacatcaccccagtccacaaccctgc

SEQ ID NO: 11462 - DNA, 73 bp, Homo sapiens
aactctggcttatcaagtactattttcacagctagtgcaaagtaacaacttgagacggtggagttttgacacc

SEQ ID NO: 11463 - DNA, 73 bp, Homo sapiens
cctttcaatgcagaagtacatagcctcttgtcaggcacaggttaagtgagagcttcagtttatggggtcgtca

SEQ ID NO: 11464 - DNA, 71 bp, Homo sapiens
ccccagaggagccctgtcacacccctgatcatactgtccatgctgtctctcggggccactattccataaga

SEQ ID NO: 11465 - DNA, 72 bp, Homo sapiens
gcagagctgagagaggtggggacgaggaagctgctggagggcaacattgtcaaccttgatctgagtggtggt

SEQ ID NO: 11466 - DNA, 73 bp, Homo sapiens
gcctggccattccctgctcccagcacctgctgcaatcttggagcagggttggggctgagcccaggtgcagttg

SEQ ID NO: 11467 - DNA, 74 bp, Homo sapiens
tccagccctgggtcccaatgtcaggacctaccttagtccagtccatgctctcccatgggcctgagagaagattt

SEQ ID NO: 11468 - DNA, 71 bp, Homo sapiens
gacaggttaagatttatgggtgggagggacatttaacactgcctatccatttgtttgttttgaattttgtt

SEQ ID NO: 11469 - DNA, 70 bp, Homo sapiens
tgatacagtgtatacatatattttgtatctgcaagaggagatgatatatatacagtatgcctgaactccc

SEQ ID NO: 11470 - DNA, 71 bp, Homo sapiens
aatggtagttctgtttgaagttcttgagaaacctccaaactgcttttcacagtggctaatttacattccca

SEQ ID NO: 11471 - DNA, 74 bp, Homo sapiens
ggtcccggaaacccactacgcctccactaatgcctccctgcctagaagggacgagagtgccccgtcactcactg

SEQ ID NO: 11472 - DNA, 70 bp, Homo sapiens
tggcatttggctgagaatggcaatggtaatggcgtcccaaatccaggccccagcccttcagccccactct

SEQ ID NO: 11473 - DNA, 71 bp, Homo sapiens
tcagaacttgactatctagaggaattttcttgagatttcatcaattatttctcaggtaatcagtcatcata

SEQ ID NO: 11474 - DNA, 72 bp, Homo sapiens
tttgcgtctgtaggaagccagcgctttgcagcccaggtgttgtaaagtattcttagcaggctgtgggggaac

SEQ ID NO: 11475 - DNA, 73 bp, Homo sapiens
gggagggggcgaggaacacgtggggaaggagaaggatccacctaaagatggtgggaagcaggcgcacctgtgc

SEQ ID NO: 11476 - DNA, 73 bp, Homo sapiens
gagtgtgtgctgggtgacccgcaacctggaagcacaggaggaggtgtaggttgcatgaggggtcacttgggac

SEQ ID NO: 11477 - DNA, 74 bp, Homo sapiens
cggcgctcgcggggcccgggtcgcgcccagcccgggcgcccccgccccgccgccgcccggcctcgcccccgccg

SEQ ID NO: 11478 - DNA, 73 bp, Homo sapiens
gtcctcccaccaggtcgccatccacacgctctggaacatccgcatcgtggtgctggccaagcctgagcacgag

SEQ ID NO: 11479 - DNA, 71 bp, Homo sapiens
tatccccagctgcctctcctccatcgcacttcagaagtgctgcgatgggcagaagggcagctgacactccg

SEQ ID NO: 11480 - DNA, 70 bp, Homo sapiens
agaacagcccttgacccagaagctgggagacccttgctggagtcttcgtccgctgagtcaggatgggctt

SEQ ID NO: 11481 - DNA, 71 bp, Homo sapiens
cctcacccttgccttttcacagtggctactgccaactgttcaaattgttaacagagaaatcagcaggtgta

SEQ ID NO: 11482 - DNA, 71 bp, Homo sapiens
tccccagcagcattgatgtcgttcttcactttggccagagtcttcagaagcttgctggctcccagggctgc

SEQ ID NO: 11483 - DNA, 71 bp, Homo sapiens
tgacgtttcatatcaaatgatgtccatagtgagcctgtggcttttcattcctgtgagcctcactagatccc

SEQ ID NO: 11484 - DNA, 71 bp, Homo sapiens
ggccccagggaggaaagcatgctgagagccattgatttttttcccactggaggctgctgcctccttggacc

SEQ ID NO: 11485 - DNA, 73 bp, Homo sapiens
ccagtgaccacgccccagtcctagagctgacatgccacactttgtccatgtaggactgccacgccccttattg

SEQ ID NO: 11486 - DNA, 72 bp, Homo sapiens
gaaattgctgctacaaagcaggctaggtcaacccgaagattggcttgcataccactgagctcttcctgaaag

SEQ ID NO: 11487 - DNA, 74 bp, Homo sapiens
ccacttttaaggactcatgtgattacattggtctacctggataatccaggaaagatctccccatctccaagtcc

SEQ ID NO: 11488 - DNA, 72 bp, Homo sapiens
ctcacagagggactgtagctgatcagacactctggtaccaaagcagaaacactggcatctcagggctgtatc

SEQ ID NO: 11489 - DNA, 71 bp, Homo sapiens
ctctttggggcctcagcggtccccttaggctgagcatctgaaccttcccgtggtccgtgtggctggaagga

SEQ ID NO: 11490 - DNA, 73 bp, Homo sapiens
gagcaccgtaaggcaggctggaccacgctaattaaaatgagatgctcaagatcagagttcctaattacctgcc

SEQ ID NO: 11491 - DNA, 72 bp, Homo sapiens
agtcacctcccaccaggccccacctccaacactgggggttaccgttcgacatgaggtttgggatggggacaa

SEQ ID NO: 11492 - DNA, 73 bp, Homo sapiens
cgccagcttctgtcctttgaaggttttcctaagatattttcctagtttaataggaagtgtggacatgggacat

SEQ ID NO: 11493 - DNA, 73 bp, Homo sapiens
accaaggtcagtgttcccaggaataagacaggtggctgtcaggtgcctctggtacagagcaccaggaagggtg

SEQ ID NO: 11494 - DNA, 73 bp, Homo sapiens
tatttctgacctatgaatacagtctgcttgtacctgttacagccatatgactgttgttagtacacctggggtt

SEQ ID NO: 11495 - DNA, 72 bp, Homo sapiens
agagagccatggggatcacactgaggctgagatttagccagaaatcatacccttggttgcccttttctcttt

SEQ ID NO: 11496 - DNA, 70 bp, Homo sapiens
gcctctttgggtgacgaaaatttgatttagggaccattggtcctctgagtcaaaaacagtatttctgaga

SEQ ID NO: 11497 - DNA, 72 bp, Homo sapiens
gtcgtgggccgaaagccagggatgtgtctgcccaacagaacttcagtttatggttggcttcctctgtgcaca

SEQ ID NO: 11498 - DNA, 74 bp, Homo sapiens
tctgcttcaggttacttgctggcccatccacacggtcagatgaccttcctgcgaccagcagcaccaggaactga

SEQ ID NO: 11499 - DNA, 70 bp, Homo sapiens
cagggcctctcctggaatgtcttgccctgtgtgtcaggtgccctgctccctatgatgagagccctacccc

SEQ ID NO: 11500 - DNA, 73 bp, Homo sapiens
cctggagcagctaaggcactggctacagggtctattacttaaggctgggagcctcctgggcgggtctgggttc

SEQ ID NO: 11501 - DNA, 72 bp, Homo sapiens
gcccgaccctgctaacggtatttctagaagatgggcagaggacaagccaaaccccgggagggaccacgcggc

SEQ ID NO: 11502 - DNA, 73 bp, Homo sapiens
tgggagattatcttgtattatatggtgggcccaatgtcgtcacaagggtccttataagagtgaggcaggcggg

SEQ ID NO: 11503 - DNA, 70 bp, Homo sapiens
agagcttcagggacctatgagacgataacaaatgatataacattcgtttcattgaaatccctgaaacaga

SEQ ID NO: 11504 - DNA, 73 bp, Homo sapiens
gctttgcattaagcctgtgcaccgacatgcagggagcccgcccctctgcacattgacccagctgcgagggaga

SEQ ID NO: 11505 - DNA, 72 bp, Homo sapiens
accactgatctgccgcgcgtgcgagcaggcgtccacccgtccgtccgtccgtccgtccactcattcattcac

SEQ ID NO: 11506 - DNA, 71 bp, Homo sapiens
tccgatgggcttctggccagggcctcgtactgcatcagagcgtggccattataacagccccatgcttgtgg

SEQ ID NO: 11507 - DNA, 71 bp, Homo sapiens
cattaatttcagccaaatgccaggatttgattcctaaacatgcccagggcaccagaatctggccggaagag

SEQ ID NO: 11508 - DNA, 71 bp, Homo sapiens
gccaaggacacagcgtccacacaaaacgcctgtggttctcattgaaaaaggtcttggctttaaaatccaca

SEQ ID NO: 11509 - DNA, 72 bp, Homo sapiens
agcctttgctctgctcacattcatcccttttctggctcccagatgtgatggggcagctccattgcccaaaac

SEQ ID NO: 11510 - DNA, 73 bp, Homo sapiens
actgtggctccggggttcagtctctgagacgtggcccatctgggtcactctgggtggtcctacccattacatg

SEQ ID NO: 11511 - DNA, 72 bp, Homo sapiens
cctgccgtgcccacccccgcgcccccgccccggcgggcgaagccgcctcgcggcgcgggtggaaaggtccag

SEQ ID NO: 11512 - DNA, 73 bp, Homo sapiens
gggcggcggcggggacggtgctccgcggcggcggccccacaacctcccctcctcattcacaaaaaattgaccc

SEQ ID NO: 11513 - DNA, 73 bp, Homo sapiens
ctgtgagctgtgacccaatataggcctgcaccccagatgagtgctcaggtgctgcttgtgtccccaacaaaca

SEQ ID NO: 11514 - DNA, 74 bp, Homo sapiens
ggaaaatggctcagtgactgtcctgtgtgcctgccttctgcacgccccgctgggcttcctgcagccacagccaa

SEQ ID NO: 11515 - DNA, 72 bp, Homo sapiens
agcttccgatggggcttctgacggcctgggacaaaaccccgaaccttagccttgcccgcctctagggcctcc

SEQ ID NO: 11516 - DNA, 72 bp, Homo sapiens
aaccctgtgcccctgggcctctgggccagcctctgacctcagccccacagcctcagtccctcctgcattggc

SEQ ID NO: 11517 - DNA, 70 bp, Homo sapiens
gttgcagtgagtcaagatcgcaccgttgcactccaatcccaggcgacggtgtgagactccatctcaaaaa

SEQ ID NO: 11518 - DNA, 72 bp, Homo sapiens
agactcactccagtgccaggtagagcaggtcatgcctgcagcccagtgggcgtggcatgagacagcccagaa

SEQ ID NO: 11519 - DNA, 72 bp, Homo sapiens
ttaggcactgacttgtccccgcacctgcccgggagccctgtggggtggcctggccagtcctgactcgcgggg

SEQ ID NO: 11520 - DNA, 73 bp, Homo sapiens
gtgtctgagctgtaggccactatacccggccctgactgacctaaaggcactgtatgaggcccagctgagctgc

SEQ ID NO: 11521 - DNA, 72 bp, Homo sapiens
acagctcctcccgtcacctgctgaacgtgtacttggccaagccgttcagcgtaagcccctgtcccaccccct

SEQ ID NO: 11522 - DNA, 74 bp, Homo sapiens
ctacctaagaaccatcctggccgccagcccagttgtagcaccgcccagacgactggccagggcgcctgtgggat

SEQ ID NO: 11523 - DNA, 74 bp, Homo sapiens
cggggcccaccgcgccgtccttgtcccctgccaccatctgccggtgcagccgagcgggcggcgaggagggtcct

SEQ ID NO: 11524 - DNA, 72 bp, Homo sapiens
tctcttagctgtaatccagttatcccagagcttgtcagttagaggggagggaagggttggggaggggcagtt

SEQ ID NO: 11525 - DNA, 70 bp, Homo sapiens
acccatgcatggcctacatgccccatgcacacagcagctgcaatacagggcaacagctcccaaggtcaac

SEQ ID NO: 11526 - DNA, 73 bp, Homo sapiens
ttgtaacctacaaagccacaagggtggagctgcccaaggcattgttatcccactccttgtaccagtgtgccgt

SEQ ID NO: 11527 - DNA, 72 bp, Homo sapiens
cctcatattaactatatctgtaatgtctttatttccaaataaggtcatattcataggtacttgaggttagga

SEQ ID NO: 11528 - DNA, 74 bp, Homo sapiens
ttcacgtgagagctggttgtttaaagagcctggcctgccttctctcttcctctctttctccccatgtgacatgt

SEQ ID NO: 11529 - DNA, 71 bp, Homo sapiens
tggtacagagaaaaaggctacattgggaatctagagattttgcttctactattgtctctttctcttaacca

SEQ ID NO: 11530 - DNA, 73 bp, Homo sapiens
gctatgtttctgctccagctagtcactcaaatacccgggtgaatggtggctcttttgcattcagcaagtggct

SEQ ID NO: 11531 - DNA, 72 bp, Homo sapiens
ctaacaagctgccagttgatgtactgctgctattctgcagaccacacttttcgtagcacagcactggatcac

SEQ ID NO: 11532 - DNA, 71 bp, Homo sapiens
acttttataaagaagggaaagttttcccagaaatcctcttccatgtaagactttccttgtagctcattggt

SEQ ID NO: 11533 - DNA, 71 bp, Homo sapiens
cctctcaatcttttagagatagctctgtcaaagttaagagtgaaaattctagagtcagacagcctggtatc

SEQ ID NO: 11534 - DNA, 72 bp, Homo sapiens
ctttcagtcaatgtctattgctactagaagcagcaccagcctggtgttttagtcataggccagctggtagca

SEQ ID NO: 11535 - DNA, 72 bp, Homo sapiens
gctgaagactcagtccccaaaactgctcccccacttcagatatcagttgcaaatttgggcctctggaacttc

SEQ ID NO: 11536 - DNA, 73 bp, Homo sapiens
attagctagacgtgggggtacatgcctagctatcagggaggctgaggcgagagaatcgcatgtacccaggagt

SEQ ID NO: 11537 - DNA, 72 bp, Homo sapiens
attgttgcgggtcaggttgtgccaccaacaatgcccaggttggctgttggtggttttgtttccttgagttac

SEQ ID NO: 11538 - DNA, 72 bp, Homo sapiens
tggatgggcaccatctgattagctgccagcatggctggaataaagcaggcaggagaagatggaagagcagac

SEQ ID NO: 11539 - DNA, 71 bp, Homo sapiens
agctacctttgggcctctggactagttgcttaaagagcaggctgactccagtaaagagtccttagggcaca

SEQ ID NO: 11540 - DNA, 70 bp, Homo sapiens
aaccagcttgcactggctggtgagtgccgattgggtgcgtttcttccctactctgagttcagtgatgtca

SEQ ID NO: 11541 - DNA, 72 bp, Homo sapiens
tctctgtggtttccaggatcaggagtgagagttaggtaggacttcaaccatatcctgagagtttccaggaca

SEQ ID NO: 11542 - DNA, 72 bp, Homo sapiens
tcaggattcaagcctctagtcatgactgatatggttattagagacaaaagaggttagagtaactgaaagcaa

SEQ ID NO: 11543 - DNA, 72 bp, Homo sapiens
gtccccaacctttttgacaccagggactggttttgcagaagacaatttttccccatatggaggtggggaggg

SEQ ID NO: 11544 - DNA, 73 bp, Homo sapiens
gttttctgcatcagaggctaatgtttcaggtaaccattgggcaatgtctaataatttgagatgccagacggta

SEQ ID NO: 11545 - DNA, 72 bp, Homo sapiens
cttagggacagtaatccaggagcagctgagccagtcattctggcccaggatctctcctgaggttgttgtcaa

SEQ ID NO: 11546 - DNA, 72 bp, Homo sapiens
tatccccactttctcgtcgacgctgagtgaagtaaaaatagttgatgaatcggtgggtcttgagtgaaggcc

SEQ ID NO: 11547 - DNA, 74 bp, Homo sapiens
taattaaaaagaggttgaaaataaacatactggcattgcagacatgcaatgcgttattattgttgttccctctt

SEQ ID NO: 11548 - DNA, 72 bp, Homo sapiens
atttggtagagatttatgagatttggaatcaagtgttgtgggttttaatcatagttctactaccagaggtgg

SEQ ID NO: 11549 - DNA, 74 bp, Homo sapiens
atggaaaaagctgacacaggcataactgtggcagccagctatgttttgacatcattgaaagcctggtgagcttt

SEQ ID NO: 11550 - DNA, 72 bp, Homo sapiens
tgacatcaggctcagtttttcaaaggaaactttagaaatgaggaggatttttagaaagtgagagaaagtgca

SEQ ID NO: 11551 - DNA, 73 bp, Homo sapiens
aaaactagaaagaacactcatctcagttttatagttgacctatgggcactgagccagacatgtttgttaagtt

SEQ ID NO: 11552 - DNA, 71 bp, Homo sapiens
acaggaaaacagggggcctgcagtcagagagagaacgctatcacctgcagcccactggataccccagctgc

SEQ ID NO: 11553 - DNA, 71 bp, Homo sapiens
gttcactggaagagacagagggctttcaaaagtcaacatgaaacctaaagtctcaaaggcagacactttgc

SEQ ID NO: 11554 - DNA, 74 bp, Homo sapiens
atgatacttcacattagcagatgaaacacagtttggtataaatagaagcgttctgttagttaagtgaaaatcaa

SEQ ID NO: 11555 - DNA, 70 bp, Homo sapiens
aagatctgccagtatagcaggggagcaagatgatcagttccgtttgagatgtgctaagtttaagatgcat

SEQ ID NO: 11556 - DNA, 74 bp, Homo sapiens
ctcggggggtgagtgggagcaagcgctgggcggagggccgcccccggggagccaggcctgtgccagctcacctc

SEQ ID NO: 11557 - DNA, 71 bp, Homo sapiens
cgggctgcggcgcccgggtctggccctggcctacgggctaagcgcccggccccggggccgcggatccggca

SEQ ID NO: 11558 - DNA, 71 bp, Homo sapiens
aatatggcagtttagagtacagatgctggcatcaagactgctaggtatcagtgctggatctcctgcttacc

SEQ ID NO: 11559 - DNA, 71 bp, Homo sapiens
gttggtggattgagtcttttcaggtggcataaaggacaggggtcagtcggtccatctgaggaggtcaggga

SEQ ID NO: 11560 - DNA, 73 bp, Homo sapiens
ccagagagcttgctctagcttatcaacacacaactgtggccaataggcaagtccagaaaagtcatctcaacat

SEQ ID NO: 11561 - DNA, 71 bp, Homo sapiens
gactgggcccttctctccaggatgactcttccgcagccttgaggggacacagagggcactgtcagcaagga

SEQ ID NO: 11562 - DNA, 73 bp, Homo sapiens
tgttccctcttatgctgagtacccagataataggggtaggccaataaatcaatgagcagagaaggactagctt

SEQ ID NO: 11563 - DNA, 72 bp, Homo sapiens
aggcagccacccctgctgagtgagctggcacacaagagaagctgatttggcatatttagcagcccaaaggta

SEQ ID NO: 11564 - DNA, 72 bp, Homo sapiens
agtaaggatgctacattagacagatgttccacgcgtagttcctgctatcatgtttgagggcccccttgtacg

SEQ ID NO: 11565 - DNA, 72 bp, Homo sapiens
aggatccctgactgattggattgccggagtaaaggctcaactgcctcaacctgatcagcccatctcaccctc

SEQ ID NO: 11566 - DNA, 70 bp, Homo sapiens
gtcctggtgggagaggttggatcatgggagcgatccctcatgaatggtttagtgccatccccttggtgat

SEQ ID NO: 11567 - DNA, 73 bp, Homo sapiens
gaaaagtccactgttagtctgatgaggtttcctttatgggtgactagatgcttttctcttgcttattttaaaa

SEQ ID NO: 11568 - DNA, 73 bp, Homo sapiens
aatatgtttaaggcactgcagttgggtctctgatacaaccagtgttataggcagtcttcagctccaggctcat

SEQ ID NO: 11569 - DNA, 70 bp, Homo sapiens
ctgccccaggtgttctaatgttgacatgtgctgcagggagccgacttagaacatctgagaacaaaaggag

SEQ ID NO: 11570 - DNA, 71 bp, Homo sapiens
acctcttaatgcatgttcccagtttggttggtgggggttggtggtgactggaagaggccagtggttaattt

SEQ ID NO: 11571 - DNA, 70 bp, Homo sapiens
ggccggaggatgagtgaaatatcatgaaatccacactgaatctctttctctcaagacactcctcctccca

SEQ ID NO: 11572 - DNA, 71 bp, Homo sapiens
ggctgcagccgggaatgccctccgcggggcggcctgggcggcagctccgcccccggggccgcggttgcacc

SEQ ID NO: 11573 - DNA, 73 bp, Homo sapiens
cccatggcttatatacaggtggtggaggattaatgtgtgcaaatccacattaaacttgttcagaagttacatt

SEQ ID NO: 11574 - DNA, 74 bp, Homo sapiens
gctgtgctcttgggcctgctgcctcatctcccgggcctcactgttcccatgtggactcagcagctggtctcgca

SEQ ID NO: 11575 - DNA, 74 bp, Homo sapiens
accgaggggccgagggagcgagaggccaagaggccatggggctgagtggttggttctcctggggcaatgacccc

SEQ ID NO: 11576 - DNA, 74 bp, Homo sapiens
ggccagaacaccctgggctctgttcctgtccctcctagagcaggatgtcctacagagatttagctcagcaagtt

SEQ ID NO: 11577 - DNA, 71 bp, Homo sapiens
acctagaaggcatgaaacatctggcagccaattccagatgaagcttaattttgcctacctttgttttatta

SEQ ID NO: 11578 - DNA, 72 bp, Homo sapiens
tagattaaagaatgtgctagatagtctagtcgcttgactaagtggtcttttcattaatctcctacaactgaa

SEQ ID NO: 11579 - DNA, 72 bp, Homo sapiens
gagataaagctaaagtccctgagaccctatgccctgaaattgggtcaggcagtttggattttgagggaacaa

SEQ ID NO: 11580 - DNA, 71 bp, Homo sapiens
atcctgacagtgccggccaaagaggcttcttgaatgctcaccgcaggccaggggccatcgagcaaggtcag

SEQ ID NO: 11581 - DNA, 73 bp, Homo sapiens
ccacacagataatgtgtagtaccacagtgctctcaatcacacttgcacatgaatccatgcacagtctgtacat

SEQ ID NO: 11582 - DNA, 74 bp, Homo sapiens
aaactgaggcctggagaagctaagggcatggccagtgggcaccctgaacctccttctcacaatctctctctgca

SEQ ID NO: 11583 - DNA, 72 bp, Homo sapiens
caagttagcagccagctgtggtggcacacgcctgtaatcccagaattttgggaggccgaggcgggtggatca

SEQ ID NO: 11584 - DNA, 70 bp, Homo sapiens
ggactggccctcccccgccccaagagtgccttccggccttcaaggaatagaggccagaagtatcaaggaa

SEQ ID NO: 11585 - DNA, 74 bp, Homo sapiens
ttcttttaagtggagagttagtatctgtttgaattctgatcaaacagtggtaccctggacctcatgcccaagga

SEQ ID NO: 11586 - DNA, 73 bp, Homo sapiens
aaatccattattggtagccatggatttaaccttacccacaggtaaaatctgtgcatacagaaatgatttggga

SEQ ID NO: 11587 - DNA, 72 bp, Homo sapiens
tcttctagattttccaatttattggcatatagttgcacatagcagcctctaatgacccttggaatttctgtg

SEQ ID NO: 11588 - DNA, 70 bp, Homo sapiens
tactgggtattgtcatagtggaaattgccctgctccagggtcagtgacctccccaaattagtaccttgcc

SEQ ID NO: 11589 - DNA, 70 bp, Homo sapiens
gatccatggcttgatgtccaccagtttcagtgctgaactggtgcttagcagcacatcatagggccctttg

SEQ ID NO: 11590 - DNA, 73 bp, Homo sapiens
aatggccacttgatctaggatcgaagaccaatgcagtgcagtgggaaagagattctattttcaaataaatggt

SEQ ID NO: 11591 - DNA, 74 bp, Homo sapiens
tttcattcacagcgtagcctggaatttcttcacctgtctgtgaggaaccaacctcccagaatagaaattaatgc

SEQ ID NO: 11592 - DNA, 71 bp, Homo sapiens
cagcattgtagagcagaatcatagttggtgtgctgtttcatagatatgctatgtctgcataatacatattt

SEQ ID NO: 11593 - DNA, 70 bp, Homo sapiens
cagaaagcaaaactcagactggcttaagtagaaaaggagacttactggctcagaagtccaggagttggaa

SEQ ID NO: 11594 - DNA, 72 bp, Homo sapiens
attgctataattgtgaataaaaaagtcatgcttctttaggagaaaagcatggcatctatatacgtatgtaca

SEQ ID NO: 11595 - DNA, 72 bp, Homo sapiens
tccagtctgtcattgttgggcgttttggttggttccaagtctttgctattgtgaacagtgcctcagtaaata

SEQ ID NO: 11596 - DNA, 74 bp, Homo sapiens
gtgctgtccagtgcagtagccgctggccacatgtggctattgcatactcaatatgtggccagtgtgactgagga

SEQ ID NO: 11597 - DNA, 72 bp, Homo sapiens
tcaaaggagtcattagggttatggggtcccaaaggtaataacaattgtctatacatggctcttcttgatcag

SEQ ID NO: 11598 - DNA, 73 bp, Homo sapiens
taggagctatcatctcgatattgtggtacaactatgctaagtactttatgtgcgatagaagtctcttatccaa

SEQ ID NO: 11599 - DNA, 73 bp, Homo sapiens
ctcccagagctaggagatttatgattcagtcagttaggtagatgttaatagagttggggtgtttggtgtggtt

SEQ ID NO: 11600 - DNA, 72 bp, Homo sapiens
tggtcctggagggaaagctctgaagtcattatggggtaggagacaagctgcacaatggaccctgtgaccaaa

SEQ ID NO: 11601 - DNA, 73 bp, Homo sapiens
ccgtaagaagtggagctagagtttgagtggcgttttgattcctcccggggcctttgccttgctgtctcctgtt

SEQ ID NO: 11602 - DNA, 70 bp, Homo sapiens
ttagtaagtggtagagccaggatttgtccaaaaacattctgcttccagagtgtaagttcttatatctaca

SEQ ID NO: 11603 - DNA, 71 bp, Homo sapiens
gcatttaataggcacttaataaatatttgttgactgatagattaactgacctattaattgaatgaactaaa

SEQ ID NO: 11604 - DNA, 70 bp, Homo sapiens
tgtgtaataatcacatgaggggaaatgaggtattcattacatcaagcatttatcctttttgttacaatat

SEQ ID NO: 11605 - DNA, 72 bp, Homo sapiens
taagaatataatacaattcggatttgtgtccccacccatagctcatgctgaattggaggaaggtcctgatgg

SEQ ID NO: 11606 - DNA, 72 bp, Homo sapiens
gtgtgatatgtatcactgtgacaactttcactcccagagttgtatctcctttatgttacaaaagccaatttc

SEQ ID NO: 11607 - DNA, 73 bp, Homo sapiens
atcaagggaagggctaaaagatggagaaaagttggagtcaacccactgggctgaaacagtgcctcccttggga

SEQ ID NO: 11608 - DNA, 74 bp, Homo sapiens
gcgagagaaggcctctctgaggataaacttttaagcagagactggaagtctttgggttttttttttcttttttc

SEQ ID NO: 11609 - DNA, 74 bp, Homo sapiens
taggttttgtagaatgctttaatggcaggtagagcagtgcctcctcatagctttttcttttcaatgtcctctgc

SEQ ID NO: 11610 - DNA, 71 bp, Homo sapiens
tgctttggtctttcttctggcaaccagcctctatcctgaagctgcctaagggctgccagccagccatcagt

SEQ ID NO: 11611 - DNA, 74 bp, Homo sapiens
aacttaagtgtgtgtgtgtgtgtgtgtgtgtgtgtgtgtgtgtgtgcgcgcgcgcgcgcgcgtgtgagctatga

SEQ ID NO: 11612 - DNA, 72 bp, Homo sapiens
tcaaagggaggatggtggcttgacccagcaggacagaaatggagatggtgggagtgtgcagactcaggatct

SEQ ID NO: 11613 - DNA, 72 bp, Homo sapiens
ccagcacaggccactaagcttatcctcagtaaaccagaaaacttagtggttctggccattcttcaagttttt

SEQ ID NO: 11614 - DNA, 73 bp, Homo sapiens
atattttaggctttgcaggctatacagtctctgttgcaactgctcaactatgccactgtagtataaaggagcc

SEQ ID NO: 11615 - DNA, 71 bp, Homo sapiens
agtggcgagtgcacaggcaggtatggggctttgtgtgtgggcaaaaccccagaggaccatgtgactggcac

SEQ ID NO: 11616 - DNA, 72 bp, Homo sapiens
acgagtttgtggtccagaaaccagagctttgctccaggtaacttctagcaccatgactaaacagactctcca

SEQ ID NO: 11617 - DNA, 73 bp, Homo sapiens
gcaggtgcttccttgcagttggaagctgtgtggtagagcagcaacagctacaagagactaagatgttatgaag

SEQ ID NO: 11618 - DNA, 73 bp, Homo sapiens
tgccccatgtgactttgtttttcttacctctaagaagagacaaaattactggccttccaaaactcagagttat

SEQ ID NO: 11619 - DNA, 70 bp, Homo sapiens
ggatttgttccttggattgcttgggacccaaggtgcaagccaccttgggaatgctaacaaataggaaaac

SEQ ID NO: 11620 - DNA, 72 bp, Homo sapiens
agttgttctaaccacagtgtatgttgtgcagaagtggccaacacagcacagactgaactcctgaggtgagaa

SEQ ID NO: 11621 - DNA, 73 bp, Homo sapiens
gaaattgtcatggtgagtttacaaaaggtaaaaatcaatcttttgattcagtcaagtgcaatttctaggacac

SEQ ID NO: 11622 - DNA, 71 bp, Homo sapiens
ctcgtgtagcagtggaatgatgcctcctgacctttcagacctttgagacctctgggcggtcttagaaatca

SEQ ID NO: 11623 - DNA, 74 bp, Homo sapiens
tgtccatgcaatgtctgccgctctcagcagtgaggaggccctggaaaaggtagctcctatctgcaggcaggtca

SEQ ID NO: 11624 - DNA, 71 bp, Homo sapiens
tggtctcctgtgattctggcctatgaattgatagataaacctctagaatagcaggtcattgtaaaagactg

SEQ ID NO: 11625 - DNA, 70 bp, Homo sapiens
tacattagaatctagactgaaggctaatgattgcatttatctttgcctaagtcttccagggtttctagct

SEQ ID NO: 11626 - DNA, 71 bp, Homo sapiens
gttgggatctttgtgacaagctaatatctgagcaaaaggaaatgggcatgtctgtagaaagagctttccat

SEQ ID NO: 11627 - DNA, 74 bp, Homo sapiens
gaacactggacttggagtcagaaggccttggttcagaatcaactcctcctctttgagtttctgtttcttcctca

SEQ ID NO: 11628 - DNA, 73 bp, Homo sapiens
gccggcagtggtggcacgcacttgcggccccagctattcaaggaggctgaggtgggagaatcgcttgaacccg

SEQ ID NO: 11629 - DNA, 73 bp, Homo sapiens
ctggatgacaagagctagacactgtgtcaaaaaagtaaggcctgggcacagtgactcatgcctgtaatcccag

SEQ ID NO: 11630 - DNA, 72 bp, Homo sapiens
ccccactggttttcttgctgttcatccaacacaccaggcatgttcttgcctcggcacctttgagtagtgccc

SEQ ID NO: 11631 - DNA, 70 bp, Homo sapiens
cctcagatccagttttctttcctagagcttcaacccaaagcttggaatttaggttgggacaaaaatttgt

SEQ ID NO: 11632 - DNA, 70 bp, Homo sapiens
tatgatttactttaacctcgagggtatagttgtttggtataccagcttttggtgggaagagtcctctgtt

SEQ ID NO: 11633 - DNA, 73 bp, Homo sapiens
acacaagggctgtttgctacttaaccaaattaagttccacatcactagcttattgagtcacttggcccactgt

SEQ ID NO: 11634 - DNA, 71 bp, Homo sapiens
tttggaggtttgagaaatttttcctcatctaaaaaatggggaacgtgtacaaaattatttgtgagatcttt

SEQ ID NO: 11635 - DNA, 71 bp, Homo sapiens
acggaacctcacgagcttagacccactggcttggaatccctgccagcttagtggcagcaggctggagaccg

SEQ ID NO: 11636 - DNA, 73 bp, Homo sapiens
cagagcatctaggaagccaaacaaacttgcttttataacactgtctggtaactaatcatgtcctgagagcaag

SEQ ID NO: 11637 - DNA, 73 bp, Homo sapiens
ccctggcaaaataaacctctaaattgactgagacctgtctcaaacagtttatggtttatactctctgaggcca

SEQ ID NO: 11638 - DNA, 74 bp, Homo sapiens
tggtggcgccccacccccggccccccgtaatcccagctatttcggaggctgcggcaggagaatcgcttgaaccc

SEQ ID NO: 11639 - DNA, 73 bp, Homo sapiens
tattttgtagtgatggtcttgcataggctggtctcgaactcctgggctcaagcgatcttcctacctcagcctc

SEQ ID NO: 11640 - DNA, 71 bp, Homo sapiens
gtggttggccacaataggcaagatgctaatgactatggtcaccaactgcccagaaccaacccctgccaatg

SEQ ID NO: 11641 - DNA, 72 bp, Homo sapiens
cgggattgagcaacccgagacagtaaggtggaagggacaatgcttttcgtggcctatcacagcagtcccaca

SEQ ID NO: 11642 - DNA, 72 bp, Homo sapiens
gagactgtaccactgcactcccgcctgggtgtcagagtgagatcctgtctcaaagtcaaaaaaaaacaaaaa

SEQ ID NO: 11643 - DNA, 76 bp, Homo sapiens
ggcctggtcaaaagggtgcacagagcccagccattctagaaaaggctactctttgcacccctctgctcagagaccc

SEQ ID NO: 11644 - DNA, 76 bp, Homo sapiens; identical to SEQ ID NO: 11643

SEQ ID NO: 11645 - DNA, 74 bp, Homo sapiens
agaattataggttgttgggaagctttgatggatatttctggtttgtcaaatcaaacacagacccagaaattatg

SEQ ID NO: 11646 - DNA, 73 bp, Homo sapiens
ctggcccattcctgaagcatatgggattcttctaataggaaactttggctcagggactctccagtgacctggc

SEQ ID NO: 11647 - DNA, 72 bp, Homo sapiens
tttcctggctatagtaaatgatcccagcctgtatgaaggaagacataactgcaatagcccagtcccttctct

SEQ ID NO: 11648 - DNA, 72 bp, Homo sapiens
ccagccctctcccgccagcgccctccccgccccgcttccagcacggtccctaaaggcgcggacgactcaagc

SEQ ID NO: 11649 - DNA, 71 bp, Homo sapiens
tcttcctgggacccagacatacacttaagctatagaatatgtactggcttcaaggaaatatacctctcagc

SEQ ID NO: 11650 - DNA, 71 bp, Homo sapiens
tcaaagcatgcagtctacaaaggctagaccagtttggctaaatttggcctcagactcactggagcaggctt

SEQ ID NO: 11651 - DNA, 74 bp, Homo sapiens
tcatggaataggaggcaagctggccttgtgaaaagagatgggcattggctcagtccagccttccatatttgttg

SEQ ID NO: 11652 - DNA, 74 bp, Homo sapiens
tcatcattccaatatggggtgtagccatgtatgagcatactctagaaagcaagcagagtaaagcatggaagccc

SEQ ID NO: 11653 - DNA, 70 bp, Homo sapiens
ctctgcaggtcaactccatggcagttggctctcctttccattgctattacccacaattctgtaatgagta

SEQ ID NO: 11654 - DNA, 70 bp, Homo sapiens
agtgtgagcactctgtcaagccgggacagggccaccagagggctccttggtctagcggtaatgccagtgc

SEQ ID NO: 11655 - DNA, 72 bp, Homo sapiens
ggatgactagagcttaatcctttggggaaactctgggtaacagcacagaacacacctcagagttatcttcct

SEQ ID NO: 11656 - DNA, 74 bp, Homo sapiens
cctataaactaaagctgacctcttgcctgtataaccagagtttgtcaaatattttgctgacaggaactggtcag

SEQ ID NO: 11657 - DNA, 72 bp, Homo sapiens
aatgttcaaaaattttactggtttcagtttatgtccaggttccttgggagccgcctctctagtgctgagcat

SEQ ID NO: 11658 - DNA, 70 bp, Homo sapiens
cggcccgcgggcccgggtggaggggctggagggatcttcccccctcccccggtctcccggctccatctgc

SEQ ID NO: 11659 - DNA, 72 bp, Homo sapiens
tctgttaaccctgtttccctgagagttgggtccaacttgcctgttggaccaggggcctgccttttgggatgc

SEQ ID NO: 11660 - DNA, 72 bp, Homo sapiens
ctggtccttgcacctgtcatctcatgcactctctacgggaactaatgatgatgattatgcattttatagaga

SEQ ID NO: 11661 - DNA, 72 bp, Homo sapiens
tctgtgtataactgtaatgtgcattgcaggatctgcccgccagatgccaacagtatacctctagctgcaaaa

SEQ ID NO: 11662 - DNA, 72 bp, Homo sapiens
catgtttcaagtaattcagctttcattgattattgcataattggtagtaagaattaatgcagagactgaata

SEQ ID NO: 11663 - DNA, 73 bp, Homo sapiens
gatttgcacagctgggaggaatagtctgagatagtgtgggttggagaatactcaagggccagtgcaggtaaca

SEQ ID NO: 11664 - DNA, 73 bp, Homo sapiens
tgactggtcaggagcaaagtacagaagctttgccctttttctgtcaaatgatgccaccaaccctttgccggag

SEQ ID NO: 11665 - DNA, 73 bp, Homo sapiens
tggagctaccctgtcttcacagtggctaatgcctctctgatgttgggaagggctggagacaagggaggagaca

SEQ ID NO: 11666 - DNA, 70 bp, Homo sapiens
gtgaagaagcgggtgctcgtacagcaagtgccaacatgcattaggcagccggagggcacacaggaccact

SEQ ID NO: 11667 - DNA, 73 bp, Homo sapiens
tgacatagcaccattttccccactgagaagacccaaggcagaaagtcaactcttggaggaaaggaaatggtct

SEQ ID NO: 11668 - DNA, 70 bp, Homo sapiens
agtgtcagatgcctctttcataggggttgcaattttaagtgacaatgaggtagtgcaactgatttaaagt

SEQ ID NO: 11669 - DNA, 70 bp, Homo sapiens
tgcctcaggccccctggacatagtgtgaagatacaggatctgattcagcaggatggggtgggcccgagct

SEQ ID NO: 11670 - DNA, 71 bp, Homo sapiens
gccactttgggctcctcttacctatgaattaacaggcaaataagggagtgctgtgttggttgggatgattg

SEQ ID NO: 11671 - DNA, 73 bp, Homo sapiens
acaatgttcagtttcacctggtttgtcaaataccctcaaggcaaaggtcagactttggcattctgctacctct

SEQ ID NO: 11672 - DNA, 72 bp, Homo sapiens
tgtaccagtttgcacccacaggcctgacaccaactacagcaggcacagcactgtggtagaggagtgcacagg

SEQ ID NO: 11673 - DNA, 72 bp, Homo sapiens
agggggcgtgtgagatgtcgggagctccaagagtggctgggtgccactcatctctcttgcgcccacagctgc

SEQ ID NO: 11674 - DNA, 70 bp, Homo sapiens
tagacttctaggcttttaacagtattaatttggtttctataaaccagtttgactggaataatgcagaaga

SEQ ID NO: 11675 - DNA, 70 bp, Homo sapiens
tcttactattggaccaagtcactgcctcttctctgttgggcagaagcaaatgaggaggtgagagaatggt

SEQ ID NO: 11676 - DNA, 74 bp, Homo sapiens
atatctccccagcacctccaccaaaaataaaaactaaaaagttattaatttatcacagtgtttctgagggctgg

SEQ ID NO: 11677 - DNA, 74 bp, Homo sapiens
ggggattgtgggtagttattctgtgccaggccttgggctgtgggtgcaaatacaaaaatactggtggcattata

SEQ ID NO: 11678 - DNA, 74 bp, Homo sapiens
ggacggcgggaatcgccatgtttgggtgcgtccagtttctaatggcctgtatttccatatcaaagcttgccatc

SEQ ID NO: 11679 - DNA, 74 bp, Homo sapiens
tcagcggctttgaaaacacagctggttgggtagaaacatgtcttctgggcaaagtgggcctgagctgagagccg

SEQ ID NO: 11680 - DNA, 71 bp, Homo sapiens
gtgtgctcccgggtgctgtaggcattaagatgggcccccatgctctccacctccttctccagggcactgcc

SEQ ID NO: 11681 - DNA, 71 bp, Homo sapiens
aggcccgagcccctccccgtgggagacagggaagccttgctctgtaaacacgacatcagctgctccaccag

SEQ ID NO: 11682 - DNA, 72 bp, Homo sapiens
tggaggctccctggagatggtgagggcagggagtgtgctgagtcatgccttgccctctccctctaggacctc

SEQ ID NO: 11683 - DNA, 74 bp, Homo sapiens
gcccccaccagtgaagcgccgagaccgcgaggccctgatggcctctgggagtggtaagaaggcagggttagggg

SEQ ID NO: 11684 - DNA, 70 bp, Homo sapiens
agagcaggaggacaggggattgatctcccaagggaggtaccctgatccgagtcacggcaccaaaatgtca

SEQ ID NO: 11685 - DNA, 72 bp, Homo sapiens
catcatctctacagatttttttttaatagccaggcacagcagtacactacaggtgtactgtataagtgtcta

SEQ ID NO: 11686 - DNA, 74 bp, Homo sapiens
cctaggagacaagcctaggtaacagagcaagaccctgtctcaaaagaccctaggtgatgctctgtcacctaggc

SEQ ID NO: 11687 - DNA, 74 bp, Homo sapiens
agcaggggacgaaatccaagcgcagctggaatgctctggagacaacagctgcttttgggattccgttgcccgct

SEQ ID NO: 11688 - DNA, 73 bp, Homo sapiens
actgaatccgggcccttctcatacgagtcattcttgacaaacgccaggttcaccatcgactcgggctctatat

SEQ ID NO: 11689 - DNA, 70 bp, Homo sapiens
tgtgctggggacaaaggtgactggggtattctgctgcagggagatttagattcccttcacttgcttccct

SEQ ID NO: 11690 - DNA, 72 bp, Homo sapiens
ctgtcccaagacctggtgagattagatggcatagttgtcatacttgctgattggttaggggatatgcatggg

SEQ ID NO: 11691 - DNA, 74 bp, Homo sapiens
caagggagagctgtagcccctacagagtatgacagcagacattctggcatttgttgggggttggatacaatgct

SEQ ID NO: 11692 - DNA, 72 bp, Homo sapiens
ttgaattttagtatagtagcatagtctgagctcagaagggccttatgatagaccctgtatgttctgggaggc

SEQ ID NO: 11693 - DNA, 70 bp, Homo sapiens
gggctgggcccaggggagggggagggttttgacacccaccagcctgttggtcccatcttggcctgtctgt

SEQ ID NO: 11694 - DNA, 72 bp, Homo sapiens
ccgggctttgaaggcagcagcattgtacaggtgctagagtggggacagagagtgacaccctggggagctggg

SEQ ID NO: 11695 - DNA, 72 bp, Homo sapiens
aaagcaaacaaagacgtattggtttctgctctattagaggggcaggaggggggaaatcaatgtttagtaaat

SEQ ID NO: 11696 - DNA, 72 bp, Homo sapiens
tttttgtggcagttgtaaatgggattgagttcttgatttggttctcagcttgaatgctattgaagtatagac

SEQ ID NO: 11697 - DNA, 72 bp, Homo sapiens
gaaagtagcttatactcacagtgtctgcccctgccgtgtagctctctcatggggagggcctgtttttgtaag

SEQ ID NO: 11698 - DNA, 73 bp, Homo sapiens
gagacgccggtgccggttcctcgctcccggccggggccgccgggtcccgcaacaatggggaccgactggagac

SEQ ID NO: 11699 - DNA, 74 bp, Homo sapiens
agtgggaccctctctggaatgagggtcttatgacccataattagaaaggagggtttggaattttagagtcctgc

SEQ ID NO: 11700 - DNA, 74 bp, Homo sapiens
cagcgcctggaggccatgctttttgcactggaccgcatcaaccgtgacccgcacctgctgcctggcgtgcgcct

SEQ ID NO: 11701 - DNA, 72 bp, Homo sapiens
taggattataggcaagagccgctacatcccgcccagaggcggcttctcaaggccctcgttgattcctgagca

SEQ ID NO: 11702 - DNA, 70 bp, Homo sapiens
ccaccatcatggcatcagctgaaaccacttccgttcatcaagcgcttatgacagcaggccctgagtgtgg

SEQ ID NO: 11703 - DNA, 70 bp, Homo sapiens
gaggaggtctggagaaggatgggggccacagtctggggaagtgaggccccagtggacaacaagccccgag

SEQ ID NO: 11704 - DNA, 73 bp, Homo sapiens
cacctgagcagcccgtcaaataggaacttccaggactaccatgggggtgggggtgggggagcaggtttaaggt

SEQ ID NO: 11705 - DNA, 73 bp, Homo sapiens
gatgttctcctgggagcaatatgggaaagcactggggcaggcttgtggcacaggaatgacaggagtggacatt

SEQ ID NO: 11706 - DNA, 71 bp, Homo sapiens
tgactgctaaccaccaatgacctgtctcctggcaggcaccctgcttctggggcctagtccagaccctggca

SEQ ID NO: 11707 - DNA, 72 bp, Homo sapiens
aaccaatggctcaaggttcaagaaggccaatgttgtgagcacaggccttctcgagccttgagtgtgctggtg

SEQ ID NO: 11708 - DNA, 74 bp, Homo sapiens
gtgggcagagcagagcctgcattggccatctccatctggcccaggccaacaggccttgctctgctcacagacgc

SEQ ID NO: 11709 - DNA, 72 bp, Homo sapiens
ccgcgccgcggcccgccgggcaccgccgctggaccccgcgccgacccggcagcgccccgacctgccgctcgg

SEQ ID NO: 11710 - DNA, 73 bp, Homo sapiens
agctgaggcaagatgctggcctaggccatccagttggtggtggaggtacccaggctgctcttggagaggctga

SEQ ID NO: 11711 - DNA, 73 bp, Homo sapiens
taagaccattggaaaagcgcagtattagggggtgggagtgtcccgattttccagaaaccgtctgtcacggctt

SEQ ID NO: 11712 - DNA, 72 bp, Homo sapiens
gagggcacaggcaggagaccccacagccagctatgccctgagcctgtggtggctgctgctggtgccctcacc

SEQ ID NO: 11713 - DNA, 74 bp, Homo sapiens
ataaatgtgggggacagtggcaatggtagcagtctctggctttgagtctcagccactgtcatctttggaatcca

SEQ ID NO: 11714 - DNA, 73 bp, Homo sapiens
acaagctccagtggactccagtcccttcaggaatcccctgtagtagggatggagagagaggagaaaagtaagt

SEQ ID NO: 11715 - DNA, 74 bp, Homo sapiens
caggtccacgccacggtaggtgaacctgcggaaggtctgcttcttctgctctacttctgccatcttgccggatc

SEQ ID NO: 11716 - DNA, 71 bp, Homo sapiens
gcagcctggaaggccgtacagtgtccaggcatctagtctctgtcagggcttacctcaaatgtgggcttttc

SEQ ID NO: 11717 - DNA, 72 bp, Homo sapiens
ctggcttataattttctttccaataatgctcttgttgggtattgatattaagactattttagcctcatagaa

SEQ ID NO: 11718 - DNA, 73 bp, Homo sapiens
ggtctatcatttatgtcctgaaacatgccagcatgtgtcttttgtggccatgccagccaatcataaagtcact

SEQ ID NO: 11719 - DNA, 73 bp, Homo sapiens
agagaggcagcatatcgttaaaaggcctgacttcacccagctggttgctggtttgtgtttatgtttccctttt

SEQ ID NO: 11720 - DNA, 70 bp, Homo sapiens
gtcccctggcctgtgttcaaaaggaaaggtctactcagctagtgccccagcccttagaaaggtcactccc

SEQ ID NO: 11721 - DNA, 71 bp, Homo sapiens
ttgcatgttaaccgccctcttttagagatagtctgatgagggtaaaatgcactttaatctctatttctaaa

SEQ ID NO: 11722 - DNA, 73 bp, Homo sapiens
gccctcatgctgagaattgccacattgtggttggttctgtctgcccacatttcaacaacaaataacagcctgg

SEQ ID NO: 11723 - DNA, 73 bp, Homo sapiens
aaaactgtctcagaagaggtatggggcaggaaagagcacctcagaaccactgatttttcctatttgtattcct

SEQ ID NO: 11724 - DNA, 73 bp, Homo sapiens
ccaggatggttcgattccacagcctccccacaccacctccaggacaggagaggagaagaaagcttttggctcc

SEQ ID NO: 11725 - DNA, 74 bp, Homo sapiens
ttagcgatccttctctagtggtttgtgctctaatatgtcagattcttgaatatcccagagcaggtttctcgctg

SEQ ID NO: 11726 - DNA, 74 bp, Homo sapiens
ctgggctggccgaggtgaagctggctccctctgcttgcagagggatgtggagggagaagcatgggcaggaaccg

SEQ ID NO: 11727 - DNA, 73 bp, Homo sapiens
taggaggcactgagtcagcagtggctgtggtcattaccaacaatggtataggtctgaggcgatggctgacgcc

SEQ ID NO: 11728 - DNA, 74 bp, Homo sapiens
ctgaagttcaggtgaggctggctctactccttggttctagatgtagctacttccaagcaaatccccaagacttc

SEQ ID NO: 11729 - DNA, 71 bp, Homo sapiens
tttgcctggggagtctggcagcactcacaccacccctgtgggtggctttgctgaggccactgctttggcca

SEQ ID NO: 11730 - DNA, 72 bp, Homo sapiens
aggtacatagggcaaagtgttgggtgaccataccccagcacttccacccattcagcaacctgaaagctctcc

SEQ ID NO: 11731 - DNA, 74 bp, Homo sapiens
taaatatcgcttctttgtggaaaacttccctgaccttcttcattaggtcagactcctggaataaatattcatag

SEQ ID NO: 11732 - DNA, 72 bp, Homo sapiens
tgacatcatagtggtaattgcgtaatgatattataatttcattacgtagggattataatggcaaaatgatgt

SEQ ID NO: 11733 - DNA, 72 bp, Homo sapiens
gaaatagatgcatattctgattgtctactttggaaaagcttatcagacactcaaaagaaggcaagcatttgt

SEQ ID NO: 11734 - DNA, 72 bp, Homo sapiens
tatggtcctgagtcactgtagctttgggccagtgaactcaacggattcactgggctcccctattttggacag

SEQ ID NO: 11735 - DNA, 72 bp, Homo sapiens
ttagtaacaaagtcagaggtcaaaaggcaggagatccctttggaattctagtttatcccttctgggatccag

SEQ ID NO: 11736 - DNA, 72 bp, Homo sapiens
ctgagggctctaagggagaatctgttcagtgtgtccacttcactgctgggagtttgctgatgatctttggca

SEQ ID NO: 11737 - DNA, 72 bp, Homo sapiens
gtcttgataattttgcctccatgagattgtggtttggacacaactcatatcgcatgcattatttgatctttt

SEQ ID NO: 11738 - DNA, 72 bp, Homo sapiens
aatcttagtgataatccagctctcaattatctgtaccttaattaggtgctgttttgattatctgcattctcc

SEQ ID NO: 11739 - DNA, 71 bp, Homo sapiens
agggtcagaagcaaggctgggccatcaaataccccaatactcagcacagtgattgatccaggaatgggctc

SEQ ID NO: 11740 - DNA, 73 bp, Homo sapiens
agatcaggaaggaaagagaatgcatctggtggaaaatgaggaataaccagcacagctgtctttcatgagcatg

SEQ ID NO: 11741 - DNA, 73 bp, Homo sapiens
gttcttgtggaagatggcggtcccttggatgatggaaatattgcgtttggacataagaggatcttggttcacg

SEQ ID NO: 11742 - DNA, 70 bp, Homo sapiens
catttcatatccatgtagcttaagtctgactaacttatgttcttcacaaatttaggtaaaggcagctacg

SEQ ID NO: 11743 - DNA, 72 bp, Homo sapiens
gggtggcaaggtattggggtcagaagtactgaggctctgaggacgctccgcgctctcccccctccagccctc

SEQ ID NO: 11744 - DNA, 73 bp, Homo sapiens
tggcttttgacactactcagcaagactcaaacaaattttttccagtaggtggagaagatgttcgcttcagtgg

SEQ ID NO: 11745 - DNA, 72 bp, Homo sapiens
aaagatgcatgggcttgcacagggtccagttgtggggacaaggagctctgtgtcagatgtcagctgtgtgga

SEQ ID NO: 11746 - DNA, 72 bp, Homo sapiens
tggtgccagagtgcttgtggacacttgatgagcatttgcttatcagatgagcaggtcctggctaccctctaa

SEQ ID NO: 11747 - DNA, 73 bp, Homo sapiens
gccggccgcggccgcccccggggagtaccgggagcgcggggagcgcgggtcccgcggcggcggcggcggcggc

SEQ ID NO: 11748 - DNA, 72 bp, Homo sapiens
cacttcctccccatctagtcagagaaagcacttgtgagcaagcatctctgacacacattacaggagttgata

SEQ ID NO: 11749 - DNA, 74 bp, Homo sapiens
aagagaagcacactgagctacatcacttatcaaagggagcactctccatcatgctcagttgacatgtttctttt

SEQ ID NO: 11750 - DNA, 73 bp, Homo sapiens
ctgccttcttccttgacatgtagggattattacaattaaaggtgagatttgggtagtgacacagccaaaccat

SEQ ID NO: 11751 - DNA, 72 bp, Homo sapiens
gtaatggcacaagggcctggtccccttgaatcagtttgagacaactttgaaagaccatcctagttctatcac

SEQ ID NO: 11752 - DNA, 71 bp, Homo sapiens
tctttgttggaggcaggggttctgtcctgtgcactgtaagttgtttagcaccatttctggcttcaaccctc

SEQ ID NO: 11753 - DNA, 73 bp, Homo sapiens
cgtgccagctgttccgtctgtactcactcaatgtgtagtcttatgtgcctgactatctgtgagttgtgtgcct

SEQ ID NO: 11754 - DNA, 73 bp, Homo sapiens
agaattcatcctgggccatgggttggtgccatagactttggatacttaactgttgatagggtttatttctgga

SEQ ID NO: 11755 - DNA, 71 bp, Homo sapiens
tctcctgcttcatttgccctgcttagtgaaactcagctagaatcaaggtgcaactggtctaggaggctagg

SEQ ID NO: 11756 - DNA, 71 bp, Homo sapiens
cactcagaaatggtattggaggcagaagtgtcaaatgtaagtcacttggaaaccagcttcatgagttttgc

SEQ ID NO: 11757 - DNA, 73 bp, Homo sapiens
tcttcatcattggggaatttttgcttgtaatctgaagtccctaatgagcttagactcttgattggtcaaacat

SEQ ID NO: 11758 - DNA, 74 bp, Homo sapiens
aggccaaggcaggtagattgcttgagctcacgagtttgagaccagactgggcaacaaagtgagacctattcttt

SEQ ID NO: 11759 - DNA, 73 bp, Homo sapiens
gtaagataattgtttatccagtttttccagcttagggtctctgatggctggagcacagggtgcaaggtaagag

SEQ ID NO: 11760 - DNA, 72 bp, Homo sapiens
ctgttggtggatctaccattctgggttctggaggacagtgccctcttctcatagttctactacacggtgccc

SEQ ID NO: 11761 - DNA, 74 bp, Homo sapiens
tctagcaatgatcttttgaagcaggtatcagtgaggcaacttaggtgaagttacatagaatccaacagctagta

SEQ ID NO: 11762 - DNA, 71 bp, Homo sapiens
gatggatttgaggcataaacaggaagtagaattaataggtggtagtgactgattggatgcagaagtttatg

SEQ ID NO: 11763 - DNA, 73 bp, Homo sapiens
cagagtttgcctgaattgctgtgggaagcaatattttccactgggaggactttggagcctagatagttatagc

SEQ ID NO: 11764 - DNA, 73 bp, Homo sapiens
aatgatactgaactgtgcactgggcagtaataccccaactaatgccctttgttgagtactcactttgtgccca

SEQ ID NO: 11765 - DNA, 72 bp, Homo sapiens
gctctgcctgcattcactgtgccattcttctccctaggtctacactccatccagcagggccttcctttacta

SEQ ID NO: 11766 - DNA, 73 bp, Homo sapiens
gcgaagcccaacaaatgcctcatcactgggcgtttgttgtcctctctataaaaccagttctgctccacgccta

SEQ ID NO: 11767 - DNA, 72 bp, Homo sapiens
ctgggtgaccccatttctaaaacaaattttaaaaagtgatttcaatagaaatgtgctatggttgcaaagagg

SEQ ID NO: 11768 - DNA, 73 bp, Homo sapiens
caggaatgagattccaggcagacaacattctgtgggctacaactctgaggctggaatgtgcttggcaggtttg

SEQ ID NO: 11769 - DNA, 73 bp, Homo sapiens
ttcagtcagtcttgtggcagcaaacatgtccttaggggcaggtctctatagctgtcaataatgactatgttta

SEQ ID NO: 11770 - DNA, 73 bp, Homo sapiens
gtgctgagaggcagatgtattgcgaagcacagagatagactaactgggccacagtcacaagttaccgcacagc

SEQ ID NO: 11771 - DNA, 72 bp, Homo sapiens
agtgggatatgctggacaaaggaatgatttactccacaagtgggatggagcaggatgtcatgagagttcatt

SEQ ID NO: 11772 - DNA, 73 bp, Homo sapiens
agtgggaatacagacatgaagaaaggtactgtctgatgagtcagacagaaatatttttaaattcctatttagt

SEQ ID NO: 11773 - DNA, 71 bp, Homo sapiens
tatcttggactgtgcagttttagagggggtcatagaatttccatattcatgacaatcggatcttaagcaga

SEQ ID NO: 11774 - DNA, 73 bp, Homo sapiens
ggcaccttccatgtgaaaatgcacatttggttgattgatggggcgtaggaggtggttttatacatggtgctgt

SEQ ID NO: 11775 - DNA, 74 bp, Homo sapiens
gacaggtccagttttcccactttggtgggcatcaggaccatgtgggatgcgatttaaaaacacagatgctggcc

SEQ ID NO: 11776 - DNA, 72 bp, Homo sapiens
gaaacattttaggaaattctgatttggttatttcatagttgtggaaactgagatgctaagtaagtgtcttgc

SEQ ID NO: 11777 - DNA, 73 bp, Homo sapiens
atttaggcaaacagcgagggcaaaagggtccttggtggaattacccttttaacaaaaagcagccccagaatta

SEQ ID NO: 11778 - DNA, 74 bp, Homo sapiens
tagccagggccaacctggaacagcaactccatgggttcacctgggacccgggcttctgtcgttcagctcttgct

SEQ ID NO: 11779 - DNA, 72 bp, Homo sapiens
gaagctgcctcttaaagcagagcatctcgggtaattccctgagtccctaataacactgcttccttgagcccc

SEQ ID NO: 11780 - DNA, 72 bp, Homo sapiens
catgctttccaaagcctgtggtttgcagggaactttagtagtaactctcaactgccaacacttgacatggct

SEQ ID NO: 11781 - DNA, 74 bp, Homo sapiens
gaagctgatgctgctagttcagggagcccacatggagaaccactgtgtagactttctctataggttgtcacagc

SEQ ID NO: 11782 - DNA, 73 bp, Homo sapiens
tctcaaggtaagcattatcttcaaaacccaaaggcacatgtgaacagcagttggggctggggatagggggagg

SEQ ID NO: 11783 - DNA, 70 bp, Homo sapiens
acaaggttcctaggtacctcggtgcccattaaagccagaggacccctgacctacaggccacagacccaga

SEQ ID NO: 11784 - DNA, 74 bp, Homo sapiens
tgcctaagggttattagctactaaatagtagtttgggagcttgaacttggcctcttacctccaagtacattatt

SEQ ID NO: 11785 - DNA, 73 bp, Homo sapiens
gctgcaggagcattgtacagcctgtactgctgtctatggcagctctggccagtaaggtctagcagtgcttggc

SEQ ID NO: 11786 - DNA, 70 bp, Homo sapiens
gtcactactgggggagactggatacttaaccccatgggactgtcagaaaagtttgatctaccctagagga

SEQ ID NO: 11787 - DNA, 74 bp, Homo sapiens
tatttgagtcccttctaagaacctggcactgtggaaaagtgagcaaaactgtgctaggtctttaccatgatgga

SEQ ID NO: 11788 - DNA, 70 bp, Homo sapiens
tgcagttatgaggctgtaaaatgagcattgctataagacaagatgctggctatctaactgattatataaa

SEQ ID NO: 11789 - DNA, 72 bp, Homo sapiens
gcccgttgatgttgggaacatgtaaactttgcatgtattaacaggagcagcattgtacctttacttcattaa

SEQ ID NO: 11790 - DNA, 70 bp, Homo sapiens
tcgcggggagccccggccggaatttcaccgacggacacgggcggagagaggccggcgggctcccgtgcac

SEQ ID NO: 11791 - DNA, 72 bp, Homo sapiens
tttgggtatctggtttagcaggacactcccattgttttgggttctggttttagcacatcactcccattgttt

SEQ ID NO: 11792 - DNA, 72 bp, Homo sapiens
gtgggggctgggccgaggggcttgggtcgtggggacagatctctcatgacttcatgctgtcctctcggtagt

SEQ ID NO: 11793 - DNA, 74 bp, Homo sapiens
ctgtttttggaaaattgctcttcatttgccttaaatagggaaacactgacctatgaattaccattccaaagata

SEQ ID NO: 11794 - DNA, 72 bp, Homo sapiens
tgcttagaggtcggaaaagatctcaatatattcactgagattaagctgacatctgatactgacaatgttaaa

SEQ ID NO: 11795 - DNA, 71 bp, Homo sapiens
tgctcctggaacacccaaggcttgggcaatctctgagcagccaagcccagtgttctctgagttcaaagatc

SEQ ID NO: 11796 - DNA, 74 bp, Homo sapiens
aagttcacattacacacaaagacaccccccacacacaaaaatgttaactgtggaaggtagtggctatgttaatt

SEQ ID NO: 11797 - DNA, 72 bp, Homo sapiens
gagtataagtggtagactggctataatctatggactgtttgtttcatatgaaggtgcagttttattcacttt

SEQ ID NO: 11798 - DNA, 72 bp, Homo sapiens
catgtgctgtgtgtggtcagagggcacactcccacttggctgctctgtctacttccactgtatccctgccta

SEQ ID NO: 11799 - DNA, 71 bp, Homo sapiens
tcatggatggttccacttagatattcagagctcactgccaaagttgcctcttcacagtgaccaatcctgat

SEQ ID NO: 11800 - DNA, 73 bp, Homo sapiens
tgtgtgagtgggaggtgagtaccacagaaataaaaatgagcaaagataaagtactcttgattctacttttata

SEQ ID NO: 11801 - DNA, 71 bp, Homo sapiens
cgttctgttccattacaaaacaactgctattagtcaaatatcggttgggaaaaaaaacagcagattgaaag

SEQ ID NO: 11802 - DNA, 72 bp, Homo sapiens
agaggtgacagttgattacacacacccataaacaccaagggatgagaatgagggggagtcagtttagcttct

SEQ ID NO: 11803 - DNA, 72 bp, Homo sapiens
cgtttataaggactcttgtgataatattggatcaattctgataatccaggatagtctaccttaacttaatca

SEQ ID NO: 11804 - DNA, 72 bp, Homo sapiens
gcagctgtattaatatatacgcatctagtgttgctaacagcataagaatagatatgattgaaagcagttatg

SEQ ID NO: 11805 - DNA, 72 bp, Homo sapiens
ccctatactgagtggttcttcaggctttcagcagatcctggctgagtcagctgcctcacttccctcttccat

SEQ ID NO: 11806 - DNA, 72 bp, Homo sapiens
atgtggattgttgtaaagaacatgaatttttttctatcagaaatgttcaagtaattcagcaatctgcctgag

SEQ ID NO: 11807 - DNA, 73 bp, Homo sapiens
tttcatcaaaagtggctcaataattttggattgaggagcatcttagcttgatgggaaagaaggctttgatcaa

SEQ ID NO: 11808 - DNA, 72 bp, Homo sapiens
aattgcaaaaaaaatttcaagtaatcactaggtccatgttacagtaagctacaatatgggacagtgaagatg

SEQ ID NO: 11809 - DNA, 73 bp, Homo sapiens
cataaccagcggctggtaatactgaggggtgttactatagactcctctcaggaacagtagaatgcctggatcc

SEQ ID NO: 11810 - DNA, 73 bp, Homo sapiens
atacatatcatgtcacctttataaaaacagacttattttaaaatagaataagctttggtgtaaaacatagatg

SEQ ID NO: 11811 - DNA, 73 bp, Homo sapiens
cctggggaatttttgtagctcaagtctgtctacaatctggaggcagaaatctctttacctccaggaactttgg

SEQ ID NO: 11812 - DNA, 71 bp, Homo sapiens
ggatactgggaaaacagacctggggtgagataaaaaaagatcaaaccagagaacatttgaatcccacaaat

SEQ ID NO: 11813 - DNA, 70 bp, Homo sapiens
gaaatggaaggtcaccaccaggatctgcttcactaaggtaaattacatagtggcaggcagctgtgagaaa

SEQ ID NO: 11814 - DNA, 73 bp, Homo sapiens
ccattttacagttgaggagacagaggcactgggaggctgagtaacttgactatgatcaccaaactagtaaggg

SEQ ID NO: 11815 - DNA, 74 bp, Homo sapiens
gatgtgctagtgttctccattcaaggctggccattatcacattgccctttctcaaatggtgtttggaaaacatc

SEQ ID NO: 11816 - DNA, 71 bp, Homo sapiens
tatagtgaaagatggggatgtagtttcattcttccgcattaggatgtccagttttcccatgccatttatta

SEQ ID NO: 11817 - DNA, 71 bp, Homo sapiens
ccaatattttgacttaaaactttccttcattttagaagttttgaggtagcttatcagaagtctggaacgaa

SEQ ID NO: 11818 - DNA, 72 bp, Homo sapiens
cctgttgtcttggtaagaacttatacaagaatattactgataatggtaatcgtctttgtcttatttcttaca

SEQ ID NO: 11819 - DNA, 72 bp, Homo sapiens
tgtttgcttaggcaatggcttatcagatcagactctgtgctacgtgagcaggaaggaaaggaattaggcagg

SEQ ID NO: 11820 - DNA, 71 bp, Homo sapiens
tctaaagatgtttcctgatgggtggacagccaataagtatcagcactgccaacaacctgacaaagcatctg

SEQ ID NO: 11821 - DNA, 73 bp, Homo sapiens
ccagctccaggagagacagagagagtaaatttagattttttctgcctttttattctatctggggctccagctg

SEQ ID NO: 11822 - DNA, 72 bp, Homo sapiens
cttgcattaaaaaagccgtggtcactgtttggtggtctgctgctggtctgatccactgcagttttctgaagc

SEQ ID NO: 11823 - DNA, 70 bp, Homo sapiens
aatgcatgtggagcttaaaacctagatgatgtgttgataggtgcagcaaaccaccaagtcacatgtatac

SEQ ID NO: 11824 - DNA, 72 bp, Homo sapiens
gtagcactccatcatcaaatgcaagaaatgtatgagattgggctcaagcaggtcccaaaggcataagctgcc

SEQ ID NO: 11825 - DNA, 74 bp, Homo sapiens
gcttcaacccaatgaatgtaatagtgacactacttgacttctgtcaagatcataaagactaaaatggaaggggc

SEQ ID NO: 11826 - DNA, 71 bp, Homo sapiens
ggtgtgtgagaggtctgagcagattcaatggggaagatcaacccttaacatggtcaggcactatccaatcg

SEQ ID NO: 11827 - DNA, 74 bp, Homo sapiens
tgagcacatggaagaaagcatccctagtaataggaacagaacctatgcatgggcccatgcaatagacatgccct

SEQ ID NO: 11828 - DNA, 71 bp, Homo sapiens
cacattttcactgcagtccagttttcccagaagcttaattgtgggaaaattatctgtgctaaaaataaaca

SEQ ID NO: 11829 - DNA, 72 bp, Homo sapiens
tttaaatttaatgttaatgctactgagttgacacagtcagtagattgatttaacttaggaagcggtattttt

SEQ ID NO: 11830 - DNA, 72 bp, Homo sapiens
agatcttagtcaaatgaccatacaatgctgtgtacaagaaaggccaggaattggtctttggcagagtggcca

SEQ ID NO: 11831 - DNA, 73 bp, Homo sapiens
atttgtgcatgtcagcagctgtagtagcactacaaagtgcatgcatgttagccagggtgacacacccacagga

SEQ ID NO: 11832 - DNA, 72 bp, Homo sapiens
tatttgtttgactggggattgcacaacagctgcaacacaaaggacagaaagtgcaataaaactgagtataac

SEQ ID NO: 11833 - DNA, 73 bp, Homo sapiens
aatctcccgattagtagaactacaggcataaacaaccacacatggttactttttgcttttttgtagagatggg

SEQ ID NO: 11834 - DNA, 73 bp, Homo sapiens
aattaataatgagaaacttagggctcctgtgctttgggtctggcaggcagcaaacattgaagcatttcaaagt

SEQ ID NO: 11835 - DNA, 74 bp, Homo sapiens
tcttatttgccatggaaagcagtgtcattttgagaatagtgggtaacttctaaaggtcaccttgtgtgtactgc

SEQ ID NO: 11836 - DNA, 70 bp, Homo sapiens
tattataaggaaaataacctggttgctatgacatataggttgacctgttttgtatgcaaaggttaaagaa

SEQ ID NO: 11837 - DNA, 72 bp, Homo sapiens
ccactcagtctgggaagctttcctgagccttgggagactggcttatcatgaatccgagccttctgtggtccc

SEQ ID NO: 11838 - DNA, 74 bp, Homo sapiens
atttaagactcttgagagactacagcactccaggaagattacaatgataatagtcacagtgatagtcccaagag

SEQ ID NO: 11839 - DNA, 72 bp, Homo sapiens
ataatacagctgacagaattgtatagtgtggaaacatcacatttaactggattgtggtggcagatttgtgtt

SEQ ID NO: 11840 - DNA, 71 bp, Homo sapiens
agacaaaacaaaaaattgggcatctaggtcacttgaaagagtgtgggtttcttcaagggcttctgctaatc

SEQ ID NO: 11841 - DNA, 74 bp, Homo sapiens
ccacactctgcctgccatccgaggggcttctcacggaactaatgctctgtgggccttaaatgagggagactgta

SEQ ID NO: 11842 - DNA, 74 bp, Homo sapiens
gtaggtaatagtgttcagagctggggttttaacccaggcagtgtggctctacaatccatgcacccagtaccatg

SEQ ID NO: 11843 - DNA, 73 bp, Homo sapiens
atctttgttttttgcacctcatcaatgtagatgagttgaatattctgtctcaaactcaaggaggttgagtggt

SEQ ID NO: 11844 - DNA, 71 bp, Homo sapiens
cagtttagcttatcaggtgaatgcttgtaatgatacctttcacatgcatgtttcttgatacatcaggagac

SEQ ID NO: 11845 - DNA, 72 bp, Homo sapiens
ggatctcgggatataggcttttcagtcagcgctttgctaaacacatcaaagaagtctgtcacttgatggttc

SEQ ID NO: 11846 - DNA, 73 bp, Homo sapiens
tttgaaaagtttgattttaataagtagggaaataaaaacatatttccttagtctaagaaatttcatctgcaga

SEQ ID NO: 11847 - DNA, 72 bp, Homo sapiens
gcaagtgtgtggccatagaagagttctgccttgagagttctatggcagtgtttgtcaaattccccaataaca

SEQ ID NO: 11848 - DNA, 71 bp, Homo sapiens
atggccatcagttctcactggatacttagctgtgaggtgcaaaagattttaaatgttggtggggatgggtg

SEQ ID NO: 11849 - DNA, 72 bp, Homo sapiens
aatgcaggcattgagtccctgaaatttcgacttgtgagaagtttctttcagcaaaggcacaggtgcagtgct

SEQ ID NO: 11850 - DNA, 70 bp, Homo sapiens
acttttcagggttgagtatgctttggtggtaaattatataaagtggtcatactaccaagtaacatttata

SEQ ID NO: 11851 - DNA, 70 bp, Homo sapiens
tacagcttctcatgaggagttgcttttttagaatcatcctcattaggtcttatcgcttgcagtctgtgat

SEQ ID NO: 11852 - DNA, 72 bp, Homo sapiens
tgcctgcctcagccacccaagatgctaggattacatgcatgagctactgtacccagctgggaaatgcaagtt

SEQ ID NO: 11853 - DNA, 71 bp, Homo sapiens
ctaagtaactccatgctggttgcatgataggccatagaaaggtttaacagccacacttggtttctcctcca

SEQ ID NO: 11854 - DNA, 70 bp, Homo sapiens
aggaaattggcatgtgaattggtagactgagtgggaaagatccatactcaatatggcaggaactatcaaa

SEQ ID NO: 11855 - DNA, 73 bp, Homo sapiens
accagagcagcatagtacagggctagtcaggtccatatgagtttttctgtatttatagcatttggacagagat

SEQ ID NO: 11856 - DNA, 71 bp, Homo sapiens
gattggccaccagtcccaaaatgaatgtaagaaaggggttagggaaggaactctggggcaccacaatcctg

SEQ ID NO: 11857 - DNA, 73 bp, Homo sapiens
tttacataatttgtcttccaatggctgtagaatacccactcttctcagcacacgggtcaatcgcaaggacaga

SEQ ID NO: 11858 - DNA, 72 bp, Homo sapiens
ggacatgaaacacaagtaggtggattaagcagctttgtcatgttcagacacccactagtagccctcagtcac

SEQ ID NO: 11859 - DNA, 71 bp, Homo sapiens
gtttattggggtggaaggtaccaggaatatccccagaaaaatatatgggaaaaccttggacttcatcttgc

SEQ ID NO: 11860 - DNA, 73 bp, Homo sapiens
agtttgccatcacctgactccatttgttttggcagcaaatttgattgaacaagtgcattgtgtggtagtctcc

SEQ ID NO: 11861 - DNA, 74 bp, Homo sapiens
gcctccactggcctagccctacagtaacttaagtgaatacttttagtgagctgttctggtaccctctggtcaat

SEQ ID NO: 11862 - DNA, 72 bp, Homo sapiens
ttcaaggttgctttttccaggtgtttacatcatggtgaaaaataatagcagcagtgaaaatacaaataccac

SEQ ID NO: 11863 - DNA, 70 bp, Homo sapiens
aaataaacatctgttgtttaagcgatctagtctatggtattctatcatagtagcttgaatggattaaaac

SEQ ID NO: 11864 - DNA, 71 bp, Homo sapiens
gtcttgccccggcagtgccaccaaatcatcagaactcctgagacagcaggtgctcaggggctggcataggt

SEQ ID NO: 11865 - DNA, 70 bp, Homo sapiens
tgtgacttcctgcttaaagtggagaaatgtatggttctcaggagctactggtctggtcactatactagga

SEQ ID NO: 11866 - DNA, 74 bp, Homo sapiens
gccaggccacagagggtggcagaatagggactgagatgattttaggcaaaccaccaagtcagggactctgggct

SEQ ID NO: 11867 - DNA, 73 bp, Homo sapiens
gaaatcagctacagtactttggaagggagcatgcaagtaaagctccctggaacataaactgcgctactctctt

SEQ ID NO: 11868 - DNA, 70 bp, Homo sapiens
ccatttctatctcctgcatcaccccaggtagcactggctactttccatcagtaggaagaatgatagaaac

SEQ ID NO: 11869 - DNA, 70 bp, Homo sapiens
accgcaccggttttcaacaaggagtatttttgctcccccagttggggagatttcacaatatctggcgatc

SEQ ID NO: 11870 - DNA, 73 bp, Homo sapiens
agcctctcatgacagagcagcaaacattgaatatcccagggcattccaaagtgatgctttgtgaagcttctcc

SEQ ID NO: 11871 - DNA, 70 bp, Homo sapiens
cacaagcataagagtgagagacgtatgaggcttgtggaaagtctgaactgctgagtacactctggagctt

SEQ ID NO: 11872 - DNA, 72 bp, Homo sapiens
cagatggatgtctcatgagtcaaacagttgccaaatggcatggaacctaaggaagtccttctacaaattgag

SEQ ID NO: 11873 - DNA, 72 bp, Homo sapiens
gactttctgggtcttaggtaaatgacaagatgattctgttttcccatttcagtcccagtttacactttctta

SEQ ID NO: 11874 - DNA, 73 bp, Homo sapiens
gccgagcctgcccggaggatgcgccagcttcgtcagcgcggatcaagagcccccggagccccggcctggtgca

SEQ ID NO: 11875 - DNA, 72 bp, Homo sapiens
tccatcttactaaagaagaagctgagccttctagccagtgagtcacttgttgaaagtcacatggcacaggtt

SEQ ID NO: 11876 - DNA, 73 bp, Homo sapiens
atttcagtgtgacaccagtcactcccgatttttttagttgttcagtgattgggctgatcttgtggattgagat

SEQ ID NO: 11877 - DNA, 72 bp, Homo sapiens
agtgctgaaggtagggcctggcagaaagtgtttggatcacagtgggtccctcatggcttggtgctgtcttca

SEQ ID NO: 11878 - DNA, 70 bp, Homo sapiens
tacacattgaacatgcatctggggtatttgtaaaatatgcttgggagcctgcagacagatgaagttttgt

SEQ ID NO: 11879 - DNA, 70 bp, Homo sapiens
aatgtggatatgatgggggctatcacttctgtctccttcaggacttcaatgaggggaaatagtctctgct

SEQ ID NO: 11880 - DNA, 71 bp, Homo sapiens
cggcactgctgtcccacaatagtctgcactaaccacatggcagggcacatggctgtgaccagctggccttt

SEQ ID NO: 11881 - DNA, 73 bp, Homo sapiens
gagtgaggttgttgcaacctcttaggaagagttaggcagaggagctgtttttatttcttcagggatggaataa

SEQ ID NO: 11882 - DNA, 72 bp, Homo sapiens
gaaagagtgcttataggaatggtggccttccctactccaggggcagatgatgccaccactgtagctgtactt

SEQ ID NO: 11883 - DNA, 74 bp, Homo sapiens
ctcttagcagacccagcacttcctccattagcatgggctgagattttatcctaattacgggcctgatggacagt

SEQ ID NO: 11884 - DNA, 73 bp, Homo sapiens
tagcatggctcagttcaagtccaacagcctcagaaccactgaggctgttggtgtaattctcagtccaaggcta

SEQ ID NO: 11885 - DNA, 70 bp, Homo sapiens
tcttgaccttgatacactgtgccattgaaagcagtcacactttcaaggttagaatatggcttgtttgtgc

SEQ ID NO: 11886 - DNA, 73 bp, Homo sapiens
ttggatatatccccagtagtggggttgctggatcatatggtagctcaatttttagttttttgaggaacttcca

SEQ ID NO: 11887 - DNA, 72 bp, Homo sapiens
agtagttccatgtgtctggaacatttggtgatgaagtgatggcaagaatgaagcttcatagacatgtgtggc

SEQ ID NO: 11888 - DNA, 72 bp, Homo sapiens
actagaaaaagtttttgaagaatggtgtctgcccctactttgtgtggcggggtgaaataccactatttcacc

SEQ ID NO: 11889 - DNA, 73 bp, Homo sapiens
gtttttgatcatgagtctgatggacagtgctagtccatgtgtcttgctgcccttggacaccactggttgtcat

SEQ ID NO: 11890 - DNA, 73 bp, Homo sapiens
aaaggattattctgaacttgatttttttaaaggctttctcgagctttaggaggaggaagtgctgagctatctt

SEQ ID NO: 11891 - DNA, 70 bp, Homo sapiens
ggctccagtgagcatgtttgtcttccacaatgaaataaggcaatggtaatgtactggtctcctgagttca

SEQ ID NO: 11892 - DNA, 72 bp, Homo sapiens
atagttctggaagattttgcatcagaggctatttgtagaaatttggagataaactctgtctgccacagaagt

SEQ ID NO: 11893 - DNA, 72 bp, Homo sapiens
gctgtcaatggcaccaggcaagatgtcaatcgcttagtatttgtcaactactggtagccatcatttccctat

SEQ ID NO: 11894 - DNA, 70 bp, Homo sapiens
aggtgtttataactgctccctatgatagacatttgcagcatgaattagaaagtggggcctggggagacag

SEQ ID NO: 11895 - DNA, 72 bp, Homo sapiens
gggatctggcatgtccgcttataaaaacatcccctgtcaacccactgggagttccttctgatggcctgtctt

SEQ ID NO: 11896 - DNA, 74 bp, Homo sapiens
ttatctgacagaaagaaacttccgaaagtggtcaaggtgctggccaagtgggggtgtaactgagtcgtgttctg

SEQ ID NO: 11897 - DNA, 71 bp, Homo sapiens
gaagaagggactctgggaatgtcactttctcccaaatgaagtgggggaaatgccattattctttcacagcc

SEQ ID NO: 11898 - DNA, 73 bp, Homo sapiens
gttagaatcaacagtatggtatgtttggaaggctgcctaacagctcttccctcagtctctctgctgttgttag

SEQ ID NO: 11899 - DNA, 73 bp, Homo sapiens
tgcctaatgatgtagctgtctttatgttgtagtgcaatgtatcctggtgtacacaaacctgcactaccagttg

SEQ ID NO: 11900 - DNA, 70 bp, Homo sapiens
agacaagatgaccacagaaggccttgtgtagaagattgggtacacggcttcattttgaagtatcagcaga

SEQ ID NO: 11901 - DNA, 71 bp, Homo sapiens
tagttccttgccaaatagggttcccaacatggtcacttacttcctcaaagccagcaagggatagagagcca

SEQ ID NO: 11902 - DNA, 74 bp, Homo sapiens
gagcccagcaccatccaggatcagacagaacttaagccatgagctgcctagaaagatcttgggagggcactggg

SEQ ID NO: 11903 - DNA, 71 bp, Homo sapiens
tctacataaggatatgtccagttttcccaaccctgtttattgaggagactgtcctttccccattgtatgtt

SEQ ID NO: 11904 - DNA, 71 bp, Homo sapiens
tatttttgcgggtctcatcattacttttgtgctatagtacaaacattcaggacatggataagattagtgac

SEQ ID NO: 11905 - DNA, 73 bp, Homo sapiens
tactttgtggtcagatcctagctcagtcaacacacagaagcattgtacagctagggtggtgaagggtattgtg

SEQ ID NO: 11906 - DNA, 74 bp, Homo sapiens
tctgtcacccagaaggaatgatgagggcagtcacgccccaggcacaagtgtttcttgtgattaagcacatctga

SEQ ID NO: 11907 - DNA, 71 bp, Homo sapiens
tctgatcaagcttccagcaccatttgaagagtcactagatcttcccttatggaagttcttacagaaaaaga

SEQ ID NO: 11908 - DNA, 72 bp, Homo sapiens
taactcacctcggtcctagaggagtatcctagtactgcttggcaacttctaagaccctaacttgtgaaacta

SEQ ID NO: 11909 - DNA, 71 bp, Homo sapiens
tgggttgcagattcccagagtgggacagggaggctccacattgcctgccctccttgggaatctacaacccc

SEQ ID NO: 11910 - DNA, 73 bp, Homo sapiens
gagaagagactgccttgtgaaagcacagacacacagggagaagtcctggtgaggaccaaggcagagactggag

SEQ ID NO: 11911 - DNA, 71 bp, Homo sapiens
catagtgcatcagaggctaagtgggaactagctctaaactttcaaacacttgtcctccagtgccactcatg

SEQ ID NO: 11912 - DNA, 73 bp, Homo sapiens
cacacagcagcaaaagtgtcctgagggaaagaggccttaagcatacaggtttaggggagtcccagctggaggg

SEQ ID NO: 11913 - DNA, 72 bp, Homo sapiens
ccaaagtgctaggatcataagcatgagacactgtgcctggccaaagacatagaattttaagtgtgatgggca

SEQ ID NO: 11914 - DNA, 70 bp, Homo sapiens
ggagggctggccatcatttgtgaggactgtggtgttgagatctacacacatcaggctgagagttggacca

SEQ ID NO: 11915 - DNA, 72 bp, Homo sapiens
aaagtgctggtaaggataatctagagttgttcttccacttgacagattagtacattgaaagccagcaagatt

SEQ ID NO: 11916 - DNA, 72 bp, Homo sapiens
tctgaggagccttttgaaaaataaagacatttggacccagatccagtgagtctgtttgtggggtgggccggg

SEQ ID NO: 11917 - DNA, 71 bp, Homo sapiens
gaggccctacaggcttggagcagggtctaccaggaatagatgctgagcctcagtcctgcagagggctgaac

SEQ ID NO: 11918 - DNA, 72 bp, Homo sapiens
taggcaggatggcactcaaataatgtaatgtctggtctggcatagaggaacctgaatgcactggctgtgatg

SEQ ID NO: 11919 - DNA, 72 bp, Homo sapiens
atggtcagcaaaaccttcttgcaggagctgatatcggaactgagagctgctattgaagggaagcctgccata

SEQ ID NO: 11920 - DNA, 71 bp, Homo sapiens
cccaggaaagaccatgggaattgtgaatgtagcaaaatcacattgccaggctttatatgaaaatgggattc

SEQ ID NO: 11921 - DNA, 71 bp, Homo sapiens
ccccagcaccttcttgacattctttgctaaaaatagcaaaccaccaagctgtgcacaccagggcaagaaca

SEQ ID NO: 11922 - DNA, 73 bp, Homo sapiens
aggatgaatgggcggacaggctgacacagtcacgttactggaatccattatgcagtcaccgcttggcatctgc

SEQ ID NO: 11923 - DNA, 73 bp, Homo sapiens
agcccatgtacccaacagtaaccaagtacacattattttcaagtgtacatggtaggtacatttgtcaaaagag

SEQ ID NO: 11924 - DNA, 70 bp, Homo sapiens
acagggttaggagcagctgctgcacttgggtaactcaagtaatttaatgcgtgcatttaacagaactgtt

SEQ ID NO: 11925 - DNA, 70 bp, Homo sapiens
tgggaatcgacgctgactgtgggctgagaccttagctgggatttttagccaggacaccacatgtggcccc

SEQ ID NO: 11926 - DNA, 73 bp, Homo sapiens
gggctgtgaaggcttggccagctggcttccatacctccatggcagtcattgcctggctatgaactacggtctg

SEQ ID NO: 11927 - DNA, 74 bp, Homo sapiens
cccccagagaagcgccccactgtgtccctggctcctgcatacccactgttataggcagtcaccctgacacaggc

SEQ ID NO: 11928 - DNA, 74 bp, Homo sapiens
caatggggctgcgggaggcctgggaggcaatgcaggtctagcagggagcttcgtgagtgtcgtggtccacattg

SEQ ID NO: 11929 - DNA, 70 bp, Homo sapiens
tttgttgacccgcaggctgtcagccagtgggtgaggggacttcagttgggaagggtctggggtcaggagg

SEQ ID NO: 11930 - DNA, 73 bp, Homo sapiens
cccctggcttcagggacagctcaacatgggcctggacagtcaaattccatccccaagcttgggactcagggag

SEQ ID NO: 11931 - DNA, 74 bp, Homo sapiens
gtcagaagtccaaaatatgtctcactggattgaaatcaaggtgtcagcaggactgtgtttgtttctggggcttc

SEQ ID NO: 11932 - DNA, 74 bp, Homo sapiens
gaagtgggggcatggagctggtatcctacactctcagcattccctgtccccacccgtactggccacaaaaggat

SEQ ID NO: 11933 - DNA, 72 bp, Homo sapiens
ttgggcaccagctcggctacagtagactagagcaccaaatggattcctaaggtttctgactccaggccccag

SEQ ID NO: 11934 - DNA, 73 bp, Homo sapiens
ttaggcatctgcacatatccccggaaagcagcctgctccaggcagaaataacatactgggggcttgaccaggt

SEQ ID NO: 11935 - DNA, 72 bp, Homo sapiens
atatttggtgcatgcatatcggaatgaatgaatgaatgaagaggtcatttcccactgcctgcaccaattacc

SEQ ID NO: 11936 - DNA, 70 bp, Homo sapiens
gctccagaacctgcatctgcaatgtctgctgccctcacggggggctggtgcgggtctcttctgcctaact

SEQ ID NO: 11937 - DNA, 73 bp, Homo sapiens
ccaagtagctgggactacagacgccaccacgctggctaatttttgtatttttagtagagacggggtttcgcca

SEQ ID NO: 11938 - DNA, 70 bp, Homo sapiens
agagcaggaggacgggggattgatctcccaagggaggtcccccgatccgagtcacggcaccacatttcat

SEQ ID NO: 11939 - DNA, 72 bp, Homo sapiens
ggatgctggggctgggcatgcagggagaggctgggtggtgtcatctggtaacgcagccaccaaacaatgaag

SEQ ID NO: 11940 - DNA, 72 bp, Homo sapiens
gggctggggttaggatgaccccctggtgtggactcctgctaccgggcctgtagctgtctccacccacacata

SEQ ID NO: 11941 - DNA, 74 bp, Homo sapiens
tgggaagttgttgagtgccactgatgggggaaactgaggcacagcatcacccaacaaggtggggcagactgagt

SEQ ID NO: 11942 - DNA, 73 bp, Homo sapiens
gtccagtgatgcataatgtccaaggactgttgaggtagcttatcactgtgagacactgggcagagttggcccc

SEQ ID NO: 11943 - DNA, 72 bp, Homo sapiens
gagcaatcagaagtaactggatttccaaggtcacaatggggcatgacgtgcccagaccgcaaaggggcagtg

SEQ ID NO: 11944 - DNA, 71 bp, Homo sapiens
attccccatctcttccattcaacgcacactatttttttttttttcgtttagtggggtatttgtgtgaggtg

SEQ ID NO: 11945 - DNA, 72 bp, Homo sapiens
aggatagttatattttatctgcaagtgctagtgccgaaagtgctgcactgtactgcaggctacagtgatcac

SEQ ID NO: 11946 - DNA, 74 bp, Homo sapiens
tccattatgcaaatccatgcaaataatatgcaaagaggcagtagcctcagattgtggggagggggagtgtgtag

SEQ ID NO: 11947 - DNA, 73 bp, Homo sapiens
agactggcttggatcaggggcagaggtgcaggcaatgagaggtgctggtccttagggagaaccaatgaaattt

SEQ ID NO: 11948 - DNA, 72 bp, Homo sapiens
tggtgccagggggtgggatgagaaggactttggcccaggaacctcatccatgcgatctagctggggctgcac

SEQ ID NO: 11949 - DNA, 72 bp, Homo sapiens
cctccctgggggctcatttaacctcaactccaatacagtggactaagggtgagcatctatgaactaggcctc

SEQ ID NO: 11950 - DNA, 74 bp, Homo sapiens
gcaacgtggtgtgttcctgagggtccctgcttagggacagcctaaggtgctatggggactcgttttgagctacc

SEQ ID NO: 11951 - DNA, 72 bp, Homo sapiens
ctactccagacgcttaggatcaatcagtttacaaaacacacactggtccctagccttggggagcttatattc

SEQ ID NO: 11952 - DNA, 72 bp, Homo sapiens
ctgggatggggcgcaggggaccaggtatcttcatctagtgcaatgttaaccttccattggtctctggggtcc

SEQ ID NO: 11953 - DNA, 70 bp, Homo sapiens
ccaaaccatatcagaggctattcagaccagtggggagcactggcttcccattaagctagcccatggactg

SEQ ID NO: 11954 - DNA, 70 bp, Homo sapiens
ggcagcagtgagagccacattcaatcgacagcttaagataatcacatgtgtgaggcactgcaataatggc

SEQ ID NO: 11955 - DNA, 74 bp, Homo sapiens
cactgtccacactcagtaagaattagcaatggcagtgattaagaagaactgtgagtctgatggagtggaggcag

SEQ ID NO: 11956 - DNA, 72 bp, Homo sapiens
ctgtagagcgggtgctggcattactaagggcttaggaaggccaggcaccaatgttcatttaatgatgcctat

SEQ ID NO: 11957 - DNA, 73 bp, Homo sapiens
tacctgcacacatgagcaaagatagcttctgaccaagggaggatttgtcagttcactgggccttgggtgtgtc

SEQ ID NO: 11958 - DNA, 70 bp, Homo sapiens
atatcttgtgaattcaaagtgagaattcacttgttactgcaaggaggataccaagccactcacgaggtat

SEQ ID NO: 11959 - DNA, 71 bp, Homo sapiens
agctgggcttgtggaaaactgagttcttggagcagctgctatgtccttcatgtactttttccccttaatgc

SEQ ID NO: 11960 - DNA, 74 bp, Homo sapiens
caagctgaattgaacatgcaatgtctgagtaatggcattatttatttaatattcatagcagagtgaatgcagtt

SEQ ID NO: 11961 - DNA, 70 bp, Homo sapiens
acaactcccgggttctaatgtgtcactcctggtttccatatgctgcttatgacacaccacagagctgact

SEQ ID NO: 11962 - DNA, 72 bp, Homo sapiens
tcctcattggctgcttctctgagatttcggtcctcagcgactgatgctcttaggtttctgtgctctgaccct

SEQ ID NO: 11963 - DNA, 74 bp, Homo sapiens
tgcttggctactgggatttgaaggctttttgttactgcaacataacgtagcctatcctgattgaaagaggatgt

SEQ ID NO: 11964 - DNA, 73 bp, Homo sapiens
ctctgtccaggaagagtacacagagtatacccctaggcatttgtgtgtaaacatccttgacaagacagtccag

SEQ ID NO: 11965 - DNA, 72 bp, Homo sapiens
ggaaattgcattgttgtatggtgaggcaataaaagcgaacacagaggctattgttcccattcataatggaac

SEQ ID NO: 11966 - DNA, 73 bp, Homo sapiens
ggcaggcttcccaggttccatgggctccaggaatccctaaagagctttcttcttatgacttggacaagtgtaa

SEQ ID NO: 11967 - DNA, 71 bp, Homo sapiens
ctgcccaggggcaggcatggcacaagagagggcttatccatgggtgctgtttggcctgaggtaaaagagag

SEQ ID NO: 11968 - DNA, 74 bp, Homo sapiens
aagtctttggatactaattgagcccttactcatgggctagaattagtttatggggtttatatgtattaactgat

SEQ ID NO: 11969 - DNA, 70 bp, Homo sapiens
ctgggcagcaggtctccagaagtggtctgtgccccggagggtgatccggggctcgatggcctggaggacc

SEQ ID NO: 11970 - DNA, 71 bp, Homo sapiens
cggactggagacgcacagcgccccggggacggcgaggagagctggccgagatgcggctgcagaaagcaacc

SEQ ID NO: 11971 - DNA, 73 bp, Homo sapiens
cgcgctcagggcgcacgggccgcgcctcggccgctggcccccggcgcgccgggcgtcttccccagcgccctga

SEQ ID NO: 11972 - DNA, 71 bp, Homo sapiens
cccagctgagcaggggccatgctaagaggagcctccacagtggttcccagccctgctttttgtggctgttc

SEQ ID NO: 11973 - DNA, 72 bp, Homo sapiens
aagagaggaagggagagcgagccagctcagagactcctaagatatccagctgcactcccaagttgtgttctg

SEQ ID NO: 11974 - DNA, 72 bp, Homo sapiens
tttataatacttgtcatttgtaaattagggatttcctctctaattaaatatgtgttttgttttataaattac

SEQ ID NO: 11975 - DNA, 73 bp, Homo sapiens
ccatttatttatgttaaaacagactcagtgaggttgtagcttatcaagttgatgtagctagattgtggtagtc

SEQ ID NO: 11976 - DNA, 71 bp, Homo sapiens
tcttcattttacttacattcttgaaggctggctatagaatagaggttgacagttttattccagcgctttaa

SEQ ID NO: 11977 - DNA, 72 bp, Homo sapiens
ttcctcttaattcatcctctaaggctcagtgggccttttaatctaaaggaccaaatatttctttagcttggg

SEQ ID NO: 11978 - DNA, 74 bp, Homo sapiens
gttttattagggtgtttggggtaacccctgtggttatgacctatgaattgaggtgatcacaggtcttgcagaca

SEQ ID NO: 11979 - DNA, 70 bp, Homo sapiens
tggatttggggacactaagagcccatttggagctacacttctctgtagccatggtggttcctaaatccag

SEQ ID NO: 11980 - DNA, 72 bp, Homo sapiens
tgatcactttttgcttaaaagcattggaagcttcccaggtaactatagcttatactcgcagaagcagaagaa

SEQ ID NO: 11981 - DNA, 74 bp, Homo sapiens
tctgtgatttacacattgtattcaacttcaggcttagtcagcctcgtacaatggtatggcaggtttatggagtg

SEQ ID NO: 11982 - DNA, 73 bp, Homo sapiens
cagatgcatgttcaaaagtttggcggtcaccaacatagcttactgtgctgatgaagaaatcccttttgaaagc

SEQ ID NO: 11983 - DNA, 72 bp, Homo sapiens
tgctccccagtgaagtctgatttcactgtgacctagaaacgagggtaagcattcagtgttttgtcagcttca

SEQ ID NO: 11984 - DNA, 73 bp, Homo sapiens
taggataattttttaagcagcaggaaacagggctatctggctgcgcagataatgatatcagctgcttccttcc

SEQ ID NO: 11985 - DNA, 70 bp, Homo sapiens
cagatcctaagattctcgagataaggattggcatctgttttatttagaatttcctttcttgctctcggct

SEQ ID NO: 11986 - DNA, 72 bp, Homo sapiens
acaaagagaaggactgggatacagctttctctaatttcatgattttgagttgggtctggtctgtttgccttt

SEQ ID NO: 11987 - DNA, 74 bp, Homo sapiens
tctgatgagtatatagtgttatttcattgtggttttaatttccatttccgttatgagtaataatgctgagtact

SEQ ID NO: 11988 - DNA, 72 bp, Homo sapiens
gatccctgatctagacaggcagtactgtactctacagctatgaagctgctcaggttgagggttgggggacac

SEQ ID NO: 11989 - DNA, 71 bp, Homo sapiens
gaatcccttgaacgcaggaggtagaggttgcagtgggctaagatcgtgccactgcactccagcctgggaga

SEQ ID NO: 11990 - DNA, 72 bp, Homo sapiens
ttattactcggtaaatgtcaacccagacctacacccaaagtgggcttgagggagggtggacgaagtgtaaac

SEQ ID NO: 11991 - DNA, 74 bp, Homo sapiens
actattattcaaagttgggatttttcagtgaaggtgacttttgtgctgatttttcttgtttggcttctgaaggg

SEQ ID NO: 11992 - DNA, 74 bp, Homo sapiens
acagtgtgaaaaagcactggacttggagtcagttatttggcttcctatgacaggtccccatttgatcaccatgt

SEQ ID NO: 11993 - DNA, 72 bp, Homo sapiens
agatcaaactcatattgagcaaccaagggatagatcccattttattgatgatgtctattagggaaaatgtgt

SEQ ID NO: 11994 - DNA, 70 bp, Homo sapiens
agatgtaatgatataggaatagctttgaagttttcagagatgctggttcgaggtatcattataagggcag

SEQ ID NO: 11995 - DNA, 74 bp, Homo sapiens
tgaagcatcctcatggctcttgcttgtgttacaccattgagcatttccaggcaaatgtagaaaagggcattgct

SEQ ID NO: 11996 - DNA, 72 bp, Homo sapiens
cttacgcagggcattggaatcttatccacatatgtgggttggtatttcatcattaacagttatcaggaaaac

SEQ ID NO: 11997 - DNA, 72 bp, Homo sapiens
gttctatagttgggcagaaagcaaaacacataagtgattaacttggatgtttgagctgaggatatttctaag

SEQ ID NO: 11998 - DNA, 72 bp, Homo sapiens
ccacggtgtcaagaagcttggttcctttgaaggcttctccccttggcttgtaggtggttatcttcatgttca

SEQ ID NO: 11999 - DNA, 73 bp, Homo sapiens
gaactcctgggctcaagctatcctcccactttagcgtcccaaagtgctgggattacagtagtgagccactgtg

SEQ ID NO: 12000 - DNA, 74 bp, Homo sapiens
acaatctccttggcaccatgtcactcatgtaatgtaggaataatactgcctctgtgggtcaagtgaaagaatgt

SEQ ID NO: 12001 - DNA, 72 bp, Homo sapiens
ggaaaagtgtgcactacagacaggggtctgggaaaagtttctcttactgggctccagcatccactctttcct

SEQ ID NO: 12002 - DNA, 73 bp, Homo sapiens
ttcattggttgttccttttattcagtatgcattttttttttgaacacctgctgagtacagctgaaataccagt

SEQ ID NO: 12003 - DNA, 73 bp, Homo sapiens
cctcgagtagtcaggtagtttatgggcaataatttacctagaacctgctttgtcctcagaactacctttaagg

SEQ ID NO: 12004 - DNA, 72 bp, Homo sapiens
tgtcttgcaaatgaactctgtagcactgtgcagtatgagtttgccagcaaaacttatatgacttattttatc

SEQ ID NO: 12005 - DNA, 72 bp, Homo sapiens
tgtgtgccttaccttctttacctgcaaagtgcagaaaatagcagtaaacacttcgcagggatgtcgtgagat

SEQ ID NO: 12006 - DNA, 74 bp, Homo sapiens
ttgcacaattactttactatgctgtaatatggtgatgtcgcaataagtatttggtaaatgaaaatgtgtgacaa

SEQ ID NO: 12007 - DNA, 72 bp, Homo sapiens
ggtccagtatccccatgagccatcttgtgcccaagtagcagccccataatattgtatgagtctctcaggggg

SEQ ID NO: 12008 - DNA, 74 bp, Homo sapiens
catgtattaccttccaggaggtctccttaagaggaggcacttttctttctttcttcctttttcttgttgcttgt

SEQ ID NO: 12009 - DNA, 72 bp, Homo sapiens
gcccatagcagcacggccatgccactgctcacagcagcctgtgtgctgactggccagtgcctgaccccaggc

SEQ ID NO: 12010 - DNA, 72 bp, Homo sapiens
aataatgtcatgtccatggtaaccccaaagaacatgagtcatcatgaagagactcccactggacactagaaa

SEQ ID NO: 12011 - DNA, 70 bp, Homo sapiens
gcctggtccaacttaacagcttcagaggtggcttcttaccacctgctgacctatgaattaaaaaggcaaa

SEQ ID NO: 12012 - DNA, 73 bp, Homo sapiens
cacttttggcttaattaagatcttggcctaaatgttggctcagcctgagtccttattgtgaaatagaagatga

SEQ ID NO: 12013 - DNA, 72 bp, Homo sapiens
atattttagattgttgtccagttgtcttttacccccatggaacttgcaattgactgtgatctgcaaagaatg

SEQ ID NO: 12014 - DNA, 71 bp, Homo sapiens
gagaaacacttgaagccaggaggcggagattgcagtgggacgagatcataccattgtactccaacctgggt

SEQ ID NO: 12015 - DNA, 71 bp, Homo sapiens
ttctaagacaacaacttgagggctgagccatttggtatagtaagaagaacagggctcttgagttagaaaca

SEQ ID NO: 12016 - DNA, 73 bp, Homo sapiens
gctaagagcttatcatactgtacttggtgaattattttcactaagtttataaaatacacttagtctttgcaca

SEQ ID NO: 12017 - DNA, 74 bp, Homo sapiens
ctagaacaggtgtcatcggtaaaagtcagaggttgagtggaaatctgtagaaatggtgactttaaaaacttgtt

SEQ ID NO: 12018 - DNA, 74 bp, Homo sapiens
ggtcccagtgcctgttgttcctttcttcatgtgcatatgaaaacttagcagcacatcaacatggcacatgtgtc

SEQ ID NO: 12019 - DNA, 73 bp, Homo sapiens
ggtgggaggggggtcacagtcaagtggaaataccttgggtaaaagtgcaacatgacataattatctgtccatt

SEQ ID NO: 12020 - DNA, 74 bp, Homo sapiens
tgttgtttggactaggattttaagagtgtttcaagaatgaaagggggcttaaagtttgatctaacactaatgca

SEQ ID NO: 12021 - DNA, 70 bp, Homo sapiens
aaaatctttaattgcctattaccttgtggtgagactgaggcagatgaagatgatgtggcttcaaatccag

SEQ ID NO: 12022 - DNA, 72 bp, Homo sapiens
atctcccagttgttgaggtgagatgtccaagatcaagacgttgataggttggacagtcttggtatcttctga

SEQ ID NO: 12023 - DNA, 74 bp, Homo sapiens
tttcataagaggcttttctcccacttattctgcagttcttgctgctgccacgtgacgaagaataggtttgcttt

SEQ ID NO: 12024 - DNA, 71 bp, Homo sapiens
agctggaattcactattttacttgagctaccttggtgtggtagtaggttgtgagaagggggacattttaaa

SEQ ID NO: 12025 - DNA, 74 bp, Homo sapiens
cccaggggacaattctgtgccttttccaaagattattctgagggcttgaatatttaaggggaaaagcaagctgg

SEQ ID NO: 12026 - DNA, 70 bp, Homo sapiens
gggggagcctggagcgagaccggatctcacacggtggtgttaatatctcgctggggcctccaaaatgttg

SEQ ID NO: 12027 - DNA, 74 bp, Homo sapiens
gaggaaagaatggttttgagagtcaagtccagggtgtcactgccctgttcagcctcggtacactgcctcccaca

SEQ ID NO: 12028 - DNA, 72 bp, Homo sapiens
gagatatctgcacttccttgtttgttgctgcactattcacagtggctaagatttggaagcaacctaagtgtc

SEQ ID NO: 12029 - DNA, 73 bp, Homo sapiens
ctcagcagttaaataaacaaagtctgcgttccctgaataataggaagatttgatgcatgtgcctgctggctca

SEQ ID NO: 12030 - DNA, 73 bp, Homo sapiens
agtaattaaagattgaacaaatgtgggctaagtacagtatttttggtctgttatttacccagagttaattatt

SEQ ID NO: 12031 - DNA, 74 bp, Homo sapiens
gtgaataacacacaaagacatcaggtgccttggggctcagagaagtgacaaatttccagcctgagctggacaag

SEQ ID NO: 12032 - DNA, 71 bp, Homo sapiens
ccgcccaccggcgctgcccttgatttctcgctgggccttaactgccttcccgtggggcagggctggggacc

SEQ ID NO: 12033 - DNA, 72 bp, Homo sapiens
aaaaaaagtcagtgttttgctcagggtgttattttataccgtggagcttagcaggtgataaatctcatgtaa

SEQ ID NO: 12034 - DNA, 72 bp, Homo sapiens
ctctaaattcagtgaagtcagtaaatatttcagaagctactacatgctgcatgaggaaattgactctcaata

SEQ ID NO: 12035 - DNA, 72 bp, Homo sapiens
ctatctatttgggggtgtgcatagtggaaagtttatgagtcattagacttatacacacctgaggtcacttcc

SEQ ID NO: 12036 - DNA, 71 bp, Homo sapiens
gtgggaggtgattggatcatgggggtggattcttcatgaatggtttagcaccatctctttagtgctgttgt

SEQ ID NO: 12037 - DNA, 74 bp, Homo sapiens
tatattccctggctggagctgatgtgatttaaagccatctgtttctttcacttgaaatgcagttagctttgtat

SEQ ID NO: 12038 - DNA, 72 bp, Homo sapiens
gcaataaacatgtcatatgattatgcttgtttgctaatgccacatgctacacatggtcatagccaatgtttc

SEQ ID NO: 12039 - DNA, 73 bp, Homo sapiens
tattagctactttattgtcagtttcactttatgggtctctgtcatctttaaagtggaatcactactccagagt

SEQ ID NO: 12040 - DNA, 74 bp, Homo sapiens
gctatagaatggcttccacattgaggcaatacattcttaagaatatattgttctgagctgagtgagagatgtct

SEQ ID NO: 12041 - DNA, 73 bp, Homo sapiens
aattgaggaaggcatcagactaaatccatctacaggctagatttgagtgaattagggtttttcaggtttcctc

SEQ ID NO: 12042 - DNA, 72 bp, Homo sapiens
ggaaactgacctattcattgacgcattctggttctgagaactggcgcaggtcaggaaatgggacaagagatt

SEQ ID NO: 12043 - DNA, 72 bp, Homo sapiens
cctcaccctatctgaggggggcagctgctatgcagccaatcagttattcttggtgtatcatgggtgtaaggc

SEQ ID NO: 12044 - DNA, 74 bp, Homo sapiens
agtagccactaatactaatacttgtggttcactacatacttattgagtgaatgaacagccttcacagatgtggt

SEQ ID NO: 12045 - DNA, 73 bp, Homo sapiens
tgaaaagcccatggctcttccctcacaaatattgcatgacataatgttatttccatgcacttttcatatcatt

SEQ ID NO: 12046 - DNA, 73 bp, Homo sapiens
attgagtgtaatccacacacttgcttatttatacactatatacagcatatgtgtacagcatttggtgaattaa

SEQ ID NO: 12047 - DNA, 71 bp, Homo sapiens
aataaagaaggtcggctgtgatgaactatactctctgtagcctctctctgacaatttctttatacctatat

SEQ ID NO: 12048 - DNA, 74 bp, Homo sapiens
ttgtaagtaaagtgcacagccatgcctatgcatttagtattgtccatggctgctttcacactacagtggaaatt

SEQ ID NO: 12049 - DNA, 73 bp, Homo sapiens
aggctgactctcgttaggatgtaatgctgctggtgacttgaagttgaagccagtgctcatttaccattctaaa

SEQ ID NO: 12050 - DNA, 72 bp, Homo sapiens
cagggccagaactacacaagggcccaaggctttgggagcccacaccttgtaccagtgtggccttgatatgag

SEQ ID NO: 12051 - DNA, 71 bp, Homo sapiens
caagtgtgagagattttaacataatagggaattgtaattttcgtgttaaaaaattcttgaaaacatttttt

SEQ ID NO: 12052 - DNA, 70 bp, Homo sapiens
acacaaagcaatagtgcccatgccatgaagaatggcaaagtaattccatctgagagcattctttgctaca

SEQ ID NO: 12053 - DNA, 73 bp, Homo sapiens
acaagcatagcttataaaaatgcttaggctgggcacagtgtctcacacctgaaatcccagcattttgggaggc

SEQ ID NO: 12054 - DNA, 71 bp, Homo sapiens
tgctgggctcagagccagtagacttggggtgcatgcaacataatcagaaactaactggggcagccaaggca

SEQ ID NO: 12055 - DNA, 72 bp, Homo sapiens
gagcagactttacccaatcccctagaggagcagtttagcacgtcgacttgctacttttacgtgtacctctca

SEQ ID NO: 12056 - DNA, 72 bp, Homo sapiens
taaacattaacatttagaaagatctctactgcatgagctactaatgagttcattgagatccatcatgcaacc

SEQ ID NO: 12057 - DNA, 72 bp, Homo sapiens
aatggttcaacctaatcccaggtactgtgtttgcaaatggcaaggggtacctaacagttgcgttttgatcct

SEQ ID NO: 12058 - DNA, 72 bp, Homo sapiens
gccccgggcttcagtgcctggcttccttgaagtcttccttctggccgatgttgcccaggtaggcaatgatgt

SEQ ID NO: 12059 - DNA, 72 bp, Homo sapiens
aactccgatgtacattagggatccttgtctatataaagagagtagatggagttattatgctacatagagtga

SEQ ID NO: 12060 - DNA, 70 bp, Homo sapiens
ggcacctgcaagcaagagagggtatttcaatttcctctgaatagcttgactaatgatgatcacttgctat

SEQ ID NO: 12061 - DNA, 72 bp, Homo sapiens
tggtatgcttggggcccactcgagttgctagtcaccttgaattttccagtacccagaggtataaccagtgaa

SEQ ID NO: 12062 - DNA, 72 bp, Homo sapiens
caagtcttgggctaatgcctggccagatagatgggggctatccctcaacccttagggtaaaacagtccaggt

SEQ ID NO: 12063 - DNA, 73 bp, Homo sapiens
gaggctagaagcctcaaggtgtcagtggagctatgctgaatctctaggggaaaatacctccttcttcacagga

SEQ ID NO: 12064 - DNA, 73 bp, Homo sapiens
aactgggaaccatcactcctgacggggcaggtgagtgcgcctttaccgactttgggaacatgcagtggcttcc

SEQ ID NO: 12065 - DNA, 72 bp, Homo sapiens
taacttctaaatgatcgacaactctcaagcaataacttgactgttgaatagaagattaagaaaagttggtta

SEQ ID NO: 12066 - DNA, 72 bp, Homo sapiens
gaagttatcttttataagagaaattgacatctataaaggaaatctccatttgtaaacatgtctccctcttta

SEQ ID NO: 12067 - DNA, 74 bp, Homo sapiens
gattcaccataacccaaaggcccactaaactgttggtcccaaaccaaagtgctcggcttctaatggtgatttca

SEQ ID NO: 12068 - DNA, 73 bp, Homo sapiens
actaatgattgctattgaatattcctccagagtgggttagaactacctacagctagcacaaaaggcagtcgtc

SEQ ID NO: 12069 - DNA, 70 bp, Homo sapiens
catattgctgctctatgttgacaaaacaagaaatggctactacatgcccatagtgtttttctacaagtgg

SEQ ID NO: 12070 - DNA, 72 bp, Homo sapiens
cataccagaacctgtgggttacagcaaaagcagtgctgaaagggaagtttatggggttaaatgcctacatta

SEQ ID NO: 12071 - DNA, 73 bp, Homo sapiens
accattgcaacaaatctttcaccttgcagaagctggaaagggagagtctgcaaatcccaggaattttcattaa

SEQ ID NO: 12072 - DNA, 70 bp, Homo sapiens
gaggtttgagcaggatgttacgaagagaagaggctgagtctacatgacatcgtaaatctgctataaaagt

SEQ ID NO: 12073 - DNA, 72 bp, Homo sapiens
cagtgcattattacttttggtattaagcttaaataattgtctacttaccctgagctggtaatagcaaaatac

SEQ ID NO: 12074 - DNA, 72 bp, Homo sapiens
aatcaccagtcagccctgccaccgcttagttcatctgtcagccacagaaatattttggccaccatcactggg

SEQ ID NO: 12075 - DNA, 74 bp, Homo sapiens
cctggggtagtgacaatggccttctgaccctatggctcttcctgactgtggatagaattgatagcactttttca

SEQ ID NO: 12076 - DNA, 72 bp, Homo sapiens
gagattagctttgttggactgccacagagaatggtgcagcctgtgcagtttacctgttactattttaatctc

SEQ ID NO: 12077 - DNA, 70 bp, Homo sapiens
tgaggcctaaatatgaaccacagtgtttaagctttttaaatgctgctgccatttcataaaaattgccctt

SEQ ID NO: 12078 - DNA, 71 bp, Homo sapiens
aaagagcagagcagagatttcacatcagcctgtcttggtgtgaatcctgctgagtacataaccagtaattt

SEQ ID NO: 12079 - DNA, 72 bp, Homo sapiens
tgaatcatcttgtacgtacagctcagtcaatacgtcagaggactctagttgatctctgactgtaactacatg

SEQ ID NO: 12080 - DNA, 73 bp, Homo sapiens
ggagatgacctatgggccagtttcactgaggagggccaggcagcatgagctcctggtgctggtgcgtgaccaa

SEQ ID NO: 12081 - DNA, 71 bp, Homo sapiens
ttctgtagggactttctccgccactgagcttggcaaagagttcatatctaatctaagttcaacactgcact

SEQ ID NO: 12082 - DNA, 70 bp, Homo sapiens
ctggattgggttagggttacatgggtgtagagagttatcaaaagtgagtaactataatcctaaaatcgat

SEQ ID NO: 12083 - DNA, 72 bp, Homo sapiens
ttatttgagatgggatgtcacccaggatggagtacagtggtgtgatcatggctcactacggcctggaacccc

SEQ ID NO: 12084 - DNA, 74 bp, Homo sapiens
ccaatcaggacatccacagtgcaggcagtgactttgcttcagatgcagctgctgtgctttagaatgtgctccgg

SEQ ID NO: 12085 - DNA, 73 bp, Homo sapiens
ggtccctcagcggcgggcggcgcagcgcactctccagcgccggcgtctcctccagccaccagtctctgccgca

SEQ ID NO: 12086 - DNA, 70 bp, Homo sapiens
cagcagagctggcagaagccttccgccaggagcagggtaagtagcaggctggcggcaggcctaccctcac

SEQ ID NO: 12087 - DNA, 73 bp, Homo sapiens
ggctgagacttgccctgttatcactgtgttcgccccgccttgattacacagcatgagcagttcaagggcaggc

SEQ ID NO: 12088 - DNA, 73 bp, Homo sapiens
tgagtagctgtgactataggcacgtgatgccgcatgcggcccaaatctgtatttctgttttctcacttgctca

SEQ ID NO: 12089 - DNA, 74 bp, Homo sapiens
gagagggcgtagatgctggcatagtactgcatatgaggattgtccttcatgctgtcactcaccgaggtctcgtt

SEQ ID NO: 12090 - DNA, 72 bp, Homo sapiens
ctccttagaacaaggggctacgtgccagtcagttaaatgtcattaggtccgctttaggctggctgaggggga

SEQ ID NO: 12091 - DNA, 73 bp, Homo sapiens
catcccagggtacctcagcttcccacaccataccccacttcatcatggggtagctcagctccccacaccatac

SEQ ID NO: 12092 - DNA, 71 bp, Homo sapiens
ccaaacccagcagactaggaaacggttgaggctaaaattaggatccctactccgtgtcctcagaccagtgg

SEQ ID NO: 12093 - DNA, 74 bp, Homo sapiens
agaccatttcatctatcatattggcaaatctttttttttttaagataaaataaatgccagtgggggtgcgtgtg

SEQ ID NO: 12094 - DNA, 72 bp, Homo sapiens
atgaggtattcatctgtcactagttctttaatttgcccaaaggtcataggttatccagctaatggtggtgac

SEQ ID NO: 12095 - DNA, 73 bp, Homo sapiens
taaaaatcaattaataagccgggcgcggtggctcaaacctgtaatcccagcactttgggaggccgaggcgggc

SEQ ID NO: 12096 - DNA, 73 bp, Homo sapiens
cactgccctgacttgctgaaagagacttcttttcaagcagaaaaagccaggaagaaagccaacattgctgaag

SEQ ID NO: 12097 - DNA, 71 bp, Homo sapiens
tatacagtctgcctggcttgacaaatttgacttgggggcaccttgagtgggcggagggcaatcaaagtgat

SEQ ID NO: 12098 - DNA, 72 bp, Homo sapiens
atctccttgccttagggtttaacagccaaggagggaagaaggatgtgctggggagcgggggaataggggcca

SEQ ID NO: 12099 - DNA, 71 bp, Homo sapiens
actggatccccggcctcagctgaggggaatgtttccctagacctcttccaggtgccccctccagtgaccca

SEQ ID NO: 12100 - DNA, 70 bp, Homo sapiens
gctgcagctgttcacagagcttccgagatggaatgatattccccgacgggagagactctgtgtgtgggaa

SEQ ID NO: 12101 - DNA, 72 bp, Homo sapiens
attatgaagctacaattattatgaggcacaacagcagaggtgccaagagtggggtctttgaagcaagcactc

SEQ ID NO: 12102 - DNA, 72 bp, Homo sapiens
ctcgcagtgatattagggatcctgcaaactcccttttcgtggggtgcaaataccccaagttgatcacaagtt

SEQ ID NO: 12103 - DNA, 74 bp, Homo sapiens
taaaaacagctccgcgatttgacctcaccccctgccgccggaccacggtggtgtctgcagccgtgcagctagtt

SEQ ID NO: 12104 - DNA, 74 bp, Homo sapiens
tctatgcttccaccttgtccttctcaacagagcacccagagggattctgtgaaagtaaaatttaaacgctgtct

SEQ ID NO: 12105 - DNA, 70 bp, Homo sapiens
gctgaaagcccgaaggtctggaaacctaaggacaaagcagtgtggttcagtggtatggtcctgggctgag

SEQ ID NO: 12106 - DNA, 73 bp, Homo sapiens
atgggtccattgtaaggtgtaggaggagagttgtgtgacaatggaaacagagattatatgcattgaagatgga

SEQ ID NO: 12107 - DNA, 74 bp, Homo sapiens
tggccactggaggtgaccaagtagatgccagatattcatgaggtagtaggttgggctgggtgatgtttaaggtc

SEQ ID NO: 12108 - DNA, 71 bp, Homo sapiens
atctttccaagagattagcaccatttctttatggaatcatattgttgttccatgagtgagaccaagtctta

SEQ ID NO: 12109 - DNA, 72 bp, Homo sapiens
ctagtgatccatattggatggatgaggtatggatggattagaaaggtttatgtagcttacccaatgtggcac

SEQ ID NO: 12110 - DNA, 73 bp, Homo sapiens
cagtgtctagccgtagaggtggtatgatagtatgataattccacatgtcctgccttctgggctttttgacatt

SEQ ID NO: 12111 - DNA, 72 bp, Homo sapiens
tatttacacagttgccttaggagaggatcacaacttggaaagcttgaagcttctttattataaactatgtag

SEQ ID NO: 12112 - DNA, 70 bp, Homo sapiens
aacagctgataccattccgaaaaactgaggaggagggagttatctccaactcttctaaaaggccagcatc

SEQ ID NO: 12113 - DNA, 71 bp, Homo sapiens
tggtgaatgatagcttctctttggggaacatgtgtgctccctcaactgagaggttgtctttattaagtaag

SEQ ID NO: 12114 - DNA, 73 bp, Homo sapiens
gcacatgtaaacatccttgactgagtcccttaacacctaagtggagggacagagcctgcagtcagtcattgga

SEQ ID NO: 12115 - DNA, 70 bp, Homo sapiens
ataaagagtccagttatctgagttggtgttctcaaaacaggaagtggctcttttactagagttggaacat

SEQ ID NO: 12116 - DNA, 71 bp, Homo sapiens
catgtacatcaccccataaacagcgattgttcaagctaagagtcagtgtgtcctgtgcttgtgtgtgaggt

SEQ ID NO: 12117 - DNA, 72 bp, Homo sapiens
attctcagtgtggccaactaggaaacctgcattctttccgttgctgagtcacttgctggttgtacaggcttg

SEQ ID NO: 12118 - DNA, 73 bp, Homo sapiens
gagaagtgtggggcttgcatgggtgacattgcattcctggataagcagggagaaaagtcataaaggacagcca

SEQ ID NO: 12119 - DNA, 73 bp, Homo sapiens
ctctggtctcgcctgtagtcacagtcagatagagatgctgaagcagcctgagcctcccaggaatccctctctt

SEQ ID NO: 12120 - DNA, 73 bp, Homo sapiens
atctcctgccctgactccctgctcaaagcctccaggctccacagaggccgacgcttccagcaggagagagggg

SEQ ID NO: 12121 - DNA, 72 bp, Homo sapiens
tcagcttagaccaggacagaactggctactttcttgcaccacgtggaataattcagtccatggcctatcaca

SEQ ID NO: 12122 - DNA, 71 bp, Homo sapiens
tcttaatatccaagtggtgatatcaggaagaaagaagattttgaggatgatgccacgtagagatgaagcca

SEQ ID NO: 12123 - DNA, 72 bp, Homo sapiens
gaaatgaaatccttgtgagtcaggcagccatgccccagcacccccatggctaccaggcctgttgtagggcta

SEQ ID NO: 12124 - DNA, 70 bp, Homo sapiens
acagatgcgtgccatcatgcctggcttaagcttctatcatcttacgccacctagttcgtggtactttgtt

SEQ ID NO: 12125 - DNA, 74 bp, Homo sapiens
taggctggtgcagaagtaattgcggttttcgcattactttaacggcaaaaccacaattactcttccaccaacct

SEQ ID NO: 12126 - DNA, 72 bp, Homo sapiens
tgtgacactgtgactgaggcccgtctcctcctgccacgacgactcatgtgccctgagagacaggctcctctc

SEQ ID NO: 12127 - DNA, 72 bp, Homo sapiens
agtgtctgctaacatgcactgaaccccaagtagaaggggattaggtcctgggggccgtagatgtggttgctg

SEQ ID NO: 12128 - DNA, 72 bp, Homo sapiens
cggcttcctcagcgagcagtagacacggggagggctggagtttgcttctggccccctgaggacagggttcag

SEQ ID NO: 12129 - DNA, 72 bp, Homo sapiens
aaatgaaaagatattgagcctgtcctggggccacatccctgagatttcgtggtcaagggtaagagtcaggtt

SEQ ID NO: 12130 - DNA, 72 bp, Homo sapiens
gttcacttgaaataaatccgggtatttttcttgaatgtcacacgcgtccaggtcatacctgcggttacaagt

SEQ ID NO: 12131 - DNA, 74 bp, Homo sapiens
actcacggtccacatggcgctggagcgtcgggcaccatctacagggcttgaggccagcagcctagcctctgggt

SEQ ID NO: 12132 - DNA, 73 bp, Homo sapiens
cctgaactacaagaataatttaaagcctgtgtatgtgaatgaccatatactacatgccatattttggtatctt

SEQ ID NO: 12133 - DNA, 72 bp, Homo sapiens
agtggtgtcctgtggcagggctctagggctctctacctggtgcctagcccaggatgaaactctgacacgctg

SEQ ID NO: 12134 - DNA, 74 bp, Homo sapiens
ctctctgtgaggaaggatgggctggttaatattccctagggaggggtcacaaacgacccatgggggtcacagag

SEQ ID NO: 12135 - DNA, 74 bp, Homo sapiens
agctctggagctaagtgtgggtctgaatctccccgcgagggtccaggccttgcggccacagcagcaacagaagc

SEQ ID NO: 12136 - DNA, 74 bp, Homo sapiens
taaaaattctttgtttttgtctttgttggattgggttaattcaaaagccttgtcttcaagctgtgaagtttttt

SEQ ID NO: 12137 - DNA, 72 bp, Homo sapiens
ttctctcagtgcatgacagaactccacttacagtatatcagcagggggaaagtgtccatgagtgggaggtag

SEQ ID NO: 12138 - DNA, 73 bp, Homo sapiens
tcgccgataggctcagcgactacaactcccagcaggccacgcgccgcggcccgccgtgtactcttggcgcagg

SEQ ID NO: 12139 - DNA, 74 bp, Homo sapiens
ggcctggcaaaagaatggagacagggagagtggcggtgtttatgcgtcagtttgctgggcgtttcattcttggg

SEQ ID NO: 12140 - DNA, 74 bp, Homo sapiens
cctgacttccttgccagccacagggcctctgtaaaggcctgcctcgcgcaggtgttgaagtttagggacacctg

SEQ ID NO: 12141 - DNA, 74 bp, Homo sapiens
acacccacccaccaggagcctggcactgtggccgcagcactgagcagtgccccgtttctgtggcaggtgtccat

SEQ ID NO: 12142 - DNA, 74 bp, Homo sapiens
gcagaattgcttctccttctaagcttcaggtagttgttctaaaaaatgggagggtcagggaatgctggggtgcc

SEQ ID NO: 12143 - DNA, 71 bp, Homo sapiens
agagccaaggatccagggtacccacctgcccaggggctgaggagccagcggggcggggaaccagttctggc

SEQ ID NO: 12144 - DNA, 73 bp, Homo sapiens
ggcggggtagagccgggcttctggacatgtgtggtgttgcaggccccttcagagccctatgaacactccaggc

SEQ ID NO: 12145 - DNA, 73 bp, Homo sapiens
atgaggctgacaagggttacaatgggtgacattcacaaggagagaatctctcccttgttccttgcaaaagccc

SEQ ID NO: 12146 - DNA, 70 bp, Homo sapiens
tccatttcctcatctgtaaaacgggactgatgatcccagtgatgatgtcatgcaagctggctcagtgtgg

SEQ ID NO: 12147 - DNA, 72 bp, Homo sapiens
cactttgtgctgttttgcgggttggtatttgtttagctggcagatgtgctctgcatgaacaagtcaagggtg

SEQ ID NO: 12148 - DNA, 71 bp, Homo sapiens
cgtccagcccctactcttcactctccattggctcctcttgacccctttgatggctgagccagcaggagcgt

SEQ ID NO: 12149 - DNA, 73 bp, Homo sapiens
atacactgctggaactccactgggctgtgtttccttgtgggatgctgcagcgagagggatggtcatagttcca

SEQ ID NO: 12150 - DNA, 74 bp, Homo sapiens
gcgggggagagaaaccacagggtacctggattcttcaggaagccagagaggccccgccccacctgccacaatgg

SEQ ID NO: 12151 - DNA, 72 bp, Homo sapiens
gctgtgggcggggagtcaggggcccagggcacgggtccagtcctgtccctgactggctagtccacaaaagcc

SEQ ID NO: 12152 - DNA, 72 bp, Homo sapiens
ttgtggggtctgtctccatcagatcgactctccacttatttcacaagtctgatgtgaagagacaccttggtg

SEQ ID NO: 12153 - DNA, 72 bp, Homo sapiens
tagaggacagtgatggtggaggcagggaggccagaaaggaggctgtctcagtaatccagctatcagagggta

SEQ ID NO: 12154 - DNA, 71 bp, Homo sapiens
agaagccaagatggccagcaccaagccccttctgcatgtcccagggggtgaggaggccaggccagggaggg

SEQ ID NO: 12155 - DNA, 71 bp, Homo sapiens
taaagcgccccacggcagtgatgaatcccggcagaggcctctgaccccggcgggcctgtcgtcaggggtgc

SEQ ID NO: 12156 - DNA, 71 bp, Homo sapiens
tctgcctcccgcctttttctggggaccaaggggtctgacgtattccggatgtgggaagcgctatgcccgct

SEQ ID NO: 12157 - DNA, 71 bp, Homo sapiens
aatatctactaaaaaatcctgccattgaaagagcttcataaagtgacagaacatttcagctggaagggacc

SEQ ID NO: 12158 - DNA, 72 bp, Homo sapiens
atcgtgttttgggagtcctcagggcaaccccagcgtttggagattacctggaaggactcacgggacttggca

SEQ ID NO: 12159 - DNA, 74 bp, Homo sapiens
ctccccatcgggggctgcgattagaggactgctcgcttccagtgatgcttccctgaggatttgaaggagacggg

SEQ ID NO: 12160 - DNA, 73 bp, Homo sapiens
gggtgtgtcacattgccagggacagttttaccttcctccgcccctcccctctgtaggactcacccagcatctc

SEQ ID NO: 12161 - DNA, 74 bp, Homo sapiens
aggtgtgtctaaatagccgtgaaagggctaggaagtcacaagtcggcctcttaatttttacggatgcccttaaa

SEQ ID NO: 12162 - DNA, 71 bp, Homo sapiens
ggccttaatgtgtagaactgccctgaagccagtgggaagctactgttgggttttaagcaggaggcatggac

SEQ ID NO: 12163 - DNA, 82 bp, Homo sapiens
ccctcctcggcacttcccccacctcactgcccgggtgcccacaagactgtggacagtgaggtagagggagtgccgaggaggg

SEQ ID NO: 12164 - DNA, 74 bp, Homo sapiens
cataacgctgggggcggggagcgcaggccgggccagcggcgccacacgaacggccccgcgggacgctgccaccc

SEQ ID NO: 12165 - DNA, 73 bp, Homo sapiens
tggtggcattggagctgagtctttgataaataccccaatggcttatgtaccaatagtcattttcccctctcca

SEQ ID NO: 12166 - DNA, 70 bp, Homo sapiens
tgtgttgtttctgtggggggtgtctttgttaatgagttgttagagaactttaaaaactgaggctattcat

SEQ ID NO: 12167 - DNA, 72 bp, Homo sapiens
aaggcatctcagaataatggtagcaacaatgagagttccaataggtaatctgggtggccagagagagagaga

SEQ ID NO: 12168 - DNA, 72 bp, Homo sapiens
aaggtatgtacctcctttaagctgcttgggacctcccattaagtaggccaggaaattttaggatgggaaata

SEQ ID NO: 12169 - DNA, 72 bp, Homo sapiens
atagtgtatgatggttgaccttcatgggtggcagttagcttgctgctatctagggtcaataggcaactagac

SEQ ID NO: 12170 - DNA, 73 bp, Homo sapiens
gcgtcctgccactctcccaccccgcgcgcgccgcactcacctgagccgcgcctctgtccagcccgtccggcgc

SEQ ID NO: 12171 - DNA, 72 bp, Homo sapiens
ggggaggtaacagatttctccaagatgacatacatgtttttaaatgcaatgtagtgcctttccactatgcga

SEQ ID NO: 12172 - DNA, 72 bp, Homo sapiens
aaacatgaaacaatgtagctcatcagactgagcttatcatgcaactggtgggccagagttcattaactattc

SEQ ID NO: 12173 - DNA, 74 bp, Homo sapiens
ctcctcattccttaagtgtagatccctcataatcacttccttccaaagggtataccatggaaagggaataaaaa

SEQ ID NO: 12174 - DNA, 72 bp, Homo sapiens
ttttatgggaggtcttagggctataaacatgctgatacactattcactccacagcaggtgtgcaatcaccca

SEQ ID NO: 12175 - DNA, 71 bp, Homo sapiens
acaactttttccaagaaatggagaaatgtctctggtgtctatgagagtatgcatggggaatttttcacccc

SEQ ID NO: 12176 - DNA, 70 bp, Homo sapiens
aagttaggcaccatctgggtactctgttctctctaccagcatctgtatccagacaagacaggctctcgtt

SEQ ID NO: 12177 - DNA, 71 bp, Homo sapiens
acacccctaccctagacctaccacatcagaatcctcaggctggggaccaggaatccatattttaaaggtgc

SEQ ID NO: 12178 - DNA, 72 bp, Homo sapiens
gtgtgtgtggttgctactctcttcacattagtgaggctctttaaattcctgagaccagccagacacttagaa

SEQ ID NO: 12179 - DNA, 72 bp, Homo sapiens
tggtgcccatctgttggttctggctccatatgtatctttactctgggatcaggctgaaggaatttccccgct

SEQ ID NO: 12180 - DNA, 71 bp, Homo sapiens
tttttggttgtgggttgctctatagcgttgttgttgattttcccactggagccagcaccacagtgttgttt

SEQ ID NO: 12181 - DNA, 74 bp, Homo sapiens
ctaggcataatagctgggtgacgaagtgatctgtacaacaaacccccgtgacacaagtttgcctgtataacaaa

SEQ ID NO: 12182 - DNA, 72 bp, Homo sapiens
ttcaagggccctacagtgtctgttgaagctcatcaactgtcccattgtagtgtagaagcagctatggacaat

SEQ ID NO: 12183 - DNA, 74 bp, Homo sapiens
gactacttgagcttctaaacatctgggatcaggtgtaactttgatggtccaagaacaagtgatctgtcaagagg

SEQ ID NO: 12184 - DNA, 72 bp, Homo sapiens
acttacatgtattgattcacttaatctttaccacaactctaagaaaaggattaaatgagttaatacttgcaa

SEQ ID NO: 12185 - DNA, 73 bp, Homo sapiens
cccagctcacaggtgtgaaggaaggtcagtgcttttgggtcaaatccaaatacttttcttaacttttatgtga

SEQ ID NO: 12186 - DNA, 71 bp, Homo sapiens
ccacagtactttattgtgcccagtcagtaaggtatcttttaatgagggtacgtatattgttatttagacat

SEQ ID NO: 12187 - DNA, 71 bp, Homo sapiens
tgtttaccacagggatcttggtcctgatcacaattcatcatcttctgatatggaatctaggtaatctgtgt

SEQ ID NO: 12188 - DNA, 70 bp, Homo sapiens
ttgctccaatctctaagtgaacaatgttcagtgttatagttcatagagctggtggttcagtggttcagaa

SEQ ID NO: 12189 - DNA, 73 bp, Homo sapiens
ctccatctggctctgctttttgtcatcgccccacaaacaacgagctccagggagcacctgccatgattccctt

SEQ ID NO: 12190 - DNA, 72 bp, Homo sapiens
taaaatgtggtgttcccgtggtgatcagtggaggtctctatgtgatcatcttgctctgccccctgaaatgaa

SEQ ID NO: 12191 - DNA, 74 bp, Homo sapiens
agctagggagctagtggagttgggtttcaaagtcagaccatctgcctccagaagccccactgctgaccccagct

SEQ ID NO: 12192 - DNA, 70 bp, Homo sapiens
tccagcaatgtttcatatcttacttaaagtgagatctaccccagagacttggtggttcagtgggcaatca

SEQ ID NO: 12193 - DNA, 73 bp, Homo sapiens
actttcaaagtgctgcactgccagcagcatcctctgaatcctgtaggggccatgtggaggaggctgggcagaa

SEQ ID NO: 12194 - DNA, 70 bp, Homo sapiens
ctgctggcagtgcagcactttgaaagtttatgaagttttccacataggcaagatgctgtacatgtctaag

SEQ ID NO: 12195 - DNA, 73 bp, Homo sapiens
cttccattcatgtgggtgatgctgctgaacatgtcaagtttgtacaggacatgaccttccctcctggactgga

SEQ ID NO: 12196 - DNA, 72 bp, Homo sapiens
agtgcccattgaaacatctacagaggggtaacttgtcatttttattgcacaagtgagggtgctcctacggtg

SEQ ID NO: 12197 - DNA, 72 bp, Homo sapiens
attaactccagtatcaccatctgtatagagtgtattctcaccaatcagaacagatacccacgtgatataggt

SEQ ID NO: 12198 - DNA, 73 bp, Homo sapiens
tactgtggttcagggactgtcctacatggagaggtccagtacctggactttggggtctgatagtcctaggttt

SEQ ID NO: 12199 - DNA, 70 bp, Homo sapiens
gctgagccgcacacgctgcagataacgcatcaattccaggaaatgttatcgccaaacactgcctgcgtca

SEQ ID NO: 12200 - DNA, 73 bp, Homo sapiens
aacacactggacttggagtctctctactgattcccctgatggggttacacacttatctttgaaactctgttta

SEQ ID NO: 12201 - DNA, 70 bp, Homo sapiens
ctccatgactcttgcattctgtgtgcctatgggcttagcaccacttgaaatcctgcaagtctcatttgcc

SEQ ID NO: 12202 - DNA, 74 bp, Homo sapiens
tgtgacagagaagtggttcaattccagtctctaatgagttgtagggaaaggcaggaaaaggagcgagattgctg

SEQ ID NO: 12203 - DNA, 71 bp, Homo sapiens
gtgtaagtaagtgggtctatgatgggatggcatgtacagtcacaagcagcccagcaccagtgacccatggt

SEQ ID NO: 12204 - DNA, 74 bp, Homo sapiens
ttacgattaatctaggggaagcaatgtggttataattaatttctacccaattctgctccctatagtggggatgt

SEQ ID NO: 12205 - DNA, 71 bp, Homo sapiens
ttatttcctgatgatatgggtttggctgtgtccaccacccaaatctcatcttgaattgtagctcccataat

SEQ ID NO: 12206 - DNA, 72 bp, Homo sapiens
tttggatctcccacaaagtgtacactgcattgacgaaagggctgtggcactcagtacgtacccaagaagtat

SEQ ID NO: 12207 - DNA, 73 bp, Homo sapiens
agtaaagaacacacattcacagtggctagtttctattgcttatggaaattataactggaggattagatattta

SEQ ID NO: 12208 - DNA, 73 bp, Homo sapiens
caccttgcctcctaagaatgactaataataaaaacagcataggctttgtccttgctccccttcctggagaggc

SEQ ID NO: 12209 - DNA, 73 bp, Homo sapiens
cccactaaacctattgctcctccatagaaaatagttatgttagtctgtcccactgaagaactgggacggggca

SEQ ID NO: 12210 - DNA, 73 bp, Homo sapiens
acggacacatgtgcatgtacaccacacacacacaccaaataacacagtgtagtacatgcaacagagagcacgt

SEQ ID NO: 12211 - DNA, 71 bp, Homo sapiens
tgaggatgtaatttgcttggtcttagagacttaaattcagagtggctaagttccctttttactatcttttc

SEQ ID NO: 12212 - DNA, 73 bp, Homo sapiens
taagcacttcacttctcgatcatacagtttattcaatattgtaatgaaacttttccatgaagtggagcgggaa

SEQ ID NO: 12213 - DNA, 73 bp, Homo sapiens
ctgggttgggtggatgtagctttgtgagccactggtgactcggttctaccctgtaagcttaggcacagtgaga

SEQ ID NO: 12214 - DNA, 72 bp, Homo sapiens
gaacaagagaatgatatacagtaattcaggataggttatgtttacctgtgctaccattctgttgggggagaa

SEQ ID NO: 12215 - DNA, 74 bp, Homo sapiens
tctgcctcagcttccacccaggctgggaaggacacagggagatgcggaggtacagatcaaaccactggctattt

SEQ ID NO: 12216 - DNA, 72 bp, Homo sapiens
agaatagggctgtctgagctgagtgaacagcatctgttaaaactcagaggcaaggaaagcatgatgggctta

SEQ ID NO: 12217 - DNA, 73 bp, Homo sapiens
gggtgctccatagtatgcatggatccacatggtggaacgggcattaattgagcgcagggaacaactaggattt

SEQ ID NO: 12218 - DNA, 70 bp, Homo sapiens
gctgcatggaaatgggcaccttgcaaatgtgcgtggcatttgctccagagctgtgctgtcatacctatga

SEQ ID NO: 12219 - DNA, 74 bp, Homo sapiens
cctttttaatctctcatgtccagtttttttgaaggtatttgcaaaaggtcagggggcatttggagaggatgtgg

SEQ ID NO: 12220 - DNA, 74 bp, Homo sapiens
agttactcaggaggctgaggtaggaggttgatgctgcaatgctgagacggcaacactgcactccaacttgggtg

SEQ ID NO: 12221 - DNA, 72 bp, Homo sapiens
ggactctactacctgtcaaatactttgcaaatactgtgacacttgtgggtaggtatatggtcctcattttgc

SEQ ID NO: 12222 - DNA, 71 bp, Homo sapiens
aatgttagactagttgcataataaatttggattcaaaaccagaaatgaagccgtctggtatggcgtttatt

SEQ ID NO: 12223 - DNA, 71 bp, Homo sapiens
gtatttgtgagtaatccaggcgcgtactatcactgcagatacagagatggaatgtctgatgaaataatcat

SEQ ID NO: 12224 - DNA, 73 bp, Homo sapiens
gtcctgctgttataaatgttcatgtgtgaggccaggcgtggtggctcacacctgtaatcccagcactttggga

SEQ ID NO: 12225 - DNA, 72 bp, Homo sapiens
tctattagcctggtgttgtggtgcttgtctgtagttgcagctactcaggaggctgaagtgggacaagagact

SEQ ID NO: 12226 - DNA, 71 bp, Homo sapiens
gcctctacgctttcttcgaagcccccatggggctggcaggaatttgggcttggggagtgtgactcagtaga

SEQ ID NO: 12227 - DNA, 73 bp, Homo sapiens
gtgttttggatgtggctgggcccatgggaatatccctggaactaatgcactagactggtctcccagggaagct

SEQ ID NO: 12228 - DNA, 71 bp, Homo sapiens
gcagctggtttaaatttcttctcagaaaaagggcttttcttttctatcacattgccagcctgcaaatttcc

SEQ ID NO: 12229 - DNA, 71 bp, Homo sapiens
aaaatggtgtcttctgggagaggtttccatgggctgaagagaagaagcagcaagtagacctacaggcatta

SEQ ID NO: 12230 - DNA, 71 bp, Homo sapiens
ctccccgcctttaaagtggctgcctttcagttttcatccagaggctctgcttcccagcctgtcagaatggt

SEQ ID NO: 12231 - DNA, 72 bp, Homo sapiens
atgatagcctaatgaatctagttatgcaaaccagtgacctgggatcactggtgtgctggggccagctactta

SEQ ID NO: 12232 - DNA, 72 bp, Homo sapiens
tctgaggttttcattttggggtattgttttctgagccccaacagtagcctaaactgaaagacccttttttca

SEQ ID NO: 12233 - DNA, 70 bp, Homo sapiens
agtaattggtagcagtttcatgcaatccctgcactttataattataggaaaggctgctgttatcccaaaa

SEQ ID NO: 12234 - DNA, 71 bp, Homo sapiens
ccttgtccctagtctctgtcagtcagaagtgagagttggattagaagcataatgaaacaggcatagcaggg

SEQ ID NO: 12235 - DNA, 70 bp, Homo sapiens
ggactttatggttgaatcacattgccagggttgtttacattccacctaattgtgattctgcacccttacg

SEQ ID NO: 12236 - DNA, 71 bp, Homo sapiens
ggccagagtttgactgtttatttcacatcagttatcatgaaattattcataacaggaaaacaatactgggt

SEQ ID NO: 12237 - DNA, 74 bp, Homo sapiens
aagaattaacaccagtaataaaaagacaacactctagttggaatgtgtctcaaactcatgatttggtgaatttt

SEQ ID NO: 12238 - DNA, 73 bp, Homo sapiens
agattgagttccttgaatagggtgaatatgtcaaacaggtaagcaagttttgcagcgcactctgtgtcactga

SEQ ID NO: 12239 - DNA, 73 bp, Homo sapiens
tgaggcagaaaacagtcagtcattgtcaggtgcttggggtggggcataggcaggagagtgacaaaaaagttgc

SEQ ID NO: 12240 - DNA, 74 bp, Homo sapiens
gtggctatgcagtggtgatccatcatggttttttatcaatcttttccaaatgcttaggttgtccatcactgtat

SEQ ID NO: 12241 - DNA, 72 bp, Homo sapiens
atgaggaaactacagccttgatatatctgagtgctgattctcattcaggatcggtatgacatgttgtgcctc

SEQ ID NO: 12242 - DNA, 73 bp, Homo sapiens
gattggtagtccatttggagtagatttaagccagactttaaaaccataatctgcccttgactatctaggtcaa

SEQ ID NO: 12243 - DNA, 73 bp, Homo sapiens
aaggacatgtgtcacatttcccccagcaatgagattagctctgtgctgcttgaatgtatgagaaaaacaagcc

SEQ ID NO: 12244 - DNA, 74 bp, Homo sapiens
caggcattgtgctaggtcctcgggatgaatagatggataattaatattcttgatattcatgcttactgtccagc

SEQ ID NO: 12245 - DNA, 71 bp, Homo sapiens
ctgttgttttatttctatgtacgtcatatttagtgcattattacttttgcattagtgacattacatttatt

SEQ ID NO: 12246 - DNA, 73 bp, Homo sapiens
ctgggggacagtggcttgatctaggctcactacaagctccgcctcccaggttcacgccattctcctgcctcag

SEQ ID NO: 12247 - DNA, 73 bp, Homo sapiens
ctagcttgtggggtttctgctgagaaatctgttattaatcaggtaggatttcctttacaagttacttggtgct

SEQ ID NO: 12248 - DNA, 73 bp, Homo sapiens
ggctgcagccatctgaaggcttgttagggctagtcttccaaattgaccacacagagggctgacagttgatgct

SEQ ID NO: 12249 - DNA, 72 bp, Homo sapiens
tccagcaatttgaagatcatcttaggcatggcatgcagaaaacatgagatgatatattttagttgaagacaa

SEQ ID NO: 12250 - DNA, 72 bp, Homo sapiens
tttcatagatgggtgaatgaatgaattgtgaagtcttggctttgtgtgtacctatcatgcaaacagtgtaca

SEQ ID NO: 12251 - DNA, 73 bp, Homo sapiens
cccttgagctaacactgcccagagaataatgtatcctctttggccctgtgcaatcactcctgcttgtggggca

SEQ ID NO: 12252 - DNA, 74 bp, Homo sapiens
tgctcccgcgcctcgcctcggccgccgcttcctctccgcccgcgggggcggggagcaggcgccccgcgcggggg

SEQ ID NO: 12253 - DNA, 70 bp, Homo sapiens
actcagtgtctgagaggttttgcctgtggctcatcctgctacagtactattatcattgtcattttatgca

SEQ ID NO: 12254 - DNA, 71 bp, Homo sapiens
agagcatgcccaacctgcactggagtctagtttgtccatgcatgtcccaaccccagccctaggttaggtat

SEQ ID NO: 12255 - DNA, 71 bp, Homo sapiens
aaggggaccctgggtccagccacgaaaccactttttcctcatagccctctgggcctccttcttggctgcca

SEQ ID NO: 12256 - DNA, 70 bp, Homo sapiens
ctgctggctcctctcggggcgtcgcggccgccccctcccgcagcacgcccctgccccgcctggccgcgga

SEQ ID NO: 12257 - DNA, 72 bp, Homo sapiens
atcacagtgctatgagtcagttcaagtttatgggttgcctatactttgtttgtatgaactgattttttctgt

SEQ ID NO: 12258 - DNA, 70 bp, Homo sapiens
tgcattctccctaagagcactgcgggtggttcagggtctagtgtggagcacgtgttagctggggaaagct

SEQ ID NO: 12259 - DNA, 73 bp, Homo sapiens
gagaaggcaccttattagaagtgacagaatatatattatctatcactgactacccagtttaaagaagggtgtt

SEQ ID NO: 12260 - DNA, 71 bp, Homo sapiens
tgggtcttgcccaaggcccgcagtgaccactgcctggctactgcttctgttcctcaaggcccaagggctct

SEQ ID NO: 12261 - DNA, 71 bp, Homo sapiens
agagcccttgggccttgaggaacagaagcagtagccaggcagtggtcactgcgggccttgggcaagaccca

SEQ ID NO: 12262 - DNA, 74 bp, Homo sapiens
aacttcaggccctagagcagggctgggccagtatctgaattctgatagcagcactgccaggccagccccagggc

SEQ ID NO: 12263 - DNA, 73 bp, Homo sapiens
taatcatagaagtctgcaacttcttatctactgaggaagtatgcaagaactgctaactcatgccccccatatt

SEQ ID NO: 12264 - DNA, 72 bp, Homo sapiens
cccaccaacatggcaacgattcagaggcagaaggtgaagttgtgtgtcgactgcctgatcttgagaaggatg

SEQ ID NO: 12265 - DNA, 74 bp, Homo sapiens
tctgtaagagccatcagtggatcccgcctagaagggcttagccctcttgaagggaaaggcgccagctttggagc

SEQ ID NO: 12266 - DNA, 74 bp, Homo sapiens
ccctgcaacacacaggaggatcatttgagtcgtattgatagtaatctgaatatttgtctcagaaatcttactgt

SEQ ID NO: 12267 - DNA, 74 bp, Homo sapiens
ttaccttgtataattgcatttgtggttcagtagttattaggaactgacctagatatgtatcatatatgaagtga

SEQ ID NO: 12268 - DNA, 73 bp, Homo sapiens
cagccttgttgctcacacaaagcctgtttggtgaactctcttcacacggacgtgcgtgacatgaacttttgct

SEQ ID NO: 12269 - DNA, 74 bp, Homo sapiens
gaacctctgtacactgttggtgggaatgtaaaatggctcagccacactttatggaaaatagtgtggcaatggtt

SEQ ID NO: 12270 - DNA, 74 bp, Homo sapiens
aggctatggcttccctttccaccagtgtggaaattttcaagtaaggattctatctggaatgaatgtgccagtgc

SEQ ID NO: 12271 - DNA, 74 bp, Homo sapiens
ctgagctcctcatccactcgtatgtcctgaggggaaaaaaaaaatctatctcaaacagtggatggggtgcaagg

SEQ ID NO: 12272 - DNA, 70 bp, Homo sapiens
aataacagcaaactggcaaaacaatgtcaggagaggtagacttcaactgtaagataaagccattgttttc

SEQ ID NO: 12273 - DNA, 74 bp, Homo sapiens
ggagtcaagaatacattttgcttctagattggtgtctgaaatgacattaattaaaatagctgaataatcatggc

SEQ ID NO: 12274 - DNA, 72 bp, Homo sapiens
gtgatctggtgatggtaactttaaggaaatctagagtggatgcaatttatatacctcagatcagttaatgac

SEQ ID NO: 12275 - DNA, 71 bp, Homo sapiens
cacttgctgtatggggagaaagtgcttctatctaatataatacataccagcgctgccacatattcagtctg

SEQ ID NO: 12276 - DNA, 72 bp, Homo sapiens
acaacaaacatggcaataattcaagttcaaaaatacagacgggtttgaattaacattgcacaatgatttgtt

SEQ ID NO: 12277 - DNA, 70 bp, Homo sapiens
agaatgcaatttgttggtctaatgcacaaagtgacatgtccaagaatgttcattgcactctaatttatag

SEQ ID NO: 12278 - DNA, 74 bp, Homo sapiens
atagttctgtgtaattttattgcatatgtagattcatgtaacaagcattccaattaagttacagaactattcca

SEQ ID NO: 12279 - DNA, 71 bp, Homo sapiens
atttgggagattacagagcaataaaaaggccttcaatgtaccacatggcctatgaatgtccctataaatta

SEQ ID NO: 12280 - DNA, 74 bp, Homo sapiens
tgtctgagtgctcatggtttctcctcaacactcacataatatagagagcttatcatcagtgcactgacccatta

SEQ ID NO: 12281 - DNA, 74 bp, Homo sapiens
ccttgcagaaaacccttcgatatttttctagtgctcttaaaagtccacaattggccgggtgccagttgcagtgg

SEQ ID NO: 12282 - DNA, 72 bp, Homo sapiens
atcttcactcacagaggctgtgcttacttagtatttagcacctagagaagctaatttttaacatcctcttat

SEQ ID NO: 12283 - DNA, 72 bp, Homo sapiens
acatgaagaagttgggctctgtgggaccagaggcttggctcagaccctagtccatgatcttttccaatgttt

SEQ ID NO: 12284 - DNA, 73 bp, Homo sapiens
cccgggctggagtgtggcgcgacctcagatcactgcaacctccgccttctggtttcaagcaattctcctgcct

SEQ ID NO: 12285 - DNA, 71 bp, Homo sapiens
ctgaatcaaaagaatgttttaacttgtggaatgaatccataaagtggaaagcactttcacagatatctttt

SEQ ID NO: 12286 - DNA, 73 bp, Homo sapiens
ctcacccactcaccaacctgggccaccacagccaagaaatcccagtggttcagttcagtgaaggtgagggggg

SEQ ID NO: 12287 - DNA, 72 bp, Homo sapiens
atacttagctttagtctggtcttggtgacgatcagtagctttcttatgtatcgcttgacaacagattgaaat

SEQ ID NO: 12288 - DNA, 70 bp, Homo sapiens
acccactagggccaaagaatggtttctgttgagcaactagaggaagccagctaggggagtagaagatgtg

SEQ ID NO: 12289 - DNA, 72 bp, Homo sapiens
ttggtgtctgtttgtcaaatacttggtcctgtgttcctagcatgccaaacagcactgataggaattaatatt

SEQ ID NO: 12290 - DNA, 72 bp, Homo sapiens
aggcagtattgttcagaactgaaatatagatgaagagaaattcatctaatttgcatccacttttcattgcct

SEQ ID NO: 12291 - DNA, 71 bp, Homo sapiens
tggtggaaggtgtttgatcatgggggcagatcccccatgaatggcttagcaccatttctttggttataagt

SEQ ID NO: 12292 - DNA, 72 bp, Homo sapiens
tcttccagggcttgcgatttgcttgtctatctgtgacagaagcacatcgtggctcgcacactaacagctaca

SEQ ID NO: 12293 - DNA, 72 bp, Homo sapiens
aaattagcagcattaggtctataggtggctgcttaactaattatgaactcagctgcttaaatatatttgctc

SEQ ID NO: 12294 - DNA, 73 bp, Homo sapiens
cacagactagttgagactgcaattctaggtgcagtgatctgtggaagcaggagtgacctgttgatggagctca

SEQ ID NO: 12295 - DNA, 74 bp, Homo sapiens
caccaagcttccttggtaacagcggccaggtgatagggaacattttataaattaagccgcttttgccagaaaag

SEQ ID NO: 12296 - DNA, 71 bp, Homo sapiens
tggttttagaaggttgcgtgttcttcgagttgggctaaagtagagttcgttgtgctgtttctgactcctaa

SEQ ID NO: 12297 - DNA, 72 bp, Homo sapiens
gggattttgctgaaatgcaaaactgattcagaaggctggggataaggccagggattctgcatttctaacaag

SEQ ID NO: 12298 - DNA, 74 bp, Homo sapiens
tattccagatcgtctaggtgtatagtaggctataccatctaggtatagaaatagtctgtgatgttgacacaatg

SEQ ID NO: 12299 - DNA, 72 bp, Homo sapiens
aaggcactggcaggttcagctatctggtgagggctgcctcctccggatgggaagaatgttgtgtcttcacat

SEQ ID NO: 12300 - DNA, 74 bp, Homo sapiens
caaagtactaggcttaaaggtgtgagccaccataacgcccagccccctactcttattttttaagtttatgcttt

SEQ ID NO: 12301 - DNA, 73 bp, Homo sapiens
ggctgggtgcagtagctcatgccactcagcattttgggaggccgaggtgagcagatcacctgagttcaggagt

SEQ ID NO: 12302 - DNA, 71 bp, Homo sapiens
gctttgcattccagcttatccactttatttgatttgctcatctactagttggttagtacacaatgcttagt

SEQ ID NO: 12303 - DNA, 72 bp, Homo sapiens
ctttcacgcttggccaagggactcctctttttcttctttggctcctgagtcaagcttgaatattttttggat

SEQ ID NO: 12304 - DNA, 73 bp, Homo sapiens
cccttatgggcctggctgtgatgagatggagcagggactccgcttagaggtttgctgggcaccccaagcatgg

SEQ ID NO: 12305 - DNA, 73 bp, Homo sapiens
agtccctcctgcctggtacatacttaagtgattagttgatgtgggtgattaatgtggtgcagtggggaggaac

SEQ ID NO: 12306 - DNA, 71 bp, Homo sapiens
aagcacatactctggagctacattgcctggacccaaatcctggctgagcatttccatgctgtagtggttaa

SEQ ID NO: 12307 - DNA, 72 bp, Homo sapiens
ggagtttccccactatattccctacgtctgaccaagagatgaaagaagagtagtagtttatgggcaagtcct

SEQ ID NO: 12308 - DNA, 73 bp, Homo sapiens
cagctcaggccttcatcatgtgtcacacggacaactgcagtagtctgctgattggtcttccttggtctcactg

SEQ ID NO: 12309 - DNA, 74 bp, Homo sapiens
agaaagaaatgaaaggcatccaaatagggataaaggtagtcaaactacccttgtttgctactgattcagtttct

SEQ ID NO: 12310 - DNA, 70 bp, Homo sapiens
tttggatgatatgtaatattattagtgtttattagcttctaaaattgtattatatttatcctactccatt

SEQ ID NO: 12311 - DNA, 70 bp, Homo sapiens
actccttgcattctctttcttacaagctattttgaggatattgagtctcataatagactaagagaaccat

SEQ ID NO: 12312 - DNA, 72 bp, Homo sapiens
ctggagccttttacagatacaaaaataatgtagaaaataatgattctggattagatctagtctgtgataagg

SEQ ID NO: 12313 - DNA, 72 bp, Homo sapiens
tgtgtatagctcacatcatggtttatagtaactgagcaacatctttccatgatgaatgtgctgcggcgtttt

SEQ ID NO: 12314 - DNA, 73 bp, Homo sapiens
tttatgtgttgagcactgtagatgagtaagatgaatttttatcttattgaacatcaataatgaataatatcga

SEQ ID NO: 12315 - DNA, 74 bp, Homo sapiens
acttctgtcagtttgtcaaactttttctctgtccagttttgttcccttgctggcgaggagttgtgatcctttgg

SEQ ID NO: 12316 - DNA, 71 bp, Homo sapiens
aattaaatttatacaaaggcagaaaagatatgaaaccctattatatctcttttttcctttgtattctttct

SEQ ID NO: 12317 - DNA, 74 bp, Homo sapiens
atatataaatacacgtgtgtgtgtttgtgtgtgtgtgtgtgtgtgtgagtgtgtgtgtgtgagtgagtgatttc

SEQ ID NO: 12318 - DNA, 73 bp, Homo sapiens
tgaagtcttcaatgcccagacattgatgaatatttacacgcatcaagaacttcttggaaaatatgacctcacc

SEQ ID NO: 12319 - DNA, 74 bp, Homo sapiens
cttggggatgggacccaagtctaaacataaaattcacttatgttttatatatgtcttatacacatagcctgaag

SEQ ID NO: 12320 - DNA, 72 bp, Homo sapiens
aataccagaagttctcacttataaatggaaactaaactaaatgatgagaactcatggttacatagcagagaa

SEQ ID NO: 12321 - DNA, 74 bp, Homo sapiens
ttctcaggggatatatattttctatctttgaacaggcagagattgacatattttacctgtactggaggtgaatt

SEQ ID NO: 12322 - DNA, 72 bp, Homo sapiens
tctagaagtacttgttttacaaatctggggctccaatgttggatgcatctgtatttaggatagtcttcttgt

SEQ ID NO: 12323 - DNA, 74 bp, Homo sapiens
gaaatactggtattattctcctacccacaaccatagcaacagccttcataggctatgtgcttccatgaggccaa

SEQ ID NO: 12324 - DNA, 72 bp, Homo sapiens
tctgactgaatatactgctatgtataatgttgtttttgttcttctatagcttatcaagtcagataatttctg

SEQ ID NO: 12325 - DNA, 72 bp, Homo sapiens
tgtccattatcaactaatggcagcggtttaagtcaggttccagcagggaatctaaaagaatgttgcataatt

SEQ ID NO: 12326 - DNA, 72 bp, Homo sapiens
tgtcttaatactgcctgtgccatctctctgtggtccgtggtatagttggcttatatatgtggtatttattag

SEQ ID NO: 12327 - DNA, 73 bp, Homo sapiens
aggctcattcaaagttgttctgttgcacaggaggccaggtagaaccatgtgggataggtataataggttggaa

SEQ ID NO: 12328 - DNA, 71 bp, Homo sapiens
ggtttcaaataatgctttgcacatagcaggcattctgcactggtaactacaggaacgcattactgaaatag

SEQ ID NO: 12329 - DNA, 70 bp, Homo sapiens
aagggtagcaccataactttatgatcatcatcctggagattttatttctgtccttggtttgcccttacta

SEQ ID NO: 12330 - DNA, 70 bp, Homo sapiens
agctggaatctgcttaagcctactgaattcctagggggagggctgaccagcacctgctgatgctgcctgc

SEQ ID NO: 12331 - DNA, 70 bp, Homo sapiens
atcgtgactcgcaatgatgctgcaaaacagaaatatgcgttttgcataattgccaatgcagctgcagcac

SEQ ID NO: 12332 - DNA, 73 bp, Homo sapiens
gcgcttggctcatgtacgagatctgtcaaagacctttcgtgtctctgacagcacttaatggtttgatctaggc

SEQ ID NO: 12333 - DNA, 70 bp, Homo sapiens
tcctttcctggttgtttgatttggggcaagttatttaacctctgtggccccactataaaatttggctaat

SEQ ID NO: 12334 - DNA, 74 bp, Homo sapiens
ctgaatctattgataaaatcgtgactttttgtttttagcttgttgatgtgatgggtcacatttagttgattttc

SEQ ID NO: 12335 - DNA, 71 bp, Homo sapiens
cttgttattggtcttttcagagtttctatttcttcctggtttaatctagggagttgtatatttccaggaat

SEQ ID NO: 12336 - DNA, 71 bp, Homo sapiens
tggctgacattgacttctccactgcaaccatcgagttcattgtctcctaaaccttgccatggaggcctgtg

SEQ ID NO: 12337 - DNA, 71 bp, Homo sapiens
cagagtaactctccagcataccattggactgtaatgttccacatcccatccagtggcatgacaatcagagt

SEQ ID NO: 12338 - DNA, 71 bp, Homo sapiens
ctccattacacaggctgagtgcagtcacatgatcatggctcagttcagcctttctctttcggtctcaagta

SEQ ID NO: 12339 - DNA, 72 bp, Homo sapiens
gctgaatcactgccctgaggattctttctgttctgaggagagcttgtagttaatagcagaacctaaatagtg

SEQ ID NO: 12340 - DNA, 73 bp, Homo sapiens
tctatagtacagatcaaataatctggtactatatatgtatctaaagtacagatcaaataatctgtactataga

SEQ ID NO: 12341 - DNA, 71 bp, Homo sapiens
tacaaaagttgtattatctgctgactcagtggtttcctcatccactgaggtagtagctttagtggttgtgc

SEQ ID NO: 12342 - DNA, 73 bp, Homo sapiens
ctgttctggtttctccccatctttatggttttatctatctttggtctttgatgttgatgacctacagatgggg

SEQ ID NO: 12343 - DNA, 71 bp, Homo sapiens
ttcaaaaaaaagacaccttttgtgggtgaggctgggggaaacaggccctcttatacttcacttgtggaaat

SEQ ID NO: 12344 - DNA, 71 bp, Homo sapiens
agcctcccaaagtgctgggattacaggcgtgagccaccgtgtgcagccttcagctgattttagagtcttac

SEQ ID NO: 12345 - DNA, 71 bp, Homo sapiens
gcctgggcgggggagcagagggtcagggcgaggagccgccgccccgtcccgtccgctgcgccgccgccgcc

SEQ ID NO: 12346 - DNA, 70 bp, Homo sapiens
gggattacaggtgtgagccaccacagccagccagtatgacctatcttaatcatcagctcaactgtaattt

SEQ ID NO: 12347 - DNA, 72 bp, Homo sapiens
tgattctcaaagtaggaactgaagagccctaagtgtccctgagaccctttcaaagggattgaaaggtcctag

SEQ ID NO: 12348 - DNA, 74 bp, Homo sapiens
atgggagttcatctgtgatttggctttcgactttcctgtggttggtttaaagtaatgctagtgagttttgcaca

SEQ ID NO: 12349 - DNA, 70 bp, Homo sapiens
aaagaactggttttatgaatgtatattaacctatatctattcataatcccaagtagatttttgttcttag

SEQ ID NO: 12350 - DNA, 70 bp, Homo sapiens
ctacttggctcagttcagctggataaaggtttttaccttcatgtagtgttttctgcagagaaaatcatgc

SEQ ID NO: 12351 - DNA, 72 bp, Homo sapiens
acagaaagttacaattcagctatctaaatatttgatacagtggatggagggactactgtgctttctgtgctt

SEQ ID NO: 12352 - DNA, 74 bp, Homo sapiens
ttacaagagctgctaatcttgtgtttctgggcactggcaaaccagtggctgagactgatggaacactctctctt

SEQ ID NO: 12353 - DNA, 74 bp, Homo sapiens
agcagtcacaacgggcattgagtgagacccagtgctctgctggcttcaagtctcacctagtacagtcccagtgg

SEQ ID NO: 12354 - DNA, 73 bp, Homo sapiens
taaatgcatgtgggaacccgattccctttggcaggtgtggagaaatgtcattggtttggtccacagagatgct

SEQ ID NO: 12355 - DNA, 74 bp, Homo sapiens
tattttcccacattgtgcaggaatcatatctagaggctaggtttcctacactctcagcttggcattctttgtaa

SEQ ID NO: 12356 - DNA, 72 bp, Homo sapiens
aaacaaattggcatccccagggatgggacccaggctaacagcacgtagggattgggcactataggatgtatg

SEQ ID NO: 12357 - DNA, 71 bp, Homo sapiens
aggggagggaaggggttgtgtcaccgattcaggactgttttgtctatctccttagagcctctttcagcgtt

SEQ ID NO: 12358 - DNA, 74 bp, Homo sapiens
ttacatatactatatgctatatgtatatatatgttattacatatactatatgctatatgtatattaaatatact

SEQ ID NO: 12359 - DNA, 72 bp, Homo sapiens
acaattgggtttcagagcctgcaaggcaagttttctctgactctgggatgtccagtagtgttcagtgctctc

SEQ ID NO: 12360 - DNA, 73 bp, Homo sapiens
acatcttgccccactgagcaaaatgtggtctcataatctcaaccaaattgcaccagtgcaccaagttgtcata

SEQ ID NO: 12361 - DNA, 73 bp, Homo sapiens
cgccccagcaagcgcgggtctccaggcgcccccgcgcggcccgcgtgggatgcgccctcggcccgggcgctga

SEQ ID NO: 12362 - DNA, 73 bp, Homo sapiens
agagatagggtctcgcgatgttgcccagggctggtcttacatactcccaggctcaagtgatcctcctgcctca

SEQ ID NO: 12363 - DNA, 74 bp, Homo sapiens
tccttggatgaggcagtactctgccactaaggcagtccccagaggggctgtccacagaaggctgcctgccaagg

SEQ ID NO: 12364 - DNA, 73 bp, Homo sapiens
tagtctcccactctggagctgaacaggaagctcagaccactgtgcaccccacagattgccagaggcaacagag

SEQ ID NO: 12365 - DNA, 71 bp, Homo sapiens
ttgggaacctggatatggtcatagtctgacttaactcctgtcattctaagcatgttcaccatctatgttgc

SEQ ID NO: 12366 - DNA, 74 bp, Homo sapiens
tggttctggctcagtaagttacttcctctgggactttagtcaaatctgaatatcctctgttgcagtatcttctg

SEQ ID NO: 12367 - DNA, 73 bp, Homo sapiens
atttgtgttttcatttcctatgactctgtgcagaggctaggccactgggccttggcttttattcagaacatgg

SEQ ID NO: 12368 - DNA, 72 bp, Homo sapiens
cagtcccacgggagacatacagagtgggtgggaaagatctgagtttgtcagtttgctgggggtggggttgaa

SEQ ID NO: 12369 - DNA, 73 bp, Homo sapiens
tgtctggtggtcatcttgtttctcagggactgtcacttggggaatctgtcatcttgtcaaaatggggaagtct

SEQ ID NO: 12370 - DNA, 72 bp, Homo sapiens
ggtgattgggtcatggaggtggttatccccatgctgttctcgtgatagtgagggagttctcatgagatctaa

SEQ ID NO: 12371 - DNA, 72 bp, Homo sapiens
taacatggctatatggtaatgagtcaaatatgggaagtaattgttttgcatgaacgaatttccatagccttt

SEQ ID NO: 12372 - DNA, 74 bp, Homo sapiens
atggcttaaagagaccctttgcattctgtgaaaggcagagagagggagagaaaggtgtctacacagccaggatt

SEQ ID NO: 12373 - DNA, 74 bp, Homo sapiens
tttcctcatcatccccattccagaaccttgagattattgcaacactgggcgttggtgggttcggaagagttgag

SEQ ID NO: 12374 - DNA, 74 bp, Homo sapiens
agtctgttctcagggccgggtgccgtccctaggaattcaagtaataacttaatagcctctggcctctgcagagc

SEQ ID NO: 12375 - DNA, 74 bp, Homo sapiens
gggccagaggggagcccaatgccctgaaagtagagtctgtggcctggcagcattgtgtgaaatgcctctgggtc

SEQ ID NO: 12376 - DNA, 70 bp, Homo sapiens
ccagatgctgcagggataggaacagccccatccaggtgggcgtcctcttcagcctttaagtcagaaacaa

SEQ ID NO: 12377 - DNA, 72 bp, Homo sapiens
tttccaaagtgctaggattacaggcttgagctaccaagctcagcctttgaaggctttttttttttttttttt

SEQ ID NO: 12378 - DNA, 74 bp, Homo sapiens
tttcagcacaagctactctacatgtgtttggaaagaagtggatcaagatggccgactgagcatatgtgtttgtc

SEQ ID NO: 12379 - DNA, 72 bp, Homo sapiens
tattcgaagccttgaaacaatctgaccactgatcagtcttctagcctgatttctatcatgctttccctggct

SEQ ID NO: 12380 - DNA, 70 bp, Homo sapiens
gagcaggtaaaagtggttcagggagggctgggatctcctggtggtataacgaaccggtgatgccctatga

SEQ ID NO: 12381 - DNA, 73 bp, Homo sapiens
aacttttgtttatagcagaatttagtagacgctttacaatagtggaggggtttcctaactcagaggcataaac

SEQ ID NO: 12382 - DNA, 70 bp, Homo sapiens
acaagttccttagcagcagaactaatccttagcaggattagttccttagcaccagaactagattagcaag

SEQ ID NO: 12383 - DNA, 70 bp, Homo sapiens
aaaatgggaaaatattaggaatagtctgactcagactaacttacctattctatactattttatagtttac

SEQ ID NO: 12384 - DNA, 74 bp, Homo sapiens
ttaattctcccttgaattgtaccaacatcttcacatgttctgggattaagacgtgaatatcttggtggggggag

SEQ ID NO: 12385 - DNA, 71 bp, Homo sapiens
gtgtttctgttctgtcagccattctctaatatttccatttacctgctcagcaaagggaaggcttaggaagc

SEQ ID NO: 12386 - DNA, 74 bp, Homo sapiens
aggtgagagcaggacttgagaagtggcagcacatgaaacaagcaagcagagccactgccttcctgaggctacca

SEQ ID NO: 12387 - DNA, 73 bp, Homo sapiens
gattacttgagcccaagagtttagggctgcagtgagctacaatagcgacaccgcagtccagctgggatgacag

SEQ ID NO: 12388 - DNA, 74 bp, Homo sapiens
caacagcagatgccaacactgacccctgatatggcaccattgccatatgattagcagctgtctggtagcaggct

SEQ ID NO: 12389 - DNA, 72 bp, Homo sapiens
ccatacaacacctctttacagttactaacatgtggttagtgtctcattgagtaatataggctgataatggca

SEQ ID NO: 12390 - DNA, 72 bp, Homo sapiens
tggcaaagctggaatttgaacttggatctgtgaatccaaagttcttatgttacatcattgctacctctcaca

SEQ ID NO: 12391 - DNA, 74 bp, Homo sapiens
aaaacactaacatgctgggtgcactggctcatgcctgtaatctcagcacttcagaaggcagaggctagtggatc

SEQ ID NO: 12392 - DNA, 72 bp, Homo sapiens
gaaagccaagagagccaattgtatagttcccgttcaagtctgaagacctgagaaccaatgatgttgagttct

SEQ ID NO: 12393 - DNA, 73 bp, Homo sapiens
tggtgcttactatgtagttatgaaaatggtcattaatcaaaccatcacaataatgaaaactgcataggaccaa

SEQ ID NO: 12394 - DNA, 72 bp, Homo sapiens
gcttccatgaggagttcttcagagtttcgccttgagatatcgggggcagatttcctcaaattaatttgctct

SEQ ID NO: 12395 - DNA, 72 bp, Homo sapiens
atctcccaccacagaccctccgtagccaaccctgagactggaggatctcagttgtgacatagttcactctct

SEQ ID NO: 12396 - DNA, 70 bp, Homo sapiens
tattttctgaaaatacagttgaagggctcctgctgccaaggtagcagttgacccgaagtgtttctccctt

SEQ ID NO: 12397 - DNA, 70 bp, Homo sapiens
attttagggatacacagatgaatcagttcatgtatttttcatcacatgttccttgaatacccactgtttg

SEQ ID NO: 12398 - DNA, 73 bp, Homo sapiens
tgttagtgagaatcactcaatatgggcacattagcaccaaactggcagcccagtactatgaacaaattctcat

SEQ ID NO: 12399 - DNA, 71 bp, Homo sapiens
tggcaacatttaaaggaggccatgaaatttttatcagtctagagaattgatctcctttaaggtgactctgg

SEQ ID NO: 12400 - DNA, 70 bp, Homo sapiens
aatgtaaagtaggcaaagctcaaagtggggactgaagacaaccagctgtacaatagtccttgtttccttt

SEQ ID NO: 12401 - DNA, 72 bp, Homo sapiens
agcagcatgaggacaaactaatacagagacaaacttaagttatatgtgttacttgttggttctccttagttg

SEQ ID NO: 12402 - DNA, 70 bp, Homo sapiens
aacaaggagctaggtggagggggggtaaaaaaaatggccacttttataatccacaacaatccaaaatcat

SEQ ID NO: 12403 - DNA, 70 bp, Homo sapiens
tattttcttcaatgttttgaggaagtaatttaggagaaaacctcaactgtgccattgaagatagtcaact

SEQ ID NO: 12404 - DNA, 73 bp, Homo sapiens
taactacttgccaggattgttatggggattggatgtttgtaaagtatccagcactatgccaagaatatagcaa

SEQ ID NO: 12405 - DNA, 70 bp, Homo sapiens
cactgtttaccacaacctaaactcatattgcttgtttgtggggtggggagggggggggtgcaagggggga

SEQ ID NO: 12406 - DNA, 71 bp, Homo sapiens
gaagggttagcacattgaggtctgctattgtaagttagagaattagtaatactcccatgagcccacccttc

SEQ ID NO: 12407 - DNA, 73 bp, Homo sapiens
tggctgaagcagctgcggaaagacaactgcgctaccgagtttcggtgggagtagtcttagcggattttgagcg

SEQ ID NO: 12408 - DNA, 74 bp, Homo sapiens
tgcagtaacctggcttagtgacggcttgaaatagaaagcaggagaaattagagaagtgagaactgagcagtact

SEQ ID NO: 12409 - DNA, 74 bp, Homo sapiens
caagtactcagttttcccaggaatcagatgagatgagctggactggaggttgggatcaagcatagattaggaaa

SEQ ID NO: 12410 - DNA, 74 bp, Homo sapiens
gcatctgaacattagaggcattgtgtcttaattgctaaaccagctatgattatgctttctatagtagaaaatgt

SEQ ID NO: 12411 - DNA, 70 bp, Homo sapiens
ttgtcagctgtcacagcaaaactgtgagaagggaggggaggtcggccccggcatcaggtggtgtgtggag

SEQ ID NO: 12412 - DNA, 72 bp, Homo sapiens
ccatagagagtttctgctatttgctcctatagcaggcaggagtttgagattacagtgaactataatggtacc

SEQ ID NO: 12413 - DNA, 72 bp, Homo sapiens
atttctggttaatgctctcaccaggtcctcttgggtgtacattttcactcttttgttgttaagagcactcag

SEQ ID NO: 12414 - DNA, 70 bp, Homo sapiens
cccagcagccacatcccagctcctaggggccaaggcctttgcccagctgcatggcaagcctgtcatcagc

SEQ ID NO: 12415 - DNA, 72 bp, Homo sapiens
taaaaactatgtttatttcatggtgtggatcattttttaagtaatccaaatatgggtaagacatccacaaag

SEQ ID NO: 12416 - DNA, 72 bp, Homo sapiens
agggaggattccgtctctttctattgattggaatactttcagaaggaatggtaccagttcctccttgtacct

SEQ ID NO: 12417 - DNA, 74 bp, Homo sapiens
tcgcttgagcccaggggtttgacaccagcctggggaacatagcgagacccccttatttctacaaaaaaaaaaga

SEQ ID NO: 12418 - DNA, 71 bp, Homo sapiens
tcaaagaggcagagatcctcacccactggcatggtccaggggtcttgagtcaggcaggggatgcttgttaa

SEQ ID NO: 12419 - DNA, 71 bp, Homo sapiens
atggggaaattgcccagcatgctgacttaggggtgcagttctcttttaagtaagatcaccaactttctctt

SEQ ID NO: 12420 - DNA, 70 bp, Homo sapiens
cttccatttttttttccagttgggtagtttacccaggtgggtagtttaaacctggaggcctttgcaattc

SEQ ID NO: 12421 - DNA, 74 bp, Homo sapiens
gctaagaggtagagaagcactgatgaaggcacaagacatagaaacagtttatgggggctttttcctgcatatct

SEQ ID NO: 12422 - DNA, 73 bp, Homo sapiens
gcagggcaatggtctgtatctagttgctaaagtagatatccagatgctagtatacctccatagtcacactcag

SEQ ID NO: 12423 - DNA, 113 bp, Homo sapiens
attggaaatcctttgagttgcttctcaaggatgagcaaagaaagtagattttttagattctaaagaaactatcttctttgctcatccttgagaagcaactccttatccattaa

SEQ ID NO: 12424 - DNA, 73 bp, Homo sapiens
aacaattagaatagtctgactctcactgtggagttggctagttagccatggtgctcctagaagtgaaatagat

SEQ ID NO: 12425 - DNA, 71 bp, Homo sapiens
ctccctagcaccagctgagtagccaaaacaacttcagacaaacagcagtagggcaccagctgagtagctac

SEQ ID NO: 12426 - DNA, 71 bp, Homo sapiens
cagaattgagccattaaggatggagttgggggcacgcctgtccttgtaactggggaaactttctaggatca

SEQ ID NO: 12427 - DNA, 74 bp, Homo sapiens
gatatttcaagtaatctgacatagcaaataatttcatgcgctgtttgctgtttgcacgcaaagggctgactgag

SEQ ID NO: 12428 - DNA, 72 bp, Homo sapiens
attaagctctatgaaggcagggatcatgtctggttttgcttatcaatgtgccaccaggatctaatccttaac

SEQ ID NO: 12429 - DNA, 70 bp, Homo sapiens
ttcttctttttctgttcgtagttgttcatagtctaataccagattatcatagtcagcacgaagtgagttc

SEQ ID NO: 12430 - DNA, 72 bp, Homo sapiens
ttgcatgtgacagtctgagttggtgtcaccgaccctgatgtcctgttattctaatttgcaaacgagagccta

SEQ ID NO: 12431 - DNA, 74 bp, Homo sapiens
aagaccttagtggcgaagtttgctagcactgaagtttggactactgggattgtgggttcgtctctggctagggg

SEQ ID NO: 12432 - DNA, 70 bp, Homo sapiens
ttggacctctgcctcagacttaaatgctagaggcaggtatttcctatctattgaaggtcagcaaattcag

SEQ ID NO: 12433 - DNA, 71 bp, Homo sapiens
aagattctgttgaactgtctatgcagcttcattaccctccttagggacctgatgctcgtggcacagcaggc

SEQ ID NO: 12434 - DNA, 73 bp, Homo sapiens
tctttctattttttaaaaacttacttatttgttttcttgaagcagctatagattcacaggaaaacagaggtga

SEQ ID NO: 12435 - DNA, 72 bp, Homo sapiens
tacaagggccctcagctttcagagtttcagttaacagtaaggagacttggagaggcactataatgatcaaac

SEQ ID NO: 12436 - DNA, 71 bp, Homo sapiens
tacgtatatacatatttatgtataaacatgtatacagatgtctacagttatatcgtaatgtgtatatcttc

SEQ ID NO: 12437 - DNA, 70 bp, Homo sapiens
aaatgcagcttatcagactgcctcaagcctactaaatcaagagcagtgacttaaggcctgcaaatctgta

SEQ ID NO: 12438 - DNA, 71 bp, Homo sapiens
tgggtgggttgcaatgggcagactggaggaagtggcttgacttcaaagcatcttcaggaggcacagtcagt

SEQ ID NO: 12439 - DNA, 71 bp, Homo sapiens
taggttctacaatagcgatgtcatctgcaggagtaactggggaagttgaaaatcttgtgacttctggaata

SEQ ID NO: 12440 - DNA, 73 bp, Homo sapiens
tttagaactgtggcatttgggcaatagtaagtactatatgagtgttagctatagctcttgttcttaagtctag

SEQ ID NO: 12441 - DNA, 72 bp, Homo sapiens
gaatctgaaggtgaaaaacgagctcttcaaaaggctggacaagtttgctgctgagtatgtaacctctggaca

SEQ ID NO: 12442 - DNA, 74 bp, Homo sapiens
ggtttcaacagtgagcgcttgtatcagtggattttctcatggctgatttaattgttctgtttgctttttgatta

SEQ ID NO: 12443 - DNA, 70 bp, Homo sapiens
ttggtcacattacccaaggttgagggcaagaggacatcccatcctcagtgtcagcaggcctgcgactcct

SEQ ID NO: 12444 - DNA, 71 bp, Homo sapiens
tgggcattggcagtgttcacagtggctatcatggtcacagtcatggtcacacttgtattgacattccgccc

SEQ ID NO: 12445 - DNA, 73 bp, Homo sapiens
tcagctgtttacccttgtgatcgcttgcatggctgactgggagctgcgagcatcacaagagggtatcttatat

SEQ ID NO: 12446 - DNA, 72 bp, Homo sapiens
aattatttgatataaacctcagtgaaatctgaaattccctgagactctagattgtactgagtcctttaaaac

SEQ ID NO: 12447 - DNA, 74 bp, Homo sapiens
aagaagcgggcaacctagatccctcccatgtgcagggttcctgctcctataagaatctaatgccccagtgatct

SEQ ID NO: 12448 - DNA, 72 bp, Homo sapiens
atattgtaatgttaactgtagggttcccagtgttatttctagcatctgactcagttcagcaggactccatgt

SEQ ID NO: 12449 - DNA, 71 bp, Homo sapiens
tacaacaaagtgcttacgacacactcagaattttaaaagtaaaacgttgttgtctgggcatggtgtctcac

SEQ ID NO: 12450 - DNA, 72 bp, Homo sapiens
gaggccagaagttgttagtcccaggattgttggctcagtggctcaatagtgtcatcgatgattgaaccttct

SEQ ID NO: 12451 - DNA, 72 bp, Homo sapiens
tttgttggtgtgtgtaggaagtaatctgggcgttttgcccagtttggtttaatttttgtttatttgtgaagt

SEQ ID NO: 12452 - DNA, 74 bp, Homo sapiens
aaatacttctgaagctctaaactaaatggtggtgagggaaaaggttattacgctgggctctgccgctgcaagtt

SEQ ID NO: 12453 - DNA, 74 bp, Homo sapiens
tggatgctagtatgtgactgaggttgaatgaaaaggcagaggacacttctggcaaatggtactcagtattaaca

SEQ ID NO: 12454 - DNA, 72 bp, Homo sapiens
gaggcatagagagagaatggaaaataataagcgaaaatgaaactgggctttcattttgttcttctctctgag

SEQ ID NO: 12455 - DNA, 70 bp, Homo sapiens
tgctttgttatctggacagtctcttccagaagaagagacttcttgagtcaaaataagataagaagtatgc

SEQ ID NO: 12456 - DNA, 73 bp, Homo sapiens
gtctcaggaatggcaaaggtggaggaaaatccacgtataagtggacctgtgcagttcaaacccatgttgtccc

SEQ ID NO: 12457 - DNA, 74 bp, Homo sapiens
tttgaggctggaaaatgataaatatttattgtgtgctgttcgtgtgcatggcactcttttaggtattttcctag

SEQ ID NO: 12458 - DNA, 71 bp, Homo sapiens
ataaatttttttttctctgtttgcttagctggcattcagtagtctgcacatcaacaggaaagaaaaaatgc

SEQ ID NO: 12459 - DNA, 74 bp, Homo sapiens
ttatttccttttcaactaaattagaaaccctgggaatgacctacaggccagtgagtttctctgaggtttctaat

SEQ ID NO: 12460 - DNA, 73 bp, Homo sapiens
ggaccctaatacaatatgactggtgtctttataaaacgaggaaattggacatagagataggcatacgtatagg

SEQ ID NO: 12461 - DNA, 74 bp, Homo sapiens
gttccctagttaacatgggactctagaatgtttgaggaaaacagttagcttatgttcacaaggtcaagtagaac

SEQ ID NO: 12462 - DNA, 74 bp, Homo sapiens
taaaaagttccataatgacagcaattagtgataagtgcccttacaacgctaaagaagagctgcaggtgaaactt

SEQ ID NO: 12463 - DNA, 73 bp, Homo sapiens
aatatttagtgtgattttattctgtactgtgtcaatagcagcacatcgtggttatgtcttttatattaaatat

SEQ ID NO: 12464 - DNA, 71 bp, Homo sapiens
tttcttatttaaaatgttttttctattttcttacaaagaactgtattctttgtaagaaagaaattcttaca

SEQ ID NO: 12465 - DNA, 72 bp, Homo sapiens
ctctgcctcccaggttccagtgattctcctgcctcaggctccggagtagctgggaatacaggtgcatgccac

SEQ ID NO: 12466 - DNA, 72 bp, Homo sapiens
aatctcacaactgagaagggttcctccacactcttggaactgaacacctattagtgtacaccattttaaagt

SEQ ID NO: 12467 - DNA, 72 bp, Homo sapiens
atattctgtcattccaaaaccttccctgtggaaatagccacattgagtttatgggcagtggatgcagcttgg

SEQ ID NO: 12468 - DNA, 72 bp, Homo sapiens
tgactaaccatcccctgtgctccgactgggctacttccagtaatacagcaaatcatctttggtgagttaatt

SEQ ID NO: 12469 - DNA, 72 bp, Homo sapiens
attatccccagtaaagaaccattggctgacacagggatgtagagatgagtcattctctttatagggttttaa

SEQ ID NO: 12470 - DNA, 71 bp, Homo sapiens
caagcctgatggagtcacttccatccattagtggctctccattgccctctggatataggataagcttccca

SEQ ID NO: 12471 - DNA, 74 bp, Homo sapiens
ccaacggtgctagtgtttctcatctgggctcacttttatgctgctttatggtgatagaaggagcagtcctccag

SEQ ID NO: 12472 - DNA, 74 bp, Homo sapiens
tgttcccagctgtgccattgaaagcagaatgtttatatttaaggtgcctgtagccgttgtgggcccagtttcct

SEQ ID NO: 12473 - DNA, 70 bp, Homo sapiens
caattctaagagcttcctgaagcggggggaaaaaaagacctcatacaaagaaagttagagggctctagaa

SEQ ID NO: 12474 - DNA, 71 bp, Homo sapiens
gagtctgagagctttggcttagtagtggctgcctgcggcggcgactccttcatattcctttgccatcctta

SEQ ID NO: 12475 - DNA, 71 bp, Homo sapiens
tgctggtggctgtcagaggtgtgaggacatcttatgtattcctacatggctcagttcagctggatgcagtt

SEQ ID NO: 12476 - DNA, 73 bp, Homo sapiens
tcatcagcgatagcagccactactatcacactttttaaaaaagtgtgatccacaagaaagcttttcctcaatt

SEQ ID NO: 12477 - DNA, 72 bp, Homo sapiens
ttgtttattctggaaaattataacatgtcttgccaaaattgattggctagatgtgctgcaacttacagagct

SEQ ID NO: 12478 - DNA, 71 bp, Homo sapiens
tcacttacactactggtaaaagtcaaaattggtaccatacattggggcagacttttgactacatagccgat

SEQ ID NO: 12479 - DNA, 72 bp, Homo sapiens
ttataaaaccaatattactgattgctctttatggaacttttagtaagttgtccctgaagaaatccagttaac

SEQ ID NO: 12480 - DNA, 71 bp, Homo sapiens
taacatatgaagttgatgatggttacaattacatatataaaatatatgtatcatgtatagttatatatttc

SEQ ID NO: 12481 - DNA, 71 bp, Homo sapiens
gaactgcagcggccaggcgttcctccagaatctcctagcacaggagcttgctacatgtgccgtaaatctgg

SEQ ID NO: 12482 - DNA, 70 bp, Homo sapiens
gaggaggatagtagagtcttcaaaagggtcctttattaaaaagagaaaacaattttacaacttcctccta

SEQ ID NO: 12483 - DNA, 74 bp, Homo sapiens
taccaatcactatgctgaggatggaacatcagacataaacaatctctagactcctaaagcttatagtgtattgg

SEQ ID NO: 12484 - DNA, 70 bp, Homo sapiens
gagtgtctaacctgccagtccaaagtttttaaagtggcagatgaaacacctagggcactggcaacagacc

SEQ ID NO: 12485 - DNA, 72 bp, Homo sapiens
agccatgagggtcctcatagtgaacttggtgaggaaagttttttaagtggatacttacagtgtggttcagac

SEQ ID NO: 12486 - DNA, 74 bp, Homo sapiens
attttttaaagtaaaggtcagcgaggtttagttgaaaaaagcagagtagtactcgggccacatagcctgccttg

SEQ ID NO: 12487 - DNA, 74 bp, Homo sapiens
caagaacacttctgtatagacgctgagtactacttgtggatgagaatatttgtagtcagcgaggcatccagtgt

SEQ ID NO: 12488 - DNA, 73 bp, Homo sapiens
tatttatttttgggagtgcttattactgcgccaatgagtatgccttgtatcaaagatgggtgtttcaacagca

SEQ ID NO: 12489 - DNA, 72 bp, Homo sapiens
ccaaagtgctgggattacaggtgtgagccaccgtgcccggcttatttgaattaatttctacaatgaccaaat

SEQ ID NO: 12490 - DNA, 70 bp, Homo sapiens
agctttactccctgtaaggaattgacggaagccaaccctgacagtgtaacaaagctcatctgctggtaac

SEQ ID NO: 12491 - DNA, 73 bp, Homo sapiens
tggctctgccgtgtgagtagccaagcaggtcagcctgagcatgctctcttagcagtggtggagacacatgaat

SEQ ID NO: 12492 - DNA, 72 bp, Homo sapiens
ggtgcccattaagtcacatggctaaattaaaggaagaaaaagtcacaagaatttgagcatgttgtgatttgg

SEQ ID NO: 12493 - DNA, 71 bp, Homo sapiens
ttcattcagttttcacccaaattcttattgggtatttacaatatggcaggaatagtatgaggcactgaaga

SEQ ID NO: 12494 - DNA, 70 bp, Homo sapiens
gaggagtcaaacagatctgaagcatgtatcattatatcatggcactcatatatgctttattggcacttag

SEQ ID NO: 12495 - DNA, 73 bp, Homo sapiens
tgtattacctaaataaatgtgtcaacatatctctggaagtttgagatagcatatgaggcagtgggtcaaaaca

SEQ ID NO: 12496 - DNA, 72 bp, Homo sapiens
ttttccactgattagtttatctatgctagactcgtgtgtgatgggatggaaggcagtgtaattgaaagaaaa

SEQ ID NO: 12497 - DNA, 72 bp, Homo sapiens
gtttctttttaatgctctcaccaaacagtaaagaccctctaaatgctgtggttatgattttaaggggatacc

SEQ ID NO: 12498 - DNA, 71 bp, Homo sapiens
aataaaaaataatgatttgggcatcgtggtatgcacctggagtcccagctactcaggaggctaatgcagga

SEQ ID NO: 12499 - DNA, 70 bp, Homo sapiens
gtatttttaaacatttttcttggtaggttacatgtgacagtacatgtatagtagttgaatatctgctgac

SEQ ID NO: 12500 - DNA, 72 bp, Homo sapiens
tctagtcaatggcactcattaaatgccttttaagtcttaaagaaacagaattataggctcagggtagctatc

SEQ ID NO: 12501 - DNA, 72 bp, Homo sapiens
ttattagctcagagttctatgaaccagtgatccagcactgcatggctgactggattatgggagtaaaatcca

SEQ ID NO: 12502 - DNA, 72 bp, Homo sapiens
ctcaaactcctggactcaagtaatccactcgcttcccctaccaaagtgttgggattacaggcatgggccacc

SEQ ID NO: 12503 - DNA, 74 bp, Homo sapiens
atggatgggagattgctttgcttatgggcgataaaatattgttgactaggtatggtctgcctctttcattaaaa

SEQ ID NO: 12504 - DNA, 70 bp, Homo sapiens
agcaaaacaaatgattttttggttctgaagtgctaaagtggtacatcatgctggggtatttgtggttctg

SEQ ID NO: 12505 - DNA, 72 bp, Homo sapiens
ttagtatagctcagagctgaataagattagtatagcatgtgaatctggatattcagcactttatgatgctac

SEQ ID NO: 12506 - DNA, 72 bp, Homo sapiens
tgttcctctacaaccactcatggcaccaaaatccgtattagtcagggttctctagagggacagaactaatgg

SEQ ID NO: 12507 - DNA, 70 bp, Homo sapiens
gctagagagttgatataccttcagctaggcagtgaaggtccattgcttacctattcagctgaaaacaaac

SEQ ID NO: 12508 - DNA, 70 bp, Homo sapiens
cccaaaagtccataaatgcctacaacctgacaaagagttcagtttaggctcatgataggctttggtatac

SEQ ID NO: 12509 - DNA, 70 bp, Homo sapiens
ataaatgacactgacaggattgatcccaccaggtgagggggctaaaatcagcccgtcttttcgtattatg

SEQ ID NO: 12510 - DNA, 72 bp, Homo sapiens
acaatttttgttgctcagctagcacatttttgcttttctcaataggcaagtagcatagcaaattacatgggt

SEQ ID NO: 12511 - DNA, 70 bp, Homo sapiens
gggctctgcgcacttcgtcactgggaagcaatactctagccagctaccctggctgcagcctggagcaacc

SEQ ID NO: 12512 - DNA, 72 bp, Homo sapiens
ctgtagttggagacagggccttaaaagaggtaaatgtggtcaaaagggtgaggccttaatccaataggactg

SEQ ID NO: 12513 - DNA, 72 bp, Homo sapiens
actcctctctgctatcagcctcctgtcgccgttggaatgaaaggagagtctctaagagcatgagaaagttaa

SEQ ID NO: 12514 - DNA, 72 bp, Homo sapiens
aggggtgctgcgccccgtggccctgcccgcttcatcgcggctgtccccgccccgccgcgccccccatgcccc

SEQ ID NO: 12515 - DNA, 71 bp, Homo sapiens
catggctctcaaccacactgtggtctggagatagactacaatgtgcatttaaactaggagtcaggagaaga

SEQ ID NO: 12516 - DNA, 70 bp, Homo sapiens
actggattctatgaccagtatagcaggaactctaaaagtaaaggtcctggtgtgacgacttggtaaaggg

SEQ ID NO: 12517 - DNA, 70 bp, Homo sapiens
ctatccagttcttgccgcgggtcggggcggcgaacttggtgttggggtcgcaggccaggcggtcgtgggc

SEQ ID NO: 12518 - DNA, 72 bp, Homo sapiens
ctgagttataagggggatggggctggtaggtaggtgtaagttttctactattacttccattttctcagtgaa

SEQ ID NO: 12519 - DNA, 71 bp, Homo sapiens
aatcctagtgctgaacagggcccagagccagtgcaatgggggaacacagcctactaagacaccagctgggg

SEQ ID NO: 12520 - DNA, 73 bp, Homo sapiens
taaagggtgttcaaaatagtggtattgaaatcatgtgatttcttgttgctagtagcagtcatgtctgattagt

SEQ ID NO: 12521 - DNA, 72 bp, Homo sapiens
tggtacaaaagtaataattgtgccattgaaagtaatggcaaaatctgcaattatttttgcaccagcctaata

SEQ ID NO: 12522 - DNA, 74 bp, Homo sapiens
aaaattcttttttatttttaatggagcaaaagtagtctactgaaaatttcagagatctggtccacagggtgaaa

SEQ ID NO: 12523 - DNA, 72 bp, Homo sapiens
ataatggtgatgggtgtgcatcattttgaatgcattaaatgctaccgattgtacactttaaaatggttcaaa

SEQ ID NO: 12524 - DNA, 71 bp, Homo sapiens
ttagcttttaggccagagtaaagtgtacttaagacatactatatggtaatgacttagattcaggcttgaca

SEQ ID NO: 12525 - DNA, 70 bp, Homo sapiens
tgcatcctacaaagtcacagaagtggagcttcccaagaccctgggagcccaacccttgtgccagtgtgcc

SEQ ID NO: 12526 - DNA, 70 bp, Homo sapiens
caaaagaaacctgtgacaccgagggcactgtcaaagcaccatacctgctgtggactgcctgcctcaggct

SEQ ID NO: 12527 - DNA, 72 bp, Homo sapiens
ataaagcttgtctcaatcgacttgtgattctgttttgtgatacagggggagacacagtgtagggtaaaaaag

SEQ ID NO: 12528 - DNA, 74 bp, Homo sapiens
ctgttcctgcttctcggccaacttcctggccagaacactgagctgctgggcgtggtgggaaggcggggaaaagg

SEQ ID NO: 12529 - DNA, 72 bp, Homo sapiens
ggctctggggaagaaagacggcctatgcttcttgttgtgtctttctgtgctttgcaatgccccatttgtatc

SEQ ID NO: 12530 - DNA, 74 bp, Homo sapiens
ttactcaaggggtgcttacatgattccgagtgggtgagcatgtaggccaatgtttgtcaaataccccaaggtaa

SEQ ID NO: 12531 - DNA, 70 bp, Homo sapiens
tctttttgtcaagtatctatatttgcatttgcatttaaaatttttatctggatacttaactttctaagat

SEQ ID NO: 12532 - DNA, 71 bp, Homo sapiens
gggaggtaattcagttaagagcagagccctcatgaatgggatgagcatccttaaatgagatcccagttaat

SEQ ID NO: 12533 - DNA, 70 bp, Homo sapiens
cctgccagatggcatttggcaatgtctgcatatgttttaggttgctataattattgggggggtgctacta

SEQ ID NO: 12534 - DNA, 70 bp, Homo sapiens
gcttagactgtacagcactcagacttccttccctctctcctctctggtcagacttgcactgcagtctgat

SEQ ID NO: 12535 - DNA, 73 bp, Homo sapiens
aaatatggtggatattgtagactggatcacttcacattctctccaatccatttccatcatgccttttatgttt

SEQ ID NO: 12536 - DNA, 74 bp, Homo sapiens
ggaagtgagtaaatgaggacgagcataaaagttagcaaagtgcacatatgcaccttctctcctgcgtgctactc

SEQ ID NO: 12537 - DNA, 72 bp, Homo sapiens
ttaggtagacattctggagtcaacagataacatataagaaatgagcacgctattgaagtcatgtgggaccta

SEQ ID NO: 12538 - DNA, 73 bp, Homo sapiens
tcatgctctgctggttggaatgaaagcaggtgacatgtgcaaatctatgactcagaagttctgttttcattct

SEQ ID NO: 12539 - DNA, 73 bp, Homo sapiens
tttatctgttaaaattattatcaaatatcagccaggatgcagtcgtgaatcacaggctgctcctcgccttcag

SEQ ID NO: 12540 - DNA, 73 bp, Homo sapiens
tagtgctcagaacagaaattagtatggacaataaacagcaatgtctattaagcatacaggtgatggctgaaac

SEQ ID NO: 12541 - DNA, 74 bp, Homo sapiens
gaattccatactattgaaaagagctcattggaaggaaactttaaatgggtaagagatttcaacaaattcctgga

SEQ ID NO: 12542 - DNA, 71 bp, Homo sapiens
atttcccattttgttctcagtgttcagattaccttgtcatgaatattgtcaaatgctatggatgctgctcc

SEQ ID NO: 12543 - DNA, 72 bp, Homo sapiens
ctcctcatcccttgcagttgtctccgtggagagtcttgctttgctgcacagccacccataggaagagctgtg

SEQ ID NO: 12544 - DNA, 72 bp, Homo sapiens
tggcatcctaaggctggtttatgggggcaagacggcttccagtggtaaccagagctttgtgcttcctgtgca

SEQ ID NO: 12545 - DNA, 74 bp, Homo sapiens
catccatcccttcttcctgtgtctgagcactgtaaatgctcctcgtggggaacctgctactctgtgtttgggca

SEQ ID NO: 12546 - DNA, 71 bp, Homo sapiens
tggcatcaccccagaacatgcttctgagtggaggcttgtttttctctctcccacccctccttccctccctc

SEQ ID NO: 12547 - DNA, 72 bp, Homo sapiens
ccaagtgcaaaatcattctgcctaatttcaagcagcctggcagctgcagaggaagaacagctttggccttca

SEQ ID NO: 12548 - DNA, 70 bp, Homo sapiens
acaatttcatttcctctgcttgctttgggcttagtttactcttattttttaaggtagaaggtgagattat

SEQ ID NO: 12549 - DNA, 71 bp, Homo sapiens
cctccttggggataggtgagtcacacttgagtttgtagtgtaacccaggggttcccaaggtcccacgcagc

SEQ ID NO: 12550 - DNA, 70 bp, Homo sapiens
atagagtcctgaatctgcatcagaggctgtcacctgtgagacaggagggtgatcaggaggaaacagaaat

SEQ ID NO: 12551 - DNA, 74 bp, Homo sapiens
gtagctgctgatgatctgagctcctttagactcagtccctgtcctccaggaatctgcagtccaacggagaagat

SEQ ID NO: 12552 - DNA, 72 bp, Homo sapiens
acacatatatacaggtgaaatgcctttaaattaacaagcatttcactgcttgaattatttatagtgcagaac

SEQ ID NO: 12553 - DNA, 72 bp, Homo sapiens
aaggcagagggtgagtccgaggtgggatcccggaacaggtatgggaagttgggcaaaaacggatgaaatctg

SEQ ID NO: 12554 - DNA, 70 bp, Homo sapiens
gcagtggtcatgagatgagcaatttggagcctagaaaattagatttaaagttgccagatcactgagtccc

SEQ ID NO: 12555 - DNA, 73 bp, Homo sapiens
aaggactgcactagattaccatggatgtgctcttaatcattgctgaggttctccatggaagagaaatgatgtc

SEQ ID NO: 12556 - DNA, 72 bp, Homo sapiens
ccttataaaatattttctcccagttagcacgttgactgcatatcctgaaatattttataaggatgaggtgac

SEQ ID NO: 12557 - DNA, 73 bp, Homo sapiens
gaggacaggggaatctttggtatgcagtggcagaaagtttaccaagatgatcccctgcaggaatgtgaaatgt

SEQ ID NO: 12558 - DNA, 71 bp, Homo sapiens
taaacacctaaaaaggtggtctaaatgaaacactaagggttagatctgacctgtgggccactgattagcaa

SEQ ID NO: 12559 - DNA, 70 bp, Homo sapiens
ttccagatgcccaaggagctcagcaggcagccgtaagtatactagcaggaggtaagaatggcaggaggcc

SEQ ID NO: 12560 - DNA, 72 bp, Homo sapiens
gtatcatatctctatagttttgtagacaggatttttgtactacatgggatattgtattagaatcttaaatgt

SEQ ID NO: 12561 - DNA, 72 bp, Homo sapiens
caatttccctttatttggaaactttgtgtagtatcaagcagcaatgcaatatacataacaatgagaggaatt

SEQ ID NO: 12562 - DNA, 72 bp, Homo sapiens
agttttgtgaacacctaagttttattaggcacttaaaaatgctttatgacctataggccagttgaacagaat

SEQ ID NO: 12563 - DNA, 72 bp, Homo sapiens
ggctgcttggctgagcatgaacacgattgagctgctctgactttgctccaacatccatgaggccgatttgcc

SEQ ID NO: 12564 - DNA, 74 bp, Homo sapiens
ctactagtgaagttcagaagggaaatgtggtatttgagcccctacacggagtccctgatgaagcactgcctagt

SEQ ID NO: 12565 - DNA, 72 bp, Homo sapiens
ttcagcttaaagtagccagcactactgatgtagtttggctctgtgtccccatcaaaatctcactttaaattg

SEQ ID NO: 12566 - DNA, 70 bp, Homo sapiens
tgcttggttttgctatatagcacttgtcaatgctatttctagcagaattcagagcagcaggatgagacaa

SEQ ID NO: 12567 - DNA, 71 bp, Homo sapiens
tggatctgtcccacgctctggatacttagctgttaagctaatacatgtgtgggtttacacatgaaattaaa

SEQ ID NO: 12568 - DNA, 73 bp, Homo sapiens
ttcattcattgcatgggcatgtgctcagggaggatacaagttatctatattatacctacagcattgtgcatta

SEQ ID NO: 12569 - DNA, 74 bp, Homo sapiens
cttacaagaagtggaagagagcagagtgaattctctctcctcttttcctcctcctcctccctctttgccccctc

SEQ ID NO: 12570 - DNA, 70 bp, Homo sapiens
gcaaatgattatctgataatggccctagatttgcagctcaagctacacaacactggacccaatcatgggc

SEQ ID NO: 12571 - DNA, 73 bp, Homo sapiens
tatctttgttgtaggaaaatccgggttcttgtcacatgacaaggaaagattaggcacgcagctacttggaagg

SEQ ID NO: 12572 - DNA, 72 bp, Homo sapiens
ccttaagagtatagttctgagtttagtcattcgtatgtctccaaaacttaaaacaatgtcctgatcatgggt

SEQ ID NO: 12573 - DNA, 73 bp, Homo sapiens
tctgtgtgcaccatggcaaaagtttcagcggcgtagaaggcctgtttgagccagcaggctggaggtgcacaga

SEQ ID NO: 12574 - DNA, 70 bp, Homo sapiens
gcttggattgtgacctacgatatcaagaacatgaaatctggtggaagtgacatttctgagaatccaaatt

SEQ ID NO: 12575 - DNA, 72 bp, Homo sapiens
actgaattttaatgaggcttagtttctttgtctgtaaaataaagataatactgcctgcattatatgtgacga

SEQ ID NO: 12576 - DNA, 71 bp, Homo sapiens
ttagctaacctatgaattgactacagtcttatggctgactgctggcgagaccagcagaagcagcatctaag

SEQ ID NO: 12577 - DNA, 73 bp, Homo sapiens
ctctccttctttccaccctctaaatccttctggtgtctccaaacagaacccaaccagaagccgaagggcaagg

SEQ ID NO: 12578 - DNA, 71 bp, Homo sapiens
gtgcacacttcatctatcatattgaaagcatcggagctacacagttgtgggtgagtttatgtgattccact

SEQ ID NO: 12579 - DNA, 72 bp, Homo sapiens
aaaaacagttttctgcctgtatgagccttcaaggtgaatacataattcagaaaccatatgcagagactaatg

SEQ ID NO: 12580 - DNA, 74 bp, Homo sapiens
cctcttgctcgtcacggtgagaagctgctgaaccatatcagtcatgtggcgcaactgggtgtttgctcctgagg

SEQ ID NO: 12581 - DNA, 73 bp, Homo sapiens
attgtctgcaatgttcatctaatgttgaagcatgggtcagtattttgttccttttttgggtgactaatgttgc

SEQ ID NO: 12582 - DNA, 72 bp, Homo sapiens
aaggccaaagttcattcctcgtcctgcagcgctagaaattgcatcagggagacagggtgaaactgctgtgct

SEQ ID NO: 12583 - DNA, 70 bp, Homo sapiens
tacatcccttgcctctcggtgcctgacatgcctttggcaggcatgggatccgggccagtggtgcaagcca

SEQ ID NO: 12584 - DNA, 71 bp, Homo sapiens
gtggtttttgaagggaaggtgatatggtttggctctgtgtccaccaacccatatctcatgtcaaattataa

SEQ ID NO: 12585 - DNA, 72 bp, Homo sapiens
caccccaaggagctacctgggatgcctcacctgagaaactcccaactgacctataggcactcctaatgctct

SEQ ID NO: 12586 - DNA, 71 bp, Homo sapiens
cagattaattgtgaaggaaaagagaaaggcattggatatgatgcccagactttatgttttggcaattggtt

SEQ ID NO: 12587 - DNA, 70 bp, Homo sapiens
tgccctgatgccatacattatgccatgctgggtttctgacctatgaattgtgagctaatgaatggacgtt

SEQ ID NO: 12588 - DNA, 71 bp, Homo sapiens
ggctgggcacagtggctcatgtctgtaatgccaaaattttgggaggctgaggtgggtggattgcttaagcc

SEQ ID NO: 12589 - DNA, 74 bp, Homo sapiens
atgtagtgcagttaaaagctttatataaaatactgtttatataaaatatggctgctgccattattattaattca

SEQ ID NO: 12590 - DNA, 71 bp, Homo sapiens
aacaccaggcaggtgtatgtggctttggcaaactgaatgatgccatagtcaaggcgctgaagcagtgagtt

SEQ ID NO: 12591 - DNA, 73 bp, Homo sapiens
atgtactcatcagatttgatcatgtggacctagtttgtagacccctgttgcaggtgaatgtgctattagactg

SEQ ID NO: 12592 - DNA, 70 bp, Homo sapiens
tgcgtatcccccttacttatggagtgcacaccattagatgtgcaggtgaactcagctctctgacttaagg

SEQ ID NO: 12593 - DNA, 73 bp, Homo sapiens
ttctctattctgttccattggtctatatttataccagtatcatgctatttgataagtatagcctgtagtatag

SEQ ID NO: 12594 - DNA, 70 bp, Homo sapiens
aaaaacagtcttcaaacaccacggctagtgtccaaggctacttagctcagctggttggggtgctgggcta

SEQ ID NO: 12595 - DNA, 73 bp, Homo sapiens
cagaaataaatatagaaacatgtatatgtgggttagtataaacatattattatgaatacagatatctatattt

SEQ ID NO: 12596 - DNA, 72 bp, Homo sapiens
gcattcattaagaaagggctatcaggaatgctgctcatacaagctagcagcattaagtacataggtttgaac

SEQ ID NO: 12597 - DNA, 70 bp, Homo sapiens
aagctgccaaataaagtccagttttcccagttgcagcagaagttgcatcgggacatgtttgtgtgtgtgt

SEQ ID NO: 12598 - DNA, 71 bp, Homo sapiens
agcagaaaaaaaaaactgtgacagtttaactctctgatctgtcattataataattgactgtttccttattt

SEQ ID NO: 12599 - DNA, 72 bp, Homo sapiens
tttgcacctgggcgataaggttgcagtgagccgagatcgtgccattgccctccagcgtggctaacagagtga

SEQ ID NO: 12600 - DNA, 70 bp, Homo sapiens
atgcagctgcatagcaagcagggatacagaggactttcctgctgagctaacaggtttctgttgtgatgga

SEQ ID NO: 12601 - DNA, 71 bp, Homo sapiens
acaaaagagatggaggctacaactctgattatcacctaaaatttagttgcagtgtccaaacagaagaataa

SEQ ID NO: 12602 - DNA, 73 bp, Homo sapiens
tcacggcacttaagtcgaaggagaatgcagatgaacaagccttggcccagcattgcaggcctgttcttcagtg

SEQ ID NO: 12603 - DNA, 73 bp, Homo sapiens
gctgcctaagcctgtgtagtgtggatacaccagaatctctgggaccagtgcctattgttggatacttaagcag

SEQ ID NO: 12604 - DNA, 71 bp, Homo sapiens
atgtataacattcctgaggtatatgttacatgcctccttccataatgacagcgtgtttatcgtagaccttt

SEQ ID NO: 12605 - DNA, 72 bp, Homo sapiens
ttaccactaggggcttttgagtatttcaggataggttttgatcttccctttttatatattcatggagctctc

SEQ ID NO: 12606 - DNA, 74 bp, Homo sapiens
cagtttagcaccatttgactaattgtagctagtcgcttgaaggtattaagttgtctaggcagaggaagaggcta

SEQ ID NO: 12607 - DNA, 72 bp, Homo sapiens
atgtcaagggaatcaacatttgacatgagggctctccgcggattcttcctggataactttatctctattcct

SEQ ID NO: 12608 - DNA, 70 bp, Homo sapiens
acctccaataaacacactgcgcttgtggcccctcccaagtgttagcaggccactgcgcacacgaacagga

SEQ ID NO: 12609 - DNA, 74 bp, Homo sapiens
aaggcaacccctgtcttctccgctgatgtgatgtttaattttaagtgtcaacctgactggattcagggatacct

SEQ ID NO: 12610 - DNA, 72 bp, Homo sapiens
ggattttagatcagttgagtgtcatgaccatgtaggctctcagtagataagtaatttctttgagacggatgc

SEQ ID NO: 12611 - DNA, 71 bp, Homo sapiens
attaaatcatgctttcaagagggatttgaggcgttgggactatgcatgatatgaagcagcctcaaatttta

SEQ ID NO: 12612 - DNA, 71 bp, Homo sapiens
cctcttcctgggtggggtggcagaaccatttcagccgaattacgggtctgggtggtgtcagctgatccact

SEQ ID NO: 12613 - DNA, 72 bp, Homo sapiens
tgtttcaaggttttctagagatggacaattgagaaggtggcagtcttgcctatttctagcaaaatttcatta

SEQ ID NO: 12614 - DNA, 71 bp, Homo sapiens
ggcagctggctcagttcgatgataggacctgtttgccgtttcctcttgctccttccagctatctagaacac

SEQ ID NO: 12615 - DNA, 72 bp, Homo sapiens
aaattttgccaacaacctgaccaagcttgcaagtggattcttctccaggtaagcctccagataaaaatgtgg

SEQ ID NO: 12616 - DNA, 72 bp, Homo sapiens
tttctcttttttttttgagatgaagtgtcactttgtcacccaggcaggagcgcagtggcgtgatctcggctc

SEQ ID NO: 12617 - DNA, 74 bp, Homo sapiens
ctgcctgaaagtttctttgggaatcccaggtgctcctggactatactttgtgtccaaatgtatgatgtaggcag

SEQ ID NO: 12618 - DNA, 73 bp, Homo sapiens
tcagactgcatgaaggtctgacccctttgaaggagagatgggaggaagggtgatcaagcaggaagagtctgac

SEQ ID NO: 12619 - DNA, 72 bp, Homo sapiens
attttttttccatgacgaaaatattggatcgtggagggaaaacatcgagcactaaatagaaaacattattat

SEQ ID NO: 12620 - DNA, 72 bp, Homo sapiens
gaccagctgcaatgtcttatacctgtaatcccagtgctttgggaggttgaggcaggaggagcctgggcaaca

SEQ ID NO: 12621 - DNA, 70 bp, Homo sapiens
gtcttctgacctactcattaacagctgttctaagctgtttggtgtagcttgggcaacaacagagttctca

SEQ ID NO: 12622 - DNA, 70 bp, Homo sapiens
cagtgcatagcggaggtaaatcatccacccaatgagatgattttgctagcaccatctgaagagctaccag

SEQ ID NO: 12623 - DNA, 71 bp, Homo sapiens
agggaaggagcctgggacctgatgccatcacactgagggcaccgtgatcacagggaaggagcctgggacct

SEQ ID NO: 12624 - DNA, 72 bp, Homo sapiens
gatgtcttcacgatagtggtccggagaaacacgggccgtgcagctactcaagttctggtctcttttgtgggg

SEQ ID NO: 12625 - DNA, 73 bp, Homo sapiens
agggcctggctctgtcacccaggctggagtgcagtggcacagtcatggctcagttcagctttcaactcctggg

SEQ ID NO: 12626 - DNA, 72 bp, Homo sapiens
ctgtcggtggaatggctgcatggccatcattattagccacatactgagagttccgtgatctttcccaaaccg

SEQ ID NO: 12627 - DNA, 72 bp, Homo sapiens
ttgtaaacctgaggatgcatcactggctattgttcttggtggataaaccacaaagcctgtgatttatctcag

SEQ ID NO: 12628 - DNA, 73 bp, Homo sapiens
agagatttcctgaattccagccacagcggccatttctctatggcatagctcgctgcacacaactgtcaggatt

SEQ ID NO: 12629 - DNA, 74 bp, Homo sapiens
ggggctccaggcttgctgggtttgcagccccagctgcgggtctcaaagccagcacagatcacaagagcaaggcc

SEQ ID NO: 12630 - DNA, 70 bp, Homo sapiens
tcaggttttacagatggatctggcatctgagaatctatgaacagatggattcttaaggtcagtgactggc

SEQ ID NO: 12631 - DNA, 70 bp, Homo sapiens
ccactgtgtgttataattctaggtactgaatgtacttacaatatgtacttccagtactcagtacagtatc

SEQ ID NO: 12632 - DNA, 73 bp, Homo sapiens
ttctctgcagcaaacaacaggatgaactttattttctcattgaaaacaaggtgccgggaagtgattgcgcacc

SEQ ID NO: 12633 - DNA, 72 bp, Homo sapiens
ccattgctcagaaaaatagtgccattaggagccctcagcagcacataataatggcaattaatgacaatcagc

SEQ ID NO: 12634 - DNA, 70 bp, Homo sapiens
cttctgtgtcttgcaaatgatatgtcacctcactttcattctgattaatgaaacaagggatttgtaggaa

SEQ ID NO: 12635 - DNA, 72 bp, Homo sapiens
cttatccagtcttagggtttagcagctgaaaggtttacaaaactgaatctggttgaatctctgtgaaagggt

SEQ ID NO: 12636 - DNA, 72 bp, Homo sapiens
aatagggagaaggcccagcccagactgaactccagtttgatttgtgcagtagagactgggcgttttaaaggg

SEQ ID NO: 12637 - DNA, 73 bp, Homo sapiens
ccttctccctccatccatctacaggtgtgagttgtgctacaactttgcagctgtgtggttttagaatcataaa

SEQ ID NO: 12638 - DNA, 74 bp, Homo sapiens
catgctggcttcagagggattctcagtggtgctgggaccagagccagaccccaaggatatgaaggcatcagaat

SEQ ID NO: 12639 - DNA, 98 bp, Homo sapiens
gatgttgatgcacgtgacggggagggcataggagagggttgatataaaatgcaattacagcctcttatgctttccaaagtgggggatgattcaatgat

SEQ ID NO: 12640 - DNA, 73 bp, Homo sapiens
atgttttgagacccactgggccttttgcactagaaatatataggcttcatggataaacaacagaacaaggatt

SEQ ID NO: 12641 - DNA, 74 bp, Homo sapiens
aatgcatctgtataggcatcctatgtctgcataatgcgtctacacaggctttgggatgcagcagcattggatag

SEQ ID NO: 12642 - DNA, 72 bp, Homo sapiens
tctaggctgccagaaaacagaagataagcatatggttgttaaaattacaagaacaactggggcagaggagac

SEQ ID NO: 12643 - DNA, 73 bp, Homo sapiens
cctgagtatttggtccttgagtagcatggaatcctctctagatttaatcactactaagccctaaaggtgggag

SEQ ID NO: 12644 - DNA, 73 bp, Homo sapiens
ctgatggttatggggagaggctgtttctggcacagtggcctgccgaggctggatccctcctcaactcaccatc

SEQ ID NO: 12645 - DNA, 72 bp, Homo sapiens
ataaataggaattgtaggcagctttgaagtcttattcaaggtcgaagactatgaatttatagtgactatatt

SEQ ID NO: 12646 - DNA, 71 bp, Homo sapiens
cctttggaagctgaataaacccaagagacagataatagcttatggagtcagttcaggtgtggtttcattct

SEQ ID NO: 12647 - DNA, 71 bp, Homo sapiens
tttgtttacagtaatccagcttagccaaagggcagcctggcctcactggggccacatttcccatcagctgc

SEQ ID NO: 12648 - DNA, 74 bp, Homo sapiens
gtgccactcgagatgtgctcagctgagacgagtagagcagagagaagacatctcaggggagcgcagccaacaca

SEQ ID NO: 12649 - DNA, 72 bp, Homo sapiens
aacactttttaattgaacagttattaccttgtcattagcagcacgtgaaataaacgttcctgtttcaaggtc

SEQ ID NO: 12650 - DNA, 73 bp, Homo sapiens
tatgaatgcatgggtcagtgctattggaaaagagcacttttgtaccctttcacaggcctcagaagcagtgtat

SEQ ID NO: 12651 - DNA, 74 bp, Homo sapiens
cttgcactttgcctttagcaggtacctcagctctggttgtgattctttattaacaggtatgggagcaagcatat

SEQ ID NO: 12652 - DNA, 73 bp, Homo sapiens
gtactttgtcagtttgatgggccagggtatcctgcttcccagggcacgagatctgggtggcccagaggtactt

SEQ ID NO: 12653 - DNA, 74 bp, Homo sapiens
tgttggaagtgcagtctagtgggaggtatttggttcatgggagtggattcctcagaatggcttgatgccctccc

SEQ ID NO: 12654 - DNA, 72 bp, Homo sapiens
taactaactacatctgcgatgaccctatttccaaataaggtcacattctaaggtgccaggggttaggacttc

SEQ ID NO: 12655 - DNA, 73 bp, Homo sapiens
ctgattttactttgttcacttcaggatggaaaggatggcagagtctctgctgcatccaggatagtatgaatca

SEQ ID NO: 12656 - DNA, 74 bp, Homo sapiens
aatcacattcctcagctacagcagggcacagcaattgatttttgatacaccaaggctgaacacaatggggaaag

SEQ ID NO: 12657 - DNA, 70 bp, Homo sapiens
gacatacctattgctcctaggtaacacacctgtaccgcaggttactgcactgaatactgcaggaggttgt

SEQ ID NO: 12658 - DNA, 70 bp, Homo sapiens
acctaagctgctactgcagggcatcatcttgaaaccgctagataggtaccctgccctgggggccagtggc

SEQ ID NO: 12659 - DNA, 74 bp, Homo sapiens
tagggtcatcttcatcagtacccagaccaagtttgttcatcctgtagatcctgttagcatgtgtctggggacct

SEQ ID NO: 12660 - DNA, 74 bp, Homo sapiens
atgtccctgaggtggggaacagggcagccctccactccacaatttcttcctctctgctctctttcctgtttctc

SEQ ID NO: 12661 - DNA, 73 bp, Homo sapiens
ctcctgtcagggcggatctgacatctaagccgacagcacagacccagctcaccaccttgtaggagtgaagccc

SEQ ID NO: 12662 - DNA, 71 bp, Homo sapiens
actagccgctgccctctctcctaggaattgacaaccctgtgttttctccggacgaggccctggaccgcagc

SEQ ID NO: 12663 - DNA, 70 bp, Homo sapiens
gtgttgcagacataagcccagttttcccagtcccggctgctgaagattcctttgtcaggatgatctctgt

SEQ ID NO: 12664 - DNA, 73 bp, Homo sapiens
ccacctccgccccgcggccgtacctggcgccccctggctcccccggcccccgcgcggcgtggagccatcttcc

SEQ ID NO: 12665 - DNA, 70 bp, Homo sapiens
cacgtctcgcctgtccgcgggcgggcaccaggaacagctctgacaccgctccccgcccccgggcgggtgc

SEQ ID NO: 12666 - DNA, 74 bp, Homo sapiens
atcgacgtgtggtggatcgtgcacgacggcggcatgctcatgctgctgcccttcctgctgcgccagcacaaggt

SEQ ID NO: 12667 - DNA, 70 bp, Homo sapiens
acccgggctgggcgcgcgccgcctgtgtgctgctgtccttgctgcccgtgctgtgggtcccggtggccgc

SEQ ID NO: 12668 - DNA, 74 bp, Homo sapiens
gaagtcctgccttagggtggcttgactgcagcattagacaacccaacaaagcatattgaaagccaagggctgga

SEQ ID NO: 12669 - DNA, 73 bp, Homo sapiens
gggttcactgacagccaagaagataatgtggactcctgtggagcccagcttatcagacagatgcttaggaaca

SEQ ID NO: 12670 - DNA, 70 bp, Homo sapiens
caccctcagggtcccaggatggcagtgacctagagcagcagcaattcatgtggaaaagggtttgatggtc

SEQ ID NO: 12671 - DNA, 71 bp, Homo sapiens
tggtgcctgtgggatgggagggagggctgcatgtctcccccaggtgtggtgttttcccaggaacctaaacc

SEQ ID NO: 12672 - DNA, 72 bp, Homo sapiens
tataatgagataccatggactgggtggtttataaaaccacagacagaaatttgtttttcatagtcttggagg

SEQ ID NO: 12673 - DNA, 71 bp, Homo sapiens
ccttgggatggacatcattatatgcggccactatttaccttgcctttttctgttgtaccatcaagtcaggg

SEQ ID NO: 12674 - DNA, 72 bp, Homo sapiens
agggatcagcctgcacgtggactcgctcacggatcactcgtgctcggccgagtcggacggggagaagcttcc

SEQ ID NO: 12675 - DNA, 70 bp, Homo sapiens
caggcgcccggctcgctggcgctctactcgtgcccggcctacggcgcgtcggctttggcggctccgcgca

SEQ ID NO: 12676 - DNA, 71 bp, Homo sapiens
gcatttctacttgagaaacagtaatccctccctctgcagccgactgagaactgatctcgaaccttaggtgc

SEQ ID NO: 12677 - DNA, 73 bp, Homo sapiens
aaggagccctgagatggcttattatttcgatcctacacaattacaattccagctccatacatcagagctctta

SEQ ID NO: 12678 - DNA, 72 bp, Homo sapiens
agcagcatccctggcctccacccacaagaccagtagcccctgttctcctggttgtgacacgcaaagctgttt

SEQ ID NO: 12679 - DNA, 73 bp, Homo sapiens
attgggtgaaaatggtagaaccagctgaggagaacctattctgtcagcatggcactggtatgggtgactacaa

SEQ ID NO: 12680 - DNA, 70 bp, Homo sapiens
acagaatgtcatagactgacctaggaattgaactcagttttctgttggattgcattctgaatttccagct

SEQ ID NO: 12681 - DNA, 73 bp, Homo sapiens
ggaagggatccagtttcagctttctacatatggctagccagttttcccaggaatcctttccccattgctcgtt

SEQ ID NO: 12682 - DNA, 70 bp, Homo sapiens
ctgcatttgacattgtttttcaaccttagaacctgagcaaacatctgttgagagtgctgaattgcagagg

SEQ ID NO: 12683 - DNA, 73 bp, Homo sapiens
gcccaggtctctgtgcccagtgttcagcagcagacacttgtggaattggcttttgagaagcaaggggctgggc

SEQ ID NO: 12684 - DNA, 72 bp, Homo sapiens
ggcgagaacaggaactcagtaagcaccctctcagcagaaactgggcgtggacgacctgcttctcactcaaaa

SEQ ID NO: 12685 - DNA, 70 bp, Homo sapiens
cagcctggtgagcaagcgcccctctctagcacgttggccctatagctcaggggccatttccaaaccatgt

SEQ ID NO: 12686 - DNA, 71 bp, Homo sapiens
tggatggaactaacaggatatatgtacatataaaagggggagtgtttttttgttttggtttggttttttct

SEQ ID NO: 12687 - DNA, 74 bp, Homo sapiens
catcgctttaggtcttggctcagacactacttccatagagtccagtggtggctcgtctaagtccactcagggtg

SEQ ID NO: 12688 - DNA, 72 bp, Homo sapiens
gttctgtcacccttactagaccttgagtttcagagcagtgcaatctacgccttgcgtttctgaaactccctt

SEQ ID NO: 12689 - DNA, 72 bp, Homo sapiens
cccaaagattggttggaccaggtgtgacatttccatagcacacgaggaagctgaccaccccatcctagtctt

SEQ ID NO: 12690 - DNA, 74 bp, Homo sapiens
aacgcccctggaaggattgcatggggtgcccactctggggctccttgagtgtccctgcccctggcttccagggg

SEQ ID NO: 12691 - DNA, 74 bp, Homo sapiens
gttcagctccatcatcaaacatgtctcccattcctggtggcctcacagacaccaaggtttgcagttttcatggg

SEQ ID NO: 12692 - DNA, 72 bp, Homo sapiens
aagccttgaggtttccagtgcaatgtgaaaggggtagtgacacatttgtcacttgtcactgtccttggtgct

SEQ ID NO: 12693 - DNA, 73 bp, Homo sapiens
ataaggcacagaggacaaagtgcttacagtcgactgcggaaaggcagagacaagctttggaatcttaaccacc

SEQ ID NO: 12694 - DNA, 72 bp, Homo sapiens
ctacgtgagaaagagtagcagttagagacataagagacttcagtggtagaatctctaaaagtcatacgtgga

SEQ ID NO: 12695 - DNA, 71 bp, Homo sapiens
aaatgtaataaaacacagttgggcagtttatgggactgaggaaatgtatcctgcccttggtaaccacctgt

SEQ ID NO: 12696 - DNA, 73 bp, Homo sapiens
attctgttatcagactgatgatgacatcacatgatgtatcctccagcgaactcaagtctaactacaacagaat

SEQ ID NO: 12697 - DNA, 72 bp, Homo sapiens
aaatctcaagtctcaaagctgtactctacttgcattggctttctctgtctgcaagggtctagagaccaaggc

SEQ ID NO: 12698 - DNA, 70 bp, Homo sapiens
acacatgttccatgagtgagaaagtgttcttattcatgattaagagcctgccagactcatgctgtcatcc

SEQ ID NO: 12699 - DNA, 74 bp, Homo sapiens
ggcgctcgagtttcaccccggcggggaggaggaggaggaggaggcggcgcggcggcgggggcggggcaggggcg

SEQ ID NO: 12700 - DNA, 74 bp, Homo sapiens
gtctggaggcaaaccatcacattgccagtctcccttgcaactctggttatgaatgtgaattgggttccagcctt

SEQ ID NO: 12701 - DNA, 71 bp, Homo sapiens
gacggctttttgtcatattgcccaggctggtctcaaactcctgggttctagcaatccacctgcctctgcct

SEQ ID NO: 12702 - DNA, 72 bp, Homo sapiens
tgtggaactttagcataagtgagtccattttggtttgatctgctggggcctagtgcagaagctcagtccata

SEQ ID NO: 12703 - DNA, 71 bp, Homo sapiens
acaacagcaacaacactgcaagcaaggccatgtcggatgacacagtgacagctgtctgctgcacactgcac

SEQ ID NO: 12704 - DNA, 74 bp, Homo sapiens
agaccagaggtagtaggttgatatagtcatggtgccgaaagaaaaaaaaaactgtcagccaagaatcctatgtc

SEQ ID NO: 12705 - DNA, 70 bp, Homo sapiens
acataatggcccctgtaaaaaaaggtctgcttaggaaggaaataacatatgcgtggggctgtgctcaatg

SEQ ID NO: 12706 - DNA, 73 bp, Homo sapiens
atcaactttttggtttccgtaccagcagaacagtcatgaactgttgaacatagtcatgaactgttggctgttt

SEQ ID NO: 12707 - DNA, 73 bp, Homo sapiens
ctcagtagagtggccttggactcttggctagatgagaaagtctcagagcactagtgactacaaaaaaagagag

SEQ ID NO: 12708 - DNA, 71 bp, Homo sapiens
atggtacatatatgaggcatatatatacatcatatgtgtgtcatacatttatcatttatatatgtatcata

SEQ ID NO: 12709 - DNA, 73 bp, Homo sapiens
gaaatatgttaccaaaaaggcaatggtagcatagacatgctcactagtgcctaactatcctcttcaggtgaca

SEQ ID NO: 12710 - DNA, 71 bp, Homo sapiens
ggaaaaggatcattagtccactaagtctctctagatagcaccatctgaggataactggggcaatggaactc

SEQ ID NO: 12711 - DNA, 71 bp, Homo sapiens
tcatgattgcgaccatatagtattggtacaattgcatactagtgtatactggaacaaatgcatggactaaa

SEQ ID NO: 12712 - DNA, 72 bp, Homo sapiens
ccagagccctgtggggtgcagagcagcaccaggcggaaccaggatgaatcagggcaaggaaaaatctggctg

SEQ ID NO: 12713 - DNA, 70 bp, Homo sapiens
aaacacaactccattaagtactttgcttacatcagccatgataatcaggttagcaatgttttaaggatga

SEQ ID NO: 12714 - DNA, 70 bp, Homo sapiens
aagcgctctggggcccggaaataaataaccgcgcgcacgaggcgccgccgccgccgccgccgcccggagg

SEQ ID NO: 12715 - DNA, 72 bp, Homo sapiens
cgacctatacacatctgatcgatcttatgtctagctgtttctctcaggagccctagaagggaagtgatttta

SEQ ID NO: 12716 - DNA, 71 bp, Homo sapiens
gtgatcagtcaaatgcaaatcaaaactgcaatgagataccatctcatgcctgttaggatggctgttatcaa

SEQ ID NO: 12717 - DNA, 72 bp, Homo sapiens
ggcaagagaggcacaggaggggagcagccagattgcactttggtttccctctctgggattcttctgagaaaa

SEQ ID NO: 12718 - DNA, 73 bp, Homo sapiens
ccctagatatgcacttagcaccacttctgtgcgtccgtgaatctcacattgtgggtgctggcttccttctcag

SEQ ID NO: 12719 - DNA, 73 bp, Homo sapiens
gggtattggatttatgtgagaatacaagggcctggccccccttgcctagattatgaaagctctgaagggcctt

SEQ ID NO: 12720 - DNA, 71 bp, Homo sapiens
ccaggctttccaaaaaatatgtgataaggtgcctaacaggtgctgacacaagaggatgtctgaccaagtgt

SEQ ID NO: 12721 - DNA, 70 bp, Homo sapiens
tattcttgagtgctttctggttaggacaaagggtttggctactgataggaatacagacactcagtgagta

SEQ ID NO: 12722 - DNA, 74 bp, Homo sapiens
cacattggagtagcacgtctgtgggttgggattacacaccagacatgtcagtccgctggcccaactgtgcctcc

SEQ ID NO: 12723 - DNA, 70 bp, Homo sapiens
atgtatacggtaaaggcattagtatctccgcggcagagatgctgaggcttagattggtgagggcagcaca

SEQ ID NO: 12724 - DNA, 73 bp, Homo sapiens
ttgaaatgctataattcacaatgaactgtaaaatgagagttttttggactcataagaggttttctttgtggag

SEQ ID NO: 12725 - DNA, 72 bp, Homo sapiens
tttcattgcctatggaccaataatggtaatgccattttctgttttgaggtaaaataatattttcattgaaga

SEQ ID NO: 12726 - DNA, 73 bp, Homo sapiens
tagtacttaaacaccagcagcaatgttgtttgctacaaaactggtggaaacattgctgtggcaactggtattt

SEQ ID NO: 12727 - DNA, 73 bp, Homo sapiens
ttgtgatgcaacatcctacagctgatagatctgcttccacaaaagtcaggttttctgggagagtaaacatgac

SEQ ID NO: 12728 - DNA, 70 bp, Homo sapiens
gtggtcaaaacctgagttctggctagccccaccactgtgggctaaagcactccagggtccttaatgaact

SEQ ID NO: 12729 - DNA, 71 bp, Homo sapiens
ggtttctgctgaaagttacactgttagcctgatgcagtcccctttgtagatgaccttactcttcccaatag

SEQ ID NO: 12730 - DNA, 72 bp, Homo sapiens
aagcagagcaaagccagagggttgggaactgttgacacaacctctctcctcctgctttatgatcttctgcca

SEQ ID NO: 12731 - DNA, 71 bp, Homo sapiens
tctccaacttctgacctcaagtaatccagccgcttcagcctccgaaaaagtgctggtattacaggtgtgag

SEQ ID NO: 12732 - DNA, 70 bp, Homo sapiens
tctctttccatgagctagcaccatttgaaaaaagcttagactggctaagttcatggactcattattaaat

SEQ ID NO: 12733 - DNA, 70 bp, Homo sapiens
taatgttgttgctccattgcggctgctccctacacaccaagcaacatatgaccagaggcagcatttagca

SEQ ID NO: 12734 - DNA, 73 bp, Homo sapiens
ctgccctacgaaaaaggagtcagcctgcttctttatgcgagtccctgatgaaatttctcctcactgggcagga

SEQ ID NO: 12735 - DNA, 72 bp, Homo sapiens
ttgctatactcctaagaaactccagttagggaggcaggagtctcatctaacttgagaggtctccatttatca

SEQ ID NO: 12736 - DNA, 72 bp, Homo sapiens
ttatttttatcattattttaatgggatatgaaggagagcagcacctaatggttgttttcattttcttaactc

SEQ ID NO: 12737 - DNA, 74 bp, Homo sapiens
actgaaaaatgtggactcagcaactagactctttgagtgaaaattcgagttctgatagagtgaactgcaccaca

SEQ ID NO: 12738 - DNA, 71 bp, Homo sapiens
gctggtgtctgctgcttggtgcctgaggaaatgtcctcacatattttgtcccagaagtcctctgtgttgat

SEQ ID NO: 12739 - DNA, 72 bp, Homo sapiens
tagactgagtgtgatgtctgaaacagattatggggcaatgtatgtttctggaattcaaaactattacacaac

SEQ ID NO: 12740 - DNA, 73 bp, Homo sapiens
atggtggtgcatgcttgcatgcctgactaacatggagaaacctccttacaaaattaggtgggcatggtagcgc

SEQ ID NO: 12741 - DNA, 70 bp, Homo sapiens
tctgtctcatcatctgtttgaaatggctcaagagctgcttttattagctcccacattgaccaaactgaga

SEQ ID NO: 12742 - DNA, 72 bp, Homo sapiens
ctaacatctttgttgaggtggtgcttttgatgactcaaataacagggactgcataacctcttatgaaattaa

SEQ ID NO: 12743 - DNA, 72 bp, Homo sapiens
caatgatactgtagagcatttgtaggatgtgagtaggtattcattttaactgcaaaggacttatattaaagt

SEQ ID NO: 12744 - DNA, 70 bp, Homo sapiens
ttggtcacctttgcctttcctggcatgtgtcttcccaggtaggtgcctctactggggcgaatacgaccct

SEQ ID NO: 12745 - DNA, 72 bp, Homo sapiens
cttaaatatctctccctaacttgtgatccctggatttttcctggattactatttctgttttgacttttggtt

SEQ ID NO: 12746 - DNA, 70 bp, Homo sapiens
tgtcactagttgaatataacgggttatgagatattatttgtaagcctcgttataacttcaaatctacaaa

SEQ ID NO: 12747 - DNA, 72 bp, Homo sapiens
aatgcctactgggtgacaatactttgcagggctggggcaaagttctccagaagtctatgtatgggctgaatt

SEQ ID NO: 12748 - DNA, 74 bp, Homo sapiens
gtgaatgcataaaactgaaagcttttaagagcacccaggtcaatttttgaaggctttgctgcttataaatttat

SEQ ID NO: 12749 - DNA, 70 bp, Homo sapiens
tggaatcattcccttcataggcatacgttgccagcgaatcatatggaggtgcacttgggtctgcgtcgtt

SEQ ID NO: 12750 - DNA, 70 bp, Homo sapiens
gcttccaccatcacaaatgctatggcagcatcaagaagttaccctatatggtctaaaaaggggaggtgtg

SEQ ID NO: 12751 - DNA, 72 bp, Homo sapiens
ttccatgttcatacattggaagactcagtgttgttaagctgccagttcttcccagtttgttctacagagaca

SEQ ID NO: 12752 - DNA, 74 bp, Homo sapiens
tgtctgcatggcactcataactacatgagtagtttgactctgtatatttttgttacctatgaaactccatgaga

SEQ ID NO: 12753 - DNA, 72 bp, Homo sapiens
aacttagctatgagcctcagcttagaatatcagctctgacctatgagttgatcaggacaggtatatacggct

SEQ ID NO: 12754 - DNA, 73 bp, Homo sapiens
tcttttccaaaaaatatttttctatttgggctccagtgcctgtttcagcaggaacagtaagtgagagaataaa

SEQ ID NO: 12755 - DNA, 74 bp, Homo sapiens
gagagagctacattgtcaatcaggtaggcgctgtttcacatgcgcctattgagcactacacattgagatgtgct

SEQ ID NO: 12756 - DNA, 70 bp, Homo sapiens
tcccagaaatgtgagtggctcagttcagcacattgagtcttcactgaattacttctttgggggaagaaga

SEQ ID NO: 12757 - DNA, 72 bp, Homo sapiens
ggtctctgcatgctgagaatcattttaggcatttggaattctccagagccagaggactaagcaagaaatttt

SEQ ID NO: 12758 - DNA, 74 bp, Homo sapiens
aaaagatagacatttcagcaggaggacaatacaggcttgggatttgttcgagtcttctcctgacagtgggcaga

SEQ ID NO: 12759 - DNA, 74 bp, Homo sapiens
tgggggctattgtatttaatgcaatgtctttatgggtgaccagttggaatggcagtgatcgatggagtcacaca

SEQ ID NO: 12760 - DNA, 71 bp, Homo sapiens
gctgcagtttcagccgcgacagcaagaacggcagagccggcgaccgcggcggcggcggcggcggaggcagg

SEQ ID NO: 12761 - DNA, 73 bp, Homo sapiens
ctccagacacattttgctgttgctgtttgtggggaatagcatagactgtgacaacaggctggaagaagtggta

SEQ ID NO: 12762 - DNA, 73 bp, Homo sapiens
caagtgatgcgactctgagctgagcccatgtgactggggtacgtggcacccagcaggcatctgagggtagagc

SEQ ID NO: 12763 - DNA, 72 bp, Homo sapiens
ccctccagcagggaaggctcctgggagctttcaggtgcatggattcctgtcatttccagagccttactgtgg

SEQ ID NO: 12764 - DNA, 70 bp, Homo sapiens
gggtttcaccatgttggccaggctggtcttgaactcgcgacctcagatcagcctgcctcagcctcccaaa

SEQ ID NO: 12765 - DNA, 72 bp, Homo sapiens
cttctcctccagtcactggcattcatgatggtctgtgacttttactccagtctcaggatccttgtgtttgtt

SEQ ID NO: 12766 - DNA, 70 bp, Homo sapiens
agccatctatgtgtttggatggtagtgagacctcagctacattgccaggcattacggggagaatgggctt

SEQ ID NO: 12767 - DNA, 70 bp, Homo sapiens
ttaatcgctcactttgagttaattgaaagggagattacctggttgatcctaaccaaattccatgagccct

SEQ ID NO: 12768 - DNA, 70 bp, Homo sapiens
gatgcttggatttggccttgaacccgtgagccaggcacaggcaagcagaggataaggccagtgagtggga

SEQ ID NO: 12769 - DNA, 72 bp, Homo sapiens
tctggttcacattccgaggctaaatgttaatggcttgctgctgccaaaccctgctttggggatgatcacttc

SEQ ID NO: 12770 - DNA, 74 bp, Homo sapiens
ctggaagacctgctgtagcttggcttcacactcagctgtgaacttgtcagctgaacacacaactgcaggtgcag

SEQ ID NO: 12771 - DNA, 72 bp, Homo sapiens
atattttgcttatcagactagcaagataagattgataaagtccagtgctagcaaaaatgtgagtaaacatcc

SEQ ID NO: 12772 - DNA, 70 bp, Homo sapiens
taaaaagagattatctgccccagagattcacttcatagaggtagtctgcagcaccttggggatttaaaaa

SEQ ID NO: 12773 - DNA, 74 bp, Homo sapiens
gtagcccagatcagggcaggatggtgactcactaaattcactcatttatacctggttgatcctgccagttaaag

SEQ ID NO: 12774 - DNA, 72 bp, Homo sapiens
ctctcctcagtggttttgtttcctttcagagacctgcagaagacaccctgtatgaagcagcagaaccaggta

SEQ ID NO: 12775 - DNA, 72 bp, Homo sapiens
aatttaggtgacacatgtcagtcatctgtctaccaacatgattgaaattgttagctaagttttcttttttct

SEQ ID NO: 12776 - DNA, 72 bp, Homo sapiens
cttctgcatatggatatccagttttcccagtccatttattgaagagactgtcttttcctcagtgtatgttct

SEQ ID NO: 12777 - DNA, 73 bp, Homo sapiens
acatggaagaatctaagacacagagacttggtagataacagtatctagctagtatctggctaatgattgtttt

SEQ ID NO: 12778 - DNA, 74 bp, Homo sapiens
cttcctagcaacatactgcaatgaagtagtagcaatgacatttttgttttaacttctttgttattaactatgga

SEQ ID NO: 12779 - DNA, 70 bp, Homo sapiens
ttgagcagatggttgtaaaggttgacctgtaaaaagaggtgccaatttgttttgctgtagtgtgctgtca

SEQ ID NO: 12780 - DNA, 72 bp, Homo sapiens
gtatggttagcatacttaagtatggttaaccatacttaagtgtggttaacataacagtaataccatatattt

SEQ ID NO: 12781 - DNA, 74 bp, Homo sapiens
gaggcaggagaatcgcttgaacctgggaggcgaaggttgtagtgagccaaggtcacgccattgcgctccagcct

SEQ ID NO: 12782 - DNA, 71 bp, Homo sapiens
ggcctccagcacataaggcagcacatctggtgaggagctgtctaatctacacctgccttaggaagcaactt

SEQ ID NO: 12783 - DNA, 71 bp, Homo sapiens
gtcgctgttgtgactattcaactctgctactgtagtgtgagagcagccatagatagtgtgtaaaccaatga

SEQ ID NO: 12784 - DNA, 73 bp, Homo sapiens
gcatcctaattatcaggtaccatgattggggtgatgagaatgcacacagtacagacgtgtaacccacctagga

SEQ ID NO: 12785 - DNA, 73 bp, Homo sapiens
ttggcccccactctcttctggcttgtagggtttctgaagagagatccactgttagtctgatggagttcccttt

SEQ ID NO: 12786 - DNA, 72 bp, Homo sapiens
aacaccattacttctgccacattctgttgaccaaagcaagtctcaaagccaggtttagggttgggggaaaac

SEQ ID NO: 12787 - DNA, 72 bp, Homo sapiens
ctggcccttggcaggtgtaggatccaagccagtagcacgagctgagtacagcctaccaggctgagtgggtgg

SEQ ID NO: 12788 - DNA, 71 bp, Homo sapiens
tgatgtccctgtttgtccctgttcaggcgccacctgtggctgtctgccacaagtactatttgagaccatca

SEQ ID NO: 12789 - DNA, 74 bp, Homo sapiens
aatagagtgagactccatctgaaaaaaattatatcattggcaaacagtgatactttgacttctctcttcctatt

SEQ ID NO: 12790 - DNA, 73 bp, Homo sapiens
atctctctaagtgtgctgcctcatttggaagataatgataatagtagcactacttcacaggtattgggggaat

SEQ ID NO: 12791 - DNA, 73 bp, Homo sapiens
gtagtataaggattattatttatctaggttgtcaggcaagagcttacagatgggtgacatttgaatgcatact

SEQ ID NO: 12792 - DNA, 73 bp, Homo sapiens
tatattagtgacggcggtctcgctatgttgcccaggctggtctcgaactcctgagctcaagcgattcgcccgc

SEQ ID NO: 12793 - DNA, 72 bp, Homo sapiens
tgtagaaagtaccgttattactctcatttgacagaggaggacacagctgacaggagggttaagtaacttaat

SEQ ID NO: 12794 - DNA, 72 bp, Homo sapiens
gtgcctgtttcttctatgcagggaggatagtgatgcttacctcaaaatgttctaggttaaacaagatgcagg

SEQ ID NO: 12795 - DNA, 72 bp, Homo sapiens
ttctaaggtctaatccattactagactacatatatatatatatatatgtagtgtatatatatatatagtcta

SEQ ID NO: 12796 - DNA, 71 bp, Homo sapiens
ctgtattaaaacatgaggctccggtcacatcaaaggctcctcacgggtggcttgggccagggtaaggtcac

SEQ ID NO: 12797 - DNA, 74 bp, Homo sapiens
ttctgtccctgagaccctggctggaagttattggggttcctgcagagaggccccacccagtgaggaggaatggg

SEQ ID NO: 12798 - DNA, 72 bp, Homo sapiens
cagcactgtggattcctgggcatggggccagctcatgaggtagtagtttgttcctgaaccacaatttttgct

SEQ ID NO: 12799 - DNA, 72 bp, Homo sapiens
ggtcccccatatcttgagcactctgctatcacctagtggttagagatagtccaagatacattaaacttcaac

SEQ ID NO: 12800 - DNA, 73 bp, Homo sapiens
tgattctgaatttgcctgtctctccagatttggggaaggtggtttgcctttaaaattcagttctcttatgggt

SEQ ID NO: 12801 - DNA, 71 bp, Homo sapiens
actcaatattatgatgagaaagagaatgctaggcaatctttaatgctcttgtcatttccattgtagtcatc

SEQ ID NO: 12802 - DNA, 72 bp, Homo sapiens
ctagctcctttgaggtatgtgccatcaggctaaaccatctgccactcctccttattgctgtcatctgccaac

SEQ ID NO: 12803 - DNA, 72 bp, Homo sapiens
aaactggaaagaagctttctgagaccctaatttgtgatgtgcacatacatttcacagtattaaatctttcct

SEQ ID NO: 12804 - DNA, 74 bp, Homo sapiens
tcacagaatggacaaacgcagtgtttcctaactgctgactccacacaatagcttatctctgtgagatgaatgca

SEQ ID NO: 12805 - DNA, 73 bp, Homo sapiens
tagtgtactaggttttattaggcatctttattgtcttacttattgatgtgatgaacactgcatgtcatactgc

SEQ ID NO: 12806 - DNA, 72 bp, Homo sapiens
taggtgattgtctcgctgctcagctataggcgatggtctcatcgcttggtgataggcaaatgtcccttcgtg

SEQ ID NO: 12807 - DNA, 73 bp, Homo sapiens
tcttggcatcatggtcatgctagaggtcacaaaaaataggatagttagaggagaaaaatggtggtggtggtag

SEQ ID NO: 12808 - DNA, 72 bp, Homo sapiens
ggtatttaaatcctgtcgagtgctgctcctgaagggtgaaaatttcctcatacttccagcctgctactggca

SEQ ID NO: 12809 - DNA, 72 bp, Homo sapiens
taagacctgcttaacagtttatggggcttcaagtttgtgttgtgctcacatcgtggatctccagaacaagat

SEQ ID NO: 12810 - DNA, 74 bp, Homo sapiens
ggagatgacacgacttatgtttcaacaggatcattttgacttctgtttcaacagtataaatttgtctgttgcct

SEQ ID NO: 12811 - DNA, 74 bp, Homo sapiens
tgttgtgtagtgttgaagcagggcatgaatttaccatcctccaccctcactgtcaggtgtagcacatgcagaca

SEQ ID NO: 12812 - DNA, 74 bp, Homo sapiens
tcactgtgttgtccgggctggagtgcagtggtgtgatttcagttcactgcaaactcaactacccaggttctggt

SEQ ID NO: 12813 - DNA, 72 bp, Homo sapiens
actgggctagaatcaagatgtcaccagggctgcatttcttctggaggttctaggggaaaatcagtttccctg

SEQ ID NO: 12814 - DNA, 72 bp, Homo sapiens
tgtgccgagcaccatgccagatgctagactagtctctttcccaaagaagcaggcatagcttgagaacaggaa

SEQ ID NO: 12815 - DNA, 72 bp, Homo sapiens
gctttccaatgcccatccaatttagcagtgcctcagagtcatctgggatacttgtgaaagggtctgtttctc

SEQ ID NO: 12816 - DNA, 73 bp, Homo sapiens
gatgccgacatgctggctatgctacagtgtcacccccagcactattgaagccaagctgctcctcctaggcaca

SEQ ID NO: 12817 - DNA, 71 bp, Homo sapiens
taattcattcttttcccagagaatggggagaagcagtttgctgtgcacctctccttcttgagaatgacttt

SEQ ID NO: 12818 - DNA, 70 bp, Homo sapiens
atgggtgggtggtttagatatcagactaagggcctggcagccaggggtctggatctatcttcgtgtccaa

SEQ ID NO: 12819 - DNA, 71 bp, Homo sapiens
tcttatttggtcactctcctttgtatcactaaagacaacaatttagttttgtcttgaatgattgaggactt

SEQ ID NO: 12820 - DNA, 71 bp, Homo sapiens
ggtgatccgcgcccccgagcctggcccggcgggagacggcggcccgggcgccccggcccgctacgccaatg

SEQ ID NO: 12821 - DNA, 74 bp, Homo sapiens
atgaaaataaggcctgccacactgtgctggtggaaatctagactttacaagggcagttgaagttttttgtgcat

SEQ ID NO: 12822 - DNA, 73 bp, Homo sapiens
aggggtccaccttcaattttctgcatatggctagccagttatcccagcagcatttattgaatagcgagtcttt

SEQ ID NO: 12823 - DNA, 72 bp, Homo sapiens
cccaaagggtaggtaaggaacatgagctagcctccttcacagattagcctggacgcaagcccagcctacttt

SEQ ID NO: 12824 - DNA, 72 bp, Homo sapiens
gtgtcaaggaccttctgagtctgcagtgatgggaatctcacatgttgtagactggactagaaggcagagagc

SEQ ID NO: 12825 - DNA, 73 bp, Homo sapiens
tctgtttgagtgctgcactgtactcatgtgaatttatctattttaacttctgtaccagcagcctttttcccag

SEQ ID NO: 12826 - DNA, 71 bp, Homo sapiens
ttctgctgccttctctacaagtaggaactggtttcttcctggggcaggcaatgttcatggcctactcactg

SEQ ID NO: 12827 - DNA, 74 bp, Homo sapiens
taccttagactgggcaacttataaaaaatagaaatgtattgcttataattctagaagctgggaagtccaggatg

SEQ ID NO: 12828 - DNA, 73 bp, Homo sapiens
agtgaggatattgtcatatggtgatgagggacgtttgtgaattactatgtaaagaaaagatgcttactctgtg

SEQ ID NO: 12829 - DNA, 74 bp, Homo sapiens
tattgtcttggtgactaaggaacccagaaatactgtggaaactgctgctactgtcaccatgtgcatagacaatg

SEQ ID NO: 12830 - DNA, 74 bp, Homo sapiens
tgtcttcagcttggccatgcactgaagcagatgaatagtttatcagactggcaaatcaagtcggcataggtggc

SEQ ID NO: 12831 - DNA, 72 bp, Homo sapiens
cagtagggtcattattttaggccaggttatctaactccaaagcccttagcttaatcactaggctatactgaa

SEQ ID NO: 12832 - DNA, 74 bp, Homo sapiens
tagcattctgtctaaggttagtttcagcatgcaactggtgataaatggcatatagatgcatgtgcaggggagga

SEQ ID NO: 12833 - DNA, 72 bp, Homo sapiens
cagacttctgccatagccccagagtcctagtccacatataggagtacatgggctctaagccctacacagact

SEQ ID NO: 12834 - DNA, 71 bp, Homo sapiens
agaaaagtgtctggtacatggtaaacacttaatatttgttaaccgttgaaggttgaatgtttactattgat

SEQ ID NO: 12835 - DNA, 72 bp, Homo sapiens
ggatgtcagaaggctatcagtttgctgaatcaaacagcattgccacagggctccaagctggcagggcccctc

SEQ ID NO: 12836 - DNA, 72 bp, Homo sapiens
atggggaaggttttttctgcaatgttcatggcatggcaaacaaagtcattccatgtcaacctcatggaattg

SEQ ID NO: 12837 - DNA, 71 bp, Homo sapiens
ccccttgcagccaattgcagccaggcaataatgtgtcatctgactgtccagttttcccaagaggagcaagg

SEQ ID NO: 12838 - DNA, 72 bp, Homo sapiens
tcaagccagctaaatgattgtttccctgatggcaaaagtctcagattgattgcacagtttatttggttggat

SEQ ID NO: 12839 - DNA, 71 bp, Homo sapiens
tatctgcttcatagttttgaaaaggcctggtccaataaataatgatttggccatatcatgggtgctattaa

SEQ ID NO: 12840 - DNA, 74 bp, Homo sapiens
agagacagaccccaatacaaaaataactggaggacaggagccatggctcacgcctgtaatcccaggtctttggg

SEQ ID NO: 12841 - DNA, 71 bp, Homo sapiens
gaacatattcaccagatcaatggcaacatactgagtgccagaggctgtgttggtctgtttagtaaagatat

SEQ ID NO: 12842 - DNA, 74 bp, Homo sapiens
ccccatagatggagctccttgaggacagggccagacaggattttctcgatccccagtacctggtgttctatttg

SEQ ID NO: 12843 - DNA, 72 bp, Homo sapiens
gtgtcttataaggtgagagtttacttgcaggctgacagggaagtaaaagcccagataagacaagctcacaga

SEQ ID NO: 12844 - DNA, 72 bp, Homo sapiens
tgcaagtgagtgagcacaggttctgctgtcactgatcagatgaagcactgtggccagcacccccaaacaaag

SEQ ID NO: 12845 - DNA, 70 bp, Homo sapiens
ccctgacctttcttttgagctccagatttgtcctaatggacattatcttttaatgggtattaatggatgc

SEQ ID NO: 12846 - DNA, 73 bp, Homo sapiens
tggcaccagcatttacttctggtgagggcttcagaaagcttatactcacagcagaagatgaacggtagccagc

SEQ ID NO: 12847 - DNA, 73 bp, Homo sapiens
cttgaacccgggaagcagaggttgcagtgacccgagatcgtgccattgccctccaggctgggcaacaagagcg

SEQ ID NO: 12848 - DNA, 72 bp, Homo sapiens
tacagggcgggtaaagtttgatgtcagatggttactgagtcaccgatggtataaaacaacagctgcactgcg

SEQ ID NO: 12849 - DNA, 72 bp, Homo sapiens
caggaggttcacttgagctcaggaggtcaaggctgcagtcagccatgatcgtgccactgtagtccaacctgg

SEQ ID NO: 12850 - DNA, 70 bp, Homo sapiens
ggctcccgaggtctctatggcgcccgcgcccctcccccagccgagctccagcacttactccggggggtag

SEQ ID NO: 12851 - DNA, 74 bp, Homo sapiens
aggcagatgagggagtgcagagaaaggctcttcctgaatctgttgattctcaaatgcctttcactcaaaataat

SEQ ID NO: 12852 - DNA, 72 bp, Homo sapiens
tataaggtcacagtggctaagtaaatcagcggtgacagacacctctgtaaaaggcagccgctgactgggatg

SEQ ID NO: 12853 - DNA, 74 bp, Homo sapiens
ccaatagcaaaaccttttcttttcaagggctctagggttcagtggtaaagtgctttttgttttgttttgctttg

SEQ ID NO: 12854 - DNA, 72 bp, Homo sapiens
cgtcttgaaggtgctattgctaactgtttttaaggaggagatgactcgatggcactcaaatacaccttttcc

SEQ ID NO: 12855 - DNA, 71 bp, Homo sapiens
gctcactgagctacatcgtgcaataataacacatttttataggagtagcttgtcagagcagcaacaacatg

SEQ ID NO: 12856 - DNA, 72 bp, Homo sapiens
aagttgctttcctgagggaggcctaagctggtaccatagctgccactgggtgggggtgaattctggagaatg

SEQ ID NO: 12857 - DNA, 73 bp, Homo sapiens
cactgcaaagtgctacactgttctcatccactggcaacagagaaaagcagcacaaaagatgcatcattttaat

SEQ ID NO: 12858 - DNA, 73 bp, Homo sapiens
agtttggggagcaattgaggtgcaaatgggatatatccttgccctcaaagtgcttacagcataggaagaaacc

SEQ ID NO: 12859 - DNA, 72 bp, Homo sapiens
acggaaatgtgtcatcgaaagccaggtaaccagtgggccgcggctgggccgccggggcaggctaggggcgcc

SEQ ID NO: 12860 - DNA, 73 bp, Homo sapiens
ctaatttccctttatctgcaacagctgacaactacactgtcattctatgtgtgtggaacaaaggtgacaaatg

SEQ ID NO: 12861 - DNA, 70 bp, Homo sapiens
agaagagcatggttgcattcaactctatctgtggtcatatgatcaaagaccaaggaatgacaaatcctgc

SEQ ID NO: 12862 - DNA, 73 bp, Homo sapiens
atgtgaagtgctgagttctggggcagagaggtacggcacctggcacccagtgggactcagtgctgttatttct

SEQ ID NO: 12863 - DNA, 74 bp, Homo sapiens
caggaccagtgtatgccaccctggggctcaaggacaggcatgctcagcccaccgctgccaccactgaggcttca

SEQ ID NO: 12864 - DNA, 72 bp, Homo sapiens
gctatggctagatactgtgcaaggtgccagggatacggcaatgagctaatggcatatctcttacttgcatgg

SEQ ID NO: 12865 - DNA, 70 bp, Homo sapiens
tcctgctggccccgcctgctgggggctccccggcgcccccgggcccggccccggcggcgggggcaggagc

SEQ ID NO: 12866 - DNA, 72 bp, Homo sapiens
tgtaaagaccgaagttttttttagacggagttttgctcttattgcccaggctagagtacaacggcgcggtct

SEQ ID NO: 12867 - DNA, 73 bp, Homo sapiens
acctgtgatgccactgccactaatacattataatgtccagtgggtccgatggcacagtttatttttcacatca

SEQ ID NO: 12868 - DNA, 73 bp, Homo sapiens
tgaggaacagagtgggttagaggtgggtgcagcttcattctttaagtctgaaacagtttcgttttccacactg

SEQ ID NO: 12869 - DNA, 70 bp, Homo sapiens
cagtcttgggtatgtctttattagtggcaaaaaaagggactaatacagtatccagagctttctttgaaat

SEQ ID NO: 12870 - DNA, 73 bp, Homo sapiens
aaaatgtacaaatacaaaaatgtctaggcttggtgtggtggcttacacctgtaatcccagcactttgggaggc

SEQ ID NO: 12871 - DNA, 74 bp, Homo sapiens
tgcaaacaggcttgctgaggtagtaggttggtcccaccacccaccgttcctatctctatagatggcatggtgca

SEQ ID NO: 12872 - DNA, 72 bp, Homo sapiens
gaaaccaaggtgcagagcagcatatattatatactgtgctactgtttatacagtgttggtatatatatgtgt

SEQ ID NO: 12873 - DNA, 72 bp, Homo sapiens
gcccagcgtccctctcggccccttccctctcccccgggggagaaggggcgggtccacgcggcctgggcgctg

SEQ ID NO: 12874 - DNA, 72 bp, Homo sapiens
ggaaattctgagcttctaatccctgggggtggcacatggggggctggacagtaagaattgatagatgtcctc

SEQ ID NO: 12875 - DNA, 74 bp, Homo sapiens
aggacactgggaggtcagatgccctggggcagatcaaagcattgcttatctgactcagcaggacacatttcgtg

SEQ ID NO: 12876 - DNA, 73 bp, Homo sapiens
acagggtctcactatagcgcgcaggctcgttttgaactcctggactcaaaggaccctcccgctgcagcctccc

SEQ ID NO: 12877 - DNA, 72 bp, Homo sapiens
caaagggcacctgtgtctacctgaaactaggcagcctcctctcacatcatgctcagggtaggtgcacatgcc

SEQ ID NO: 12878 - DNA, 72 bp, Homo sapiens
ccaaagaaggaggtgaggcctctgattcaggggtgtctgccaacccttgtacctccacacacacactcctga

SEQ ID NO: 12879 - DNA, 73 bp, Homo sapiens
ctcttgaaacctttgaatttatattccgaagctaatttttgttggctgctaaatgcttttacatggtcttaag

SEQ ID NO: 12880 - DNA, 72 bp, Homo sapiens
aggaagccagaagattggacacgcctggcatacggcataccactgcgccatccaaaacagctgtgcacagcc

SEQ ID NO: 12881 - DNA, 72 bp, Homo sapiens
ctcccaagtagctgggactacaagtgtgtgccaccacgcttggctactctttccctgttgcactacattgaa

SEQ ID NO: 12882 - DNA, 74 bp, Homo sapiens
gcataacctcagttttcccaggagtccctcgcccgtggttattaacgccagagtttctggagctcacgcagtgc

SEQ ID NO: 12883 - DNA, 71 bp, Homo sapiens
atactgaattcttcttactgtacatttacctatattggcgggggggtggggggcggttcaggaagaaagtg

SEQ ID NO: 12884 - DNA, 72 bp, Homo sapiens
atcattgccagaaactttgtatgaccccttcaagcagtgtcttgtcagagtgtgtctttatggggtatctcc

SEQ ID NO: 12885 - DNA, 72 bp, Homo sapiens
taataattttgtaaagctgttatcatagtaccctgtctgatgggtgacaatgttttgattggcttttctcta

SEQ ID NO: 12886 - DNA, 70 bp, Homo sapiens
ttgatgagaacccatgagataattgtcctgtctggtcctagaccaggattaattgactttctactaaact

SEQ ID NO: 12887 - DNA, 72 bp, Homo sapiens
attaatgatgacatgactacgattggtgaggagtatggcaggctttcactatctctacttcactaacgaata

SEQ ID NO: 12888 - DNA, 70 bp, Homo sapiens
gagacccagcctttgctgagaagatgttttggtaagccagcatgtaaggaagccttagggcttggtttca

SEQ ID NO: 12889 - DNA, 72 bp, Homo sapiens
tgactttcttgtacatgtagactttctccatcttggaggcaagttgaccgttgacagatgaagtctcaaaac

SEQ ID NO: 12890 - DNA, 70 bp, Homo sapiens
attttaaccccttaggctgacaactgacacaaactcagattgccacacacagaagccaaggggtctgttg

SEQ ID NO: 12891 - DNA, 73 bp, Homo sapiens
ctctcattgcttccaaatgatggggtacaggaagccctacccccaaataaggcatcttggcatactgagaatt

SEQ ID NO: 12892 - DNA, 74 bp, Homo sapiens
ctaccccgcgccgccctccacctcggagcggggacgtacggtggtggcggtgacacaatgcgagtgagtgggtg

SEQ ID NO: 12893 - DNA, 73 bp, Homo sapiens
gcagactgacctatgaattgatttattgaccatctgctttatcattaaggattgatggcagaagcaagaatgc

SEQ ID NO: 12894 - DNA, 73 bp, Homo sapiens
gatgtatgatactcccatagaaaacctgtaaatatatcacattgggtcttctatggaagcaataatcaattac

SEQ ID NO: 12895 - DNA, 74 bp, Homo sapiens
ggttacaatttgagctaaaatttgggtggggacacagagccaaactatatcaatccacctctggtccctcccaa

SEQ ID NO: 12896 - DNA, 72 bp, Homo sapiens
gctatatatttacacattctgactaatacaaatgtcagaggcatgtgaaccagagtaactccatcttaaata

SEQ ID NO: 12897 - DNA, 74 bp, Homo sapiens
gtccttgagagctactcagagtgactggctggacaaatgtctacatgacagtttgtcaaatatttgaaggcagg

SEQ ID NO: 12898 - DNA, 73 bp, Homo sapiens
tatgactagttctgaatgaatgaatgtgggaaacagcctatccgggtccagttttcccgtgaatttttgagag

SEQ ID NO: 12899 - DNA, 71 bp, Homo sapiens
gaatttactggcatacagagaagcaaacagagtgtgtgggatgctataggataacaagctctcaactgcca

SEQ ID NO: 12900 - DNA, 71 bp, Homo sapiens
gagatctccacctcctggtcagctctgaaaatcttggcagcttagcactgcaattggcaaaggagtgtttt

SEQ ID NO: 12901 - DNA, 73 bp, Homo sapiens
aataggggtctagtttcattaccctgtatttggctgtccagttttcccagcagcatttattgaagggtgtgtt

SEQ ID NO: 12902 - DNA, 72 bp, Homo sapiens
ataggtagctggtaaactttagtgggattttgtgcctcagcttgttattaaagttactcctgagaaatgatc

SEQ ID NO: 12903 - DNA, 71 bp, Homo sapiens
catgacccagttgttggactgaagctgttgtttattgtaagtagtctcaggtcaaagaagctggacccgag

SEQ ID NO: 12904 - DNA, 74 bp, Homo sapiens
ccagaaaggctacatgatctccctactgtcacgtaactaattaatataagtgtaaatcttagccttagtctggc

SEQ ID NO: 12905 - DNA, 70 bp, Homo sapiens
ctttctttggcaatggattaatggaatcaagagtggcttgtcacagcaagtgtcacagtcagacagaaag

SEQ ID NO: 12906 - DNA, 72 bp, Homo sapiens
caagccttatggcctgagaactaggagaaccaatggtgtagttcccgtgcaaaagccagcaggcttaagacc

SEQ ID NO: 12907 - DNA, 70 bp, Homo sapiens
aaacaccacaggtcaaaataagtaaataaataaaagttgtttggatactttgactacttggaggtgtgga

SEQ ID NO: 12908 - DNA, 70 bp, Homo sapiens
atcaatggggcaacacacgtgttcaaagtgcttcaagagcacaaagtaggaagcccctgtgaatgtcagt

SEQ ID NO: 12909 - DNA, 73 bp, Homo sapiens
ttttaattgttgtctttctgtatttttactgtcccagaggacaacagaaataccccacaactttgtttagagg

SEQ ID NO: 12910 - DNA, 71 bp, Homo sapiens
aagaggagggaaagaaataagcctctcaatgcagatttccttctgtgtcagtgacagtttacccccaaggg

SEQ ID NO: 12911 - DNA, 74 bp, Homo sapiens
aggagtcattcatgatcaggtttacatccactgtgtagcttaatgagtgaggtttgaacaattggcaaaatgat

SEQ ID NO: 12912 - DNA, 70 bp, Homo sapiens
cgcccagtttgtggtattttgttatagccaccatagcaaaataacacaactactaagggaaaccatgatt

SEQ ID NO: 12913 - DNA, 74 bp, Homo sapiens
cccatggcagatcgacagacctggtagattgagtagatgcaatgtctgcattatatattgactctggtagagct

SEQ ID NO: 12914 - DNA, 72 bp, Homo sapiens
tctatcttgtggctcaggccttactttcttcatttggacccaacatagcaccatttgagatctggtcctgat

SEQ ID NO: 12915 - DNA, 71 bp, Homo sapiens
tgcaagcagaagagatgaaactgggcaaggctgtagaagtcattaacacggagctctcatttgtgatatca

SEQ ID NO: 12916 - DNA, 71 bp, Homo sapiens
ctgagctcaaaagatctgcacaccacacgcagcctctcaaagtgctgcgattataggcatgagcccccacc

SEQ ID NO: 12917 - DNA, 74 bp, Homo sapiens
cccatgctgctgtgcctgagacgggtgtccttagggcactgcccctaactctcctgacctatcaaatgcaagat

SEQ ID NO: 12918 - DNA, 72 bp, Homo sapiens
gcctacgtcttgaaaaacaagcagctgacagggccaacaaagggggtcatctatcttgaaatagatgtgatt

SEQ ID NO: 12919 - DNA, 73 bp, Homo sapiens
aaaacaggatggttgtgtggatacttacagtatggtttctactgaatgtgtatcatttttacaccattttaaa

SEQ ID NO: 12920 - DNA, 74 bp, Homo sapiens
gcaccatgtctgagcctagactgaagctccccagaaacatccaggagagtggctgtgaaatattaggttggtgc

SEQ ID NO: 12921 - DNA, 73 bp, Homo sapiens
gctaacatctgaagtgcagtatccgcccaaaaatctgagtcgaataggggtgttttaacctacttgacatgtt

SEQ ID NO: 12922 - DNA, 72 bp, Homo sapiens
aggaaataaagggatagtgaaacttaaatctctatgttttacaagttctgaaatttccttcttgaccttgaa

SEQ ID NO: 12923 - DNA, 72 bp, Homo sapiens
gggattcaagctcaggtgttgggtccaaagcagatgctctctctgctgctctacagagcaaattccaaggtc

SEQ ID NO: 12924 - DNA, 73 bp, Homo sapiens
tgaacttcttagagtaacagcataaggttaatgccataattgcattcacaggtaaaaactgctgtcctaagat

SEQ ID NO: 12925 - DNA, 74 bp, Homo sapiens
tactgaagagagtagtgcaaaatgccaaatttttctagcacaaagagaaatattggcagttatccccaaaattc

SEQ ID NO: 12926 - DNA, 72 bp, Homo sapiens
gccccagccaccatcaaaccaccaccatatgagagttcccaaacaagaactccaagctgagttgagcctggt

SEQ ID NO: 12927 - DNA, 73 bp, Homo sapiens
agaacttgggctctagcctctaccatttctaattacttgaaaaaggatgaagtaaataggtcctccatgtttt

SEQ ID NO: 12928 - DNA, 74 bp, Homo sapiens
caggacatgcaaatccatgcaaacagaaggtaatctggtggctaccaggggctgaagagaggggaatggagagt

SEQ ID NO: 12929 - DNA, 73 bp, Homo sapiens
ttctgtggctcttataggaatttgtatttatacccagttgcctttagctacattgtctgcttctggccacagt

SEQ ID NO: 12930 - DNA, 72 bp, Homo sapiens
tttccttatctgtacagtttggaggaaggtgataatagtacctgcctcacaagactgtgtaaggaaacataa

SEQ ID NO: 12931 - DNA, 73 bp, Homo sapiens
ctctgtctctacaaaaaaattaagccaggcatggtgatgtatgcctgttggcctagctactcgggaggatgag

SEQ ID NO: 12932 - DNA, 73 bp, Homo sapiens
gttttgcttgtggtcatctgtggtacatgattacttgagatgagatgccacgatggtggtggaggtaaagaag

SEQ ID NO: 12933 - DNA, 74 bp, Homo sapiens
gcctccggagtagctgggactacaggcgcccgccaccacgcccggggcattttttgtattttcagtagagacgg

SEQ ID NO: 12934 - DNA, 70 bp, Homo sapiens
tcagcactgctttacaatcaccatgagacaggagtctctgggcatgagaggagtcaaagaattacaggta

SEQ ID NO: 12935 - DNA, 72 bp, Homo sapiens
caggatgaatttatagatggtcaaactggatgctcccatgcgtcatgcctcattattatgattcatctactt

SEQ ID NO: 12936 - DNA, 72 bp, Homo sapiens
tctttaactcagcgttttggcaatggatttgcactggtgctttgtcttcttgtcgttctctgatcctactat

SEQ ID NO: 12937 - DNA, 72 bp, Homo sapiens
ccaggatctgatggcttccctgccgaactctatcaaatatttaaataatgagggccaattctcagattcttc

SEQ ID NO: 12938 - DNA, 71 bp, Homo sapiens
atattctgacctattaattgagagagctggtttctgagttaccttgtaactcagactctcagataaccaaa

SEQ ID NO: 12939 - DNA, 72 bp, Homo sapiens
ctgtggggagattttgcgcaagcgcctttgagataggagggccttgggcgttgcgatgtcccgcgctagctg

SEQ ID NO: 12940 - DNA, 72 bp, Homo sapiens
agtggttgtggtcaaagatgtaggtggagggcaagaatgcaattggagggatttggcctgactggcaaggta

SEQ ID NO: 12941 - DNA, 72 bp, Homo sapiens
ctcagtccagtctcagctaatttgtgactgattgctctcttaatttccaaagtggcctcggacacaaattac

SEQ ID NO: 12942 - DNA, 73 bp, Homo sapiens
actactccatgtgtttctgtttgtatagagtgcattttagaatcaattgaggtagtaggttgtacttgaaatc

SEQ ID NO: 12943 - DNA, 72 bp, Homo sapiens
atgggacctgccattctgaccagcaggccagtggattatcattctctctgttaggtcctcccaccatggcag

SEQ ID NO: 12944 - DNA, 70 bp, Homo sapiens
taaacgactatttgtagaggccctattgaatgctagatactggcactgtggaaagctacaaaataataca

SEQ ID NO: 12945 - DNA, 72 bp, Homo sapiens
gccagagaagttttccttgataaagtgaagtctaagctgagtaaaaagtgatacggagaagcaggctggctg

SEQ ID NO: 12946 - DNA, 72 bp, Homo sapiens
aatttcagaacattctcattagactgaaaagaaacccagtataaatgggcatattctggacatttcatataa

SEQ ID NO: 12947 - DNA, 74 bp, Homo sapiens
gtcagatcatggaggaaattccacatgcattgatttagatagtgtaccattgtagaaacctctagacttctaga

SEQ ID NO: 12948 - DNA, 72 bp, Homo sapiens
tagcccaagctgcgggccctgggagtggagacgcggagctgcggtcgccgctttctgggctcgctcaccagc

SEQ ID NO: 12949 - DNA, 74 bp, Homo sapiens
ggagccacctcgcccgggcgcgccaagttaacaaagtgctgggcggcgtgcggcggcggcggcggcatcatccc

SEQ ID NO: 12950 - DNA, 70 bp, Homo sapiens
ctccgaaacttttagtagcaccatttggaatcaaaaatgcttatgaggtttattaggaaatgtacatcac

SEQ ID NO: 12951 - DNA, 71 bp, Homo sapiens
ccaaacatgtatcagagctgtggaaagtggatgctgtcttttcatccagctcaccacaagaggaatgcaac

SEQ ID NO: 12952 - DNA, 71 bp, Homo sapiens
gaaatctgtgatgtgtgcattggtggttcagttttttcatgggcactagaaaccttctcacagtcttcagg

SEQ ID NO: 12953 - DNA, 74 bp, Homo sapiens
tttggtggtcttggaactacttatgaagactcactttttccatcattgttcaaatccagataaggcttgaccaa

SEQ ID NO: 12954 - DNA, 74 bp, Homo sapiens
accaaacttgcatcccaggagtaaaacctatgtgactgtggtgaattaacctcttgatgagatgctggatttgg

SEQ ID NO: 12955 - DNA, 74 bp, Homo sapiens
aattctcatggtgtttcacatgactgtgctcagaagagggcacacccactctaaacagaaaatgttccagaaga

SEQ ID NO: 12956 - DNA, 73 bp, Homo sapiens
ccgagtggggtagtagtttgtgctgcagtctatctttgttgcagaaccatctctcgctctgggccctactcag

SEQ ID NO: 12957 - DNA, 72 bp, Homo sapiens
ccttctgctaagtttagttttctattgcgtagagtctctgtagtactgatattaaacttgtagtttactctc

SEQ ID NO: 12958 - DNA, 72 bp, Homo sapiens
agccatatcagaattcatatctataaatgcaatggtttgcaaaatttctaaaatgaaaaatgttaccattgc

SEQ ID NO: 12959 - DNA, 73 bp, Homo sapiens
aatacgtcaccatagctgggctcattggctcgtgcctgtagtcccggctactctggaggctgaggtgagagga

SEQ ID NO: 12960 - DNA, 70 bp, Homo sapiens
gttttcacacttagttcccacatggtctagcgtccacattttgagtaccagtgtctaggtgatatcctta

SEQ ID NO: 12961 - DNA, 73 bp, Homo sapiens
agttgacacctaaaattaaccatcacagtctcagctcttaatatgctgtgatgggccaaatgcagtaggaact

SEQ ID NO: 12962 - DNA, 72 bp, Homo sapiens
tatcctctcttgcctctgatcgatgtggtgacatcatactctcccaacttggtcttaaggtatgttggataa

SEQ ID NO: 12963 - DNA, 71 bp, Homo sapiens
tctgaatcaagctcctcaatggtaaaaggtgtatttgataccatctgaatagccacagagcccagagccct

SEQ ID NO: 12964 - DNA, 73 bp, Homo sapiens
cagagtagctctcctcgtgccaccttatgctcgcacaaaactctgaggagtctacaaattctacacatgaatc

SEQ ID NO: 12965 - DNA, 73 bp, Homo sapiens
tggaataagtgctggtgctgtgggaagcagcatggcagtcacttgccaaattgcccatgcacacagactcatt

SEQ ID NO: 12966 - DNA, 73 bp, Homo sapiens
tagtaaagtatctaacacctgaaggcactgtactcgctaccctagtgcctttgcacaggtggttcttagccta

SEQ ID NO: 12967 - DNA, 73 bp, Homo sapiens
gaggaactgcaggttccttatcaacaaaacaaggataataaaacttgtggtttattgcagttttaataaagat

SEQ ID NO: 12968 - DNA, 72 bp, Homo sapiens
tgctttagtcatcacctagctgcgagaatgctgccagacaagatttttctttccaggcagaagataggaagc

SEQ ID NO: 12969 - DNA, 70 bp, Homo sapiens
gatgttgcttattctctcttttccaagtttcttggaaaaaccagagctactgtgcatttctaaccttcaa

SEQ ID NO: 12970 - DNA, 74 bp, Homo sapiens
ggcactattgtcacgagatatatgtcctataacagcatctttgctgccttctactacatcttaaaaccaatgcc

SEQ ID NO: 12971 - DNA, 74 bp, Homo sapiens
aaaaggctttgtctagcattatccaagttgtgtttaaccctctgaggacctgcagccagatatctagatgaagt

SEQ ID NO: 12972 - DNA, 73 bp, Homo sapiens
acgattgagatgaagacagtgctggtagggggatcaacccaatgtggctgctgaagggggatgtatgccagga

SEQ ID NO: 12973 - DNA, 70 bp, Homo sapiens
atcgcctcattccacttcatatctaatttaaagggaagaaaataagtaggaatggaggggtaggacacaa

SEQ ID NO: 12974 - DNA, 73 bp, Homo sapiens
aaaaaaattcaaaacaaaacccatgtactaccctactctaaccagggtggcatgatcagatcaaggtttgggt

SEQ ID NO: 12975 - DNA, 73 bp, Homo sapiens
cctggagccggagccgctcagctggggcccgcgactcatcccgagccccggagggcgaggcccggagggggcg

SEQ ID NO: 12976 - DNA, 72 bp, Homo sapiens
actcagaagcatttgactcagtagcggaggaaaatcagccctagaccaaatgctgctttggtcctgtttaac

SEQ ID NO: 12977 - DNA, 71 bp, Homo sapiens
tttcctagagtagtagtttgtagttctccttgaagaggtccttcacatcccttgcaagttgtatttctagg

SEQ ID NO: 12978 - DNA, 71 bp, Homo sapiens
atggctttctgtggacagatcagcatgactagagcagcagctactcacagtctctgaaactatacaagacc

SEQ ID NO: 12979 - DNA, 72 bp, Homo sapiens
cttgataaatgtctccctgtattatttctacttactcttcatctgagatgatgttgggaaggagaacagcaa

SEQ ID NO: 12980 - DNA, 73 bp, Homo sapiens
attagcccaatggcaaggtactgatggtgaagaaataaggccttctaataatactaaaagacagcacttgcca

SEQ ID NO: 12981 - DNA, 73 bp, Homo sapiens
tctagtaccacagggtagccaacagtttttagtgctctcctgaagtgatagatccctgggtgataggaattga

SEQ ID NO: 12982 - DNA, 74 bp, Homo sapiens
tggcagctacacagccttcaaacgaaagtgtgcccaggaaaccatacttgaccctttgagggctttctcttgcc

SEQ ID NO: 12983 - DNA, 73 bp, Homo sapiens
gaaaaagaggtaaagcacccctttcttttgtagtctgtgaataagcaggaataggagtatcgtggcttcttag

SEQ ID NO: 12984 - DNA, 72 bp, Homo sapiens
gaccattagctttactgctgcccgttgtcacagcagcagtgtttctataaggcaaaggaggcaaatgaaatg

SEQ ID NO: 12985 - DNA, 72 bp, Homo sapiens
taataccagggtgtttggtgaagtatagatgacccttagtgtacctgagtcagtgtcaaatatccagttttc

SEQ ID NO: 12986 - DNA, 73 bp, Homo sapiens
caacttttcagtgttcaagtaaagcaaacgccaagctgtaaccaatcagggtgtttctgtacctcacttccat

SEQ ID NO: 12987 - DNA, 72 bp, Homo sapiens
agctcagcttagctgagaaggcacagggcatctaaggaggatgggacgtcgttacctaatatgagtgggggc

SEQ ID NO: 12988 - DNA, 74 bp, Homo sapiens
taaaagcaataagcacaagttttgtccagatatttaataatgctgcttaaacttgtgaaaccatacttgtgtgt

SEQ ID NO: 12989 - DNA, 70 bp, Homo sapiens
caacaaagaaggctggtccagttttcccatgataagctgtgctggggagaaacatgcagcggccgttgtt

SEQ ID NO: 12990 - DNA, 71 bp, Homo sapiens
gtctaattttgccattgaaagctctgatcctacctgcagctgatctgggtgcaatggttttaggactcaat

SEQ ID NO: 12991 - DNA, 71 bp, Homo sapiens
agaatgtgggttggtttgggctgtaggcagaggtaaggtaatatgtctggctagagttagacagagacagg

SEQ ID NO: 12992 - DNA, 70 bp, Homo sapiens
ctcctgaatttaatttctgttctgacattaaactactaatgttttcagctgtgcagaaaaaaaaatcact

SEQ ID NO: 12993 - DNA, 70 bp, Homo sapiens
ggaccctggcctccaggtaaggaggataggaagggccagtcctagataccgccttgtccatctgcacgct

SEQ ID NO: 12994 - DNA, 74 bp, Homo sapiens
aacctaggatcatgtcagttggtaccatgtaggcccacctctactgtgtgactttcagcaggacacttactctt

SEQ ID NO: 12995 - DNA, 71 bp, Homo sapiens
tggaattgtctgctaactccactcctgggcaacgtgttctttcttgaggggggggcctgcaacatgggcta

SEQ ID NO: 12996 - DNA, 71 bp, Homo sapiens
aatttatgccaacaacccagtaacaagatgaagatgaacatctgcttaaatgagaagttgttggattttgt

SEQ ID NO: 12997 - DNA, 73 bp, Homo sapiens
ttacccagtattccctagtggtaacagtttacaaaacaatgtaaaccacagccaggatattgtcaaggtgtag

SEQ ID NO: 12998 - DNA, 73 bp, Homo sapiens
atcagtaaatggcttgttttttaccttttttcttcttcataggtaaggatggtggtctacagaatacaataac

SEQ ID NO: 12999 - DNA, 74 bp, Homo sapiens
ggcatatctgcacagtccatgttaggtacgtgggtcagtaaggtgattcaagtaggctgcattgggaggtggtc

SEQ ID NO: 13000 - DNA, 73 bp, Homo sapiens
tttcaatccagggaagcatttccatagttaagtctccaataatgaaaactacatattaagtgcaggccatgga

SEQ ID NO: 13001 - DNA, 74 bp, Homo sapiens
cacctagaaggtgaggttaattaagtcctgttggttcgaatccgagtcacagcaccaaatttcactcgcgtcct

SEQ ID NO: 13002 - DNA, 73 bp, Homo sapiens
atgtcacctgtttagtaccagcaaaggaaaaagcaagaccgcaaatagctggtaatgaaatcctgtggaattg

SEQ ID NO: 13003 - DNA, 72 bp, Homo sapiens
actcctatgaaatcataggaagctggaacatgtggtggattgtgattgtggaattgactcataggaattggg

SEQ ID NO: 13004 - DNA, 74 bp, Homo sapiens
agaacacaaggcttgccaccatcttgggagctgcccgccaccatctaggtagcacctgccactatcttggaagc

SEQ ID NO: 13005 - DNA, 72 bp, Homo sapiens
aaagtattcctgtggggctactgattttcagtgcttagcttatcatcagtaacactggaagtagctgatcat

SEQ ID NO: 13006 - DNA, 72 bp, Homo sapiens
tattaatgcaatgactacataaaagcctacctatgctatagggcaggtatcttgtttcacagcttattcata

SEQ ID NO: 13007 - DNA, 70 bp, Homo sapiens
tacaaatgccagtttcctgggtttgctgtagttctatagttgctcaggtataaccatggggagaaactga

SEQ ID NO: 13008 - DNA, 70 bp, Homo sapiens
caccaagttaaggcatggaaataagtggagaaaatcaagaagagaagtcaaggccttaactttggtgatg

SEQ ID NO: 13009 - DNA, 73 bp, Homo sapiens
caagaataagagcaaatattataagttagggtgaagcactacattctttagacccccactgaagctttgctca

SEQ ID NO: 13010 - DNA, 71 bp, Homo sapiens
tgatcgtatattattctgggaagcctgagtgttatcttacaggctacagagaacactacaggaactgtcca

SEQ ID NO: 13011 - DNA, 72 bp, Homo sapiens
tttgtttacctgttttcaagttattgatatatcttttaaattggaagatgtacattctttataaggcagcaa

SEQ ID NO: 13012 - DNA, 72 bp, Homo sapiens
ctaggagctaagggaggactgcagccaatagtcagcaagaagccagagccctcagctccccagccacaggaa

SEQ ID NO: 13013 - DNA, 73 bp, Homo sapiens
tagtgcttccttcaggggctcttgtaaagcaggtctgacagtaatgacttcccttgcttgtctgtaaagtatt

SEQ ID NO: 13014 - DNA, 73 bp, Homo sapiens
cagagtaaacaacagttgaggtcaaaagggtccaatttccttggacaagcaggcctcaagaaggcctctgagc

SEQ ID NO: 13015 - DNA, 70 bp, Homo sapiens
ttgccagtcaccctctggggcttgaaggctctttttcttttctgtggggggtggtccctcagcaaccaga

SEQ ID NO: 13016 - DNA, 74 bp, Homo sapiens
aggacgcctggcctgaggaatgaggagcagtctagggtcagagtgtgagtgtgtgtgtgtcagtgtgagtgtgt

SEQ ID NO: 13017 - DNA, 73 bp, Homo sapiens
gtcaggaggctgctgctgcctccaggtgagaggcgagggctagacgaatgccgtggaggtggtaagtggtttt

SEQ ID NO: 13018 - DNA, 73 bp, Homo sapiens
ctggtggtgggtggcctgactcgcaggccagggttcccttggccctctgggtgggcattggtatggccctcag

SEQ ID NO: 13019 - DNA, 74 bp, Homo sapiens
tgtttttcaaatggcagctacagagagagaggggctgtgatttcttgtcagaactgctttatggggttgtattt

SEQ ID NO: 13020 - DNA, 72 bp, Homo sapiens
tcaccatgttgcccaggctggtcttgaactcctgatctcaggtgatctgaccacctgggcgtcccaaagtgc

SEQ ID NO: 13021 - DNA, 71 bp, Homo sapiens
actagatgcacacagccactgggaggagggccgtgtcttgagccctttgaaggctgtatggtataagaact

SEQ ID NO: 13022 - DNA, 70 bp, Homo sapiens
ccttcaggcactagtgagcaagctgttcttccctcagggccttgggcacagtgacttgtgaggctggggt

SEQ ID NO: 13023 - DNA, 74 bp, Homo sapiens
cccagccgacacaggtgtggttttagagtgaggggcaagcctgagtcattcttctggatcactgtggtcctgct

SEQ ID NO: 13024 - DNA, 73 bp, Homo sapiens
tgaactcctggctgaaggtatcctcccactttagcctcccaaagtgctgggattacaggcatcagccaccacg

SEQ ID NO: 13025 - DNA, 74 bp, Homo sapiens
tcctctgttgcctcataactgatttcctgaaactgttgttttatatatattatctatttggttgtttcagtagg

SEQ ID NO: 13026 - DNA, 72 bp, Homo sapiens
aaggcaacctgggaaaaactcttctggacattggcctaggcaaacagtttatgattgagaccccaaaagcaa

SEQ ID NO: 13027 - DNA, 70 bp, Homo sapiens
gcaacaccagcccacagctgctgggctctgcctgggagaagcggctgtgcacccatgcccaaatgctgac

SEQ ID NO: 13028 - DNA, 73 bp, Homo sapiens
aatatgaccattgattgtcgtttaggtaacaggtgagagtcaaaggatatcatgtaaaactgacagactagat

SEQ ID NO: 13029 - DNA, 71 bp, Homo sapiens
actgatgattactagcagcttccttccctaggggccttttccgattataggctcagactgaagtttggatc

SEQ ID NO: 13030 - DNA, 71 bp, Homo sapiens
tcctgcctccaaatttccttcttgtcccgagtgctggggagccccactgaagaaatgggaaaggatttggg

SEQ ID NO: 13031 - DNA, 70 bp, Homo sapiens
actccttgtgggtccccaatacggagcagtactgcagaaagtgctctgctggggttaatgtgccacatgg

SEQ ID NO: 13032 - DNA, 73 bp, Homo sapiens
cctcctccatagaatatcacgttgcctccagcgcttgtgggatctggggctgggtaaacagggacaagtgagg

SEQ ID NO: 13033 - DNA, 74 bp, Homo sapiens
tctatggtttagaagtttcagtcgcacactcctacccgggtcggagttagctcaagcggttacctcctcatgcc

SEQ ID NO: 13034 - DNA, 74 bp, Homo sapiens
ataaaattacctcataataacttctgtggatacgctaccagggccgccccactcgcgggcccagtctggaggtg

SEQ ID NO: 13035 - DNA, 70 bp, Homo sapiens
cgggacgtgggcctggtgcttcactgtggctggtgaacttgtaacgctatttgtaatcaagtggcccatg

SEQ ID NO: 13036 - DNA, 70 bp, Homo sapiens
ttcaaagcatttcctacttcaaaggatttgaactctgggtcttacaccagagtctctggataggtgaggc

SEQ ID NO: 13037 - DNA, 70 bp, Homo sapiens
cagtcagcggtcctgacacatgagcagtgcaccccagtgcctgggcttgtccatcctctcattctggact

SEQ ID NO: 13038 - DNA, 72 bp, Homo sapiens
taactttgactgggctgtgtttccccattactttgtgagccttataattttgtgttgggatttgcacatttg

SEQ ID NO: 13039 - DNA, 72 bp, Homo sapiens
atatacaggagatctcttctgcatgttcagggtggaagtcggaattagaggagattgggtatatgtatgtgg

SEQ ID NO: 13040 - DNA, 73 bp, Homo sapiens
ttccaaggtgtctaacagtgtgccaggcatgtggctcctataatacagtatggcacatgcctttatctaacta

SEQ ID NO: 13041 - DNA, 72 bp, Homo sapiens
gagtatacctgtcagtgagttaattcatgatcttgtaactgtgtataactaactgagagatactgtatttga

SEQ ID NO: 13042 - DNA, 72 bp, Homo sapiens
cctctcttacataaactgttctagatcacagaagaaaattgaaaatgtatctttcagtttatgggactagca

SEQ ID NO: 13043 - DNA, 73 bp, Homo sapiens
acactgccctgagacctcagtccacaacgcagtgctgtagaaatgctgccttgagacagatatggaaggaagg

SEQ ID NO: 13044 - DNA, 74 bp, Homo sapiens
gccgctgccgccgcgggagccgaggccgaggctgaggccgcagtgtccgcgaacagcagcagcagccgcttgcc

SEQ ID NO: 13045 - DNA, 74 bp, Homo sapiens
gtggcggctcttaaaggggaggccgggaggccgccgcggcggcggcggcgcgcccccgccccggcacctgctgt

SEQ ID NO: 13046 - DNA, 71 bp, Homo sapiens
caggaaggcttctacctggcttagcttactccacccttcctgggttggaggtgctaactgaggtgatctct

SEQ ID NO: 13047 - DNA, 71 bp, Homo sapiens
ccagagtctacttcaaattcctcccttaggggccttcaggactgttagggtgagatgtgagctggtgtgga

SEQ ID NO: 13048 - DNA, 71 bp, Homo sapiens
tatggaagtatcagcttactgctcatcatccatggcatcacatgtgaagagcaccaccaggagtatctctg

SEQ ID NO: 13049 - DNA, 72 bp, Homo sapiens
tgtgcctcagtgggaaagcagcccacaccatcccttgctccctgggctcctccatcctctgccaaggctcac

SEQ ID NO: 13050 - DNA, 74 bp, Homo sapiens
gctggttggcattctggccctggttcatgccaactcttgtgttgactaccccaggatgccagcatagttgctta

SEQ ID NO: 13051 - DNA, 74 bp, Homo sapiens
tggggtaaatggcaagcagcattctatttccatctctccagataagggtccttaggagctgctattttagacca

SEQ ID NO: 13052 - DNA, 73 bp, Homo sapiens
ggggtgcaaaactgggggagagcaaggctgggccttaaggcttctagcacagactgcacgtccgattgactgg

SEQ ID NO: 13053 - DNA, 73 bp, Homo sapiens
tcatccttcaggtccagcataggctttgtttcctccacagggcctccctggtccccaaggtgaggagcacatt

SEQ ID NO: 13054 - DNA, 74 bp, Homo sapiens
tagaagaaatggctcatagatgctcctccaactagtggcttgggatccctgagaccagacatctcagaaattta

SEQ ID NO: 13055 - DNA, 70 bp, Homo sapiens
tagccaacctagcaaaggatctgggactaagggtagaggaactggccgcgaggggggcccaagttgtgtc

SEQ ID NO: 13056 - DNA, 71 bp, Homo sapiens
cactgcccaggtccccagtgcgccccctagtggccatagcctggttaaagttccccagtgcctccttgtgc

SEQ ID NO: 13057 - DNA, 72 bp, Homo sapiens
cagcaacgaccacagtagctgctgctgatgaagtgctcctcatgtggcaggcattgtgctaataagcaggac

SEQ ID NO: 13058 - DNA, 74 bp, Homo sapiens
agcagagtgagcaatcaatgagcgaaagcttttacctatattattattgttatcgtttatttgaaattgctctc

SEQ ID NO: 13059 - DNA, 71 bp, Homo sapiens
aaaatgcacagagctgggaagagagggacagttattaagtccacctgagatgaagcacgtgcaacgctctg

SEQ ID NO: 13060 - DNA, 71 bp, Homo sapiens
atatttctctggcagctgacctatgaatcaaaggactaaatgttcttgtactattcgggctgcatcttctt

SEQ ID NO: 13061 - DNA, 72 bp, Homo sapiens
gaaaagaagtctctgggatcaggctgggtgtggtggctcatgcctgtgatcccagcactgtgggaggctgag

SEQ ID NO: 13062 - DNA, 70 bp, Homo sapiens
actgaatttttctgtggggggtgggggttgtcttcaacctttaacccttagtgggaataacattaaagga

SEQ ID NO: 13063 - DNA, 72 bp, Homo sapiens
tccattgtcagtttggatttatgggttcctcttttgttcaggaggctataatttataactgtccttatttat

SEQ ID NO: 13064 - DNA, 71 bp, Homo sapiens
aaacagagaacacaatgaaggtattatacagcagtgctgtaaagcacggaattatagtagcatgcttcacc

SEQ ID NO: 13065 - DNA, 73 bp, Homo sapiens
acagatatcccgtatgggccacgctccagttgtattcattttggtgtgtaaatgtccaatcgatctgctacac

SEQ ID NO: 13066 - DNA, 73 bp, Homo sapiens
cagattatacttgggggtagttatggtgatggtgttgtgaaggatgccatggaaatggagatatgagtgtgac

SEQ ID NO: 13067 - DNA, 72 bp, Homo sapiens
aattactgaagctccatggcaagtaagtagtacagaatgtaaatccatgcagtctggctccagggcctctac

SEQ ID NO: 13068 - DNA, 73 bp, Homo sapiens
aaagggggcaaaggtatattatagaatgggaaggggccttatcgattcacagttcagcctaaggcaaatctta

SEQ ID NO: 13069 - DNA, 71 bp, Homo sapiens
tctttctgctgcacttagctttagtctgactctcattccaggggagtccagatgtggtcagtggcccttaa

SEQ ID NO: 13070 - DNA, 74 bp, Homo sapiens
ctagaggaaaaattagaggctcaagaaagaacataagatgttctatcattgccactttaaacactacctagaga

SEQ ID NO: 13071 - DNA, 71 bp, Homo sapiens
gaaaaatccctgaagactgtggtttgagggtaccttctctgtgccacaccaagcctaggacttgctacagg

SEQ ID NO: 13072 - DNA, 74 bp, Homo sapiens
gagcccttgttctactgtctaggccctgtattgtccagggtagtagccatttgactttggacacttggatgtgg

SEQ ID NO: 13073 - DNA, 73 bp, Homo sapiens
tccaatgctgagcaaaacagagcttctcctcttaagatgatgaacagtttatggggttatgcattgtaataac

SEQ ID NO: 13074 - DNA, 73 bp, Homo sapiens
tctgccctgagggtgatctctggttgcagagtggcatggttgcagtagcatggcagctaaaaccccaacagaa

SEQ ID NO: 13075 - DNA, 71 bp, Homo sapiens
gtgtctcctcactgtaggatctggactcatggagcagccatcaacttggtctatcatgctagaggggtgca

SEQ ID NO: 13076 - DNA, 71 bp, Homo sapiens
ttagttgtcagcacagtctttgtaggcctctgcacccctctagcatgatagaccaagttgatggctgctcc

SEQ ID NO: 13077 - DNA, 73 bp, Homo sapiens
atgtaaattgcacacatgtgtacgtgtgtgtgtgtgtgtgtgtgtgtgtacataggtagaatgacttctttgg

SEQ ID NO: 13078 - DNA, 72 bp, Homo sapiens
taatacagtcataatattaataatggtaatagtagttaaaacctattatgtaccaagctctatggtaagact

SEQ ID NO: 13079 - DNA, 72 bp, Homo sapiens
tggatgatctttctcccacttcatcacatttcccatctcccagggagagagagatgggaaatagaactctaa

SEQ ID NO: 13080 - DNA, 74 bp, Homo sapiens
ctgaggatgcagcacagaccctcaaaaccccagaatcctaaagctgggactgccatgcaagacccaggagtcca

SEQ ID NO: 13081 - DNA, 70 bp, Homo sapiens
ttacaacatctatggcagcatcaacaaccttggttaagttgggggtgaagtcaccaaggagtgtgtaaat

SEQ ID NO: 13082 - DNA, 72 bp, Homo sapiens
tggtagaggctggtgggagctggtgagttatggggtttgcagagttttcctgcgagtggaacagtctccagg

SEQ ID NO: 13083 - DNA, 74 bp, Homo sapiens
tggcatgcactgatcctccttcagctgtcctggacagcagcattgcacaggaagcacccctggaaaccctatgc

SEQ ID NO: 13084 - DNA, 72 bp, Homo sapiens
cgcgtcccggcgcgccgggctcctggggcctcaccacctcgcgcgcccagggcgcaccaccggcccgccggc

SEQ ID NO: 13085 - DNA, 74 bp, Homo sapiens
taacatacctggttgatcctgccagcagaaaaaaaaaacaaaacaaaaggctgggcgcggtgactcacgcttgt

SEQ ID NO: 13086 - DNA, 72 bp, Homo sapiens
actggggggaacgctgtgctgtaggctgcacccaagggtaggggctgtgcgaccacatggagactgcctttc

SEQ ID NO: 13087 - DNA, 73 bp, Homo sapiens
ctcagtggtggtgtctgtggcttttcattcctaagagtataaggaaagcctgagccatacaaaacaggagtac

SEQ ID NO: 13088 - DNA, 70 bp, Homo sapiens
tgacaggcttgtcgagaatcctgctttgtgatctcatgtgagatgatatgtaacggtccctgtgtactca

SEQ ID NO: 13089 - DNA, 71 bp, Homo sapiens
ctgctctacccattccctctggtaaaggaagaaatggaggcaaagagaggtgaagggtgagtgaccaagtt

SEQ ID NO: 13090 - DNA, 72 bp, Homo sapiens
gattgcagcagcaaggacgtgaggtttgatgtcagacagacctggcttcaccgctttggaaacgtgatcttg

SEQ ID NO: 13091 - DNA, 73 bp, Homo sapiens
tgtgttttctgtggctgtgctctgctctcccctggtggctcagaagagcaggactgtcacaatccagcccatc

SEQ ID NO: 13092 - DNA, 72 bp, Homo sapiens
tgtaaccatcgtagtggttaaaagcctggccttagggttccagctgtgctatttaccatgtaactttggaca

SEQ ID NO: 13093 - DNA, 71 bp, Homo sapiens
tggcaagggactctgggatgtacagctttaagattattggtatcagcaccagtatcaatgagcagagtttc

SEQ ID NO: 13094 - DNA, 70 bp, Homo sapiens
gagtcttcctgccatggcgaggcttgggcaggagcctgccactcacctaggtagaaggcctttgagacta

SEQ ID NO: 13095 - DNA, 70 bp, Homo sapiens
aggaggggtattaagagagggaccagtcagcaggcggtggatgaaaaaataaagccatgcaggcactctg

SEQ ID NO: 13096 - DNA, 70 bp, Homo sapiens
tcttcaggtctcagcttagaaagtccctcatctggtaagcctggaaagtgtcactagcacaaggcctggc

SEQ ID NO: 13097 - DNA, 71 bp, Homo sapiens
tggggaggttaaatggtttatccagtctcacagctggtaagtagaaaagctgggatttgaacttgggtctc

SEQ ID NO: 13098 - DNA, 73 bp, Homo sapiens
cagcaagttcccactcggatgatgatgtcatcatagccaaagagggaactagcgtttcaattgagtgtcttct

SEQ ID NO: 13099 - DNA, 74 bp, Homo sapiens
agatgatattaagagtaagtagatacttttcttgctataaatactggttccctccttacttaatgtggtgtcag

SEQ ID NO: 13100 - DNA, 142 bp, Homo sapiens
cacctaatgtgtgccaagatctgttcatttatgatctcaccgagtcctgtgaggttggcattgttgtctggcattgtctgatatacaacagtgccaacctcacaggactcagtgaggtgaaactgaggattaggaaggtgta

SEQ ID NO: 13101 - DNA, 73 bp, Homo sapiens
cctctcctgctctcatcctatatgagttgggggtaagcttatccttggctcagggactaaggtactgagcact

SEQ ID NO: 13102 - DNA, 70 bp, Homo sapiens
gaggcaaaaatcagtggggatgatggaacaaaatgctagtgtttatctccatcatccaagatctattctc

SEQ ID NO: 13103 - DNA, 70 bp, Homo sapiens
aaagaatggagacccgccctatacgccggccgagagaggagagtgggcgcgccccccccacccaagccga

SEQ ID NO: 13104 - DNA, 74 bp, Homo sapiens
tggggagagttggggtacgggtgtttgcccaggatgtaatttccaaggcccaccccagatatactgaattagaa

SEQ ID NO: 13105 - DNA, 74 bp, Homo sapiens
atctctaatttgttgagggtttatcatgaagagatgcttgattttagtgaaggcttttactacaactattgaga

SEQ ID NO: 13106 - DNA, 71 bp, Homo sapiens
acatttataggtaccgagggttggaactggatacatctttttggggctacaattcaacccacttcacttac

SEQ ID NO: 13107 - DNA, 74 bp, Homo sapiens
aagtttccttagcagaggaagaagctaaataaacccgccttccctttcctggttactgtctctctctcagctgg

SEQ ID NO: 13108 - DNA, 70 bp, Homo sapiens
atttagagcattatgtaaaatatgctcttgtttgtgtaaaaaaaatataagtgtgcatatgcactgaaca

SEQ ID NO: 13109 - DNA, 72 bp, Homo sapiens
acataaagaaaaatggggcctgaaacatgcacagggagaaaccaacttgtgttgacaatgtttaccctatta

SEQ ID NO: 13110 - DNA, 73 bp, Homo sapiens
tgactcctgagcaataagggattgtggaaactatggggtcaaaatatgtcagttatgcaaaatggggtcgact

SEQ ID NO: 13111 - DNA, 71 bp, Homo sapiens
caccacgcctggccaaaatgctctcattttaagcagacaatttaaattccgcaaatagtccaggcatggtg

SEQ ID NO: 13112 - DNA, 72 bp, Homo sapiens
gctaactaaggaggattccatttgatttcagcaaacaagtttttgtcaaatatgggttcctgggttggtgag

SEQ ID NO: 13113 - DNA, 74 bp, Homo sapiens
gggaagcggggctgcacgcgcgcttgcgggccagctggagttccaggtgggcgtgggcttggcaggcccctcac

SEQ ID NO: 13114 - DNA, 70 bp, Homo sapiens
agaattcaagctcctctatcctcctagcctggtagtctctcattaggtttataaaggcagttgagttttg

SEQ ID NO: 13115 - DNA, 73 bp, Homo sapiens
agcaaagaattacaagtcctcaaaagggtggaattttgagctgcatttctgttctttgaatgggtgcaagtgg

SEQ ID NO: 13116 - DNA, 70 bp, Homo sapiens
gatcaagtgctcaggacaaggccatgctgaagagacaacctccgagcagatgccagcaggatgcttgagg

SEQ ID NO: 13117 - DNA, 73 bp, Homo sapiens
tgcacagtactgggtagtttctggggttaaatattaaatctgagtatgtttttcaaaagtatttagatgtgca

SEQ ID NO: 13118 - DNA, 71 bp, Homo sapiens
gcaaacaccccagagttctcctatctcagtgctgtttgtctgtaggatggattagggaggtgttcgtttat

SEQ ID NO: 13119 - DNA, 74 bp, Homo sapiens
gccgacagcaagcttttttgcatgggaaaaagttcccttccaattacacagcagttttgtggtggctgaggggc

SEQ ID NO: 13120 - DNA, 73 bp, Homo sapiens
ctctgaatgccgagggcttcagtcagaatagcaacacacacctgtgcttctgtttcccaaaggctttcatttc

SEQ ID NO: 13121 - DNA, 72 bp, Homo sapiens
cagcatgaagagtgcatgagtgagagccacgggcctccttaggggaaaaagaacaagtactgcccaagttgc

SEQ ID NO: 13122 - DNA, 72 bp, Homo sapiens
agctgggtctcctggctcttcctaatggatatcctgtgctagtggtaaattctaaagaaaagcctcgagatc

SEQ ID NO: 13123 - DNA, 70 bp, Homo sapiens
tgatctgaacgaggggctacacagtggacattctgaaaatgattggctgtaacccactttcttttggtta

SEQ ID NO: 13124 - DNA, 74 bp, Homo sapiens
cctggtgctccaaaccttgaatgaagagccacagaaatgtggctggtccagccctggtgaaggctttgttacac

SEQ ID NO: 13125 - DNA, 74 bp, Homo sapiens
gcatttagtgttggggtcttagtcataaattcttcgtctaggttaatatccagaagagtttttcctaggttttc

SEQ ID NO: 13126 - DNA, 73 bp, Homo sapiens
gctcacattgtcttttatcagttcactgggcacaacaaacttgtatccttctgagggtccttttagataatgg

SEQ ID NO: 13127 - DNA, 72 bp, Homo sapiens
agaatcacttgaacacgggaggcgggggttgcaatgagctgaaatcgtggcattgcactccggcctgggtga

SEQ ID NO: 13128 - DNA, 74 bp, Homo sapiens
tgcagtagaacagagcaccaggtacattcctaaggctcctgactccaggtcctgactcctggacaacacctctg

SEQ ID NO: 13129 - DNA, 70 bp, Homo sapiens
ataataatcagaggctattgttttgctggtgaagtaatattccacatatcctggccctggttcttctaag

SEQ ID NO: 13130 - DNA, 74 bp, Homo sapiens
ggtagcccctaatgaaaactgcatatgctacaattggtttcagagtctgcttgactgagaatccatccggttgt

SEQ ID NO: 13131 - DNA, 72 bp, Homo sapiens
tccaagaatttacatttcactgaggccagcaagtcttttagattcttgcttatctctgaagcattgattcac

SEQ ID NO: 13132 - DNA, 74 bp, Homo sapiens
gaagtcaacatagtgagttaaatttacctaatctcggtgattattctggcccatgttattagcttgtgtgactt

SEQ ID NO: 13133 - DNA, 73 bp, Homo sapiens
ctaatccacagtttcagtttatggggttctagttaccaagataactttggtccaaaaataagtgggtatagca

SEQ ID NO: 13134 - DNA, 74 bp, Homo sapiens
ttctaggctgaattgcgtttgttaccacatcatggtaaggggctcatcacattagtgaggatttccattattta

SEQ ID NO: 13135 - DNA, 72 bp, Homo sapiens
tcttctttttcatttccaggataggtctgagtttaccctaaggctgggaaaccaagcagacacacctaagtt

SEQ ID NO: 13136 - DNA, 74 bp, Homo sapiens
ggcaggtgaacaggttatatggtaaacttttgtcacaggggtttgttgtacagattactttgtcacccatgtgc

SEQ ID NO: 13137 - DNA, 73 bp, Homo sapiens
ttggttgacataatttgggttatttgccatccctttgtcagtaactcaaataagtgtaccaccaaaattatag

SEQ ID NO: 13138 - DNA, 72 bp, Homo sapiens
gtaggatccagcagaaatcggccagcttccctacacaatagctctggtagtatcggtctgatggaactagtt

SEQ ID NO: 13139 - DNA, 72 bp, Homo sapiens
attctgctattcctagtttgctagagttgttatcaggaatggaagtcagagtttgtcaaatattttccctgt

SEQ ID NO: 13140 - DNA, 74 bp, Homo sapiens
cctgtctctacaaaaaaattaaatgattagccagggatggtgatgcacccggagtcccagctactcgggaggct

SEQ ID NO: 13141 - DNA, 70 bp, Homo sapiens
ttatacctcccctggtttttagtaaagagccaataagacagttccttcttcctaggactaaaagccacgc

SEQ ID NO: 13142 - DNA, 73 bp, Homo sapiens
tctgagatggcaggccctggggccttctgataggagcccctaccaacagctcccacagggtaccccaccctag

SEQ ID NO: 13143 - DNA, 70 bp, Homo sapiens
aattttggtaaggctttcccctcactcctgggttccctataaagtggggagcatattcctgccaacacga

SEQ ID NO: 13144 - DNA, 73 bp, Homo sapiens
tctgcagcagccccaggtgaaggagcattatcaggaattgtgcaaccttagctatgggaactatgcgtgtgaa

SEQ ID NO: 13145 - DNA, 74 bp, Homo sapiens
aggcgggcggcgggcggcgggcggcgggggcaggacgggctctaccgcagtgcccgcatcccggagccgcccct

SEQ ID NO: 13146 - DNA, 78 bp, Homo sapiens
tactgccctcggcttctttacagtgctgccttgttgcatatggatcaagcagcattgtacagggctatgaaggcattg

SEQ ID NO: 13147 - DNA, 70 bp, Homo sapiens
ctgcgaggctctatcgccacctagtggtcacgactcagcattcaggttagagcaaccagcacctagagga

SEQ ID NO: 13148 - DNA, 72 bp, Homo sapiens
aaaaccctttgaggcacgtcacagttctttaagtgactactgagtactgaggacgacctatggggttccttc

SEQ ID NO: 13149 - DNA, 72 bp, Homo sapiens
atgtgggccccttggggctgtgcggaaagaggagagtccagttttcccaggatgagcctggagtgaggttga

SEQ ID NO: 13150 - DNA, 72 bp, Homo sapiens
cacttgaatccccatgtcataggctggttggaaatgccgtgccagttgctacctaggtcttctctcctgttt

SEQ ID NO: 13151 - DNA, 71 bp, Homo sapiens
tgccatttgcttaggtgcttgtgggtacctctcctcctgagtaatccagaggaatccatagcccttccgaa

SEQ ID NO: 13152 - DNA, 72 bp, Homo sapiens
cagccatacacttgcctccagccaggtgctagtagatgcattctgttgtcataagaggacatgtggaaaagc

SEQ ID NO: 13153 - DNA, 70 bp, Homo sapiens
ataactgcgagctagtttgttcatctctttccgtgggtatcggctattgcagcctcaaacttgctttcct

SEQ ID NO: 13154 - DNA, 73 bp, Homo sapiens
tctgctagttcagatgtgaagtgattaatgtttatcatatacttaaaacctctttacagtgactgatacaggc

SEQ ID NO: 13155 - DNA, 74 bp, Homo sapiens
gctgcacttccagtgtggatttctctgcatacacagcttgacaaagccaggttagggagacgagatggcccagc

SEQ ID NO: 13156 - DNA, 70 bp, Homo sapiens
ccattggctcattggtgaaatggagatactaataataacctcaaaggatgttgttactgttcaatgagct

SEQ ID NO: 13157 - DNA, 74 bp, Homo sapiens
tgggtatgggcatgagacaggcaagttctcccagatgtgactccgatgtgacattttggagactccctcaacac

SEQ ID NO: 13158 - DNA, 73 bp, Homo sapiens
tggaataagcaagtgtgggatgatttaaaggctgggactttaaagtcaaataccccagagtttcactctggct

SEQ ID NO: 13159 - DNA, 72 bp, Homo sapiens
tctggtttctccccatctttgtggttttatctacctttggtctttgatgatggtgacgtatggatggggttt

SEQ ID NO: 13160 - DNA, 72 bp, Homo sapiens
caggcatcagaatcacctggagggcttgttaagcacagactgccgagtcctaccccagagtgtctgatgccg

SEQ ID NO: 13161 - DNA, 73 bp, Homo sapiens
gacgagcaattgggggccggaagattgcctgagaagaggtggtgtttgtacctagatacatttgtcagaactg

SEQ ID NO: 13162 - DNA, 70 bp, Homo sapiens
aagcactccaggatctacaggtgctagctgtgaaacatacgagtaggtaagagaaggacaatgaggctcg

SEQ ID NO: 13163 - DNA, 70 bp, Homo sapiens
attggcagccaagcaacttagtatttgctgcatgaggaccactggcccagctttgtgctagaagctgtgg

SEQ ID NO: 13164 - DNA, 72 bp, Homo sapiens
tagtggaatctggggtgtcgtgctgtcaaataaacgtgctcaggcaaacctgaagcctgtctggacctcttg

SEQ ID NO: 13165 - DNA, 72 bp, Homo sapiens
aggtcttgctgggtttagaccgtgcacttttttttccaatcacgtctctgtacacggttgtcagtcatgcct

SEQ ID NO: 13166 - DNA, 74 bp, Homo sapiens
gaggtgacctaggttagagtccctgctctgcacgtcatagctgtgcaactgtaggcactgtacttctgagcctc

SEQ ID NO: 13167 - DNA, 70 bp, Homo sapiens
ctgggtcatattggtaagtggatacttaacttggtaagacactgccaaactgctttcaaaatggctgtac

SEQ ID NO: 13168 - DNA, 74 bp, Homo sapiens
ttctgcctggtggctgtctctacacctgcaccttcagagtctcactcagtgcactgtgaggtcaccttgtgaga

SEQ ID NO: 13169 - DNA, 74 bp, Homo sapiens
gcctgcgcgtggaagcgcggcgcctcgcccaggaccgggcgtcgctcggggccggggccgcagcacggccgggt

SEQ ID NO: 13170 - DNA, 70 bp, Homo sapiens
accaggtcaaagcctcacaaccaggaaataccatagccagagcccggctagcgtgaagtccccgacccta

SEQ ID NO: 13171 - DNA, 72 bp, Homo sapiens
agaccattgtgacagaccattgtgatgctgactatgtagagattcacagaccactgtgacactgactatgta

SEQ ID NO: 13172 - DNA, 74 bp, Homo sapiens
caaaacaattttgagaggaatgctgccttggaagacaacggaatcccaaagccctctgagtcgctggctgcctt

SEQ ID NO: 13173 - DNA, 72 bp, Homo sapiens
tgatctcccttcacagacctccttatctctcaacacatccagaaggaatgaagtcaagagatcaaggatgaa

SEQ ID NO: 13174 - DNA, 73 bp, Homo sapiens
ttgaggctatcagcaaggatgctgacatggagttatttggccccatagtgacagtgtgcacctaatgccttcg

SEQ ID NO: 13175 - DNA, 72 bp, Homo sapiens
ggtagatcccacatgatggcaagcctgccttcagcagctccaggcatcctgctgccagcctaacacccctgt

SEQ ID NO: 13176 - DNA, 74 bp, Homo sapiens
agaactgaggcttgaaacaaagcagctctggagccagtgttctcaggaagctaggggaggtgcatggggcggcc

SEQ ID NO: 13177 - DNA, 73 bp, Homo sapiens
gtggcctgtcttctggacagggtggtcagagaagatcttgggcacagacctgaacagactgagggatggagga

SEQ ID NO: 13178 - DNA, 73 bp, Homo sapiens
gacatccctctgggtagatgaagctccatgtcacacactggtgtgctgggcaaaaaccccaaaccctgttgat

SEQ ID NO: 13179 - DNA, 72 bp, Homo sapiens
tgagggttgaattagacgaccagtgcaaagtacttagtctagtgttgcataatgctaattattacgctcatc

SEQ ID NO: 13180 - DNA, 71 bp, Homo sapiens
aatgtctgtgcaacaccaccagcaacgcatgatgctagggttgtgtagggctatggaggtggttgaccagc

SEQ ID NO: 13181 - DNA, 74 bp, Homo sapiens
gactcaggcaagatgctggcaaactccctgcaaagaattgggcacccaggacagctgggacagctcaggacatc

SEQ ID NO: 13182 - DNA, 73 bp, Homo sapiens
tatcaaggcttatcactgtgatggtgacttgagcacctggcggggctggagcttcactttcctcactgtgacg

SEQ ID NO: 13183 - DNA, 73 bp, Homo sapiens
acatttgatccatcatagcagccatgcaaaatgggcagaaagggcataattatgatcagcatgatggatggag

SEQ ID NO: 13184 - DNA, 72 bp, Homo sapiens
atgataggtactctccctttagtgatcacatccatactgaccaggggtggtgagaatcccaggcagagttgt

SEQ ID NO: 13185 - DNA, 74 bp, Homo sapiens
ccttctacaaaattgtctacttagtcaggctattgttatacagacagtcctttgtatgtagacatctgtagcag

SEQ ID NO: 13186 - DNA, 72 bp, Homo sapiens
gaagcagcagcccaagttgtaccttggccactgttagccatggctggagctggagtggccaaagtgcagggc

SEQ ID NO: 13187 - DNA, 72 bp, Homo sapiens
tccgggcctctcgggccccggggagcgcggcgggccggggcaggggccagggcagggaccggggaggccggg

SEQ ID NO: 13188 - DNA, 70 bp, Homo sapiens
ccaaaaaattagccgggcgtggagccgggcgtggtggcaggcgcctgtagtcccagctacttggtagact

SEQ ID NO: 13189 - DNA, 72 bp, Homo sapiens
atggcgagctggccgtgtagcggtggcggtgctgggggagctctgtagcatcgtggctgagtgcaccccggg

SEQ ID NO: 13190 - DNA, 72 bp, Homo sapiens
ctgcgtctccccaccctgtgcacagtgcttggtgggtgtcaggtactgaggccatgggcagggccatccctc

SEQ ID NO: 13191 - DNA, 74 bp, Homo sapiens
gcatattcctgtagtctggctacttgcaggggtgggtgggagaattgcttgagccctggaggtggaggttgcag

SEQ ID NO: 13192 - DNA, 70 bp, Homo sapiens
cacatccaggtgaggccccccactgcgcccggactggcttgccctggtgtatggagggctgtgctatgga

SEQ ID NO: 13193 - DNA, 72 bp, Homo sapiens
gctgctggttcagggactactctgtgagtagtactgctgcagtaactaactccatccttgcccccagtgcac

SEQ ID NO: 13194 - DNA, 72 bp, Homo sapiens
tggggctgccatctggtgccagcctttgtccctctgcctgcagcgggagctggcccggcagacccatggcat

SEQ ID NO: 13195 - DNA, 70 bp, Homo sapiens
cgtgggactacggtattagacagagatgttaacgaagcgatcatgctgtcatagcccctggtgtgctgtt

SEQ ID NO: 13196 - DNA, 71 bp, Homo sapiens
aagtctggggaggtgagctactggaagagacagggcaagatgcctcggtggagctgcctgctgaagggtga

SEQ ID NO: 13197 - DNA, 73 bp, Homo sapiens
gcacctgtcaaggggaagagatgcatccaccgtggccctgccccctagaggcgactcagagctccacctgata

SEQ ID NO: 13198 - DNA, 70 bp, Homo sapiens
taagcttcacagtggcatttaaggctcctgggttaagttaggaatgggggtgttcctgatgtgggggctt

SEQ ID NO: 13199 - DNA, 73 bp, Homo sapiens
tcctctcagttgccactgggatggggtgaaccaagaaagagagccttagaagccaggaatatcggggggcgtt

SEQ ID NO: 13200 - DNA, 73 bp, Homo sapiens
atgctgaagtcttaatccccagtacctctgtttaaagagggagttcaggtcaaaggagggagtatgggcagcg

SEQ ID NO: 13201 - DNA, 72 bp, Homo sapiens
tcaaacaaaaaacaaatgtaatcagaacactctgattcagacggtctgactacattacatccggggcttttg

SEQ ID NO: 13202 - DNA, 70 bp, Homo sapiens
gcctcagtgcggcatctccacgaaactcagaaatcatgcctgcgggaacagagtgtgggcaggggcccag

SEQ ID NO: 13203 - DNA, 71 bp, Homo sapiens
tgggtgggtgggacggaagctgactctggcacccccaacgcccagggggggtctgtattgcccagtctatc

SEQ ID NO: 13204 - DNA, 73 bp, Homo sapiens
ctgtcgtccgcggtgcggcagagcactggccgctcctgggtgccgttgccacaggttactgagcactgcaggg

SEQ ID NO: 13205 - DNA, 72 bp, Homo sapiens
ctctacttacgcctcagggtcaccttcccccagcacagcagcactgcagcgctggcggctctgaacagaccg

SEQ ID NO: 13206 - DNA, 70 bp, Homo sapiens
agacgggtaccttctatgggaagaaagggctttgcagatgtgcttgcagtaaggctcttgagatgagaag

SEQ ID NO: 13207 - DNA, 73 bp, Homo sapiens
agggatggctggtccaggactgggcatggtatggggtgggtagatgtaggccgtctctgtcttggtgtcagcc

SEQ ID NO: 13208 - DNA, 73 bp, Homo sapiens
tccggactgctttgtggatggagagtggggcacaggtccatcgccacccacacttttttttttttgagacaga

SEQ ID NO: 13209 - DNA, 73 bp, Homo sapiens
acatcagcagcaaacatgtatactttatgtatactattatgtatatgattatgtatactatagtgtgtttgaa

SEQ ID NO: 13210 - DNA, 72 bp, Homo sapiens
gcccatctgttccctcaggccctggatatgaagctaaggaataggagtgtcctggtcactaggaatgaacgt

SEQ ID NO: 13211 - DNA, 72 bp, Homo sapiens
ataacagcctacaccactgcagcagacatccacagcttataccactgaggcacccatggttattgctgatgt

SEQ ID NO: 13212 - DNA, 70 bp, Homo sapiens
agcactcgcgggccacgtcgatgaagaactcaatcacctgggccctctgcttcttcttggctggctgggg

SEQ ID NO: 13213 - DNA, 74 bp, Homo sapiens
ccacatagagactgagactgactgaatgcttcaagagagatgatggggctgcggacaagctcgcagtggggaga

SEQ ID NO: 13214 - DNA, 72 bp, Homo sapiens
gaaatatcacaatgcgaggagcccttgggataaatgccctgcctgggcccattgccatcagccgagggcctg

SEQ ID NO: 13215 - DNA, 70 bp, Homo sapiens
tccgacgacggcagccgggaccggccgggatccgggagcccagcgccgaccctctcccctctgcgcgccg

SEQ ID NO: 13216 - DNA, 73 bp, Homo sapiens
tttctgcttttattgtctgtggttttgaaatcacataaaaaaaaattattgcccagtccaatgtcctgaagca

SEQ ID NO: 13217 - DNA, 74 bp, Homo sapiens
agtcctgacagcttcaagaggtagtcctagaccgtgatggccacgggccaacagcagaccccatgacggctgtt

SEQ ID NO: 13218 - DNA, 70 bp, Homo sapiens
attcctctcttccatgagcccattggggtagctttaaatgtagaagttgcaactgtaggtcaagaaagta

SEQ ID NO: 13219 - DNA, 72 bp, Homo sapiens
atgcctttggagtgtgaagacctggctacaagtcctggccttcactagctgcctgatcgtgcaccagtccca

SEQ ID NO: 13220 - DNA, 74 bp, Homo sapiens
ccagccccgcccctccgcgcccccttcctcctcctggcccgccgggccgagtggtgctgctgcgggtgcggctg

SEQ ID NO: 13221 - DNA, 70 bp, Homo sapiens
cggcccgccctcggtggtcatctgggacccgggagcgaggccgggccgcgagggcgggccccgggcggga

SEQ ID NO: 13222 - DNA, 74 bp, Homo sapiens
ataggagtgtcggttacaagagtgtgtgcgtttgtcagaacagatcaaactgcagttcaacatttgtgcatttc

SEQ ID NO: 13223 - DNA, 72 bp, Homo sapiens
cagtttagaaaaagaatcacattgggtctgattttccatttcaagtgatctgtatggaagggctgaatgaac

SEQ ID NO: 13224 - DNA, 72 bp, Homo sapiens
agcgatggatgatggaccccagagaaagccagtgtgacaggcaggcgagtctgggggcttcctgacagttaa

SEQ ID NO: 13225 - DNA, 70 bp, Homo sapiens
cgagtagcggcgcgtagggagagcacgcgtgcccaggctgcctcggccggcgcgcccccgcccccgcact

SEQ ID NO: 13226 - DNA, 72 bp, Homo sapiens
cctcctcacggtaacaactcacaagtcattgggatttcaagtaatccataggctttttgtgtctctcagccc

SEQ ID NO: 13227 - DNA, 72 bp, Homo sapiens
gggaagtactccctggtgatggagtacatggagaagggcaacctgatgcacgtgctgaaagccgaggtagag

SEQ ID NO: 13228 - DNA, 72 bp, Homo sapiens
ccatcagccttcccacagcttatcagacagatgactgagtgaagcacaggagggacatgatggcaagccagg

SEQ ID NO: 13229 - DNA, 74 bp, Homo sapiens
cgctgccttctccttccgtccggagcgccggggcgcgcgacccgctccgtttcacgctctaggcaaacggtagt

SEQ ID NO: 13230 - DNA, 70 bp, Homo sapiens
tagagtggatctaccgtcatctctatgctagcactactttacttacattcttgagggctgatctctctgt

SEQ ID NO: 13231 - DNA, 72 bp, Homo sapiens
taaaggcatggccacttgggcgcaatgtgcatggtcaattctgacagccgctttcgccctttctggctgatt

SEQ ID NO: 13232 - DNA, 71 bp, Homo sapiens
cctcttctctggttgaactctgaggcggaggtcaggaggtcctgcccatcacacaggctcacacgaggcct

SEQ ID NO: 13233 - DNA, 73 bp, Homo sapiens
tagattcctgtttacggccaagtttctagtatggtggtaataagcaagctttaactaccatacaaacagaaga

SEQ ID NO: 13234 - DNA, 72 bp, Homo sapiens
caaaagacatctgtgtagtagtaatccaggaatcagattactctactggctcgttttttcaaggatggtaga

SEQ ID NO: 13235 - DNA, 70 bp, Homo sapiens
gtagaggacgcactgagcatcaagcacgcaaatctctcgcgtccctgttttttttttttgtcaaaattct

SEQ ID NO: 13236 - DNA, 72 bp, Homo sapiens
aggcaaataggcaacttgcctgagatcatgaggtaaaatatcatctgagctgagaacttccgcttcttgcct

SEQ ID NO: 13237 - DNA, 71 bp, Homo sapiens
ccttcttcacattgccggggacccttttgggaggcatcatcaaactctccatctactgacaagctgaggtg

SEQ ID NO: 13238 - DNA, 71 bp, Homo sapiens
cttatgctgtgtgccgaagagggctttttgcagtactgataacgccaaggtggcagtgagctcacttgcat

SEQ ID NO: 13239 - DNA, 73 bp, Homo sapiens
ggttaagacaacaagagagcagaacgaggttttatttggtgctaatgacctgcattctctctcttaggtccgt

SEQ ID NO: 13240 - DNA, 74 bp, Homo sapiens
acagtggcagcattagactcatagcaatggaaaagcaaatgtcagctcctcagatggctctgcagtgagctgtt

SEQ ID NO: 13241 - DNA, 74 bp, Homo sapiens
gctgagtggatgatgatgcctctgacagtgaaacgctggattagtcagggtttacgaacaaggtgtgttctcta

SEQ ID NO: 13242 - DNA, 70 bp, Homo sapiens
ccactcctgccccacccccttgcctctcgggctttatgcccacaagagtccaagccactctatcagatcc

SEQ ID NO: 13243 - DNA, 73 bp, Homo sapiens
ttctgtagagacaaggtcttgcttaggctgatctcgaactcctgggctcaagtagtcatcccaccttgttctc

SEQ ID NO: 13244 - DNA, 71 bp, Homo sapiens
ccgggcatctgctcagcttctggggaaacttcaggaagcttacagtgatggtggaaggtgaagggggagca

SEQ ID NO: 13245 - DNA, 74 bp, Homo sapiens
agcaaagtggagggtttgtcttttggaaaaacaaagtcgttttctcctctgaaaaagcctcctacatagttggt

SEQ ID NO: 13246 - DNA, 71 bp, Homo sapiens
tttcaacctacaccttctcgttggagctgccaacttattttagaggcccaggtggtgaaatgcttcatctg

SEQ ID NO: 13247 - DNA, 72 bp, Homo sapiens
aaggttgtattgtgagacattctcttcagaataaaatttagcctctgaatctgggggaggtgagcactatgt

SEQ ID NO: 13248 - DNA, 73 bp, Homo sapiens
agatgaacggaataatagatatacatatgtaagtaaatatatttgcaaattatttcttaaacatgctgtttat

SEQ ID NO: 13249 - DNA, 73 bp, Homo sapiens
gtttcagaattaaaaagggcagttttagaatttctaatggaaatatgctgacttttctttatttttgaaattg

SEQ ID NO: 13250 - DNA, 72 bp, Homo sapiens
aatgttagcagctgtagtattgaatgtgaaatttctgccaaatcaaacatggatttgctgggctgtaaaatt

SEQ ID NO: 13251 - DNA, 71 bp, Homo sapiens
tttataaaaatggagcttaggtttggccaggattattattatctccaaagcctaggatgtttactaaaagg

SEQ ID NO: 13252 - DNA, 72 bp, Homo sapiens
tcttgcctggcccctacaggcatccgaatttgaaacttctgagagacagatgagaggaggcctggtacccac

SEQ ID NO: 13253 - DNA, 74 bp, Homo sapiens
gatactaaaaatgtttttaaactttaagagaggagaagtttaaaaatccagtccctttgaaagcgtttaaagta

SEQ ID NO: 13254 - DNA, 72 bp, Homo sapiens
caaccactaggctctctctacactgttagaaatggtgatacaacaggccagaaagaggtccttaggggcccc

SEQ ID NO: 13255 - DNA, 72 bp, Homo sapiens
tgacaaaagtttgcagtagtgtttcctactactcacttctgtaagtaagaagatactgatttgcaatatttc

SEQ ID NO: 13256 - DNA, 72 bp, Homo sapiens
gaagtttgagcccacccagggacgccaaaaacaacaaacaaaaaccacctggggcgtgtttctaacattctt

SEQ ID NO: 13257 - DNA, 70 bp, Homo sapiens
ctaatcaggattgcaaatcagcatttaggatcatgagccctatctgagggaaccctgattgcagcagcct

SEQ ID NO: 13258 - DNA, 74 bp, Homo sapiens
ctgcgggaagagggattagcagaatgataacgcaggtctgtttgtgttttaggggttttaacatgcattctgca

SEQ ID NO: 13259 - DNA, 72 bp, Homo sapiens
cagtgggaaagagcctagttagaaagcaggatgaataaacttgctcagctagcaaattcctcgcattctcta

SEQ ID NO: 13260 - DNA, 73 bp, Homo sapiens
gtttccatgagaaagagccaacttcaatgtagtgtggcaagtactgtgataacagatttccaccgggagctgg

SEQ ID NO: 13261 - DNA, 71 bp, Homo sapiens
caggtgtgaactggggaaacatccagggacttggaagagaagagtgaagcctgtggcagaaggcgcctggc

SEQ ID NO: 13262 - DNA, 71 bp, Homo sapiens
aagaagtcacggtctttcatgacattgctgagcactgaatcagccctgaattgccaacttccaatgatgtt

SEQ ID NO: 13263 - DNA, 74 bp, Homo sapiens
gtcaggtggtgcgtgcgcccgccgcgcgcgggaggtaaggggcccgggaggaggcgtgggcgcgccacgggccc

SEQ ID NO: 13264 - DNA, 72 bp, Homo sapiens
catgtgacactttatctatccctgcagtgggtcaaaacctcacccagggcatatcgagtcagaatctttgga

SEQ ID NO: 13265 - DNA, 70 bp, Homo sapiens
gataggagatgggttggtttaaagacagggaaacaaggccagcacttcacttcaagaccagtcatcctag

SEQ ID NO: 13266 - DNA, 72 bp, Homo sapiens
agtctgacactgttttgcatctcccacagctgtgaacacagcactctgcaaatactttggttcagtgtagac

SEQ ID NO: 13267 - DNA, 72 bp, Homo sapiens
ggaatggattctctatcaaagcctccagaaggaaccaaccttcctgtcaccttgattttggacttcctggcc

SEQ ID NO: 13268 - DNA, 74 bp, Homo sapiens
gtttaatcacattgttgaaataataacaaaggaggagcaactcttctcacattgggtattatttggctgggcaa

SEQ ID NO: 13269 - DNA, 74 bp, Homo sapiens
tcttgttccctagtgaagcaggggtggtggatcaaaagtctgcccttgactttctccttgccttagaccctagg

SEQ ID NO: 13270 - DNA, 71 bp, Homo sapiens
ccgggggaagggagggaaagaaagggaggtcgaattctaccaccttcccaggtttcggcaccaagatgtaa

SEQ ID NO: 13271 - DNA, 73 bp, Homo sapiens
ggcatcagcttatcagacacatgaggtttcaatgagcaccgcatggactggaagtccgaggaggcccagaaga

SEQ ID NO: 13272 - DNA, 70 bp, Homo sapiens
tggctcatttggggttgcatctagctttgagaacagaaagatttgagggcccaaataatgttacatggat

SEQ ID NO: 13273 - DNA, 72 bp, Homo sapiens
aactatagtgcatttcagaatatgtagggattatgtgttcacagctaacataatatttattgtttctgagaa

SEQ ID NO: 13274 - DNA, 72 bp, Homo sapiens
tggatggtaatggaatgacatggcagcagggagatttattaggaggctgtggtagtgatccagtccaaaaca

SEQ ID NO: 13275 - DNA, 73 bp, Homo sapiens
aagcctcacattaatgaaaccctttctaagctggctctgagtaaagactgatagcaattttatggaggtttta

SEQ ID NO: 13276 - DNA, 73 bp, Homo sapiens
gaaagaaagtttcagtaaggggcagtgtcacaattcaagcttatcactgactccaaagctcactctcttttta

SEQ ID NO: 13277 - DNA, 70 bp, Homo sapiens
catagccccggtgctcttgttaagccttatccaggccagaaggcaacagcaggtcagtggttattcatgg

SEQ ID NO: 13278 - DNA, 74 bp, Homo sapiens
ttcttaggttatggattccagagctatggaaaggagggttttgtaccttgtaagcagtaggtcgtgaatatgct

SEQ ID NO: 13279 - DNA, 71 bp, Homo sapiens
gtttctggttcattcaaatttctgttttgggctcccagaaaaataccatcgagaaaggacagatgtgccag

SEQ ID NO: 13280 - DNA, 71 bp, Homo sapiens
tcttatctttagtttccacaactgtctttagcaagcaaacttgtattggcatctggatcatggagcttttc

SEQ ID NO: 13281 - DNA, 70 bp, Homo sapiens
acacataatcctgtccttgtttttcagggttccccccccccactgctattagggctggagttgcccatct

SEQ ID NO: 13282 - DNA, 73 bp, Homo sapiens
agggtctttgcagaagcaaggagagaggcatggaacagattctttctccgagtcttcagcaggaaccaaccct

SEQ ID NO: 13283 - DNA, 70 bp, Homo sapiens
caacaattaaagtattgtgtgggcctttatgcatgaggggacagtagagcacagctattttgatcagatt

SEQ ID NO: 13284 - DNA, 70 bp, Homo sapiens
atttctattgtgaaaatcctagctcattccttgctagagatgaagcactgaggacagtacaatcaccacc

SEQ ID NO: 13285 - DNA, 73 bp, Homo sapiens
tttaaaagctgattttatgcaatgagttctgcttctggctaactagctagtatcagaccaatgttcttgccaa

SEQ ID NO: 13286 - DNA, 70 bp, Homo sapiens
atttgttaccgcagcaattggaaactaattgggaacttatcagactgattttatcccatagaatccatgt

SEQ ID NO: 13287 - DNA, 71 bp, Homo sapiens
ttcctgtcagttatgtgggagtacatttgcacctaaagaattgcacaatgagaactaaagacatggctgac

SEQ ID NO: 13288 - DNA, 73 bp, Homo sapiens
accccagagcagcttgttgactttgtttccactggcttctcctcgtgttttggttgacttggtcaacatcgtt

SEQ ID NO: 13289 - DNA, 70 bp, Homo sapiens
ctgcactttccaattacacagcttataggcaaaccctccagctggtgggagagtagagaacttgcattct

SEQ ID NO: 13290 - DNA, 74 bp, Homo sapiens
ccagccactttgggcttgttcattttcagagcgaaaggtctacttccaaaaatggcatcaggtgtgacaaatgg

SEQ ID NO: 13291 - DNA, 70 bp, Homo sapiens
ctttttttttttttatgagatgaagtgtcagtctgttgcccaggctggagtgcagtggcacaatctcagc

SEQ ID NO: 13292 - DNA, 72 bp, Homo sapiens
ggtggtttggtatttgatctttctgtagttgtgtcaagctacaaagaaatggtagtctgactcagttggctg

SEQ ID NO: 13293 - DNA, 71 bp, Homo sapiens
aaaatggctacatctgagatgacccatttatagccaggagacctgtcgctgagttactcatttcaccaaat

SEQ ID NO: 13294 - DNA, 73 bp, Homo sapiens
tgtgatttgtgaagctgtaaacccatcaaataaaacatagttatgggtttacaacaaataactcacagtgaat

SEQ ID NO: 13295 - DNA, 72 bp, Homo sapiens
gtaaacacaacccctactttcctcaacaggtggactgtcatgggtgatgtatggggagagcatgatggtgtc

SEQ ID NO: 13296 - DNA, 71 bp, Homo sapiens
gcgcagcctcctggagttgggctgaagtagctgtcaagcagctgtctccacccgccctcccctcccagcac

SEQ ID NO: 13297 - DNA, 74 bp, Homo sapiens
ttgcttaaggttcctgcaaagacaggtgggatgtaacccagagcccacacgaagggacgggcatttatctccag

SEQ ID NO: 13298 - DNA, 74 bp, Homo sapiens
agctgggaaaagagagtggaggggccaagggaaatttcccctttggcttctggggaaactttgctgaaaaatca

SEQ ID NO: 13299 - DNA, 72 bp, Homo sapiens
gcttggctttttctagactgtggtgtctactcagcacagtagtctgcacacccactgtactcaccacagtct

SEQ ID NO: 13300 - DNA, 70 bp, Homo sapiens
cactgcaacctaggaggcagaggttgcagtgagcagatatgttgccaccgcactccagccactccacaga

SEQ ID NO: 13301 - DNA, 72 bp, Homo sapiens
gtgtgggtggagaaaacagcagcgagagaaagtactgtgggaggttccccagtccttgctgattatgtttct

SEQ ID NO: 13302 - DNA, 73 bp, Homo sapiens
acccatgggctcacgcctcatgatagtatgtgaccctgggcaaatcatttaatctctttgaggctgtttccta

SEQ ID NO: 13303 - DNA, 73 bp, Homo sapiens
ctgggagcaaggaaataatcagactcattagggactatagttctgagctgacattgattccaggagaccccag

SEQ ID NO: 13304 - DNA, 70 bp, Homo sapiens
actcccagagagaagtactgcagaaggaactggtttccggactgcagagggatctgcatttttgtttttg

SEQ ID NO: 13305 - DNA, 70 bp, Homo sapiens
tgtctcgtaaacaggagatcctgggttcgaatcccagcggggccttagggtgtgcgtgtttttttttctt

SEQ ID NO: 13306 - DNA, 71 bp, Homo sapiens
atgcttcgcatgtatgaggccccgggttcgatccccggcatctccaaggcgatcacgtagattttgtttaa

SEQ ID NO: 13307 - DNA, 71 bp, Homo sapiens
aacatgaggtgtgctgcataatgcttgcataagaatatctttgctgaataaactgcatgagtttacgtcat

SEQ ID NO: 13308 - DNA, 73 bp, Homo sapiens
ggaagctaaaggcgagcatcacgtccatcattttccctgcgcgtggagttgtgaggggtaggttttccttccc

SEQ ID NO: 13309 - DNA, 74 bp, Homo sapiens
ctggaccccatgagatgatatgcgctggtactccaggctttaaatggcctgggaagcctcagtggattttgttt

SEQ ID NO: 13310 - DNA, 70 bp, Homo sapiens
cccccaggttatggaaggtgaggtccattttgttatgcccattactcccagagtgacctaattttcagaa

SEQ ID NO: 13311 - DNA, 73 bp, Homo sapiens
aagtatgaggtagtagatggtacagattgttttagaatgggaccataaggtagcaatcccgcctagttatcct

SEQ ID NO: 13312 - DNA, 72 bp, Homo sapiens
gatctcaggaccggagccccgccggggtcccgggatggtggagggggccggggtcggggcctgcaggatggt

SEQ ID NO: 13313 - DNA, 74 bp, Homo sapiens
cggcccgagccggggccatggcgaagctgctgagctgcgtcctaggcccccggctctacaaaatctaccgggag

SEQ ID NO: 13314 - DNA, 72 bp, Homo sapiens
aggctttggcagttgcagcctctaaaggaaaaattcctcaggttcagactaaacacaaattgcactgacctt

SEQ ID NO: 13315 - DNA, 72 bp, Homo sapiens
aatccgaccacagatacctggtgaccctgtatggtttcagtgatgggaagcatgtaggtcctgtccatgtcg

SEQ ID NO: 13316 - DNA, 74 bp, Homo sapiens
aagggtgagggtccttccctggtgaaggtgcttgggtagatgactgggcagaggcggggggccgggaacctgct

SEQ ID NO: 13317 - DNA, 71 bp, Homo sapiens
gcaggaagcttcaggcttggcctggtggagttagggctgctccacaactgcgcgcagggcatccagcaatt

SEQ ID NO: 13318 - DNA, 72 bp, Homo sapiens
caaccctcattatccctttcagagtctcgcaggttgaggtgatgtgagagaggaagcagaagcgaaggttac

SEQ ID NO: 13319 - DNA, 72 bp, Homo sapiens
gatgggggaggcagagctaggcctgagtcagcataggttgctggccttggtgggtgttctgaggctctacct

SEQ ID NO: 13320 - DNA, 71 bp, Homo sapiens
gtttggagggctaagaggaagataggaagttgaggggaagtttggaacttcttagagactggtcaaatggt

SEQ ID NO: 13321 - DNA, 70 bp, Homo sapiens
ctcagttcttgaggccagcagcaattcagtggctcagtcactaccaggatctggccaaaggggcttcctg

SEQ ID NO: 13322 - DNA, 72 bp, Homo sapiens
atatgtcggcagggatcatgaatcagcctacgaatactacaatatcagggctaaggcatcccttgggctgca

SEQ ID NO: 13323 - DNA, 72 bp, Homo sapiens
cttaagcagcgcttcgtttcacctgttcgtgcacacgtagggatatggagtcttacattatgtattctcctg

SEQ ID NO: 13324 - DNA, 70 bp, Homo sapiens
atccaaaattgggtaatatgatattcatctgtcatattattcaactttggccctgctaaagtacttccag

SEQ ID NO: 13325 - DNA, 71 bp, Homo sapiens
tgtgctcctgtgcatggctgtgtgtggggagtgccacttgcccctgtgttggtgcctctgccccaggagcg

SEQ ID NO: 13326 - DNA, 71 bp, Homo sapiens
tggagccgcacatctggtctcggagctcgcctgcgccgctgtgcccccctcctccccgcgccccagtcact

SEQ ID NO: 13327 - DNA, 73 bp, Homo sapiens
tttgtctcaggtaataggaggttaacaaggcaaggtaagccaactctgacctaaaggcaagtgcatttccttt

SEQ ID NO: 13328 - DNA, 72 bp, Homo sapiens
gagagcatgcgtagctttccatatatgtggggaaaatcctctagatgtagcagaaagccagaagtaggctga

SEQ ID NO: 13329 - DNA, 70 bp, Homo sapiens
tgctcacacctcttatgtcactgctgctgttttaattctgtagatgggtagctgggacacacacagggga

SEQ ID NO: 13330 - DNA, 70 bp, Homo sapiens
cagggtcttggtctatattgcccaggctggtttcaaattcttgggctcaagtgatcctcctgcctcagcc

SEQ ID NO: 13331 - DNA, 74 bp, Homo sapiens
gaaaatgccttggcttttaatgcttaagtgcttctcccaggccttagaatagcacaggatacccagcagactct

SEQ ID NO: 13332 - DNA, 73 bp, Homo sapiens
cattaagggatgggagtggaagggaaatgtaaatgaagagcagccccttccttctggaagctactactcttga

SEQ ID NO: 13333 - DNA, 74 bp, Homo sapiens
cactgcacccagctggccccagcccactttttaagctatgatgtaagtacaaacagtgggctggctttggaagt

SEQ ID NO: 13334 - DNA, 71 bp, Homo sapiens
ccgaggtagggccgcagacgcaaggctctctgctaatgcaatgtgacgggcctgcagcccctagtaagttt

SEQ ID NO: 13335 - DNA, 74 bp, Homo sapiens
aaatgggacacgctgggggccatagctcagctgtgaggatgcagcatcctctgtgatcattcccttggtccccc

SEQ ID NO: 13336 - DNA, 74 bp, Homo sapiens
attgatgaagtttgctaccttgggcttatccattgcactctggatgtgctgacccctgcaattttccacaaatg

SEQ ID NO: 13337 - DNA, 70 bp, Homo sapiens
tacatgtgcaggtttatttatataggcaaatccgtgttacaggggtttgatgcacagattatttcaccac

SEQ ID NO: 13338 - DNA, 71 bp, Homo sapiens
tcaggggaggtctagtgggattaagccccagttgcccacagttgaaacagctctaaaatgaacatgtatga

SEQ ID NO: 13339 - DNA, 73 bp, Homo sapiens
tcttccccagccctgctccctgcatccttccctctggtcctagtgtcctggtgtcttgaagatgctgggtagt

SEQ ID NO: 13340 - DNA, 73 bp, Homo sapiens
atcccgcaggagtagcccagtgttcagactgcctcctctggcttgccctaggacgttctactggcaactcagt

SEQ ID NO: 13341 - DNA, 72 bp, Homo sapiens
caactcgcctggctcccttctctccgtctgcctcctggccgcggggcccggagagctgggagccagagggtg

SEQ ID NO: 13342 - DNA, 70 bp, Homo sapiens
tgctctctctctggggcaagaagtcagtaggatcaaggggacatgccctcagagggcgcaccacgtccct

SEQ ID NO: 13343 - DNA, 73 bp, Homo sapiens
tgatacacataagacactgagcctggagaggggacaggacttgtctcaggtcacccagttctcctggttatca

SEQ ID NO: 13344 - DNA, 72 bp, Homo sapiens
gtgaggtgctgggctgataaccaggagaactgggtgacctgagacaagtcctgtcccctctccaggctcagt

SEQ ID NO: 13345 - DNA, 71 bp, Homo sapiens
agagaggcggagcgctgagaagtccgaaactggctctgtgccctgtggggtggtcgatggggttcatctct

SEQ ID NO: 13346 - DNA, 71 bp, Homo sapiens
agcctggggaggtttgtgggggcaagtggggaggaaaagcagccccatgcagagaagataaaaagcccagg

SEQ ID NO: 13347 - DNA, 70 bp, Homo sapiens
gatccacagggatagtgtcttaacccctacctgggggaagtccaaaagcaagatgctggctaactgtgct

SEQ ID NO: 13348 - DNA, 72 bp, Homo sapiens
gtgccactgaatacagctgtgcaggtcgcacactggacaacttcagggcaacatccatgtagactaggtcac

SEQ ID NO: 13349 - DNA, 71 bp, Homo sapiens
tcctgcctcataatccccgcagctcttctgggacttgtcagacctcaggcccagattttgggggttgggaa

SEQ ID NO: 13350 - DNA, 70 bp, Homo sapiens
cgcagctactgccatccaatcgagaccctggtggacatcttccaggagtaccctgatgagatcgagtaca

SEQ ID NO: 13351 - DNA, 73 bp, Homo sapiens
gggcctggctcccactgcttcgttaatatttaccataactggaaaacagcaggcacacacaggcatgggctcc

SEQ ID NO: 13352 - DNA, 71 bp, Homo sapiens
gctgctgggctggaaccactctttcagatccaaagctttgatctctcctcccggggctcagcctgtgtctt

SEQ ID NO: 13353 - DNA, 74 bp, Homo sapiens
ctcctctgccagtgggacccctgcccaggaccctccggaagctctttctctgccttcaccccactggtgagaga

SEQ ID NO: 13354 - DNA, 73 bp, Homo sapiens
cccattcctagagcttctcattccactggtatggggtgagacccaggcattggtaattatttcaaactcccca

SEQ ID NO: 13355 - DNA, 71 bp, Homo sapiens
agaaatgtgaccagctaaagtgacctgagatgcgagccagtggctgagcccaagctaaagctttggcctca

SEQ ID NO: 13356 - DNA, 70 bp, Homo sapiens
gacgcctgggcgtccttgctcagttcagcagtgaccaaggacacattctgggacatgtccaggcggtttg

SEQ ID NO: 13357 - DNA, 73 bp, Homo sapiens
caagcagaaccctgagaggtgtcccatcttattgctgttgaggaccctgaaacaccgttgtttaaagacttca

SEQ ID NO: 13358 - DNA, 74 bp, Homo sapiens
tcagtcccttgtccttttgccctttgatgacctgaagatctcagggaaactgctgctgtgtaccgactgaagcc

SEQ ID NO: 13359 - DNA, 70 bp, Homo sapiens
aggaacatgtgtcagttggcttttgctgtataaccaccctaatgctctgtggcttaaccaacaaccatgt

SEQ ID NO: 13360 - DNA, 71 bp, Homo sapiens
ctcagggcatgctccccactcccgtgtgtccttgtaaagaatgcaggagggcgtgagctggggtttccttc

SEQ ID NO: 13361 - DNA, 73 bp, Homo sapiens
tgatttggggtggagaattctgtagctgtctttaggtccacttggtgcagagctgagttcaattcctggatat

SEQ ID NO: 13362 - DNA, 73 bp, Homo sapiens
acactaaatggagcatcaaagcggatcagccttctaaagagtacactgtaggggtgaggagccaagatggccg

SEQ ID NO: 13363 - DNA, 71 bp, Homo sapiens
tctaaagcagtgttactcagcaagtttgtgactattattggtcttctgtgagaaagcagcttgagccaaaa

SEQ ID NO: 13364 - DNA, 73 bp, Homo sapiens
aaaggaggtcgcataattatcttctaaagagtagaaatgcatgcgacattattacttttatgtatatgtctta

SEQ ID NO: 13365 - DNA, 70 bp, Homo sapiens
attcacaagaaggtggactagaggctggcggtgagccattgccacgcagcagttgagtgcaaactttcta

SEQ ID NO: 13366 - DNA, 71 bp, Homo sapiens
gttacatcctctctcttgagtcctgtatcattaggaggcaactctggtggagtgagagtcatagactcagg

SEQ ID NO: 13367 - DNA, 71 bp, Homo sapiens
agatctatttcaggcatgacctatcttatgacagttctaagatgcttggtattgtctgtctgtggagtggc

SEQ ID NO: 13368 - DNA, 70 bp, Homo sapiens
ggaacagctcgaggctcaccccataagtgttcatcttctgcctctaccttcatccctggtgagcttggca

SEQ ID NO: 13369 - DNA, 73 bp, Homo sapiens
actcctataatttcactggtatggggacacatgccccaaattatctgtcccttcatacttcagttttatagta

SEQ ID NO: 13370 - DNA, 70 bp, Homo sapiens
ccctcatgatagcatgacttttaacacaggaaccaaagggctctcctgtgtggtttttttgttgttgttt

SEQ ID NO: 13371 - DNA, 72 bp, Homo sapiens
ccataaccaatggtcaattagctgttctcatctcccttgaccctgtagcaccatttgacatagttggccact

SEQ ID NO: 13372 - DNA, 73 bp, Homo sapiens
aatctcccatattagtgctaccctttgcatgaaactgaggcataattggcctgtttcaggctacccagtgtta

SEQ ID NO: 13373 - DNA, 74 bp, Homo sapiens
aacctcgactcttctatttcctagttctcaaatatacatatatttgagatggagtttcgctcttgttgcccagg

SEQ ID NO: 13374 - DNA, 74 bp, Homo sapiens
ccaacatgacaaaaccccgtctctactaaaaatacaaaaattagtggggtatggtgttgcatgcctgtggtccc

SEQ ID NO: 13375 - DNA, 72 bp, Homo sapiens
ccgataccattggcattctaaatgctgggatcatcatcaaacagggtctcttcatcaaacagtgaccatggg

SEQ ID NO: 13376 - DNA, 72 bp, Homo sapiens
acatggctacagctggagttagtttattcatttggtgacagtttagacttatttttcactgctttgtaaatg

SEQ ID NO: 13377 - DNA, 71 bp, Homo sapiens
actgcacaatgatgacagcaaaactagtacctgaatcataaggttgctgttatgtctaagacaatagttgt

SEQ ID NO: 13378 - DNA, 72 bp, Homo sapiens
aatgaagacatgccgaactaatagcaaattgtttgcttttaacaatgtgtgtgttgtgtgtgtctgatatat

SEQ ID NO: 13379 - DNA, 73 bp, Homo sapiens
tgttgatgtgtaaggcagacccaaacacagcttgtccatctgtagctcttgtgtttctgtactgacatcagga

SEQ ID NO: 13380 - DNA, 72 bp, Homo sapiens
tatcctgtagtgggtctgcataggtgagattttgtgaacagttggccttagtgcattagatctgtgcagctt

SEQ ID NO: 13381 - DNA, 73 bp, Homo sapiens
caatatttgctgttgagactaaacatggtatgtttgggagaccctggggggacgagtttgattggataggaaa

SEQ ID NO: 13382 - DNA, 71 bp, Homo sapiens
tgtgttttcatgtaaacctgtctttctgcattggcaagcttctgcatatggttgggtttcattttcttcat

SEQ ID NO: 13383 - DNA, 74 bp, Homo sapiens
gggggtgatgagtcacgaggccctgggctgggaagggccttctggagagtggtgggcagagtggacgagaaact

SEQ ID NO: 13384 - DNA, 74 bp, Homo sapiens
aatctggatgtaccccatatagtttcatgtccagacctagaactgtgaatgccagcaggctggactgcctccta

SEQ ID NO: 13385 - DNA, 72 bp, Homo sapiens
tgtgatgtggaatggcccctatctggtgcatggtttggagaatataagatttctgagtttggcagggtacac

SEQ ID NO: 13386 - DNA, 73 bp, Homo sapiens
tttcagagacatatattgcaattcactgggcgtttgagtgagcttggaagattgccatgttgactatctcctg

SEQ ID NO: 13387 - DNA, 70 bp, Homo sapiens
aagctgaggtgggcagatcacgaggtcaggagatcaagaacatcctgatcttgaaaccccatctctacta

SEQ ID NO: 13388 - DNA, 70 bp, Homo sapiens
agtagtcctacacattgatttcatccaccacaaaatcccaggttgattacaatgttaaattaggatgggg

SEQ ID NO: 13389 - DNA, 71 bp, Homo sapiens
tttttttcagttttacagataatgctttgtgcatatatccatgggcatgtgtataagtcattctgtagaat

SEQ ID NO: 13390 - DNA, 70 bp, Homo sapiens
cagaggattctgaagagagagaccaaagggaggggctttccaatgcctatctgagggggaccctttacaa

SEQ ID NO: 13391 - DNA, 73 bp, Homo sapiens
gcactgtgccttctatgcctaatggctaagtcacctggctcagggactcaggagtgcctgtcatggagggcct

SEQ ID NO: 13392 - DNA, 73 bp, Homo sapiens
ggaaaggttaaaggccagactaagaagtgaagacatttcttaggaatagcttatcaatgactaaccaatagag

SEQ ID NO: 13393 - DNA, 74 bp, Homo sapiens
atttggctgcctggagtttgtcacctgtctccaacacagcaggcacatcactggatctctatatgctcttggca

SEQ ID NO: 13394 - DNA, 73 bp, Homo sapiens
agggcatgaggttatttcattctctgtagcccaccgagagtgcgtacagtgacacatgttatgtaagtcccct

SEQ ID NO: 13395 - DNA, 73 bp, Homo sapiens
ctttaaaaataagctggtagagaagaaccagacataatgacggtaactgctaagccagttttaccaactgaag

SEQ ID NO: 13396 - DNA, 74 bp, Homo sapiens
aaacacactggataaggccagcaggggtttgaagagggtggataacccaggactctggagaggggagtgttgag

SEQ ID NO: 13397 - DNA, 71 bp, Homo sapiens
gagctggcatagaatgcaaatttaaaggaggacatttaaatgttcatatgccaagactggctaatttggta

SEQ ID NO: 13398 - DNA, 72 bp, Homo sapiens
ctaatttgaactaatctgaatactttgtatctgccagcccttatgccaaagggtttatgtgcattgttttat

SEQ ID NO: 13399 - DNA, 74 bp, Homo sapiens
agattgagattccatgaacatgtgacagactgggaaatcatactttcacatccttctggccaccgtggttagtc

SEQ ID NO: 13400 - DNA, 73 bp, Homo sapiens
tagactctcctaaggagtgcaccctcgcatgcacagttcacaatagggttcaggcacctatgagattctaacg

SEQ ID NO: 13401 - DNA, 71 bp, Homo sapiens
aaaaatgatattactcccaattgcgcagaaggtgtacaattttcgtgtaatattgtttttaatatcccagg

SEQ ID NO: 13402 - DNA, 74 bp, Homo sapiens
agctcccagtgcgggccatatcatttgaggttgaggtgccacaatactgccatggttccagataataggaagtt

SEQ ID NO: 13403 - DNA, 73 bp, Homo sapiens
gttgaagacagtttataggaatatgagtgtcatacaatttacagacacatcatatatgaacttatgtggcaaa

SEQ ID NO: 13404 - DNA, 70 bp, Homo sapiens
ttataaacttggagaagaacacttactttttttttatagaaggaggaacttcactcagtttattgggtac

SEQ ID NO: 13405 - DNA, 70 bp, Homo sapiens
taacacagaagacaccagtatagcaagacagacaaacattttgatgtatgtctatgtttctggtctttat

SEQ ID NO: 13406 - DNA, 72 bp, Homo sapiens
gtctgccttgcccaagtttgggcctcccctctgctgtgcaatgagtgaaggcgactcagtatgggtcaacta

SEQ ID NO: 13407 - DNA, 74 bp, Homo sapiens
atttgcctgaacaaatgcagatgaaagtgtcctattctagaaaaaaaaaaagccacaaaggacattcattagca

SEQ ID NO: 13408 - DNA, 71 bp, Homo sapiens
tggctcactatgggcagctcaaacactatattgcctctgcatcagaggcaattttgaattgatttgtttgg

SEQ ID NO: 13409 - DNA, 73 bp, Homo sapiens
agtttgagaaattactgagaatacaccttgcaccgacagtgctgatagcttagcatcagtcatggtattccca

SEQ ID NO: 13410 - DNA, 72 bp, Homo sapiens
taaatgtatgacgtaaatataaatttccaagtagactgttgagaatttgtttacgaagttatatttaaacta

SEQ ID NO: 13411 - DNA, 70 bp, Homo sapiens
tcattgcctcagcctcctttagtgtttcaaactcttgcggctgtacacaaaaggactgataacagaatca

SEQ ID NO: 13412 - DNA, 72 bp, Homo sapiens
gagtctgtcagtttgaggggcaaaagttgtacgtgagagaaggtatcacttgtactttttaggctaaggcag

SEQ ID NO: 13413 - DNA, 73 bp, Homo sapiens
agtgctcctagggatagttagaagctctacttcagatcccacttctgacaccatccgtgaaaagaaaaacttc

SEQ ID NO: 13414 - DNA, 72 bp, Homo sapiens
tgtcgcagcagtgagtcagggtagccctcttctcggggctttgaatagctcgtgcatgtaccagtgacaagt

SEQ ID NO: 13415 - DNA, 70 bp, Homo sapiens
caatttctggcaagggccatctttctgccttgaagatagtaattttcttgctgtgtccttacatgttgga

SEQ ID NO: 13416 - DNA, 71 bp, Homo sapiens
attggtccatggttgatcatgggcagtcctgaaaaaagcaccagttgattagccaaaaggcatcatggaag

SEQ ID NO: 13417 - DNA, 72 bp, Homo sapiens
ggccccgtggtggagggatccgctgagtcagaccacttggctccctggcttcagccccctttccaggggagt

SEQ ID NO: 13418 - DNA, 74 bp, Homo sapiens
cagggttacataagtaagtttattacatagacaaattgtgaaattgagtgttttatgagctttatgtgattaat

SEQ ID NO: 13419 - DNA, 70 bp, Homo sapiens
ttgatgtttcttagaaattcttaaagtcatgacacagtggcataagaataacagctgaaagggacaattt

SEQ ID NO: 13420 - DNA, 73 bp, Homo sapiens
atctcacattttttatgggtcagggacttgaagtgttgcttaattgtatggatctggctcaggatctctaatg

SEQ ID NO: 13421 - DNA, 72 bp, Homo sapiens
ctttgaggccttgattcctacatgttcattatgcataatgagcttgtcacctatctcagcaataaaggttct

SEQ ID NO: 13422 - DNA, 72 bp, Homo sapiens
atgcccttctctccactaagaggaaagaccagactcactggttcactggtatgttttccttatagtagactg

SEQ ID NO: 13423 - DNA, 72 bp, Homo sapiens
tcagaactgaaactaagcagttgaaagagatttctttagtctttttcacatgactgtatttctcttttgtga

SEQ ID NO: 13424 - DNA, 74 bp, Homo sapiens
tgctccttcgagtccaccatggcactcatgcccacgcaatgtttcctccagggttctccaggtagagatggagc

SEQ ID NO: 13425 - DNA, 70 bp, Homo sapiens
aggtagcctgggtttaaattcaggcccaatcagttatgagaccttgggcaaattacccaatccctctaag

SEQ ID NO: 13426 - DNA, 71 bp, Homo sapiens
taataggagatgaagtaagtgctagaagttggcaatcgatgaaaagtactgagctcatcatttgtgtctaa

SEQ ID NO: 13427 - DNA, 74 bp, Homo sapiens
gtatgtgccacgatatgtttaaccttttgcctattggttaaacttttcaatagacaaaaggttaaacaaattgt

SEQ ID NO: 13428 - DNA, 71 bp, Homo sapiens
aggcgcatggctcatgcctataatcccaacattttggaaagccgaagcaggattgcgtgaggctaggagtt

SEQ ID NO: 13429 - DNA, 73 bp, Homo sapiens
catcttcagtgattccccctttgatgaatcttctgatgggggaaaaagtgttgttgttttgcttgctcggtgt

SEQ ID NO: 13430 - DNA, 70 bp, Homo sapiens
cctggtgtatatgaggtggaatttttccttaaattttcttagagtctctcccttcacttgctccatccca

SEQ ID NO: 13431 - DNA, 71 bp, Homo sapiens
ttaaaagcaggtaacatgtctcactcattttgtatactcagcactgaacatggcacctggtgcttaatagg

SEQ ID NO: 13432 - DNA, 74 bp, Homo sapiens
atgactagcttatcactgactatgttagccttcattgcctgatgtgtgggccaggattctctactgtaaagtta

SEQ ID NO: 13433 - DNA, 74 bp, Homo sapiens
tatttagtagtgatttcgatttacatcattatggtttatattaagatagcttagatgataattcactagtagat

SEQ ID NO: 13434 - DNA, 73 bp, Homo sapiens
acatggcacatgatgctattttctgactgctattataagtacactactgtcagccgggcgcggtggctcacgc

SEQ ID NO: 13435 - DNA, 70 bp, Homo sapiens
aagcaaaaatgccatggtaggtaacagaaggtaaatgcctcttaatgcactaattcacttggcagtatta

SEQ ID NO: 13436 - DNA, 74 bp, Homo sapiens
gcgacttattgggaacaggagtaaaggtcacgcttgctatgcaaaacactggtggcattttgcccctgccctag

SEQ ID NO: 13437 - DNA, 73 bp, Homo sapiens
ttgcacatttaagtcatatcaatcagtgtgatgaatcatggatgattcattgtcatgaactgcaaatcatata

SEQ ID NO: 13438 - DNA, 72 bp, Homo sapiens
cttaagaggagtagactgacctatcttaagaccagtgaagtaggcagaaaggtagcttttgtagtcagtcct

SEQ ID NO: 13439 - DNA, 72 bp, Homo sapiens
attttcttattagtaatacctgctgtatgtctaattataatcacttcgcaacagcagtacttactccctttg

SEQ ID NO: 13440 - DNA, 70 bp, Homo sapiens
aggctgagcggtcgggcggcggggggcgggggaccgcgggcggaatcgcccggtgccagcggccccggca

SEQ ID NO: 13441 - DNA, 70 bp, Homo sapiens
ataggaatgttatacccaggaaaatatgcaatgtgggagcaggacatattttaccactgtgggtatgttc

SEQ ID NO: 13442 - DNA, 74 bp, Homo sapiens
tcccgcgggcggaccggctgagcgcaaggacgcgcagtgacgagcgccgcgcgcctcccgcaggacccgcgccc

SEQ ID NO: 13443 - DNA, 71 bp, Homo sapiens
gaacgtgcaggtttgttacataggtatacacatgccatggtgatttgctgtgtccaccaacccatcatcta

SEQ ID NO: 13444 - DNA, 73 bp, Homo sapiens
gctgtgtatgtaagctggctcagttcacgtggaacaataacatatgtggctgtgaggctccaaagcagattat

SEQ ID NO: 13445 - DNA, 72 bp, Homo sapiens
gccttgtacaattttaagtcaggtaacttgatttccagccgtgttctttttgattaggattgacttggctat

SEQ ID NO: 13446 - DNA, 72 bp, Homo sapiens
tgttgtattatttaataaaattcatttgcaggctatttagcaagttatatggttgagtaataacatacaata

SEQ ID NO: 13447 - DNA, 72 bp, Homo sapiens
aatgagaagggtagatgagtcatttctgttataaatcgatcttgacaggcagtgtcagaaactcagggccaa

SEQ ID NO: 13448 - DNA, 73 bp, Homo sapiens
gagctgataccatgtgactcacagccccaactcaaaatcacatcattaggctattggtgtggaccaggctctc

SEQ ID NO: 13449 - DNA, 73 bp, Homo sapiens
ggctgcaggtgagtcagtccaggtttcccaggaagcctcagcatttcacttgcccctctctgtagtgccacac

SEQ ID NO: 13450 - DNA, 72 bp, Homo sapiens
aagagcttaggcatccacaatattgctaggcaacactgcttacggtaaaaatgatccttggttggtaaactg

SEQ ID NO: 13451 - DNA, 73 bp, Homo sapiens
atgtttattggacacctccctgggaatgaaatggctccaaaaagagtccagttttcccagatcaaaaatcaat

SEQ ID NO: 13452 - DNA, 73 bp, Homo sapiens
aggagggaaactgataggaacatgcagctcatgatatctcttgtgccaggaattatcaaagtcctttgtctct

SEQ ID NO: 13453 - DNA, 71 bp, Homo sapiens
agagattgtgacttcattggggcagctacactcaactttgtggtcattcatctttggtttcttttgatagt

SEQ ID NO: 13454 - DNA, 72 bp, Homo sapiens
atctttgtattagtccgttttcaagctgttgataaagacatacctgagactgggcaacttatgaaagaaaga

SEQ ID NO: 13455 - DNA, 73 bp, Homo sapiens
tctttgaccgtatgtctcacttccaggtcatgttgatgcaagacatgggttcgcatggtcttgggcagctctg

SEQ ID NO: 13456 - DNA, 73 bp, Homo sapiens
cagcaccctgagcccactatttctgccgtaggcagcccaaccagcggccgagatgtaggccatcaagtatgtg

SEQ ID NO: 13457 - DNA, 70 bp, Homo sapiens
cttctctaccgctctgcaagtccattggtggggcctggagttttaatgggtacaggatggagagtggggc

SEQ ID NO: 13458 - DNA, 72 bp, Homo sapiens
gctgtctatgaggtgaggagatcttagtggcaagaactggaaggataccacagggtagacagcgcctaggag

SEQ ID NO: 13459 - DNA, 73 bp, Homo sapiens
atttcttgccaagtgcacaagtattacagctgccaccccacaggtagttggatgtcactaaaagggcacatca

SEQ ID NO: 13460 - DNA, 74 bp, Homo sapiens
agatggaaattggccatgttataaactagggttgctgtcctagaggataatgacacaccactgagccagaagcc

SEQ ID NO: 13461 - DNA, 74 bp, Homo sapiens
ttctaattgtgctgcctgggattaccatccaaaaaaaccattcgcatccaaatgcctgtcttagggtctgcact

SEQ ID NO: 13462 - DNA, 72 bp, Homo sapiens
tggggcttttatccacaacaggtagctaagtgagcaggctgactgctcgcaggtggccattccccagggatc

SEQ ID NO: 13463 - DNA, 73 bp, Homo sapiens
ttagctgtctgaaatatttgcgatctatatctgcctttgtagaaaggatgctgttagaagacattgtcagggt

SEQ ID NO: 13464 - DNA, 70 bp, Homo sapiens
aagagggaggttttaaaagtctgttaaaggacattaccaagaaggcagacctatgaatttacagcctttt

SEQ ID NO: 13465 - DNA, 71 bp, Homo sapiens
tgccctttttatttagaattatttgcagacttatttcgctgtatggtctgtgaacagctgtagattttctt

SEQ ID NO: 13466 - DNA, 73 bp, Homo sapiens
gtttttccacctataggccagtggttcttccctctttttgagacacaggcctttttgagagtgtaatgaaaac

SEQ ID NO: 13467 - DNA, 72 bp, Homo sapiens
aaatgtagcttataagactgatcacctgttatctaaagaaacaactatggccaggcacggtggctcaggcct

SEQ ID NO: 13468 - DNA, 71 bp, Homo sapiens
ggggcagccttctttggaactgtctgcacagagaacccagggccctggcggagatctcccaatggctaacc

SEQ ID NO: 13469 - DNA, 73 bp, Homo sapiens
cgaggtctccctggcatctccaccaataccagagcgctatcagggtatggaggcgggactgagtgcctacggc

SEQ ID NO: 13470 - DNA, 71 bp, Homo sapiens
gtgctcctcaagggggccagcacagccaggcctgagagttcctcctaggagcctgaaacttccgaacacaa

SEQ ID NO: 13471 - DNA, 74 bp, Homo sapiens
tacacagagatacagaggaatatctttgatcatagtggagcaggggagcagatatgaacagagtcctcatggtt

SEQ ID NO: 13472 - DNA, 74 bp, Homo sapiens
tggacttttcagttatgtgactcaatgaattctaccttttgtttaagtgagtttgagttgcgttttcagttgcc

SEQ ID NO: 13473 - DNA, 73 bp, Homo sapiens
atggcattagcttatcagtgactgactcactaagcaagttcttctgtgcacagtcctgagctgggttatgagg

SEQ ID NO: 13474 - DNA, 71 bp, Homo sapiens
tggaggctaaaactctgaaatcggtttcactgggctgaaccaagatatcagcagtcctgtccttcctctga

SEQ ID NO: 13475 - DNA, 71 bp, Homo sapiens
actgttcccactctgacttctggggaaacttcctgaggcctccacagaagcagatgccatcatgtgtccta

SEQ ID NO: 13476 - DNA, 72 bp, Homo sapiens
ttaagaatctctttcaagtgtgcatcagaagcctcatatgaggatggttaagagcacttagtatttatgagt

SEQ ID NO: 13477 - DNA, 73 bp, Homo sapiens
tgagagggaatgggtaagaagcaattagataatttttatgtctacatgttgttttccttccttttcaagtggg

SEQ ID NO: 13478 - DNA, 72 bp, Homo sapiens
ttacatattatgtgtggctactttggccctgcaacagcagagtagagcagttggaagagaagccatacaaag

SEQ ID NO: 13479 - DNA, 72 bp, Homo sapiens
tgtagcaggtatgtcatcacattgggtcccggacttgactgggtcccggacttgattgggtcccaatatttg

SEQ ID NO: 13480 - DNA, 73 bp, Homo sapiens
acagcattgcagaaagcttgattttaaacttctaggctctagaatagtaagagaataaatttctgttttgtga

SEQ ID NO: 13481 - DNA, 71 bp, Homo sapiens
aggctgaggcgagagactttcttgacctgggagacagaggctatagtaagctaagatcatgccactgcact

SEQ ID NO: 13482 - DNA, 72 bp, Homo sapiens
agtgaccttttgagattggctgttttcagtcagcatagtaattcctgaggttcatccaagttgttgagtgta

SEQ ID NO: 13483 - DNA, 71 bp, Homo sapiens
ttcatgtctgctttgccagctgccttcctcttagccttggctagtagaaagcactagagggagctgtaagg

SEQ ID NO: 13484 - DNA, 72 bp, Homo sapiens
caaaatcaaggtgttggcaggactgtgatccctcctgagactctaaaggagaatcaacttcttgcatttgcg

SEQ ID NO: 13485 - DNA, 70 bp, Homo sapiens
tggggtccaggcactgcaggcacatgtcttagatcatgcaatgtctgcataaggagggccatgacaaggt

SEQ ID NO: 13486 - DNA, 71 bp, Homo sapiens
gtaacaattgtatacctggacttggagtctcttccagagaagatatgacaccaataacttggcaagacact

SEQ ID NO: 13487 - DNA, 73 bp, Homo sapiens
tattcgtgttcaaaatgggtcataaagcagcgaagtcaactggcgatatcaataatgcattcgacccaggagc

SEQ ID NO: 13488 - DNA, 70 bp, Homo sapiens
aaacctaatcgctgtgtgtgtgcgcctcatgaaatcttctgattagaattcagccccttgcacatttata

SEQ ID NO: 13489 - DNA, 70 bp, Homo sapiens
gcagtggcctaatcctttctttctgccttctagtaatgatagtttggggggaggtggggggtggttgtta

SEQ ID NO: 13490 - DNA, 72 bp, Homo sapiens
ctgtccagaaacctctgtggcctgtggtgccttggcccaagttcttctcctgcatccaggacgaatgaggta

SEQ ID NO: 13491 - DNA, 74 bp, Homo sapiens
acccactaggaatgtcaggtggtggtttggcaattatcacattgcctccctaaaagttataaattggcagctag

SEQ ID NO: 13492 - DNA, 72 bp, Homo sapiens
ataggaaccatgtcccagtacccctcattatggggttccttaatctgatggtttcttctcgtcagttccagt

SEQ ID NO: 13493 - DNA, 72 bp, Homo sapiens
actgagtgttccaaaccatgtgactaagatacgaactaaagagagtattatggcacatggtaccactagaga

SEQ ID NO: 13494 - DNA, 72 bp, Homo sapiens
atgaaggcagcaggagttagtctcaaagctgaaacaagaattgacacttctcaccctacctgggcctctttg

SEQ ID NO: 13495 - DNA, 72 bp, Homo sapiens
aacatgctatgctattcttagctcagttagaaaatgatgctggttatagcagcatagctatgatgttgccat

SEQ ID NO: 13496 - DNA, 70 bp, Homo sapiens
ttccagtgaagtaagatgtagaggtggaagacagtgatgttgatcatcctgaccctgtgtaggctcaggc

SEQ ID NO: 13497 - DNA, 72 bp, Homo sapiens
agggagaatgctaagtgtgagtccaccccaaatagtctagtgcactcaaataacatatgatatactctctca

SEQ ID NO: 13498 - DNA, 71 bp, Homo sapiens
cgcccttcacagtgggattcaaagcctggatctttactcttggaacctttttcttgctgtgagcatgaaca

SEQ ID NO: 13499 - DNA, 71 bp, Homo sapiens
cagggtacacagagcagtggattgttctgggacagcggcgatttaccacatctcagggccctgtactcaca

SEQ ID NO: 13500 - DNA, 72 bp, Homo sapiens
gcttagtttcataatagtaataccttatatgtcgttatcgatgtatcatggtttacatagttaaactttatt

SEQ ID NO: 13501 - DNA, 71 bp, Homo sapiens
gatccagttaaagaagttacttgctgtcactgtctttcacagtggctaagagccagaatcttgagtttaac

SEQ ID NO: 13502 - DNA, 71 bp, Homo sapiens
tttttgtgaactggttttattttcagtctgtttagtttcttaatgtactggattgaattgatgccatcaat

SEQ ID NO: 13503 - DNA, 72 bp, Homo sapiens
gcaatcaaagccttggtaaggaggaaccgtgagcgccccttaagctcaaatccggtctttctggttgtttgc

SEQ ID NO: 13504 - DNA, 70 bp, Homo sapiens
aagagggttgagtatctcccgcctaccaccaaaggggctagtgtagatattaacccacaccgtctacata

SEQ ID NO: 13505 - DNA, 71 bp, Homo sapiens
aaagatgctaatgttattgtccagaaactttgagaacctctgtcatagctggtaagtattagcaccattat

SEQ ID NO: 13506 - DNA, 73 bp, Homo sapiens
ctactcttttgagttgtgggttcagtgtatttggaaagcttatactctgagcttcagatctcatgtagagaag

SEQ ID NO: 13507 - DNA, 70 bp, Homo sapiens
aggcctggcatttatctgacctatgaattagaaacgtttgagagggtggggccaagtaatctgtatttta

SEQ ID NO: 13508 - DNA, 74 bp, Homo sapiens
cacaaataaaataactacactacttgactgaggaatgcaagaccaaggtcaagaagtgacaggggatgggggtg

SEQ ID NO: 13509 - DNA, 74 bp, Homo sapiens
agtcagttggcttgggttcacagtccagttcagcctttctgctgagtggccttaggcaaatcacttcatttttt

SEQ ID NO: 13510 - DNA, 73 bp, Homo sapiens
ccacccggctcagccccctcctccccgcgccccgccactcgccgggctgcggcggcggagtggtggcgacagc

SEQ ID NO: 13511 - DNA, 71 bp, Homo sapiens
aatgacaggttcgtggatgacaagccacttattagtggatatcaggcttccaattagtggatgaaactgct

SEQ ID NO: 13512 - DNA, 71 bp, Homo sapiens
accaatgcattcccctagtggactatttcccagctgtggtatcccagaaatggtgaggtgtcctagagatc

SEQ ID NO: 13513 - DNA, 71 bp, Homo sapiens
ggccacctccttggtaagctttgaagagatggtttaacatctctctttagaacatgggagtagttatcacc

SEQ ID NO: 13514 - DNA, 73 bp, Homo sapiens
tggtaatgtactcaacaactctgggcttcaattccttcaacccatcaaaatggggttagtctagatcaagggt

SEQ ID NO: 13515 - DNA, 72 bp, Homo sapiens
gtggatcatgagaccaaactgaaaggatatctccttagaagtgtccttgtattgacaaaaagtgagaagcga

SEQ ID NO: 13516 - DNA, 71 bp, Homo sapiens
atattgctatctcagtcagtgcactacagagtggtggtgttttatacaaagtagccaagatcagtttatgt

SEQ ID NO: 13517 - DNA, 73 bp, Homo sapiens
aaaattagctgggacatcgtaggcactcaatatttgatgaataaaacaagtttgagttgagtatctgtcactt

SEQ ID NO: 13518 - DNA, 72 bp, Homo sapiens
ccaagacagcataacacagccatcacccaggacaggggaatagtttcattagactgaattcttgcttaaaac

SEQ ID NO: 13519 - DNA, 72 bp, Homo sapiens
aagactacggcttacactaaatgacccacagactgtaacactgtctggtagtaagcagatctcttatgaaaa

SEQ ID NO: 13520 - DNA, 72 bp, Homo sapiens
accacaacctacctgaaccacatgtctgatggaaccaatcaccactggcttatcagactctgcttcttcgtg

SEQ ID NO: 13521 - DNA, 73 bp, Homo sapiens
aagcccttctgggcatgcttgggcaatagctaagaggccaaggcggctgaagctgagtgaagtaggaggatag

SEQ ID NO: 13522 - DNA, 73 bp, Homo sapiens
tgtatggcagccagaattaagacaccagtgaagcaagataatcagtaactggatacttaactgtgtggtataa

SEQ ID NO: 13523 - DNA, 71 bp, Homo sapiens
aaagtacatttttcacacctgattggattttgttctagttggcctatccactatgtggtatgagtatactt

SEQ ID NO: 13524 - DNA, 74 bp, Homo sapiens
cctcggaggctgtgggctgagacagggtcggattcctctcgctccctccccacccccgcgggcagtgcaccttc

SEQ ID NO: 13525 - DNA, 73 bp, Homo sapiens
gttctggggtgtgaggctgcggagcgagagcttcggaagcgcccgcgctcacagacacacaccccacaaacac

SEQ ID NO: 13526 - DNA, 72 bp, Homo sapiens
tggccacatttcatggcaagctccccagtggtcatgggacagctgctagcagcaatcagggctacacacttt

SEQ ID NO: 13527 - DNA, 74 bp, Homo sapiens
tgagttgactgctggggaggggcaggtaacgacagaagtgaggtgagctgttcagaggctattgtagcaactca

SEQ ID NO: 13528 - DNA, 73 bp, Homo sapiens
gtccataacatcctgtagcacgtaaactgtagtgtgaggtgactcactgtgggtgagtgcacaagtgacaatg

SEQ ID NO: 13529 - DNA, 72 bp, Homo sapiens
gccaataggacttttcccaggtatcctgaaacagacagtctttttctcatggatgtggacctgagacagtat

SEQ ID NO: 13530 - DNA, 74 bp, Homo sapiens
aaggaggtaaatccatagaatgcctcatgtgcctgaacatagaaggtgattaaggccactggggaagagtttgg

SEQ ID NO: 13531 - DNA, 70 bp, Homo sapiens
tgggctccccggcagtgccacacgcaggacctcgggcgccgacaccgccccgcccctggccgcgccccgc

SEQ ID NO: 13532 - DNA, 71 bp, Homo sapiens
gaactatgggaagaaagaatgaggtacatgggagaacccatgattcaggactctgtcaacctaggtttaag

SEQ ID NO: 13533 - DNA, 72 bp, Homo sapiens
agagaaagctggtctcagctgtcatcggttcccatatttctgatgcctagtccacagtggaggcttggtaag

SEQ ID NO: 13534 - DNA, 70 bp, Homo sapiens
atacacccagaaataatgtgttgccagctagctaggcacccttagctcagtccatttgacacataaaatt

SEQ ID NO: 13535 - DNA, 73 bp, Homo sapiens
agcacaatactgtacccaattcagttttatttaatttggaaatattaatccattgagttatacaactgggttg

SEQ ID NO: 13536 - DNA, 72 bp, Homo sapiens
gtggtgacctgcccatgtcacgtggctgagcccagctcagagccaggtcagtaggctcagaggtgatgctga

SEQ ID NO: 13537 - DNA, 71 bp, Homo sapiens
catatacatagtggtcttaaatgtctgcctaatgctcttactctggcgcatttaagttataccccaaagag

SEQ ID NO: 13538 - DNA, 74 bp, Homo sapiens
ataatgcaatctcccagggtgagtcatagcagagctgttaccacaccctggctcaaaggacaaggggagaaagt

SEQ ID NO: 13539 - DNA, 70 bp, Homo sapiens
tcatgtttacaaggaaatatccagatgatatctcagtatctgaatcagcaggacagattacttgtaggac

SEQ ID NO: 13540 - DNA, 74 bp, Homo sapiens
cggcagatggttaagagttgtgtggagaatcaataacctatacctcaacatggctggccttccatgcagtgctg

SEQ ID NO: 13541 - DNA, 73 bp, Homo sapiens
aagccagagagcaaatattttaggctgtgtggactacatacaatctctgtagccaattgttctttgtttgctt

SEQ ID NO: 13542 - DNA, 74 bp, Homo sapiens
cacagctagaaggcaccatctatgtgacagcaagccctcatcagaggctactgtttccatgatcttggactttc

SEQ ID NO: 13543 - DNA, 72 bp, Homo sapiens
ttggtagtggctcttaaattccagcatcaatacagcctttttttttttttaataggggtgtatttggggggt

SEQ ID NO: 13544 - DNA, 70 bp, Homo sapiens
tagtgattatgaatgtgagctctggaattggatggcctaaattcaagtccccacttctgctacttactag

SEQ ID NO: 13545 - DNA, 73 bp, Homo sapiens
ctgtcttcaccagcacttaaggaccatttctctggtgttagaacatgagagagggaacagttttcaggaagtc

SEQ ID NO: 13546 - DNA, 72 bp, Homo sapiens
atattctgtgaccagaccacgggcagatagaattgttcgtggtattgaaatcaatgatgaatggaataatat

SEQ ID NO: 13547 - DNA, 72 bp, Homo sapiens
gaggtagatacacagtggatgctaaggacgaagtgagctactctgctcgcttacactgggcggtttcataaa

SEQ ID NO: 13548 - DNA, 71 bp, Homo sapiens
caaatattgagagaatgtagataggcaaaaggcctggaccaagccctgacattctctaatattaaagatag

SEQ ID NO: 13549 - DNA, 72 bp, Homo sapiens
aaggtggtggcgaagtgattgctttttttaaaattatttttttaacacttttatgtcagtagtcagtacttt

SEQ ID NO: 13550 - DNA, 70 bp, Homo sapiens
gagtggtggtggtgatggaggtgtcctatcctaaccctttgcatttccctttattcccacaacccaatac

SEQ ID NO: 13551 - DNA, 74 bp, Homo sapiens
acaaagtgaatgggtggtgttcttgagggatggtgccacattcaggagctcattgttggtatttgtggttgaat

SEQ ID NO: 13552 - DNA, 74 bp, Homo sapiens
tgtgaggtaatttattaggaatttcccaagtggcgggtaccaacattttgaggttgaatcagttattacctcca

SEQ ID NO: 13553 - DNA, 73 bp, Homo sapiens
ggaggggttttgtgggattgtggggtaagcattggaggattccctaagatccatgaaagcagagatgaatctc

SEQ ID NO: 13554 - DNA, 74 bp, Homo sapiens
ctgggatattgctggtgatcaccatggtgctgtacatttatttttgtttttctgtggtgggagaatcaaggcag

SEQ ID NO: 13555 - DNA, 73 bp, Homo sapiens
aagcaggagtttccatggctagaggaagcaggacactgatgtgagagagtaccgaggggcctcagcttctgtg

SEQ ID NO: 13556 - DNA, 72 bp, Homo sapiens
tatactcctgagagttggatgggtcataggtcaagatgacctatgaatgtaaagacattagagatgttgtca

SEQ ID NO: 13557 - DNA, 74 bp, Homo sapiens
taatttgcttttgatttttggtctgtgttctctgaaagtgacatcatagaaaaagattgggcaaggggacgctg

SEQ ID NO: 13558 - DNA, 73 bp, Homo sapiens
actctcttaaaagtttgtggtggctgctctgatagtagtgggttatcagaacacattaacattagtgttactg

SEQ ID NO: 13559 - DNA, 70 bp, Homo sapiens
aagtttcccgaggcctctccagaagcagaagcttctatgattcctgtacggccttcagaactgtgagcca

SEQ ID NO: 13560 - DNA, 70 bp, Homo sapiens
cagtctttgccttagggtttagcaacctgcctagtcgaattgccctggtgttgatcttacagcaaagatg

SEQ ID NO: 13561 - DNA, 73 bp, Homo sapiens
acacagctgtttccaatagtgctgctgagagccaggtaggaatgaggcctgtgctctcactttgggccaggtg

SEQ ID NO: 13562 - DNA, 74 bp, Homo sapiens
tttcaatttttggtagagttcattaacgaagccatcatgccttagggttttctttgatggaaaactttgttgat

SEQ ID NO: 13563 - DNA, 73 bp, Homo sapiens
gtcatccatctgtgagaattttaattgagttttgacttagctgtgtccatagacaatcaatttattttctaga

SEQ ID NO: 13564 - DNA, 73 bp, Homo sapiens
gacaaagcagctaacacacttggtatgtaatgcccagattagggctattctttagctaaactgggagctggga

SEQ ID NO: 13565 - DNA, 72 bp, Homo sapiens
aatgttggattcagagttatgaagggtattatcatggctctctctctgaatctctcttttcccatctcccat

SEQ ID NO: 13566 - DNA, 72 bp, Homo sapiens
tgcagcagccgccggggaccgcggagccgggacgcccccgctcggcccgcgccccgctccccgccccacccc

SEQ ID NO: 13567 - DNA, 71 bp, Homo sapiens
ctatgatgaagtattatgagaacctataggaagaaggtatttcctgagtcctaaaggttggctctcaagta

SEQ ID NO: 13568 - DNA, 73 bp, Homo sapiens
attataacacatttctgggactttattgtttaggaagcagagagctgttgaacacttctgaggaagggcatat

SEQ ID NO: 13569 - DNA, 70 bp, Homo sapiens
gtacttacccagaagccaaagacagtgttttaaaagggataatcacatgtgtctaatgcttctgatagtt

SEQ ID NO: 13570 - DNA, 70 bp, Homo sapiens
cgcgcatgaaattaaccatacaaactaagaacctaaaattcaggtctttgttatgcctggccagttttac

SEQ ID NO: 13571 - DNA, 73 bp, Homo sapiens
tctgtttttatgccagtgccatgctgttttgggtactatagctgtgtagcatcatttgaaatcaggtaatgtg

SEQ ID NO: 13572 - DNA, 73 bp, Homo sapiens
tatctctgttctttgtagcttatactctggatgccagatattaaacaaatataaagatagatgtgcagtggta

SEQ ID NO: 13573 - DNA, 73 bp, Homo sapiens
tttcacccttgcctctcggcgcccctgccttccgcagcatcctagccggtgcgaggggcgggcggacgcggcg

SEQ ID NO: 13574 - DNA, 72 bp, Homo sapiens
tgtaagccagctgagtctgtttcttctgttctgtttcagtgcactgtgaggtcagtgaatggaatccttgga

SEQ ID NO: 13575 - DNA, 71 bp, Homo sapiens
caccaccaagtggaaattgggtaggtgactacttcagttatcaaataatactgcctggtaacatcaatttt

SEQ ID NO: 13576 - DNA, 73 bp, Homo sapiens
caaatgtgtattacatatatatacacttttataaaactatagatatataaaactgtatatctacacatacaca

SEQ ID NO: 13577 - DNA, 74 bp, Homo sapiens
tttggtttggcaatggaaatctgagttctcctagctgtgacttgtgttaggaacgtagactctgtccagctcag

SEQ ID NO: 13578 - DNA, 74 bp, Homo sapiens
tgggtaaactgaaaccaagtctgatgggtgtaagggatgggcgtggtggctcatgtttttaatcccagcatttg

SEQ ID NO: 13579 - DNA, 72 bp, Homo sapiens
tctatgttgccaaaactggtgtggtaaaggaagcatagcatacgctctttatacaatttgtttggctttaac

SEQ ID NO: 13580 - DNA, 72 bp, Homo sapiens
gggaaaagtgtagtaacccagccaggtagcacagtccctcatggcttcctttggcttggggaaggaggtccc

SEQ ID NO: 13581 - DNA, 73 bp, Homo sapiens
ctttttgaggacggctcagtcactcaatgcttaaaatggctagatgaccattttaaacgttttaccatgggtc

SEQ ID NO: 13582 - DNA, 73 bp, Homo sapiens
tgctggccattgtgttccatgctaagagcataacaagcttttctcaagaaactcaggctagagagccattggg

SEQ ID NO: 13583 - DNA, 73 bp, Homo sapiens
actgatagcttatcatcacaggtgcaggacagaaagtcatcacggctcttctcacttgagacaaatgcatatc

SEQ ID NO: 13584 - DNA, 72 bp, Homo sapiens
ttggaggaaaataacaaaaggcctataggtatatgtgtactgtagtcattccttttgttatttttcttcaaa

SEQ ID NO: 13585 - DNA, 72 bp, Homo sapiens
tctaggaaagtttaccctacaggtgtccagtggccgcagagaagctggaacccatgaactgggcgggcagaa

SEQ ID NO: 13586 - DNA, 71 bp, Homo sapiens
cctcaggtcccttcaggtctcttcaggtctctgtttgtcactgatagtccctgttcgggcgccacttgtgg

SEQ ID NO: 13587 - DNA, 70 bp, Homo sapiens
catgccacttcatgggtcccgtgtgcaaattcagggggagttagtatgaaacatgcagtgggaattcagg

SEQ ID NO: 13588 - DNA, 71 bp, Homo sapiens
cgctggcctgtgctgacttcttggtgggagtcactgtgatgcccttcagcacagtgaggtctgtggagagc

SEQ ID NO: 13589 - DNA, 72 bp, Homo sapiens
ttcaatggagccttgtcaagcacttggttggattcagcatcgctgaaagtcagcccttaattctgactgccc

SEQ ID NO: 13590 - DNA, 70 bp, Homo sapiens
accttgttgctcagacatattcacacagtatatacacttatacatagtgttttttatgtttctgggtttt

SEQ ID NO: 13591 - DNA, 70 bp, Homo sapiens
aggaggaaggtgggcgtgtgagctaagaggcaaaaagctgggcttttccatcacggtttcttagcctcca

SEQ ID NO: 13592 - DNA, 72 bp, Homo sapiens
aatggagtgtcagaggatgcaataggatatgaatgatggtgtaatcaagtagtatccacgcagcacaatcct

SEQ ID NO: 13593 - DNA, 72 bp, Homo sapiens
aacctgctgtgtggctgtcctatcttctagtgatgcattatcatctgtatccagtgggcagaaactggagaa

SEQ ID NO: 13594 - DNA, 74 bp, Homo sapiens
acaaggaggtctgggctgtagtgcgctatgccaatcagtgtctgcactaaggtcagcatcaatttggtgacctc

SEQ ID NO: 13595 - DNA, 70 bp, Homo sapiens
cgggcgggggcgcgaggaccgcccggggacggcctggcgcagggccgttatcagtctccatcggctcctg

SEQ ID NO: 13596 - DNA, 72 bp, Homo sapiens
aagctcagcagaatcacatgcaaattggagctggaacctcagaaggtctcagaaatggggctgctcctctgc

SEQ ID NO: 13597 - DNA, 74 bp, Homo sapiens
taggatagcttcaatggcacttattgctaatgttttaatcattagtagagggaacagtttatggggttttcttg

SEQ ID NO: 13598 - DNA, 70 bp, Homo sapiens
tgaacagagttgctgacaaccatgcacactacagattacagaggcatgattgagggcagggagtctagta

SEQ ID NO: 13599 - DNA, 72 bp, Homo sapiens
ttttactgtaaaacgttcccattcccatctgtctttgagtctttgtcaaatacaggtgatggtggctgactc

SEQ ID NO: 13600 - DNA, 71 bp, Homo sapiens
gaacacagatctcatttttctggattagctgcatttggttgcttgcgaggtgaagctttagaggaaaagga

SEQ ID NO: 13601 - DNA, 74 bp, Homo sapiens
tttttccagagtgggaagtgtaacccagggataagctggggtccctggtaaaggaagtatccctaaataactgg

SEQ ID NO: 13602 - DNA, 70 bp, Homo sapiens
aaacctgagttttttatgacctatgaattcatgatcaaaatagtggaggggtatgtgagatttagatgag

SEQ ID NO: 13603 - DNA, 72 bp, Homo sapiens
aacaacaacaaaaaaagatggccagtgttggtgaggatatggaggaactggtacccttgtacactgttactg

SEQ ID NO: 13604 - DNA, 74 bp, Homo sapiens
caaagaccctgaggccagagtgaaaatgaatattaagagggtagaaagaaagtcactctgggttaaaaagtggt

SEQ ID NO: 13605 - DNA, 74 bp, Homo sapiens
atttctagctgctcaggatgtaacacactgttttttcccctcccagagtgtgagagacattgtgcttagggaaa

SEQ ID NO: 13606 - DNA, 74 bp, Homo sapiens
ctttccctcgagcgcgaggaactggagcccggctggcccccgcctccgcctccgccccccggccccagctgcgc

SEQ ID NO: 13607 - DNA, 70 bp, Homo sapiens
atggcaagctatcaggcaggggtggttcagtggtgacaaaacctcagggatggaagagtgctgtggcaaa

SEQ ID NO: 13608 - DNA, 73 bp, Homo sapiens
ccacatccttaatgctctgtggttttggctgtttgtggtttttctccacttctcatcagcttgctgttgagta

SEQ ID NO: 13609 - DNA, 71 bp, Homo sapiens
tcattaatttctacactaaactccagtgccgtatcgccagttgttgactggatactgccagctgatgttct

SEQ ID NO: 13610 - DNA, 72 bp, Homo sapiens
tgtttgattttttaaagtaggtgacatctattcctatattatcaatgtagtgtatagatgtgaacaaggtag

SEQ ID NO: 13611 - DNA, 71 bp, Homo sapiens
accattcgtacctgagaatctgacaggtccttcaatgaagaaaatcttctggctatgacctgggatttccc

SEQ ID NO: 13612 - DNA, 70 bp, Homo sapiens
actgaacacatctgtgccttaaaatggacatttcatggaaggatggcattgatggtagtcaccatctact

SEQ ID NO: 13613 - DNA, 70 bp, Homo sapiens
gccccgcgccgcccgggtgcccgctcgcccgcgcgcccgtccgtccgtccgtccttcctgcccgcccggc

SEQ ID NO: 13614 - DNA, 70 bp, Homo sapiens
aataccttcatcagcaattgcagtggccatggaattatccatttctacaccttgtatttctgatatctcc

SEQ ID NO: 13615 - DNA, 73 bp, Homo sapiens
tgaaggcaaagtggaagcagcacctcgcatggctggagcaggaggtgctacacacttttaaacaaccagatct

SEQ ID NO: 13616 - DNA, 74 bp, Homo sapiens
aactgcctttgctttgaatagagatttggatttaataaaaggcaactttatttgaaaaccatatatgtgaaggc

SEQ ID NO: 13617 - DNA, 74 bp, Homo sapiens
tttccaactgtctaggtctactttggctgttataagaaaataccacagtctgggtgacttatgaataaaggaaa

SEQ ID NO: 13618 - DNA, 72 bp, Homo sapiens
attcccacttgccctggtttatggggtgcaggtttcacaccaagaaacaaaccaagaaacctggcactgttg

SEQ ID NO: 13619 - DNA, 72 bp, Homo sapiens
caaaattacagtaatccagtagaaattaaaattacctgtggtattttcaatgacctgggtaacagtattttt

SEQ ID NO: 13620 - DNA, 72 bp, Homo sapiens
cctcatgcagatggggttgattgatgaagtacatagtctttcgagtgaagacagaactgagtcccaattcta

SEQ ID NO: 13621 - DNA, 72 bp, Homo sapiens
tgttttggagggctgtggtggaaattaaattaggtaagcagcatgctgcaactggtgaagaggcaagctcta

SEQ ID NO: 13622 - DNA, 74 bp, Homo sapiens
catagaacaagagtggtgtcagacaaagctggagaatgcagcatatacagatatggctgtcatctgagaacact

SEQ ID NO: 13623 - DNA, 74 bp, Homo sapiens
tgtcagtttcagagtttctcaccacaggagtgtactagattgtctaggtcactcagtttttatggagttcctgg

SEQ ID NO: 13624 - DNA, 74 bp, Homo sapiens
tagagctttgttgttgttgttgtttctactctagaaatacctagttttggctcaatggcttcccattggttgta

SEQ ID NO: 13625 - DNA, 71 bp, Homo sapiens
gaagactttttatctcccagtgaagtcactccctgtgacttatcattcttagttttggctgaagagtccat

SEQ ID NO: 13626 - DNA, 73 bp, Homo sapiens
gcacggctgccccgtccgtccgtccgtccagcacccgcccggagagtgaggccagagcacgccccagccgtgt

SEQ ID NO: 13627 - DNA, 72 bp, Homo sapiens
ggcatttgaagtctgtccctggtaactgagtgtggctggggtaatggggatgatgggagaagctggggtcag

SEQ ID NO: 13628 - DNA, 73 bp, Homo sapiens
aattccataatgtctttatgccagcagaaaatccagcatgatgaactattttatgcactaggatatatgtggt

SEQ ID NO: 13629 - DNA, 74 bp, Homo sapiens
tgtgactgcagaacggcgccttctctcacagtagaagtcagtttgtcgttatggggaggagtgctctgaaaata

SEQ ID NO: 13630 - DNA, 73 bp, Homo sapiens
gcacaagtaaatgaattctagagggaagtgaccatgggattaaatgatccttaaaggcactggtttcttctgt

SEQ ID NO: 13631 - DNA, 72 bp, Homo sapiens
actcttatgagtgttaagtatgtatatgtatgagtgtatacagttcacatatatatgaaaaatctttacaga

SEQ ID NO: 13632 - DNA, 72 bp, Homo sapiens
tttatgagctttagtccccatgaaacctagatctgcctgtgcacttatttgatggactaggtattctggaga

SEQ ID NO: 13633 - DNA, 70 bp, Homo sapiens
agggcatggcttagtgggggcctctgttttaaggtttctcacaaagctgcaattcaaggtgttggctagg

SEQ ID NO: 13634 - DNA, 74 bp, Homo sapiens
tgtttgggaaacaacagcagcaaacagtgagggaatgattgggattaccttagaaggttcttttgttcttgggc

SEQ ID NO: 13635 - DNA, 70 bp, Homo sapiens
gcagatgccactgttgctggagaaatgtcactgctagagaacagaagactattattccaaagggtatttg

SEQ ID NO: 13636 - DNA, 73 bp, Homo sapiens
ttctgagccccaggcattttgcgtaatcagccttctttgctgtttctactgtttgatgtcttaatctgttatt

SEQ ID NO: 13637 - DNA, 70 bp, Homo sapiens
acccatcctgtcatctggtcacctagatactgcccagatagaaccaccctgcaggccgggtcactcagag

SEQ ID NO: 13638 - DNA, 71 bp, Homo sapiens
tgtgccaaggaaatagtaataatgcccaccgcatatggtggttgtaatgtttgaatgacttcttgtatata

SEQ ID NO: 13639 - DNA, 74 bp, Homo sapiens
gcggaggcaggaggactgcttcagtccgggagttagagctgtgatgaactctgagcataccactgcactccagc

SEQ ID NO: 13640 - DNA, 72 bp, Homo sapiens
gcaagcaggtgcaaggaacacagtcattttctttgtctcctgtttcagctcagttcagcagaaacacattga

SEQ ID NO: 13641 - DNA, 70 bp, Homo sapiens
tagttcccatcaaaggtgcaagaatttggtggtgagtaaaattgatgggagctgattcaagccaggctgg

SEQ ID NO: 13642 - DNA, 72 bp, Homo sapiens
tctgagctcataatttgatagctagccatggtttacatggaaaggaaatcagaagtcaactcagtaagaggt

SEQ ID NO: 13643 - DNA, 71 bp, Homo sapiens
ctcagagacattcattctgagtaatccaggaagtctgttgatttcattcttgctccagtgcttctgctctc

SEQ ID NO: 13644 - DNA, 73 bp, Homo sapiens
tttctctctggagtttgtccagttttcccacggaaaaattatccaaacatctgctttggggatgggagatgaa

SEQ ID NO: 13645 - DNA, 73 bp, Homo sapiens
tctggggacaaagatcaaaagccggctgccacaggtttattgcaagtgagagtttgagtttcaccctgacaca

SEQ ID NO: 13646 - DNA, 74 bp, Homo sapiens
aggacttcaaccaggaagaaaccaacttcatggtcactttccagcaaccaaataccttcctgagagttgactcc

SEQ ID NO: 13647 - DNA, 72 bp, Homo sapiens
caagaatcatttgaacctgggaggtggaggttactgtgagccgagatcacatcattgaactccagactgggc

SEQ ID NO: 13648 - DNA, 74 bp, Homo sapiens
ctttgtgtcacctgactcctatcatccattgaccttcttaccaattggcctcattcagtgaaggtgagcccaca

SEQ ID NO: 13649 - DNA, 71 bp, Homo sapiens
tatattgtcaagaatatcattatcagctgagcacagtgggccacgcctgtagttctagctactcaggagac

SEQ ID NO: 13650 - DNA, 71 bp, Homo sapiens
ctaagcactggggatacagtaggagtaacacaggtttgctgttgcctctactcaacataaaatcattttgc

SEQ ID NO: 13651 - DNA, 74 bp, Homo sapiens
agaatctcagtctcaggattcttgcattcttgggaaatcatgataggcttagagtgcaaccagaagagagaatc

SEQ ID NO: 13652 - DNA, 72 bp, Homo sapiens
gcatatcacagttctacagcaggccactacaggctcctgacagagaacacatgtatcctatgcattatgtac

SEQ ID NO: 13653 - DNA, 74 bp, Homo sapiens
ggaaggaaggctgcccatgtgttgggtctgctaattagcaccatttgaaaataattatgacaagaccacacagg

SEQ ID NO: 13654 - DNA, 72 bp, Homo sapiens
agacggggtggtggccgggcagagcggctcctcacttcccagtaggggcggccgggcagaggcgcccctcac

SEQ ID NO: 13655 - DNA, 72 bp, Homo sapiens
aacagtagcagcactagatgctcataggaatgtgaaccctattgtgaactatgcttgtgagtgatctaggtt

SEQ ID NO: 13656 - DNA, 70 bp, Homo sapiens
agctataagtcagccccacaacaaagaattatttggagtcaactgtcaatagttctgagttgagaaactc

SEQ ID NO: 13657 - DNA, 72 bp, Homo sapiens
ctccctccagcggcaacggcagtagttttacagaggctggctgaacacccagctccctcaccaggcctagcc

SEQ ID NO: 13658 - DNA, 74 bp, Homo sapiens
cagggtggaaggccagggtgtgtagaaaagaatagattttctctgtttattgcacaagtttgtcaagattacat

SEQ ID NO: 13659 - DNA, 73 bp, Homo sapiens
cttagtatgccatggggtcactgtttcgattcctgctaaggtattagcagttgaactcatgattgcttatgcc

SEQ ID NO: 13660 - DNA, 72 bp, Homo sapiens
atgcatgtgtataaacatacatatgtatatgtgtgtgtatataatttcatcattcttgaagcaagccagcag

SEQ ID NO: 13661 - DNA, 73 bp, Homo sapiens
gagaaggagcaggagatgacaaccgctaacctgaatagaggctcagatcagctggttgacgatcagctcagtg

SEQ ID NO: 13662 - DNA, 74 bp, Homo sapiens
ctaaaatcaaactgcttgtgagttatggaactgtgtctcaaatccagttcttctcactacctaggcactcagat

SEQ ID NO: 13663 - DNA, 73 bp, Homo sapiens
taattctgtgaaaaatgtcagtggtagtttatgggaataccatttattctataaattactttgggcagtatgg

SEQ ID NO: 13664 - DNA, 74 bp, Homo sapiens
gcatcccaaggacaaggaagggttcctgcgcttcactgcaccacacctactcggtctctacaaagctccatttc

SEQ ID NO: 13665 - DNA, 72 bp, Homo sapiens
tttagatcacagaggtcaatggtaagggctctggagtcacattgccagggatcagaacctaatctatcactt

SEQ ID NO: 13666 - DNA, 70 bp, Homo sapiens
tctatccagcgggtgctcttatctgaactgacagcagcattcattgtcttagagatgaagcgggggtggt

SEQ ID NO: 13667 - DNA, 73 bp, Homo sapiens
tatagattaattcactaggggccaactgtttgatttctctccctgctgcttggcaccggaatgcaattctagc

SEQ ID NO: 13668 - DNA, 70 bp, Homo sapiens
caaatccagtttttataaaaggctttggccctagctttgggccagtggttctcaactggggttgttgttc

SEQ ID NO: 13669 - DNA, 71 bp, Homo sapiens
ggagtttacagagaagtgtggtaagaaggccaggaaggactgggaacacttctgaggtctgagagcaagaa

SEQ ID NO: 13670 - DNA, 70 bp, Homo sapiens
gcttccacctgctggccagtggggaagagtttaacatgacctaacttaactctgtgctggccagctgggc

SEQ ID NO: 13671 - DNA, 74 bp, Homo sapiens
ggaggctgaggataaggccattgaaaaataagtaaaccacgaattttaccaatttttggatttgtaaagccttt

SEQ ID NO: 13672 - DNA, 72 bp, Homo sapiens
ataacaaccttaataaaatcaactgcagattgtagtgaggtagcgagcacatttcatttccctgcattttgc

SEQ ID NO: 13673 - DNA, 71 bp, Homo sapiens
cttttggcgaagcttgttacctatgaattggcagattttgtggcagtaagaagtacaagcaaaaaggaatg

SEQ ID NO: 13674 - DNA, 71 bp, Homo sapiens
ccgagcacctcctgaacgtcaccgataaggcggggacgccagcatctaatgggactgctgggaggattgag

SEQ ID NO: 13675 - DNA, 70 bp, Homo sapiens
ggatcctccacacaggactctggggtgcagccgtcagctgtgtgctccccggcacctcctgtgcccctgc

SEQ ID NO: 13676 - DNA, 72 bp, Homo sapiens
gctgaggctggctcttgcaatccccctattttatggaatgtttcgctctgcagcaagctctcacatagttca

SEQ ID NO: 13677 - DNA, 73 bp, Homo sapiens
tgcactttggacagaaccctatttgtcactataggcagatgagatctgtattacttaaggcacagtgtaagct

SEQ ID NO: 13678 - DNA, 72 bp, Homo sapiens
acctcataagctggaaactcagccagaaacagaggagaggggtagacagcaggcacagacagatggggatgc

SEQ ID NO: 13679 - DNA, 72 bp, Homo sapiens
cattcacagcaggctgagcacttaccacgggggacccccccaccccccagtaggtcaggagtcctaagtgga

SEQ ID NO: 13680 - DNA, 72 bp, Homo sapiens
aacattgggccactgtaaattgagatgaagtaaccattttcatctcttctgcagggactagacattgtttct

SEQ ID NO: 13681 - DNA, 72 bp, Homo sapiens
ttagaaccttacccactgttatggctgaatggtgtctgactgcaccccaattcctatgctgaagccctaaca

SEQ ID NO: 13682 - DNA, 72 bp, Homo sapiens
acatttaccagattacaaaagtggttgagcatcttttatgactcttagccatatggtatactgagttgaata

SEQ ID NO: 13683 - DNA, 70 bp, Homo sapiens
cgaaacctgtttagcaacccaagcaggaggccgcttacttcttagttcacttgctttttgttataaagga

SEQ ID NO: 13684 - DNA, 72 bp, Homo sapiens
ctttgggctggtccgatccattgtacaagttaaagcactgatgggtacacaggtcttacccctgttggcgat

SEQ ID NO: 13685 - DNA, 72 bp, Homo sapiens
ctcccctctgggcctgagcattgctctacctgcttgcctggagcagagcaggtgccggtgcaactggcttta

SEQ ID NO: 13686 - DNA, 73 bp, Homo sapiens
tgtaaaagtgtacattcttctaaagacgtaagtgattaacattttctaatctctaaagtctgagtcctgaaga

SEQ ID NO: 13687 - DNA, 70 bp, Homo sapiens
gtgccctccctggctgtcttcttggagacccttcctgcactgaagagcagggagatggagcacatgtgga

SEQ ID NO: 13688 - DNA, 73 bp, Homo sapiens
atatggtccagccccttcaggtatcctctgtgccatgaacttggcgctgtccctctgacaccctcggccaccc

SEQ ID NO: 13689 - DNA, 73 bp, Homo sapiens
gagtgtctttgtttacaatgttcaggtctgtgggtgtccagtttttccaccttggggagcagagggtgagtgg

SEQ ID NO: 13690 - DNA, 70 bp, Homo sapiens
atgtctggagccttggctggaatagctcagttggctggaaacatcctggcttggctggggccctaagtct

SEQ ID NO: 13691 - DNA, 71 bp, Homo sapiens
ctttccccataaagtaggggatctggaatgttgggagcactctctctgctcctggtcactcctccctggct

SEQ ID NO: 13692 - DNA, 73 bp, Homo sapiens
ttggagaactcccattgagaaaagatcctagaaatcacagcagagtggcagggtctttctcaactgtgtccaa

SEQ ID NO: 13693 - DNA, 71 bp, Homo sapiens
ggtgccagtatatttgagagcaatggtggcctagaatgtagcaattatgcatcaagaatataacagtataa

SEQ ID NO: 13694 - DNA, 70 bp, Homo sapiens
cctccagaaaggcagtggggaaaagctccttcttcctttgcaggtagaaggcctcacacattctcactct

SEQ ID NO: 13695 - DNA, 73 bp, Homo sapiens
atggcaaggaacggcaggaggcctccagccaacaggcagcagaaagccgaggcccttgtaatgacagctgcaa

SEQ ID NO: 13696 - DNA, 72 bp, Homo sapiens
gaacacgtgtagtagcattatagaatcagagcagtagctgcaaatgatttatgaaactatctactctggata

SEQ ID NO: 13697 - DNA, 73 bp, Homo sapiens
gagatgctgctgggtaaaaatgcttaggcttgaaagtccttaaagagtctgagaggccttaaagagagcccct

SEQ ID NO: 13698 - DNA, 73 bp, Homo sapiens
gacccctttggaccacacaggacccactggtatggggagtgtgatgggagtgcaatgggggttccctcactcg

SEQ ID NO: 13699 - DNA, 73 bp, Homo sapiens
ctacccgggcagagcgatatatatatctgagaactcctcagacaatatgatgcttcttacgtgcaatggtgag

SEQ ID NO: 13700 - DNA, 73 bp, Homo sapiens
gacgactcggtggactcaggtggtgctggcctcccgtgctcagggactgagagctggttgctccttcctacac

SEQ ID NO: 13701 - DNA, 71 bp, Homo sapiens
atccagcggctctcaagcatggcacctgcatatgataaataagccaccacatgtagccccagatttgggtc

SEQ ID NO: 13702 - DNA, 73 bp, Homo sapiens
acccatccccctgagcaaagtgctgcactgccaagtaccaggtggtgtgcagttttgaggcactggaaaggaa

SEQ ID NO: 13703 - DNA, 72 bp, Homo sapiens
atgtggatagcaccatttctttattcattgttgatggacactttgtttgtttctacatcttgtccacgtgaa

SEQ ID NO: 13704 - DNA, 70 bp, Homo sapiens
tacttaccgtcttgcatgtttattttcttcatttcaagggcttacagtgccagatgcagagtttgacaca

SEQ ID NO: 13705 - DNA, 72 bp, Homo sapiens
gtaccttggagttccagtccagttttcccagaaaactgacctggtggcccctctaccccttcacacccctcc

SEQ ID NO: 13706 - DNA, 71 bp, Homo sapiens
ctgtaggtataggggcataaacctagggagacataagcaaggatgttcactgcccctgagataactcagaa

SEQ ID NO: 13707 - DNA, 73 bp, Homo sapiens
tggacctccaggagtttgtcagttacagtttagttttctctagcccagcattggttcctgagggggtgtatta

SEQ ID NO: 13708 - DNA, 70 bp, Homo sapiens
tggggcccccacatcagtaagctaaagggaaaagtcatgctgagaatcgcttagggcaaacccgcctccc

SEQ ID NO: 13709 - DNA, 73 bp, Homo sapiens
caaaaacaatttgttcatttttataagaactaccatactgacccactggatgtgggtcaagcttggagctggt

SEQ ID NO: 13710 - DNA, 70 bp, Homo sapiens
ggaaattcttgctaagtaaaattaaaaatgcatgatctccaatgctcttgttgctaagaggtagtttcta

SEQ ID NO: 13711 - DNA, 72 bp, Homo sapiens
agagcccaggctgcgtgggatgaagcactgtagacagcagcacgttccacctcggcctccacgtggactcat

SEQ ID NO: 13712 - DNA, 72 bp, Homo sapiens
gcagctcaggcagtatagggtcagtagcggggggtcctaaccagatggctcttggagatgactgtgagctgt

SEQ ID NO: 13713 - DNA, 74 bp, Homo sapiens
taaattcagactttgcttctactattgacgaggggttaaaatccaaagattccctaaaaagtggtaaaccaagg

SEQ ID NO: 13714 - DNA, 70 bp, Homo sapiens
ctggagatggatggtgatgatgcctgcactacgatgtaaatgtgcatgataccactaaactggacctttg

SEQ ID NO: 13715 - DNA, 71 bp, Homo sapiens
aaggagctggctctcagcatcactaagacggctctgctgggctctctccggcgggtgcggggtctgcaggc

SEQ ID NO: 13716 - DNA, 74 bp, Homo sapiens
catgagaatggttaagggcaagtgatgtaggggaaaaggcagggccctcgctccccaaatcctgcctaggctgt

SEQ ID NO: 13717 - DNA, 74 bp, Homo sapiens
gagcagcgccggtgaccgcaacagcacattgttgagttattttagaagcaatgtggcttgtttttgtttatggt

SEQ ID NO: 13718 - DNA, 70 bp, Homo sapiens
atacgtcagaaagtaggtttgcaagggaagataatgagtccagttgggtcctgtttcttttgagctgcct

SEQ ID NO: 13719 - DNA, 70 bp, Homo sapiens
gtaagagaacagaaatctccagtaacaaaagtgagtcaagttttgttttgttttgttttgttttgttttg

SEQ ID NO: 13720 - DNA, 74 bp, Homo sapiens
accctgcaaatgaccgcaaagctgcgggcaggctgtcaccctgtccccccgctccccgtcccccctgtcactgt

SEQ ID NO: 13721 - DNA, 72 bp, Homo sapiens
agcgccctcacccaagattctgcccctcccagcacttccttttttagtgactgggccctgcaggggcgcaag

SEQ ID NO: 13722 - DNA, 72 bp, Homo sapiens
cccgcacagcaggcacttcactgcaggctctgctgcctttgggaaatgtgcctcccttgtagagctctgtgg

SEQ ID NO: 13723 - DNA, 72 bp, Homo sapiens
tctcatgaggtagtagtggtggctctggctgtgtcccctgtggtctcctgcctttccctggcccaggagtgg

SEQ ID NO: 13724 - DNA, 74 bp, Homo sapiens
ggtggctgggtcgctgtcgcacggccgcggggacagcgcagccccgggcccggccgccgccgccatcagcccga

SEQ ID NO: 13725 - DNA, 73 bp, Homo sapiens
tccgtctaagggttgctataacaattaaatgagataaaccatttgcagggctggcactgcctgatgagaaagg

SEQ ID NO: 13726 - DNA, 73 bp, Homo sapiens
actcacttcccagtggcttctggggaggaggaatccctccctgagtcctcaggcccctcatgtgggtgagtgt

SEQ ID NO: 13727 - DNA, 73 bp, Homo sapiens
agagctgagccaggtgatgacgctgtcacaataccccatgcaaacctcactggactccgcttgtcacctggga

SEQ ID NO: 13728 - DNA, 72 bp, Homo sapiens
aaaaaatccgctcgaggggctcaacagtagattttggctagaagaatcactgaacttgagatagatcaatac

SEQ ID NO: 13729 - DNA, 72 bp, Homo sapiens
ccccctccagtgaagaccgactctgtctaacttgtgaaggtttggatactgacggcgaaccgctcttaataa

SEQ ID NO: 13730 - DNA, 73 bp, Homo sapiens
cctgggccgggcagcttccgtttccaaccagagtcggggaggaactgggaggaggggagcgcggtctcctcag

SEQ ID NO: 13731 - DNA, 72 bp, Homo sapiens
aaatctctaactgcaagaacaaccatgtcaatattctagatgagagatgaatgctggcttgggtcagagtgg

SEQ ID NO: 13732 - DNA, 73 bp, Homo sapiens
gtccccgcgccccgcgtccccgcgcagccgcctcctggcctcgggcgccgcgcatccaggtacgcggggccgg

SEQ ID NO: 13733 - DNA, 74 bp, Homo sapiens
taagcagcctactctgtatcaatagctgtctgttagaaagctgacatcacattgttgatctaaagcaagcttgt

SEQ ID NO: 13734 - DNA, 71 bp, Homo sapiens
aatgtggatacaagtgacctgatgctgctggccacgtgcacggcagtcccagtgtggacacgagcgacctg

SEQ ID NO: 13735 - DNA, 74 bp, Homo sapiens
ggggggcccagctccaggccccctgcaacccccggggctgccggcactcctgggtgggcctcaccatgcagacc

SEQ ID NO: 13736 - DNA, 70 bp, Homo sapiens
gggtaagcccacgccccgctccccactcccgcccgggtaagcccgcgccccgctccccactcccacccgg

SEQ ID NO: 13737 - DNA, 72 bp, Homo sapiens
agctgacagagctcctacagtcctagacaagcaaggactgcttggatgagtgggagggtggatggctgggag

SEQ ID NO: 13738 - DNA, 73 bp, Homo sapiens
ccctggccaaggtacttgatctctggacccctcgatgttaccctctgggaactggagatcttcacagctggtt

SEQ ID NO: 13739 - DNA, 73 bp, Homo sapiens
aagggaagtcgtcctgccagggtcgcacagctggggtgtggtgcagagcccagccccatgaatgatgcttttg

SEQ ID NO: 13740 - DNA, 72 bp, Homo sapiens
gagaggctgcatcaagaaggtgctcagtaaatgtgtccttctccttccacgcctttccccctcctccctcct

SEQ ID NO: 13741 - DNA, 72 bp, Homo sapiens
cgggctgcagatggcggcggctgctgagggagctccttcccctcctcccgcccaccctgctagggctaggcc

SEQ ID NO: 13742 - DNA, 74 bp, Homo sapiens
ccagctcctgggtactgtggaggcagcgtggacttccatggctgctgccgcccagcacacaccacgcttcccgg

SEQ ID NO: 13743 - DNA, 72 bp, Homo sapiens
gggcagggctgggaggtgtgaccctcgcctgggcttgttacagaggcaggttccacaacccagccgtgtgcg

SEQ ID NO: 13744 - DNA, 72 bp, Homo sapiens
tctgactcaagctcaggctgtgccatttccctgcggaggacgtgccagggagacgttgactccagatccctc

SEQ ID NO: 13745 - DNA, 74 bp, Homo sapiens
gtgacatcactcagggagagggagtgggggagaggctgctctcaatgattttggacaacactgttttgtctaca

SEQ ID NO: 13746 - DNA, 73 bp, Homo sapiens
gggggccacctgccccacagccccgatgggggagaaaaccagctggccattctgttattccgcaaatatttgt

SEQ ID NO: 13747 - DNA, 73 bp, Homo sapiens
gtatggcaggctttagggaccaacatcaaatacaaacatgttggaaatctttttgtcattccagctcaattga

SEQ ID NO: 13748 - DNA, 74 bp, Homo sapiens
gcttcctcaccaccttgtgcactgctgctcccacaccacagtgactagcagcacataatggtttgaattaaagc

SEQ ID NO: 13749 - DNA, 73 bp, Homo sapiens
ccagtcagtcacctggttcccaaggttcatgagataatctctgagaagtacaactaatcatggtgctgggagg

SEQ ID NO: 13750 - DNA, 72 bp, Homo sapiens
accagctccaggaacgttgcaccaccaatgtatctttaaagtgtcctcgtggtgacaaaataatctgcacgc

SEQ ID NO: 13751 - DNA, 71 bp, Homo sapiens
aaagaaaacaggagcttcagaggctctgtctgggaggcctacggcttgagatagagtcaccccacacaagc

SEQ ID NO: 13752 - DNA, 72 bp, Homo sapiens
ccctcccgcacccccacgagtcccgccccgccccgccccgcaagagggccgcccgctccttaccgggtgcgc

SEQ ID NO: 13753 - DNA, 74 bp, Homo sapiens
tcaattcttggaaaggttttattaaaactaataaaataattggtttgtatttaagattaataaaatcgaccaga

SEQ ID NO: 13754 - DNA, 72 bp, Homo sapiens
gctgtcatcatgtccactctacagccagcagcctaatcagctttccctgcagggagtgcgggcagaatcaga

SEQ ID NO: 13755 - DNA, 74 bp, Homo sapiens
accaaggaagagtttgtaactgtagcatgcttgtaaactagaatattattatttttttttttggtagaggctgc

SEQ ID NO: 13756 - DNA, 74 bp, Homo sapiens
gtgcccctgaggaaggggagactgcactgggagctggggctcgagtcccaccgctgccacctcctgactgtggc

SEQ ID NO: 13757 - DNA, 73 bp, Homo sapiens
ttgggatcacgggagggggatgttggctcagggggaaccctgtgaggagtttccagtcggcaggcctgtgaga

SEQ ID NO: 13758 - DNA, 73 bp, Homo sapiens
atttgggatttttagaatagcatttcaggtgctcactcactttgtgggtgggaattgagcctggtacaatctc

SEQ ID NO: 13759 - DNA, 74 bp, Homo sapiens
gtctcgccactgggggtttttcctcgttcgtagtaagtccagttttcccggagggaaaacctttggcagacccc

SEQ ID NO: 13760 - DNA, 74 bp, Homo sapiens
acaatccatggggagagggtgatattactcccaatatcgaaggaggtgtacaccctcccgtgacagtgtcctca

SEQ ID NO: 13761 - DNA, 71 bp, Homo sapiens
tttataatacttttgcaagatcctgtctgggaagagcattagttctgagctgagttcagacagcacttgca

SEQ ID NO: 13762 - DNA, 71 bp, Homo sapiens
agaaaggacactgagattttttaatagaaggatttctgtcttttaaaaataatcttttggtactatcttaa

SEQ ID NO: 13763 - DNA, 74 bp, Homo sapiens
gttcataccataaggaacatctcagaagttctggaaataagaggctgagaactgaattccattgagaactgagc

SEQ ID NO: 13764 - DNA, 73 bp, Homo sapiens
gttgtgggaggctgtccttagcactgtatcatgtttagcaccatctctggctttaacccactaagtgccttcc

SEQ ID NO: 13765 - DNA, 72 bp, Homo sapiens
taatgtgtgtaaaatgtttagaaaaaccctgtgagtgaggtagtactattatatcaccatacacaggctagg

SEQ ID NO: 13766 - DNA, 71 bp, Homo sapiens
agtgctgggatgacaggcgtgagccaccgcgccggccgcgccggcctccaccctaatcttttactaggcag

SEQ ID NO: 13767 - DNA, 73 bp, Homo sapiens
gcagagagtgcaagaagcagcaaacatgtccatcagtctctgtgggcacattagcacgtggttctccatctta

SEQ ID NO: 13768 - DNA, 71 bp, Homo sapiens
taaccctgtgaggtcacttgccttatgcttccttcaacatggaggaaattccattaacattcactccaggc

SEQ ID NO: 13769 - DNA, 73 bp, Homo sapiens
gtcattagagtatcatcatgatcccattctactgggtgaggatggttgaggggagaaataatgctgaagagtg

SEQ ID NO: 13770 - DNA, 74 bp, Homo sapiens
aattagctgtgccactgaactataggttcctcatttgtgaaaacaaaacaatggaccagtgagctctgaggtac

SEQ ID NO: 13771 - DNA, 73 bp, Homo sapiens
tacaaaaggattgtctgagagctgctcaagtgtggttatgaggggaggtcaggctggagacagaaaggatgat

SEQ ID NO: 13772 - DNA, 71 bp, Homo sapiens
gaggtgtcagtagcgagggaggtggtgacggctcgaagcatcccccgtcctcctcctcccccttcacgctc

SEQ ID NO: 13773 - DNA, 73 bp, Homo sapiens
attgaggcaatgaggtagtgagctacttgccaaaggtcatagagttagcaggtgccagggcctgtgtttgaat

SEQ ID NO: 13774 - DNA, 72 bp, Homo sapiens
gcattatttgttccaacaggggagtcaagaaactgatgtatagttctgagctggtggagcagaatttgtttt

SEQ ID NO: 13775 - DNA, 73 bp, Homo sapiens
agagttagtgctagaatttgatttagggtataaatggaagatattttcactccatttaaaccatagcaatgat

SEQ ID NO: 13776 - DNA, 72 bp, Homo sapiens
ccacagccttcaacacaggatgggaaatgtgcaataggcagttttacaatgaatgtgagtgaatggcaaata

SEQ ID NO: 13777 - DNA, 74 bp, Homo sapiens
tatacagatagtggtcatggttcttttactcacctcgcagtatccgtgacatgaacgaatctaagattagtatt

SEQ ID NO: 13778 - DNA, 71 bp, Homo sapiens
tttgtgcctgataaatctaaactgcatcggctctcatgagagagctgcattattttttcagatacaaatag

SEQ ID NO: 13779 - DNA, 73 bp, Homo sapiens
tcggcatgttctcacagtctaatagcagatctactttcatctgtgtctggttattgttagctgtacattctca

SEQ ID NO: 13780 - DNA, 72 bp, Homo sapiens
agtaaaatttccaaccaatgaacttattgaagatattctgattttattatgtgagtgtcttcaaagattgca

SEQ ID NO: 13781 - DNA, 74 bp, Homo sapiens
ataacccccaagtatttcaggaagcaaatagcagggcagtttagctgtactggctgacttatgggatgggatgg

SEQ ID NO: 13782 - DNA, 73 bp, Homo sapiens
tgatgtggtgctgagaagaatgtatattctgttgacttggggtgcagagttctttaaatgtctatcaggtctg

SEQ ID NO: 13783 - DNA, 74 bp, Homo sapiens
tgtcacgtgttgattacgtgatgatcacgtgtcagtaacgactcgatcatgtgtcagtcacttgttggacatgt

SEQ ID NO: 13784 - DNA, 74 bp, Homo sapiens
ccagtatttggcaaatacgagtaagtagttcaataaaatatgtgcttagttgccactggtatgttcagatctgg

SEQ ID NO: 13785 - DNA, 72 bp, Homo sapiens
cagaatctgccaccacatggtcaagcactaagcacagcatgtgagtaaatgctagggatcaggacagcattc

SEQ ID NO: 13786 - DNA, 70 bp, Homo sapiens
aaaggctgagccttaacatatataaataaatgatatataaagaaggccccaaatcatcctttagtattgt

SEQ ID NO: 13787 - DNA, 74 bp, Homo sapiens
tgacttttgcatagctattgcatttgtaaatattcaaatgcactttgttatggataaaagggagttccttgggt

SEQ ID NO: 13788 - DNA, 72 bp, Homo sapiens
tttatttatagccaagttcatcattttaacacttaatcttccatgacagtccggaggagaagaaacttggca

SEQ ID NO: 13789 - DNA, 74 bp, Homo sapiens
tggatggaagataggtggaagaagagagggattcttaaataattttctttcttttgttttatatttctaaaaca

SEQ ID NO: 13790 - DNA, 73 bp, Homo sapiens
aattttctgcctagctagaggactgtcaacgcaccaatcagtgctctgtgtctagctaaaggattgtaaatgc

SEQ ID NO: 13791 - DNA, 74 bp, Homo sapiens
agctagactctatttcgtcgtaccagtatcattgatgtttttatttggagggctgagtcagcagcattgtttta

SEQ ID NO: 13792 - DNA, 72 bp, Homo sapiens
tcatctctccatatgtgcaggagattggttttgggaccaccgtagatcctgaaacctgatgatgcacaagtc

SEQ ID NO: 13793 - DNA, 72 bp, Homo sapiens
aagcttatgtctagttttggctcagcctacaatcattttgcaattcagtgtgcatgtagccagatgcacagc

SEQ ID NO: 13794 - DNA, 72 bp, Homo sapiens
ttgtgtgtagactttccttgcattttgaattcaaactccccaagggaaacagactaggtcagccaggcatta

SEQ ID NO: 13795 - DNA, 73 bp, Homo sapiens
caaaggagtgtgcagacttgtggcccccggattgtgtccgatgctggcagcattgcgtgattctccagtatat

SEQ ID NO: 13796 - DNA, 70 bp, Homo sapiens
aaattgagactgtctgggaaatgcttggtgtaggaatatggtttcacatctaatgcaaagtcttcacaac

SEQ ID NO: 13797 - DNA, 72 bp, Homo sapiens
cagctgtacgatgttttagtgaacataatacactgtcactataaaaagtgtttgctgttataaaacattgtt

SEQ ID NO: 13798 - DNA, 72 bp, Homo sapiens
accaacagagtctctcctctcacagagtttatggggaacatagaggagaggaacatgaagatgtgtcgtcca

SEQ ID NO: 13799 - DNA, 70 bp, Homo sapiens
gaacttctcaaagcggcctaagctgcttagagtgaaacttcttatgaggcctagaggcatggctgcagca

SEQ ID NO: 13800 - DNA, 71 bp, Homo sapiens
ctatagaaatactgtgtaatgctgcatcctgccagagcatgctgagagctaggaataaggcagaaaccaca

SEQ ID NO: 13801 - DNA, 72 bp, Homo sapiens
tgtggtgagtgctgtggttgcagagatgataagacagttcttgccctcaaggagctcacagtaaagtgaaaa

SEQ ID NO: 13802 - DNA, 74 bp, Homo sapiens
catttttataatcctgggacttcaatcaaaagtatgtggcttcttatactggcactggataccttgggctgtag

SEQ ID NO: 13803 - DNA, 73 bp, Homo sapiens
ggcattataagggttgaatgcatcagaggctagtgtgattgcaaagaggaatgtgtgccccaactcagatggc

SEQ ID NO: 13804 - DNA, 70 bp, Homo sapiens
gcttcccatctgtttcccataaaggctccctctaaaaggccgggaatgaaaaaaaaaagatggagggaca

SEQ ID NO: 13805 - DNA, 74 bp, Homo sapiens
taccatgttggccaggctggtcttgaactcctgacctcaagtaatccagtcgcgtccacctcctaaattgctgg

SEQ ID NO: 13806 - DNA, 72 bp, Homo sapiens
caccggacctgatgctgctgcaccaactccagtcttcacggttcacaggaggagaatggaagggctgctgcc

SEQ ID NO: 13807 - DNA, 72 bp, Homo sapiens
tgagtgaagttaaagttttcatatgtttatgagtcatctgtatgccatttcgtgaactatgtgttcaaactc

SEQ ID NO: 13808 - DNA, 74 bp, Homo sapiens
aggcagaggagtcactatagagatgatatatatatgaatatatatgtaaattatatagatgtctgtctaaatga

SEQ ID NO: 13809 - DNA, 72 bp, Homo sapiens
gctgaacatccacgaagcagagactagggagccatggaaagctcttgtgtaggaaatgaatgattagctgtg

SEQ ID NO: 13810 - DNA, 74 bp, Homo sapiens
ataggatcctgtgggactggacttggagtctctcggcactcatttatccggtagtaagaacaacgctgtcgcag

SEQ ID NO: 13811 - DNA, 74 bp, Homo sapiens
accatggatggggcatagcatttgatattagggttttaatgttgatcaaggtcaatgtcgcctctgctccctct

SEQ ID NO: 13812 - DNA, 73 bp, Homo sapiens
cacccctgctgcaagtgaggttcatcgtttgtatctgtctgttgttggaagactcagggagacagacacctca

SEQ ID NO: 13813 - DNA, 72 bp, Homo sapiens
taatatgtatacggagtcttagactgttcttttttggagagacagctgagaatatattataagataatatgg

SEQ ID NO: 13814 - DNA, 71 bp, Homo sapiens
atctatttatgaaagaggttatcttgcttataggaaaaataatggattaagcttaaccattcacaaatgga

SEQ ID NO: 13815 - DNA, 72 bp, Homo sapiens
ccagatctcagtggtgaggatacaaacccatttaaactgtgtcaaaatattcatggagccccattgatttgg

SEQ ID NO: 13816 - DNA, 71 bp, Homo sapiens
tggctaattcagctcaacactcagattcttacgcatctggtggtgtagcagaaatgctttatacattcttc

SEQ ID NO: 13817 - DNA, 74 bp, Homo sapiens
agtagaagctgactgatatacttatcaaaaataaaatgttttaaatgtttcagtaaagttcctcagttaccttc

SEQ ID NO: 13818 - DNA, 74 bp, Homo sapiens
aaggaggagataaaatgacgccgaggccctgaactgttcatggcatccgcggctcagccaagctgttgttttaa

SEQ ID NO: 13819 - DNA, 74 bp, Homo sapiens
cttgcctctcccctagcccagccttaacttttctgggttgcagagggaaggagaggtgggcaggggactcgggg

SEQ ID NO: 13820 - DNA, 71 bp, Homo sapiens
ctggtcccgctccggggacagtgttcgcagggcaggaacagccaaagcagacaccagccgggtagagaccg

SEQ ID NO: 13821 - DNA, 72 bp, Homo sapiens
gaggagcccacgcggcacagcacgagccctactcttgcccgcgtagaggtgtgtgtgtgtgtgtgtgtgtgt

SEQ ID NO: 13822 - DNA, 74 bp, Homo sapiens
tttctagaaaagattgccgtgcacaatcagtttagagcgtgccatgtttgatttgtaagtgatcactgtttctg

SEQ ID NO: 13823 - DNA, 73 bp, Homo sapiens
cctcatgatctaaacagttcccaaaagttcccaagactgttgcactgggaattaagtttctaacacatgaatt

SEQ ID NO: 13824 - DNA, 70 bp, Homo sapiens
ggttaagagtataggagcaggagtcagactgtttaggttcgaatcctgtctctgcccccagaacagtgtc

SEQ ID NO: 13825 - DNA, 73 bp, Homo sapiens
tgaaattctaagagtctatgaaaggcagataggcagtggaaatattgatctatcatcagtcaaggtcaagagt

SEQ ID NO: 13826 - DNA, 72 bp, Homo sapiens
ctagcacctagcacctggcccatacatagtaggtccctaagaaatgtgactgggactgggcgtggtggcata

SEQ ID NO: 13827 - DNA, 73 bp, Homo sapiens
tcccactgaccttggaattgacagggtcacttttggtttccacagagccccttatcaatcacattcatttgga

SEQ ID NO: 13828 - DNA, 70 bp, Homo sapiens
aacaacctgcagcacctcgggccgcgcatcttccagcacctgccacgtctcggcctgctctcgctcaggg

SEQ ID NO: 13829 - DNA, 71 bp, Homo sapiens
catttaaccagaccaagggaactgagatttgagaagctcagttgtctgtaaatctaatggttcccaactta

SEQ ID NO: 13830 - DNA, 71 bp, Homo sapiens
ggtagcggcgccgcttggagcacgggcgctgcgggacggagcccggagccggaggcggcggcggcggagac

SEQ ID NO: 13831 - DNA, 73 bp, Homo sapiens
tgattctgagagccttagcagccccttgagttctaaaagatgggtctttatcactttagaggctttggggtaa

SEQ ID NO: 13832 - DNA, 72 bp, Homo sapiens
cagcccccgccctcccttcccccacctccatctgggagggcccctgactcacagccaggaggtgtccaaggg

SEQ ID NO: 13833 - DNA, 74 bp, Homo sapiens
gccctagaagacccctttgaaggcatttctcccaccccaaggataacagatgggaaacttcactccagagaggg

SEQ ID NO: 13834 - DNA, 70 bp, Homo sapiens
attaagggatctgtgggttaataaatatttgtaattgctgcttcagcctccgttgccctcggctccctcc

SEQ ID NO: 13835 - DNA, 73 bp, Homo sapiens
cctgggaggccgctgagtggatgggtctggtgtgcagaagagagacctaggctggggataaaggttttgggaa

SEQ ID NO: 13836 - DNA, 73 bp, Homo sapiens
catatatagtttgttttttgaggtggggatctcactctgtagcccaggttgaagtgcagtggtgcaatcctaa

SEQ ID NO: 13837 - DNA, 72 bp, Homo sapiens
atacaatcatgccactgaggatttggtgatggggcctatgtttttaaacctcttgtggcaaatcaaatatac

SEQ ID NO: 13838 - DNA, 73 bp, Homo sapiens
agtgatagatctgcttggctcagctcagctccttggacttcccagaagagtattaagccaaaaagttgtgtgt

SEQ ID NO: 13839 - DNA, 72 bp, Homo sapiens
tagaatagcagtgtgtcacaatggccagagaagtctgccacctgctgatggaaaaactgaattgtatagatt

SEQ ID NO: 13840 - DNA, 72 bp, Homo sapiens
aaacccaatgctttctggcttttcttgaaaaatgtggggctctggccccaagcccagaaccaagtaatagcc

SEQ ID NO: 13841 - DNA, 73 bp, Homo sapiens
tgcataaaacccttagttcctgggggaaggttataaagagagttcccagtagtctgcagattggttttttaca

SEQ ID NO: 13842 - DNA, 74 bp, Homo sapiens
atttgaccgtggagcctggaaggggtgactttctctgagatgaaggtgaatagctccacaaaattagggttcca

SEQ ID NO: 13843 - DNA, 72 bp, Homo sapiens
tacaccatgcactagatcttatgcttcatatgagcttgggctacctcgtgcaatggtatactgatggactct

SEQ ID NO: 13844 - DNA, 73 bp, Homo sapiens
ataagtttaatgcaggccatgatgacagtatttctgagtcctgctctgccaagatagctcaaaggatggagga

SEQ ID NO: 13845 - DNA, 70 bp, Homo sapiens
gccctggtttccagcaggtgacaaaaccaagattctaacttggttgaccctatagcccaggcttttcttg

SEQ ID NO: 13846 - DNA, 72 bp, Homo sapiens
atcctcttccacagcaccttatggtacattgccaataagagtaagatggagtggcagtaagatgggtggaga

SEQ ID NO: 13847 - DNA, 74 bp, Homo sapiens
gaaactgatttttgtttggcctctatgccccatgacatgaattgtcaaataccccaaggggtggtaaaataaaa

SEQ ID NO: 13848 - DNA, 72 bp, Homo sapiens
tcctagctagagccctctgagatgagtaacgctttctcagaggcttaacaatcctcctccactccctttgtt

SEQ ID NO: 13849 - DNA, 74 bp, Homo sapiens
cttcattcatttaacaaacacatgttttatacctgctgtgtgctggtcactggggaaactgttaaaagttggag

SEQ ID NO: 13850 - DNA, 72 bp, Homo sapiens
caacccccaggtaatcccatagtggcagcagtaacaacaatggcaacagcagcctggagagcaccgaaatac

SEQ ID NO: 13851 - DNA, 71 bp, Homo sapiens
gcagaacagagacagtgccagtctgaagcctgcggccctccaggaacggtgcctcctctgtactcagcagt

SEQ ID NO: 13852 - DNA, 71 bp, Homo sapiens
gggtcatccttgtgagtggaaagaacagacagtggtatgggagctggcgagctcagggaggaaatctaagc

SEQ ID NO: 13853 - DNA, 71 bp, Homo sapiens
aagggtaataattttgaataatgctctgtcctaggcatttttcacacattattacttttgatcctcacaat

SEQ ID NO: 13854 - DNA, 74 bp, Homo sapiens
tgaagagatttacagggactgggatgcagactctgtatatttttctcttctcttatttcaattactatgtttaa

SEQ ID NO: 13855 - DNA, 70 bp, Homo sapiens
aaatgcaacagttacaaaactaccatgtagtagttttaagcattattatttggatggtgggttgcctcat

SEQ ID NO: 13856 - DNA, 73 bp, Homo sapiens
aaatcttcaacctcaaagtttatcctcagctacaactgggataatggaaagatggggatttagtgacatttct

SEQ ID NO: 13857 - DNA, 70 bp, Homo sapiens
caaaacgcagcaggtctccatccacttgggtttccccgtctcctagggccaaccccctactttgcactag

SEQ ID NO: 13858 - DNA, 73 bp, Homo sapiens
ttttttgaggcaggatgtcactgtcacccaggctggagtggagtatagtatggtgtcatcacggctcactgaa

SEQ ID NO: 13859 - DNA, 71 bp, Homo sapiens
taagcaccagagagaaagtcacagtctcagagatggacgggcactgacttgttctctgacctcatcaggct

SEQ ID NO: 13860 - DNA, 72 bp, Homo sapiens
caagtaagtcttgagagtggtcctgtgcctctaaatgaggatcatgaaaaatggaacctgaagaggagactg

SEQ ID NO: 13861 - DNA, 74 bp, Homo sapiens
caatgattagtgagagattgggcccaaacacttcaagccagcaaaatctcccgctgagttgatgggtctctatg

SEQ ID NO: 13862 - DNA, 72 bp, Homo sapiens
caggttctctggcctttggactctgggatttccacatgctgtttcccagttctcaggccttcagcctcagac

SEQ ID NO: 13863 - DNA, 74 bp, Homo sapiens
gtctctagaaaagtgggttgaagtcaaagtgccccccctcattctctaatattgggctgagcactatggtttaa

SEQ ID NO: 13864 - DNA, 72 bp, Homo sapiens
ggtatagggtatgacagcccagcttccttcccatagggtgggacaacgctgagaccctacaaacactccaga

SEQ ID NO: 13865 - DNA, 71 bp, Homo sapiens
tactgtgtgtggagcattgtactaggtgctgggatatatagcagtgtacagatcaaactcctcaatttcat

SEQ ID NO: 13866 - DNA, 74 bp, Homo sapiens
agcgatgcccgctcgggccgcccggggagggactggggccacccgggcggcggcgggggtgtgtccgggcggcg

SEQ ID NO: 13867 - DNA, 73 bp, Homo sapiens
gccagagatgagcttgcccagataatgactagaaggagcttatcaagtcagcctaggaagctaaagagctttg

SEQ ID NO: 13868 - DNA, 71 bp, Homo sapiens
tggatgtccagttttcccagaactatttattgaagagactgtcctttccccaatgagtgttcttgacatct

SEQ ID NO: 13869 - DNA, 72 bp, Homo sapiens
agagccaccaggctagactcttagctgcgaggtaatgtgcgtgtcccttcaaagaggagctatgccaggcct

SEQ ID NO: 13870 - DNA, 70 bp, Homo sapiens
aattcctgagggtgaaagtgatcttagagagaatctaagccaacatttcaactcatatttaaacctgttg

SEQ ID NO: 13871 - DNA, 72 bp, Homo sapiens
aacgctaggctgaggaagtagagtggaaggcactgagaacccctattcacagcttagaagttggcgttttat

SEQ ID NO: 13872 - DNA, 73 bp, Homo sapiens
aactctgaggtagtggtttgtaaagtcaccagggcatacacaaagcccctggatgaacttggtacatcatcct

SEQ ID NO: 13873 - DNA, 73 bp, Homo sapiens
ttaatggtttaaaaaatgaagttgtctgggcgtggtggctcatgcctgtaatcccagcattttgggaagctga

SEQ ID NO: 13874 - DNA, 72 bp, Homo sapiens
tttctcaaatgggttccctcctctgagctgaagagtcatcagaggggatcaggtgaggtgacctatgaggaa

SEQ ID NO: 13875 - DNA, 72 bp, Homo sapiens
gagggtgagtgcccgagccatatagcaggcacgtccgggtcctcactgtccttccactcaacagtcatcaac

SEQ ID NO: 13876 - DNA, 74 bp, Homo sapiens
gtgagcagaggaactgggatctgatctgggtttgttttgtgccccccacccccaccccacgtcacctacacaca

SEQ ID NO: 13877 - DNA, 70 bp, Homo sapiens
acctacatttcccaaccccctaaattagctatgtaagtacctgggcctctgtggaatattgggtaatcat

SEQ ID NO: 13878 - DNA, 72 bp, Homo sapiens
gcatctgtcagttcactggtatccttgagctaaacagggggtctcaggatgtccaaatctgtggaagcttct

SEQ ID NO: 13879 - DNA, 72 bp, Homo sapiens
tagctacattagtctgcacatggcttctagagaggtggcacatgcaccccatgagagatgccactttaggcc

SEQ ID NO: 13880 - DNA, 73 bp, Homo sapiens
cagactagggatcatacactatagtggtgttacttacactgaagaggttcggacaccttggtcttgtgaggct

SEQ ID NO: 13881 - DNA, 74 bp, Homo sapiens
tttcacaaacagaggtgaaagtaatctgaagcgaaacaacaaagcttcaggcatcacattacccaactctcagt

SEQ ID NO: 13882 - DNA, 74 bp, Homo sapiens
gagaagcgagagggtggggaggagggtggatctcggccccgagaagggagggcgctgccggggcctcgcgtgcg

SEQ ID NO: 13883 - DNA, 73 bp, Homo sapiens
atccgcatccacaccctgctgcacagcatgccctccgcccagggcggcagcgcggcagaggaggaggacggcg

SEQ ID NO: 13884 - DNA, 71 bp, Homo sapiens
agcctggggggagtgggggggtgtggcctgggcacacgtgtgttcttgaggaggtaggtgaggctccaggc

SEQ ID NO: 13885 - DNA, 72 bp, Homo sapiens
cctcctccagcagctagacaaaagacaccccccaccaggaggccatatttgcatgtgggtgaaagagaggca

SEQ ID NO: 13886 - DNA, 74 bp, Homo sapiens
gcctcccgcttgctgcatcacgtctgctgtgtggagcttggcacactgctttgagcgtgtggatgcagagaggg

SEQ ID NO: 13887 - DNA, 72 bp, Homo sapiens
gaacaaggcctcagggaaataacaaaagatctaatattaatgtcattggagtccctgatgaaggcagaagga

SEQ ID NO: 13888 - DNA, 72 bp, Homo sapiens
tataaaaggggcgggaggccaggctcgtgccgttttgcagacgccaccgccgaggaaaaccgtgtactatta

SEQ ID NO: 13889 - DNA, 73 bp, Homo sapiens
gggagctccctgagacaagcacagtgtctcacagactctgtgctccccatgagacaggagctccctgggtagc

SEQ ID NO: 13890 - DNA, 70 bp, Homo sapiens
aatatttgtatagtatgaggtagtaggtttctgttttcatatgaatattcagacactgagcgtcatttat

SEQ ID NO: 13891 - DNA, 72 bp, Homo sapiens
ggagccctaaaattttttggcaatggtaatagtgaccaagatcttgggctatttttgtttctttaccctctc

SEQ ID NO: 13892 - DNA, 73 bp, Homo sapiens
tccacctctgaagtggtccagtgggcccaggggcttttctctgcccctccacaatgtgcccagcaggggctgc

SEQ ID NO: 13893 - DNA, 73 bp, Homo sapiens
ggcagccctatggctggtttatggggccctggagagctgtggaacaagtgagggcgtggtcaggctgcatttg

SEQ ID NO: 13894 - DNA, 72 bp, Homo sapiens
ctgggcaaacccttctctccccggagtctcattattttcagtctatagtagggcagtagtgggtaagacgcc

SEQ ID NO: 13895 - DNA, 74 bp, Homo sapiens
atgtttcaagtgtgatgggtgtttgatttgacctggagctcagttcagcagaggtgaaggacccactcacagga

SEQ ID NO: 13896 - DNA, 73 bp, Homo sapiens
tcaaaaggaagtgaaattcattgaaataccactacagctacattgtatgctgctggtatactcatattcacag

SEQ ID NO: 13897 - DNA, 72 bp, Homo sapiens
aattgagttttgtaccagtcaagacaggttagaatatgctgctgctgcagtaaccaacgattacaaattcac

SEQ ID NO: 13898 - DNA, 72 bp, Homo sapiens
aaattttctggcttctccccagagaaataacttggtcaaaacactcaggaaggggtaagccaaaacatcaac

SEQ ID NO: 13899 - DNA, 71 bp, Homo sapiens
tataaatcccagtctgagggccagggaagatgagatgagatgggatgtttccgctcatgctggcagaagaa

SEQ ID NO: 13900 - DNA, 74 bp, Homo sapiens
ggatgcttttaccatgtaagttagatcatgtcactcccctgcttgacaccatctgacggtttaggagagaatcc

SEQ ID NO: 13901 - DNA, 70 bp, Homo sapiens
tgctggtgccttgatcttgtacttcccaaccctagaaccttgggaagtatatttctgttgtttataagcc

SEQ ID NO: 13902 - DNA, 74 bp, Homo sapiens
tctgtgagctttggtgtcttcacttgcagagtggctaatactgcctgcatttatgactgtcgccagaatgaaga

SEQ ID NO: 13903 - DNA, 72 bp, Homo sapiens
ggctcagacctgtgatcctagcactttgggaggctgaggcgggtggatcgcttgaggtcaggagtttgagcc

SEQ ID NO: 13904 - DNA, 72 bp, Homo sapiens
ttctaagcatcttcagtggtccagtcatgagtaatcaagacttcatactgcaatgtcaaatgtttgttccac

SEQ ID NO: 13905 - DNA, 70 bp, Homo sapiens
gaatttggatttttggagcaggaacagatctcagaagctctgaacacagtctacgctatcaggaatgcat

SEQ ID NO: 13906 - DNA, 72 bp, Homo sapiens
atgtatgctatgtgtcacttaatgactaggattcattctgagaaatgcatcattaggtgatatcatcattat

SEQ ID NO: 13907 - DNA, 73 bp, Homo sapiens
acgttgtagttttcatcatcttgctcctctgtgtggtaactggggaaacctcccctaggctacaaataagggc

SEQ ID NO: 13908 - DNA, 70 bp, Homo sapiens
tcccctgtgacccaggcaagctcttaatctctgtgatgagaaagaagggctcatacctttcaggggtcat

SEQ ID NO: 13909 - DNA, 72 bp, Homo sapiens
cctattgttaggactggaactggagagagaagcagagtgacattgaggagtctcaaaacctccacaggagcc

SEQ ID NO: 13910 - DNA, 73 bp, Homo sapiens
agcgacagaggctctacatagaggcttcaaaatctgtctctaacctagcttgctgagtgtctgggagttttct

SEQ ID NO: 13911 - DNA, 70 bp, Homo sapiens
ggggcctcggggccaccgcgcgccaggcgaacgcgctagcacgaaaagcgggccaacgccgcctctgggg

SEQ ID NO: 13912 - DNA, 71 bp, Homo sapiens
agaacgtccttgctgtaaggtttgctgtgcaaagacactggacttggagttgaggaaacatctgaaatcat

SEQ ID NO: 13913 - DNA, 71 bp, Homo sapiens
ttgatcccctatgctcaggcccgctcccacattgtggagtgtgctttcattttcaataaaacccttccctc

SEQ ID NO: 13914 - DNA, 74 bp, Homo sapiens
cctgctttaggcatgctggctacttctgtcccccactgcactgtggccagctctcatctcccagctttatgcag

SEQ ID NO: 13915 - DNA, 72 bp, Homo sapiens
ttgggggactgtggcttctaacagaaagtggggtagcactgccattagggattgaactgtgggccctaaaaa

SEQ ID NO: 13916 - DNA, 71 bp, Homo sapiens
ttgtgtacttgtttgctagaggaagtaaatcaggtagaaccatagcatgctgtatactgttaattggacta

SEQ ID NO: 13917 - DNA, 70 bp, Homo sapiens
atgcagcagagctggccgagtgggcaaagtagctccagagtggacagctgcatggttcaaagatgtcagt

SEQ ID NO: 13918 - DNA, 72 bp, Homo sapiens
ggaacaaaatgactccgacaacaaaagcatcaggatgggccattatagcccaagctaagatccaggcagtca

SEQ ID NO: 13919 - DNA, 71 bp, Homo sapiens
acattgtcagcttcagtgatcaaatcagctttcatccggctggatctaagagaggcagcatttgacacagc

SEQ ID NO: 13920 - DNA, 72 bp, Homo sapiens
attcaaagacattgccagggattcaagaaatttagaacagttggttccttgacagaaaatgaggccatgtca

SEQ ID NO: 13921 - DNA, 72 bp, Homo sapiens
acttgtctcgaatctgggtataatactgatagtgtatatttgcattgaaagccaggtagggcttgttatatt

SEQ ID NO: 13922 - DNA, 72 bp, Homo sapiens
aaatatattaaagatgagtatttgaatagagggccaaaccacatggtatacttctggcagaatggttaatga

SEQ ID NO: 13923 - DNA, 70 bp, Homo sapiens
aatagtcatacagggctcccttcccaccatggtccaggaagcaactgactccaggggcctgagaatggta

SEQ ID NO: 13924 - DNA, 73 bp, Homo sapiens
ataaggctgccggtgccagggatcacctgggttcagcacctatggagaggtttatggttgccgctgctgcact

SEQ ID NO: 13925 - DNA, 70 bp, Homo sapiens
agatgatgcaagaagatgcacgaaggctggcggcacctatgaatgtgagctctcagctccttactttcct

SEQ ID NO: 13926 - DNA, 73 bp, Homo sapiens
agattccggggcctcgtcctcactctggtctccgaagagatcagggtggctcaagacccgcttcttcagcttg

SEQ ID NO: 13927 - DNA, 73 bp, Homo sapiens
gcaacggtgggcccggacgagggggaggcggcgcccctggcgaggagcagcattgccaccgcagccacgcgca

SEQ ID NO: 13928 - DNA, 74 bp, Homo sapiens
cctatctagcaccatccagaatctcacatgcgcaggggtttctgtgttagtgagaggtccttgagtaggaaggg

SEQ ID NO: 13929 - DNA, 70 bp, Homo sapiens
tcctgggaagcgacattgtttgatacacaccagtcctcttgtgcgggataatgtcactggcttccatttg

SEQ ID NO: 13930 - DNA, 72 bp, Homo sapiens
tctgtaggtctggcaagcatgactacccttacctctctgggtaaggtggctcacatctgtaatcctagcact

SEQ ID NO: 13931 - DNA, 72 bp, Homo sapiens
ttaaattctgattgcagtttatggttggctcttggattttgggattcaagtctaccattcacagcctagaga

SEQ ID NO: 13932 - DNA, 74 bp, Homo sapiens
ctgaaggaccagttttgaaatactccttttgtagaatatgcaagaggacatttcgatcgccttgaggcctatgg

SEQ ID NO: 13933 - DNA, 71 bp, Homo sapiens
ctggggcaaaaagccgcggcggcggggggagaaagacgcaaaaagctgcgggggcaaaaagccacggcggc

SEQ ID NO: 13934 - DNA, 72 bp, Homo sapiens
atcgaaagaatggtttagctttctgagatgaacacagatatcacaaagcagtttctaagaaagctcctttct

SEQ ID NO: 13935 - DNA, 74 bp, Homo sapiens
ggtaattcatgaatgatcgaatatctcatgatcttctgttgtaagatggagaagcttattcttcatgctgtact

SEQ ID NO: 13936 - DNA, 72 bp, Homo sapiens
tccaatgaacctttggcagaatactgatgattcttttctcagatctgattagcaccataggactgacagtgg

SEQ ID NO: 13937 - DNA, 70 bp, Homo sapiens
acctcttgtcctgccacttgtgggagtctgtctttttccaactcctgaggcaataacaggtcttttccca

SEQ ID NO: 13938 - DNA, 73 bp, Homo sapiens
agcaattactaaacagttgctttttggaatactaccttctagtgcttcaggagatgcaaagatctggcttgta

SEQ ID NO: 13939 - DNA, 71 bp, Homo sapiens
tgctaaacaggttagcggtgtcaggagggtcttccctcttgctgctcggtgcctagaacattcttgcccag

SEQ ID NO: 13940 - DNA, 73 bp, Homo sapiens
attggatgtttcctgtaagtcccagatgagttgcctggagagaggaatgacctctgagggcatgacattgaac

SEQ ID NO: 13941 - DNA, 72 bp, Homo sapiens
tatttatttatgagttccgtgagctattttgatccaggcggataatgagtggtaattaccttaggggaaatg

SEQ ID NO: 13942 - DNA, 74 bp, Homo sapiens
ctcctctgtcttttggctggggaatagaatgttcttgtgattaagcaggactggacagtttatggggtgaggag

SEQ ID NO: 13943 - DNA, 74 bp, Homo sapiens
taatttccaacataataaatatcaatagataaatagatataagacttccttgaagtttgtattagttttctatt

SEQ ID NO: 13944 - DNA, 72 bp, Homo sapiens
aagtgtttcccaagccccttgaactggcagagtcaacacaggctttgcagaaacactgatggatccaaacaa

SEQ ID NO: 13945 - DNA, 70 bp, Homo sapiens
gggtgtggggaaagcggagcaacagcattaggacgaatatctaatgtatggggggcttaaaacctagatg

SEQ ID NO: 13946 - DNA, 71 bp, Homo sapiens
ttttcttcacagtggctaagcagagcaagacaaccaagccaagctacttctgttcacggtggggctcctcc

SEQ ID NO: 13947 - DNA, 73 bp, Homo sapiens
cgtggtagctcttaaaataaaacctttgcaacagcagagattatatataatctctgtttttctgagaaaccct

SEQ ID NO: 13948 - DNA, 73 bp, Homo sapiens
ttgactaggaaatgctcttgttgatataggagttaagaagaaattatgtaggcagggtaaggaagtccttggt

SEQ ID NO: 13949 - DNA, 71 bp, Homo sapiens
catttaatttccttggatttgtgctgatgtggaagtgagtactagcactgtagccagcatatatggtctgc

SEQ ID NO: 13950 - DNA, 74 bp, Homo sapiens
cacctagccatcttcaaactaggcacacatgactcaattctggccaatgcattgtaaactgaagcctttaggtg

SEQ ID NO: 13951 - DNA, 74 bp, Homo sapiens
atcgaaatacaagtccatagaggtactttccatatttgagcaatagatacgttccagtaaagtgcccctaagga

SEQ ID NO: 13952 - DNA, 73 bp, Homo sapiens
tcagctaattatgaggtatggtgatctcaacctccttccaaccactggtccactcttgagtcttcaggctttt

SEQ ID NO: 13953 - DNA, 74 bp, Homo sapiens
ggctagcaaagacacccacggtggggaaacttgacaatttattcccgggcccgggggaggtcacctgcagtgca

SEQ ID NO: 13954 - DNA, 74 bp, Homo sapiens
acagaatcacagctaactttcggaggtatgataatggtatgagattatgcagaaagtgcagcagatgaatactg

SEQ ID NO: 13955 - DNA, 73 bp, Homo sapiens
gcgggagggggatctgagtgtgatgttggggacatgcccttcctaacgaggccagccaccccatgtattgttg

SEQ ID NO: 13956 - DNA, 70 bp, Homo sapiens
agagaaattagttatgagaggctgttttcagctcagtaaaaggatgagctgtttattggcaagaaacctc

SEQ ID NO: 13957 - DNA, 74 bp, Homo sapiens
ggcggccgtcgcggcgcgccacccgcgctcttcagcggaagacccgctcccccgggcaggcgcctttgttccgc

SEQ ID NO: 13958 - DNA, 73 bp, Homo sapiens
ttttaggtgttgcccgtggttgagaatcagaccctctgcccagggtttgtgactttattgcacagaaggctgc

SEQ ID NO: 13959 - DNA, 73 bp, Homo sapiens
agagccttcccttgatttgttattcttgagataggctgaagaaggaacatgagtattcagtcattagggatgt

SEQ ID NO: 13960 - DNA, 71 bp, Homo sapiens
ctcccaaagtgctgggattccagccatgagccaccatgcctggccagtgggagtgttttttgtgtgtgttt

SEQ ID NO: 13961 - DNA, 73 bp, Homo sapiens
tgaggggccctgttctgacttgggtgagtagagtgatatctacgaccaagctcaaaagcacaagcactttcag

SEQ ID NO: 13962 - DNA, 71 bp, Homo sapiens
cctacgtgcagtactgtgatgtgactcattttaaagctgtgtaaagtgggcctgggcacagtggctcacgc

SEQ ID NO: 13963 - DNA, 72 bp, Homo sapiens
tgatagactggataaggccaggcgcggtggttcatgtatgtaattgcagcactttgggaggctgatgcgggc

SEQ ID NO: 13964 - DNA, 71 bp, Homo sapiens
tatatctccccactgctgggcccagctcacctcagtccccaaggcctcagtgtgagtgagtttatcagatg

SEQ ID NO: 13965 - DNA, 70 bp, Homo sapiens
atccacgtactttcttgtaaaactcagttttggcaagagccctgctgggtcagttcagcaagaacgctcc

SEQ ID NO: 13966 - DNA, 73 bp, Homo sapiens
gtgatgtccctgtgccccagttgggctcagcctggcctgtgggggctggcccagggccgagggcagtggagag

SEQ ID NO: 13967 - DNA, 72 bp, Homo sapiens
acctaggagaggacagaatcaggggaggggggtgggggacagatgtcatatgtcctactgtgcagagttggg

SEQ ID NO: 13968 - DNA, 73 bp, Homo sapiens
cgctcacgcagaaactcacaaaccttcatcactgttgctcactttcagcagctgtgaaagacccggcggtgat

SEQ ID NO: 13969 - DNA, 72 bp, Homo sapiens
ctacttgtaggctgccaaggcccgtagagacaggaagctggtttttctcgaggcttcacatggtcaccttat

SEQ ID NO: 13970 - DNA, 72 bp, Homo sapiens
aaacgaatattcatgtagcaccagttgaaataaacagttttctttgttggggtagcaggatttagatgaatt

SEQ ID NO: 13971 - DNA, 73 bp, Homo sapiens
acagttggtatttcatctggatggactcgcacttacttaggcacaaaagaagcggggactccactggccacca

SEQ ID NO: 13972 - DNA, 72 bp, Homo sapiens
atttattttggagtggggacattagggcaagcagtgtcctttgtttatcttatcactgactgcatcttctgg

SEQ ID NO: 13973 - DNA, 71 bp, Homo sapiens
gacattagaaaccaggaacatggagtcccctgtttcaagctcaccattggtgtctccatggctgtgtcagg

SEQ ID NO: 13974 - DNA, 74 bp, Homo sapiens
ctcccggtgcttcacgcggaaatacacgtgagtcctggcgccaggtcggggtgggtgggtggcgtgggggtggg

SEQ ID NO: 13975 - DNA, 74 bp, Homo sapiens
gaaggcggccgcccccggggcggggctacatacacagccgtggtcccgcccggcccacatccgggcttccgcgt

SEQ ID NO: 13976 - DNA, 71 bp, Homo sapiens
agttcaggacagacactggcatagctcaaagattcacatttgagcagctgtggaagatgacagtacaatta

SEQ ID NO: 13977 - DNA, 71 bp, Homo sapiens
atagttttggtgtctgttcttccaggcattttcaatgcatgaataatcatcggtaactttcataaaagtta

SEQ ID NO: 13978 - DNA, 72 bp, Homo sapiens
aggctgggagttgcacatgctggaggctattgtcttcaccatagagaatgaagtactgttgactctgatgct

SEQ ID NO: 13979 - DNA, 73 bp, Homo sapiens
tttcttttcagagtctgacctatgagcactgtgttaaatgagttacacgagctgcttgcagcaatgagggaga

SEQ ID NO: 13980 - DNA, 72 bp, Homo sapiens
gtgtgctctttccattcctgcaactgtacatatcgaggatgtacttagagtaaagcctggatgttgggaatg

SEQ ID NO: 13981 - DNA, 72 bp, Homo sapiens
gtttgcacttgtggtgtgttgtcttgttccagtttggtgacagagtgatctcatctgatgctaacattctct

SEQ ID NO: 13982 - DNA, 73 bp, Homo sapiens
ccaatacatttcacctaattttattctgggttttagttgatgatgatgttctgaaactaaagccattttcaga

SEQ ID NO: 13983 - DNA, 73 bp, Homo sapiens
ctggaacagggttgggctagcccagtgttcaggtgctggctgtgatgagtgaaatgggttggtccctggatca

SEQ ID NO: 13984 - DNA, 74 bp, Homo sapiens
gcatcatttcagaacactagcaaggcgctgcagtagagattctggtgttggccagactgtgggggtccaggaaa

SEQ ID NO: 13985 - DNA, 72 bp, Homo sapiens
attgggctctaaaccataattttgacactaattagtgctacaacactgggcgggtatccttaaggcctcagg

SEQ ID NO: 13986 - DNA, 71 bp, Homo sapiens
cattttctcttagatctatgatatcagttatggatctaagtctcatgccactgacaccattctagctttgt

SEQ ID NO: 13987 - DNA, 73 bp, Homo sapiens
caagttattttatggaataatagtggataccgtccagttttttctggaatatttatagcacagtctatatact

SEQ ID NO: 13988 - DNA, 71 bp, Homo sapiens
gttcttatgaccatcacatgctgacttcacaatgctgtgaaaaagaggacagtggttttatgaaaaagaaa

SEQ ID NO: 13989 - DNA, 73 bp, Homo sapiens
tcagtggcttaggctgcatttgttagtggatgctacagtacagttttgatggggacatgcatgtctggtaagc

SEQ ID NO: 13990 - DNA, 73 bp, Homo sapiens
tttgcatttttgttttggttcatattttagcaatctttttgggtagcttggtttctccaggaatcagaaatgt

SEQ ID NO: 13991 - DNA, 72 bp, Homo sapiens
gcttcatcccagggttaacatggtctggctgaaagcaaacaagtgagcagatgttacttaggtttctggtac

SEQ ID NO: 13992 - DNA, 72 bp, Homo sapiens
agatagatgcctagggctccaaacagttataccaacactggattttgggctactggtgggtttgtatttaat

SEQ ID NO: 13993 - DNA, 74 bp, Homo sapiens
actgtgatagtgcatgtgaagtgcaagcactgggttttggcccttagaaagcacttattaaacattagctatca

SEQ ID NO: 13994 - DNA, 72 bp, Homo sapiens
tatacaacctggcgcatcagtgtttcctgctctgtaaagtcaatgtgtttgactcaaggatcttgtggatgc

SEQ ID NO: 13995 - DNA, 74 bp, Homo sapiens
cacttcccccacagtagccggcttcatggcagtggtcactccaggctggctgctgctgccatcagtatagccct

SEQ ID NO: 13996 - DNA, 74 bp, Homo sapiens
tatagcctattgcttaggacagagaagtcatacttacagcaaataaaagcctgatccaggcagttaaggtttat

SEQ ID NO: 13997 - DNA, 71 bp, Homo sapiens
ttcagaaacggggtgttttacctaaacatagtagcttacatgttagccagcagtaggtcggcactagtgtt

SEQ ID NO: 13998 - DNA, 72 bp, Homo sapiens
atgcggctctgagctttctagaaggcacatgaaaaaccatggtccatcacatgattgacacggtccataaga

SEQ ID NO: 13999 - DNA, 71 bp, Homo sapiens
aagtctgttgtgtaatagcaccatctgatatatcatttcctagggtggaattgttgactgagactaatttg

SEQ ID NO: 14000 - DNA, 72 bp, Homo sapiens
aagttgacctttgaaactgtgtattcctgatttacaagttgtatattagcatgagtttacgcagtatgtatt

SEQ ID NO: 14001 - DNA, 72 bp, Homo sapiens
gatttcagtggggaatggcagtggtttccagtgcagtgagctgagtacaattgggtaccacccttctcagtc

SEQ ID NO: 14002 - DNA, 70 bp, Homo sapiens
actgtttggtattcgttaagtgactatgaagtccccttttcataggagatatgtctcagaccagattgat

SEQ ID NO: 14003 - DNA, 73 bp, Homo sapiens
cttaacttcattatttacccaggagtcattcagcagcaggttgttcaacttccaggaaattgtgtggttttga

SEQ ID NO: 14004 - DNA, 73 bp, Homo sapiens
ctgaactgttagtgaaatccttatgcaggagttgtgaaagtatagtctagtggggttttggctgggaagttta

SEQ ID NO: 14005 - DNA, 73 bp, Homo sapiens
tcctggaggctttgtttattttttaacttttttcttcgtctttgatggattgggttaattcaaaggccgtgtt

SEQ ID NO: 14006 - DNA, 74 bp, Homo sapiens
ttcccatcacattgctgaactccattgtctcttgttttttcaatttctttttccttgtaggagagggaaatgag

SEQ ID NO: 14007 - DNA, 72 bp, Homo sapiens
aatatatgtatttgaaatacattcccaaaatgggatcatattgtatatatgtatttctttaggcaattattc

SEQ ID NO: 14008 - DNA, 71 bp, Homo sapiens
cggcggcggcggcggcggcgactctgcaggcggagtttcgcggcggcggcaccagggttacgccagccccg

SEQ ID NO: 14009 - DNA, 74 bp, Homo sapiens
ctgatttcaaaggcattccagactccagaggcggcatcagatagtgacccgcaagctggggagaaaaacattga

SEQ ID NO: 14010 - DNA, 72 bp, Homo sapiens
tataaggccagttttcccaaaaatcttttattggctctttagggcaagtttgattctttaaaggaaagcatg

SEQ ID NO: 14011 - DNA, 72 bp, Homo sapiens
agacctatacttgctcaggatcccaatgtgaattggatagacatctcttcccctggtgcattggggtctggg

SEQ ID NO: 14012 - DNA, 74 bp, Homo sapiens
gttgttgctggtttgttgggtgggggttgggggaatgggagggtgttctactagctcgtggttgtattttctac

SEQ ID NO: 14013 - DNA, 72 bp, Homo sapiens
gtggtttttttctgcagaagagttcatcggcctgagttagtccaggagaaggtggatggttggactaatcta

SEQ ID NO: 14014 - DNA, 74 bp, Homo sapiens
gtgtttctgagcagtctctaagttgatcttgtctgtgagatgaagtgtcagggtttaaactgattctgtaagaa

SEQ ID NO: 14015 - DNA, 72 bp, Homo sapiens
aaaaaaatcctctgtctcctagcatccaagtacaaaatctgagctgggtttagactaatgctctgagattgg

SEQ ID NO: 14016 - DNA, 72 bp, Homo sapiens
aagacttaagcccagttgtcacagttgggtattatttcagacttggactgatagggtaatttgatgggccaa

SEQ ID NO: 14017 - DNA, 73 bp, Homo sapiens
ctggttatgccagcagtaaagttgtcacgtggacacactgagaaccactggtttgctgggattttgcaggcag

SEQ ID NO: 14018 - DNA, 71 bp, Homo sapiens
aagcctgtactgcttggttttcacactgttattaaaaaatgtctgagactgggtagtttataattggctca

SEQ ID NO: 14019 - DNA, 71 bp, Homo sapiens
tattgggcagccagtggcacggacaggattgacatttgacagtcatctttggttgcccagcaaacagatcc

SEQ ID NO: 14020 - DNA, 70 bp, Homo sapiens
ttcatagtctcacttcacagcataagaataactgtttagctggaagtttttaaagatttgaataggtttg

SEQ ID NO: 14021 - DNA, 70 bp, Homo sapiens
ctgggaacatttcattctggttggctctaccaattgtatccaattccagtggcagcctatggaaaactac

SEQ ID NO: 14022 - DNA, 74 bp, Homo sapiens
cagtcgcttttaggtctactgcacagctatcattctgagacaggatgtcactgctcttgtagattgtaccgatt

SEQ ID NO: 14023 - DNA, 72 bp, Homo sapiens
cagagactcttgtgattacactgggcccatgcagatagtgataatccaggataaccttcccatctgaagatc

SEQ ID NO: 14024 - DNA, 70 bp, Homo sapiens
ggacacagaggccacccccggggaggggacgcccgacgggtccctgccgaacccggggccagagccggcc

SEQ ID NO: 14025 - DNA, 71 bp, Homo sapiens
ccagggccacctgcagaggtactccacgcagatccacagcttccgagagggcacctagcgcccagtcctgg

SEQ ID NO: 14026 - DNA, 71 bp, Homo sapiens
gagtcacccttttgggaagaaactcagcgccgtcattacagtactgtgattcagtctgaataagtggcaat

SEQ ID NO: 14027 - DNA, 70 bp, Homo sapiens
catcatggtatataatgaaaaggctgggaacaatctaaatgttcaccagtgaggccatggttaaataaat

SEQ ID NO: 14028 - DNA, 70 bp, Homo sapiens
aagctgatgcatgaaccccaagcatagcgttatttgaactgggatcatgctgagagctattctcataggc

SEQ ID NO: 14029 - DNA, 73 bp, Homo sapiens
cctggcaagagagcccgccacgcgcttctctactagggagcccgcaggtaagtgggatggaggctgaatgagg

SEQ ID NO: 14030 - DNA, 73 bp, Homo sapiens
tagttagagggtttcagttcttcagtggctgatggctggatatttcagttctacgctacacaggctttccctt

SEQ ID NO: 14031 - DNA, 70 bp, Homo sapiens
tgtcaagatggagctaaaaaataacatgggtgaacaaggtgccacccacatccaagcttccttcctgtgt

SEQ ID NO: 14032 - DNA, 70 bp, Homo sapiens
gcacaccttgctttttattcttaggacaaaatacagatcccaagctaaatcccaaggtaagcaatcagac

SEQ ID NO: 14033 - DNA, 72 bp, Homo sapiens
accccacaaggctcacatcatgggtgacccctgggatctggccagagggtccctgagtctccagagaagacc

SEQ ID NO: 14034 - DNA, 72 bp, Homo sapiens
ttgaaccccaaaggtggatgttgcagagagcagagatcgtgccattgaacgccagccagggcaacaagacca

SEQ ID NO: 14035 - DNA, 72 bp, Homo sapiens
ccccctcctcccccaggagccggtaggccagcagaggtgagctctcgctggccatggctgagcacaggtaga

SEQ ID NO: 14036 - DNA, 72 bp, Homo sapiens
gtgtgtgtgagagaatgtgtcactgctagtgaatcatcactggtttgacttaatccagctccaactcctttg

SEQ ID NO: 14037 - DNA, 73 bp, Homo sapiens
acttcttccgtttgtgaattcgctttgtaggggaggacttcttcctgaagatgtagatatgatgtggttaagt

SEQ ID NO: 14038 - DNA, 72 bp, Homo sapiens
catgttctacaatcctctggggctggtctccactgtccagacggcttgaaggatcagggaaagccttacccc

SEQ ID NO: 14039 - DNA, 72 bp, Homo sapiens
caatgggatccattggtcctatcaacaactacatgagctggacacagtcagcctggatgaccattgaaatgg

SEQ ID NO: 14040 - DNA, 70 bp, Homo sapiens
atgaacgttctcgtgcctccactgcctgggtcttcagtttcacttcccagccctgcggggtacaggaaac

SEQ ID NO: 14041 - DNA, 74 bp, Homo sapiens
aagcagtataattagctagtcaactgcactgtacttgctacagcacagaagataatgctaccaatagcttcgat

SEQ ID NO: 14042 - DNA, 72 bp, Homo sapiens
ttttccaattttagtatctgtgctgctgaagtaagcactagttaacttttatggggtgcttactatgtgcca

SEQ ID NO: 14043 - DNA, 70 bp, Homo sapiens
taaatgaggtcaaaagggtgaggctctaatccagtagaactggcgcccttttaagaagagaaagaaacac

SEQ ID NO: 14044 - DNA, 73 bp, Homo sapiens
cctagttatacatacagctacaccgggcgggagtagggaatcatttatcactggtctggtatgtttggaaggg

SEQ ID NO: 14045 - DNA, 70 bp, Homo sapiens
tcaaaaggtgaagctaaaccagttataaggccaggaagaagaatatagcggtttggcctgttacccagta

SEQ ID NO: 14046 - DNA, 71 bp, Homo sapiens
atatatgaatatttgcttagctgtatttttatgtacataggcattgctttcataatcagaggtaaaattgt

SEQ ID NO: 14047 - DNA, 73 bp, Homo sapiens
tttactagctgctctgagccattgactatgatgaacaatgtccgcagtcttcgtggttatagcagtgccagta

SEQ ID NO: 14048 - DNA, 71 bp, Homo sapiens
aagtcttagcttaataccaatctgtgtatgcatagggtaaaaccctagccatgcaagaacaacttttaggg

SEQ ID NO: 14049 - DNA, 71 bp, Homo sapiens
aaaggatatttaatactcttctctgatacataaagtcagcttccaggaagtgggttccaggaggagtgtgt

SEQ ID NO: 14050 - DNA, 72 bp, Homo sapiens
gacaaatatattatctctgctcggtaaatgggtgttgctgttcacttgtactgtactgctaaggaggagggg

SEQ ID NO: 14051 - DNA, 72 bp, Homo sapiens
aagcacctgccctcaaaagtgggggctgaaggagactccatgctgtcaagtgagtaagccaggtgctggcct

SEQ ID NO: 14052 - DNA, 74 bp, Homo sapiens
ggaccccgcgctcactcacacaccacttgcagctccatgcctgactcacagtctcccgtggaggcgtggaatcc

SEQ ID NO: 14053 - DNA, 74 bp, Homo sapiens
gagcttgggcacacattatctcctttgctgacaggcattattatccccatcgtataggtgaaggagttgtggcc

SEQ ID NO: 14054 - DNA, 73 bp, Homo sapiens
aggcagatggaggcaggaatctcaagggaaaatggaaaggcattttgcatgagagttggaaagataatggtct

SEQ ID NO: 14055 - DNA, 72 bp, Homo sapiens
gagtcctgagcagttgcagtgaaaagcttactcttattaatatgtgcacttcttccatctgtgctgtgggct

SEQ ID NO: 14056 - DNA, 72 bp, Homo sapiens
aaccatgaaaggacctaaagcaagcctctgttgattccccactgcattgcccacagttaggatcctggtacc

SEQ ID NO: 14057 - DNA, 74 bp, Homo sapiens
aggactctggtgttaaccgtacatgttctgccatgttttaagaaaatgaagaaaaaagagcatatacgggctgc

SEQ ID NO: 14058 - DNA, 70 bp, Homo sapiens
ccttgcagccctggctccctctcggcgccccctcggccttggtgcccactctggccacgcttgaggagcc

SEQ ID NO: 14059 - DNA, 70 bp, Homo sapiens
acccctctgtcctccgtgtctctctcgttccgcctcgattccccgagccctctccaggcagcgactggag

SEQ ID NO: 14060 - DNA, 70 bp, Homo sapiens
ggtatgttgtttccaaatttagaatgtgtttcattctcatcactaccatggcacatgcctaaggtttcag

SEQ ID NO: 14061 - DNA, 71 bp, Homo sapiens
tactagaatatgactatctcaatcataaagtgtttccttttgagacattattagatttggttacatagtat

SEQ ID NO: 14062 - DNA, 71 bp, Homo sapiens
aaaatgataaaggttgagagtgtaggctgctgtcatgacctacaggcactgcctaaatccttgcaactcaa

SEQ ID NO: 14063 - DNA, 73 bp, Homo sapiens
agataaatcatacattgctgagccagtattaacatttaaaatatcagttttgtgttctaaagatttgtgacag

SEQ ID NO: 14064 - DNA, 72 bp, Homo sapiens
tagactgaacagccttagagacatcatagctttggggtaggagtcgaggcataggtctgcaaacaaattctc

SEQ ID NO: 14065 - DNA, 74 bp, Homo sapiens
taatgaatagcttaccatgcagtctaatgttccatattgtcacctgacttctggtagggcagtttgaggcagca

SEQ ID NO: 14066 - DNA, 71 bp, Homo sapiens
tttgggcagacactgagctagctggaggagtttttttttttcatgtcacagtggcgcctggaacaccagtg

SEQ ID NO: 14067 - DNA, 70 bp, Homo sapiens
aggcttttgcagtaattcagacaaacaagagatcatggtggcttgaactgcaatggtaatgacagaggta

SEQ ID NO: 14068 - DNA, 72 bp, Homo sapiens
aatatgtccagttttcctgacttgacccctaggtcaagacctccttgatatgagggaactttttacatgttt

SEQ ID NO: 14069 - DNA, 72 bp, Homo sapiens
atacaaatatgtgtaaatcatgccttattactgagtttcacaactggggtgtgcaactgatgtgtctgtata

SEQ ID NO: 14070 - DNA, 72 bp, Homo sapiens
ttggttaatttctagagctatatactgctcattctggttttcctgagacagtttaggtttatgcccatgttc

SEQ ID NO: 14071 - DNA, 70 bp, Homo sapiens
tcccatttggtataggaagggagttggttgttttcttattagttagctttaagagctctttgtatattct

SEQ ID NO: 14072 - DNA, 73 bp, Homo sapiens
cactttgatgattgcattgtgttgacataggagaatatccttgtttataggagacacagtaaagaattcagtg

SEQ ID NO: 14073 - DNA, 71 bp, Homo sapiens
agcttttctggtagaagaagccaaagtggtcatgcaggcagttctgggctgcatggcttcaaatcacaggg

SEQ ID NO: 14074 - DNA, 72 bp, Homo sapiens
cctattccttataaacatcctcccaagttgatatatgtactgggtgacctatgaaatgagagggtgagatgc

SEQ ID NO: 14075 - DNA, 70 bp, Homo sapiens
gtcctgactcttctgccagctttcttaagtcagttcgtgaactgacttaaatcaattcttgtacacttat

SEQ ID NO: 14076 - DNA, 74 bp, Homo sapiens
gctgctttggagtcagagctggagccaggttaagattgtctccagacctcagagcccttgctgtctgtccccac

SEQ ID NO: 14077 - DNA, 70 bp, Homo sapiens
ccccaaccatcccccaggagacagctcatcactctggcccatattcagccagactcctgttaggtcattt

SEQ ID NO: 14078 - DNA, 74 bp, Homo sapiens
catgtgaggcctcgcagaccacatacagagtttgcattctattctaaaggcaatggtaaatcactgaaggcttt

SEQ ID NO: 14079 - DNA, 72 bp, Homo sapiens
agtgctacttctgcaccacttttgagaatagtgttatttcagtgaatcgatgtggtgaccatattgtaatgc

SEQ ID NO: 14080 - DNA, 72 bp, Homo sapiens
ttaaatcagatatgctatacaagcaatgtatgcttgtgtactaaatattgcactttgaaatcaactgactta

SEQ ID NO: 14081 - DNA, 71 bp, Homo sapiens
tttggctgagaagcattgatccagggaaatatcctgggttttcctcacttgtcaattcagcctgcaatttc

SEQ ID NO: 14082 - DNA, 72 bp, Homo sapiens
aggtatatgaaaaattccatgtttaattgcatacaactcagttgattttcagaaatggaatgcactcatgta

SEQ ID NO: 14083 - DNA, 70 bp, Homo sapiens
ttctagatgcttccttgtattgattctattcaaataaggaatatcaccctactgatgatgtcaacaaaca

SEQ ID NO: 14084 - DNA, 72 bp, Homo sapiens
agaatctcctaaaattagttcattaggtcctatggatctttggataaattggagaggatcagaaaaaataac

SEQ ID NO: 14085 - DNA, 72 bp, Homo sapiens
cagctgggcctccaggggtgacattacatattggtaggaccgtgatgatgaccctgagccgcaaaaccagca

SEQ ID NO: 14086 - DNA, 70 bp, Homo sapiens
tttttttttttttctttttcccaggaggcggcgacggcggcggcggggggagaggaagagaaagaagcgt

SEQ ID NO: 14087 - DNA, 72 bp, Homo sapiens
tgcttcattaattttacttgtaatttgacctaatggtcaatgaaagatagtatctggctgatagatgtaggt

SEQ ID NO: 14088 - DNA, 72 bp, Homo sapiens
agtgatccatggcacagtaataaaatagaactctgcaatgggttcctaaatatgccatgctgctgattatta

SEQ ID NO: 14089 - DNA, 72 bp, Homo sapiens
agatgaccaatggcaaatgtcagagttttgaaacagcctagaaatagagatatttcttaactctcaaattta

SEQ ID NO: 14090 - DNA, 73 bp, Homo sapiens
agcgggcggccgcgcggtgcaggcagctgcgtgggatttgcgcgccccctccccgccccgcgccctcgcccct

SEQ ID NO: 14091 - DNA, 74 bp, Homo sapiens
aataaatgatgaagcttgagaagctgtttgattctaatacagaattatttccgctagactggaggtggacattt

SEQ ID NO: 14092 - DNA, 74 bp, Homo sapiens
atatcaccagtgttcagagatggagttagcagtgacatctggataaaaaagattcacaattctgtttttcatct

SEQ ID NO: 14093 - DNA, 74 bp, Homo sapiens
taaaaatgttacatggtagcagagaccatatccttgaccccaataatttcaatgtggtaatggggacatgtggc

SEQ ID NO: 14094 - DNA, 72 bp, Homo sapiens
taatacactataagactgttgcattagatgtctattccttctgaagactgagggaatgaaaagaaatgaata

SEQ ID NO: 14095 - DNA, 72 bp, Homo sapiens
cattacagacctggattggactggacagttgctatggttttccactgaccttaatcactaggcatagtaatg

SEQ ID NO: 14096 - DNA, 72 bp, Homo sapiens
ctgttttaaagaggaattaggctaaaattgtgtttagagatgaagcactgattgatgcctgtagatttatag

SEQ ID NO: 14097 - DNA, 72 bp, Homo sapiens
ttcaatgtctttatgtgcatctctgcgcctatcacacagcaggcacagatgacactcatgaaagcctatgag

SEQ ID NO: 14098 - DNA, 73 bp, Homo sapiens
ccaaatatggttgaggacctgatgctgagtttttgctagtattagggaacattatttaagccaaacatcgtat

SEQ ID NO: 14099 - DNA, 71 bp, Homo sapiens
cacaagatcagatgaaccagcttatccatcttgggtggtgccagctgatctatcaagtacagggtctggaa

SEQ ID NO: 14100 - DNA, 70 bp, Homo sapiens
caaattccttaatgctcttgtggtcattgcttcatttgaagccatttggcttaggcattttctgccagtt

SEQ ID NO: 14101 - DNA, 72 bp, Homo sapiens
catagattcttgctgggatcacctatttcttggatactacattgccagggatcctggatctcttccttctta

SEQ ID NO: 14102 - DNA, 73 bp, Homo sapiens
cggagggagagggtagtttatggggtaaatcgctgccaccaccatctgctagggcttgtccctgctccccctg

SEQ ID NO: 14103 - DNA, 72 bp, Homo sapiens
atttttctgtagtaatgggtctcactttgttgacctagctggtcttgaaatcctggccccgagagatcttgc

SEQ ID NO: 14104 - DNA, 70 bp, Homo sapiens
cctctttttcttcactgtctcctcgaaaaaaaatctgttgtgggttgaattgtgccctcgcagaagagat

SEQ ID NO: 14105 - DNA, 72 bp, Homo sapiens
aggcaggaaaagaataaagcatcaaaactggccactcctgtctgctaccactgttgggatcctgccgattga

SEQ ID NO: 14106 - DNA, 70 bp, Homo sapiens
cagtccaggtaaggtcccgaggccctgaatcaaacagtggtggtcgcaatggagggcagggttgggggag

SEQ ID NO: 14107 - DNA, 73 bp, Homo sapiens
aacagtccagggaaatgacagttgagttgcacaaacccagtgttcagacttcctgagaaacttgtcttgaaat

SEQ ID NO: 14108 - DNA, 74 bp, Homo sapiens
gtctctggcctccttgggccttccaatactcagcaacctcctccaggtagcacccaccagggctgacactttcc

SEQ ID NO: 14109 - DNA, 74 bp, Homo sapiens
ggagcgcgggcggccggggagggcggcggcccctttaagagcaggccacgccccctcccctcctcccgttcgct

SEQ ID NO: 14110 - DNA, 73 bp, Homo sapiens
agggaaaaataaaacctccccacagcggaacactttctgcttcgccaggagttttcccacctgctttcctttt

SEQ ID NO: 14111 - DNA, 73 bp, Homo sapiens
agccactacacatatgttccaggggccagcaaatgttttctgtaggaaatattttaggctcttcaggccatgc

SEQ ID NO: 14112 - DNA, 71 bp, Homo sapiens
ctgcagaacttgcatttgaacaagatcccaaagtacttcttatgcttattaaagttgctgcagctccagaa

SEQ ID NO: 14113 - DNA, 71 bp, Homo sapiens
cttgccagtggccgtgcccacccccgcggagggcgggggtagggtgaggagtcttacagcgactgggccag

SEQ ID NO: 14114 - DNA, 71 bp, Homo sapiens
ggctgtcacctgcttggacactaatgccaccacggaaccatctggcacctacagggaaaaagcttctcagg

SEQ ID NO: 14115 - DNA, 70 bp, Homo sapiens
aataaaagcctgagcttcacagtggctaacagtactgaaccagaaccaaagtgcttaggtttgaatccca

SEQ ID NO: 14116 - DNA, 70 bp, Homo sapiens
tccaggctctgtgaaccacctcctgctggaccccatctggccgtagaggtggtaacagagacctcactat

SEQ ID NO: 14117 - DNA, 71 bp, Homo sapiens
ctcacccccattgccatatccactcagccaccagatacttaatggcactttcctgtgccaggtgctggtgg

SEQ ID NO: 14118 - DNA, 73 bp, Homo sapiens
gaccctgagggtacctgagcactactgaaggattttaagcaggggaatggcacgatcagatttacactttagg

SEQ ID NO: 14119 - DNA, 70 bp, Homo sapiens
atcactgccccatagccaagcaagccaaatggaaattgctgaacctcgtaggctttagtgcaataaaaca

SEQ ID NO: 14120 - DNA, 71 bp, Homo sapiens
agtggctctcattaggctgtttgactctgataatccagtcaaacagtttatctacagtcaaacagagagta

SEQ ID NO: 14121 - DNA, 72 bp, Homo sapiens
gcaagagcagttgtgagcaatgatgatgactgacactcacatccatcatttgccttcttccaaatgcttctg

SEQ ID NO: 14122 - DNA, 73 bp, Homo sapiens
gcagaagcagcaatggtgatagtctgggcttctatcacagggtgggacagaccttggagatatgctgtctcct

SEQ ID NO: 14123 - DNA, 72 bp, Homo sapiens
gaggtttcctccttcagagcttgctgagaatcgccagcaagtttctgcaccaagtcagtgtgggaagaatct

SEQ ID NO: 14124 - DNA, 74 bp, Homo sapiens
atgagtatgcctgttggtaattctacaatctggatatccaaaaaagtggccaaatggtccaaaactaatactcc

SEQ ID NO: 14125 - DNA, 72 bp, Homo sapiens
cagcttgagtcattagtgaatcaaatgggaatattgggggtattgagtatggctggatttaagggtgccaag

SEQ ID NO: 14126 - DNA, 70 bp, Homo sapiens
gagtagtccagttttcccaaggccccagcttgttagtgacagagttaggatagaagactgggtgtgttcc

SEQ ID NO: 14127 - DNA, 70 bp, Homo sapiens
agttgtcttccacctggccctagggtgtttatggcatgaagacagtggctcagcctgataaaggaggtgg

SEQ ID NO: 14128 - DNA, 74 bp, Homo sapiens
gtagatagcaccatttgattatttcagtttacttttctgttattggaaccgatatttgagtctgtgttttctac

SEQ ID NO: 14129 - DNA, 73 bp, Homo sapiens
ttctgtttgtattatgtctaggctttttcgttttatgccatggatgggggagaagagtactgactggtagaat

SEQ ID NO: 14130 - DNA, 74 bp, Homo sapiens
aagagaatcattggagggtctgaagccatcagtgatgagatgaagctgacatcaaggatgggagtggttgagat

SEQ ID NO: 14131 - DNA, 72 bp, Homo sapiens
caccaggcccagtgctaaatgctcaaagcgtcctctcccttggatgtcgagactctcattatgcccttttta

SEQ ID NO: 14132 - DNA, 74 bp, Homo sapiens
gagcctcgggccaccaagagatggaacctggaacagattgtgctgccaccgatccttggtgcctgcagaggagc

SEQ ID NO: 14133 - DNA, 72 bp, Homo sapiens
gtaattgctattgaagccttgctatcccctgagctagctcaagtgtgagtcaataacagctacagacagtag

SEQ ID NO: 14134 - DNA, 70 bp, Homo sapiens
gcttgaacctgggaggcggaggttgcagtgagctgagatcacacaactgcgctacagcctgggcgaaaga

SEQ ID NO: 14135 - DNA, 74 bp, Homo sapiens
agcatagaagcattaggctctatcatctaacctaggtatgtagtaggctaaaccatctgggtttgtgtgagtgt

SEQ ID NO: 14136 - DNA, 71 bp, Homo sapiens
tacattatagtgctttgtaagattaaatgagatatgtttataagtgtacagtactgtgatgatagcaaaat

SEQ ID NO: 14137 - DNA, 70 bp, Homo sapiens
ggctattccattttagttgtaattgatcctcaggaaatccttctttccaggtttttattgggactagatc

SEQ ID NO: 14138 - DNA, 71 bp, Homo sapiens
agccaacagctgccgcgatccagccgtactcgtccactcctgtgcggcagcaccgggctgcttgtgggcag

SEQ ID NO: 14139 - DNA, 73 bp, Homo sapiens
aggtttgtggctgagatgagaacttcgtgactaggcaagccgggtccagaaagtgacccttggttttgagcct

SEQ ID NO: 14140 - DNA, 70 bp, Homo sapiens
aggcacttgcagtgatgcaggttcgaggtagggaaatccctggtgcctgcccccgactgcagccttcctc

SEQ ID NO: 14141 - DNA, 74 bp, Homo sapiens
ttatccaggaatacagacactgtaactgctgatgaagagaaggacagggagggaggggtgactgcagtcactgg

SEQ ID NO: 14142 - DNA, 74 bp, Homo sapiens
gtgctgagcctcagttggagactgggagcaaagtgtcaagctcattcagagcatccagaataaatgcaagcaat

SEQ ID NO: 14143 - DNA, 70 bp, Homo sapiens
taataatcacaggtaagaaagtctttgtttaaaaaacaagcctgggccgggcgcggtggctcacgcctgt

SEQ ID NO: 14144 - DNA, 71 bp, Homo sapiens
gatgactatgaaagccccagcaaggctccagcacgtagcaggtgcttgatgtgcattgggcacatggtgat

SEQ ID NO: 14145 - DNA, 73 bp, Homo sapiens
aattttaatggtgtttgtgcctggatttctgttaaaagtcacagggttataatgccgaggttgtgagtattaa

SEQ ID NO: 14146 - DNA, 73 bp, Homo sapiens
tattgggttatttgatctcttattgagttgtgttttgtatatgatttatactgaagatatatccttccagtct

SEQ ID NO: 14147 - DNA, 73 bp, Homo sapiens
cctcagccccagccctgcagaagtattccctgggtctttcagggagtcctcaaaagggtccccgacatctgtt

SEQ ID NO: 14148 - DNA, 70 bp, Homo sapiens
gaattcaggctaaggcaggggaataaagaatgtagtaagatattttccctgtcctccaagagcttcccct

SEQ ID NO: 14149 - DNA, 72 bp, Homo sapiens
ccctacttatgtgatggagccccccaccaaaatatctgaatgcctaggctcaggtgtgttccctggttggca

SEQ ID NO: 14150 - DNA, 70 bp, Homo sapiens
aggaagaatgggttaaagcagtgatgagtcaggaggacaaccaccaagtcaccaggcccagcatacaagg

SEQ ID NO: 14151 - DNA, 74 bp, Homo sapiens
caggaagcagcaccagccaggaaagggatcaacagggtttggactcaaaatccctggggtccagggccagttct

SEQ ID NO: 14152 - DNA, 72 bp, Homo sapiens
ggtttcatgcaatcatcattattatgccaggcactgtgcctggcaaggagaatattaacatgaacaagacta

SEQ ID NO: 14153 - DNA, 72 bp, Homo sapiens
cagagcaagggcgactcggctgtgtatctctgtgccagaagcttagccacagtgtggcacagtcgtgtcctt

SEQ ID NO: 14154 - DNA, 74 bp, Homo sapiens
cagagcagggggactcagctgtgtatctctgtgccagcagcttagccacagcgtggcacagtcgcctcctttct

SEQ ID NO: 14155 - DNA, 72 bp, Homo sapiens
cctgggtcttgtcgataccagaacatattttcatggtccatatcctggacacattccagaaaaactttctct

SEQ ID NO: 14156 - DNA, 74 bp, Homo sapiens
agttggattctccttgccactgtccactgaaactgttccagccaagctgatcagttttcacatgcaaactgact

SEQ ID NO: 14157 - DNA, 73 bp, Homo sapiens
ccttgggggtggggggatagaggcatggaataggtgctctgacctctgaccctctagcccagggagaaggtga

SEQ ID NO: 14158 - DNA, 74 bp, Homo sapiens
gggtggggtagggtggagcagagcaggggccttccggtccagtgcccctcacccttccttcttcccaggactgc

SEQ ID NO: 14159 - DNA, 72 bp, Homo sapiens
tggctgctggagctttcacagttcactgggcgtttctatcagtcaagtctcaagacagcctcacacacatgc

SEQ ID NO: 14160 - DNA, 74 bp, Homo sapiens
gagatttatctgttttctcccaacccttgatggatgaacacatgcagtgaaagaagggagacaggatgcaggtg

SEQ ID NO: 14161 - DNA, 74 bp, Homo sapiens
atccaggtcacactgatgcaagaggtggcttttcatggtctttggcagctctgcccctgtggcttggcagggta

SEQ ID NO: 14162 - DNA, 73 bp, Homo sapiens
tgttcatgtgctataggccagtggttctcaaatttagcatgcatcagaattacctggagggccctagcccagc

SEQ ID NO: 14163 - DNA, 71 bp, Homo sapiens
gcaaaaatagccagttgactcttgtttccttgagtgtccagtgggaaactgaagctgaatcaaggattgga

SEQ ID NO: 14164 - DNA, 71 bp, Homo sapiens
atttaagcagcattgtacagtatactacaatcagtaactgtggcacatatgctgttgagccctgaaattgt

SEQ ID NO: 14165 - DNA, 73 bp, Homo sapiens
caagagtgctggagttgaccagctgagtcagcagcagtggaatcgaactccactcactcggacccactgtgtc

SEQ ID NO: 14166 - DNA, 73 bp, Homo sapiens
aacatcaggatgtggtaagaatatgagttgatgttgagataatttggcttgtttgggccaggatttgattgtt

SEQ ID NO: 14167 - DNA, 70 bp, Homo sapiens
atttctttatagatctgggtggctgttacactgttatgttcattgtgtgataattcctgatactagctat

SEQ ID NO: 14168 - DNA, 71 bp, Homo sapiens
gcaagacgtcactttattatgaattgtctagagaggaaacagaggaggccctaggcaatttactgacttgc

SEQ ID NO: 14169 - DNA, 73 bp, Homo sapiens
atgacagcttgcctggggctgggcagtctgtgatgtccatgtccttccacacaagtctgatggttagtctgtt

SEQ ID NO: 14170 - DNA, 73 bp, Homo sapiens
ctttcctgacatgagacagaaaggacacttgaacacacaatgaaatccttgtggagacaggcagagttgggag

SEQ ID NO: 14171 - DNA, 73 bp, Homo sapiens
tattggtgatattactgtttcaaatggcccccaagcgcagtgttgagtgtcgtccagtgttcctaagcacaag

SEQ ID NO: 14172 - DNA, 73 bp, Homo sapiens
ggttttgtgggtgctttggggatggctaataaacatgagaggacatacctggttgatcctgacagtagcaaaa

SEQ ID NO: 14173 - DNA, 72 bp, Homo sapiens
gctggagctgctataacaaggtatcacgctgtgtggcttaaaacagcacgatttcattgtgttacagttcta

SEQ ID NO: 14174 - DNA, 74 bp, Homo sapiens
cgtgcctttgtgtttcggctggtccgagtgcagtggtgtttacaactaattgatcacaaccagttacagatttc

SEQ ID NO: 14175 - DNA, 70 bp, Homo sapiens
tgcggcgagtgcaaaaagaccttttctcagcagtcgcggctcacgcagcacctgaaggtccacaccacgg

SEQ ID NO: 14176 - DNA, 70 bp, Homo sapiens
ccaacatggcgaaaccccctctctactaaaaatacaaaaattagccgggggtgttggcgcatgcctgtaa

SEQ ID NO: 14177 - DNA, 70 bp, Homo sapiens
ttcatcctgctcagtcaccaccttgtgatgcttggggctgtttagtaggatggatgatgtgtttttcttt

SEQ ID NO: 14178 - DNA, 72 bp, Homo sapiens
ttgtaagaatgaaacgcatatgcatgtgtgaactacaaatattgtttacttgtgtggaatcatgtgatttca

SEQ ID NO: 14179 - DNA, 71 bp, Homo sapiens
ggaaacatactgatgatgtctgagcttcccagtgcctcagaaagggggacaaaagacactgggttcagaga

SEQ ID NO: 14180 - DNA, 72 bp, Homo sapiens
ccattgtgaataatgctgcaatgagcattattatagaaatatctgcactcccaggctcactgcaacattatt

SEQ ID NO: 14181 - DNA, 73 bp, Homo sapiens
ggataaactgtagtgtgtgtgtgtgtgtgtgtgcgcgcgcgtgtgtgtgtatgatggaatactatgcagccat

SEQ ID NO: 14182 - DNA, 72 bp, Homo sapiens
cctctcggcacacggaggaaatcactcagacttcagaaatcaggaagctcagggtgggccccatggttatgg

SEQ ID NO: 14183 - DNA, 70 bp, Homo sapiens
tatggaaacagaaagcccagtgtgactcagcagtgccaaggctgccaagagagctggcggtggcccggcc

SEQ ID NO: 14184 - DNA, 73 bp, Homo sapiens
cctatagccttccgtatgtcttagcgtctgctgaggcaaatcctctctcttcattctgttttttaaaggctga

SEQ ID NO: 14185 - DNA, 71 bp, Homo sapiens
tcttacacatatatccatgcatgcatgcacacacatacacatatatacatgcatgcatgcacagtcacaca

SEQ ID NO: 14186 - DNA, 74 bp, Homo sapiens
ggatctaggatccacctgccaaggcccattaggctgtatggtccaggaaggtggggaccagagccagcttcttt

SEQ ID NO: 14187 - DNA, 73 bp, Homo sapiens
agctggctcgggctgaatggagggctgatcgggaggggccgggagggcgctcccgctctcccacccctctagt

SEQ ID NO: 14188 - DNA, 71 bp, Homo sapiens
atttcaggcatgtgtgagtcaaacagaaagaccccagcagtgaggagttttttgtgccccacctctgtgct

SEQ ID NO: 14189 - DNA, 70 bp, Homo sapiens
aaacctacctttagctcttgttgggggctggtgacgtagcaggaaacctaggttggacctacaggtaagt

SEQ ID NO: 14190 - DNA, 70 bp, Homo sapiens
gcctcccacaatgctgggattacaagtgtgagccaccatgcttggccctcattctctaatatcccttttg

SEQ ID NO: 14191 - DNA, 72 bp, Homo sapiens
ccctgagcctctgggggggcttaggaggtgtcccctcccgggtttcggcaccaatgaaaggcaatggaaggg

SEQ ID NO: 14192 - DNA, 72 bp, Homo sapiens
cttcctcagcacccactgggatgggcacagcgttatgtcaggacattcgccatccctggggctggtccctga

SEQ ID NO: 14193 - DNA, 72 bp, Homo sapiens
cctctctgcttgctgctggctttggggttgggatctgcttcccactctcctgcatctgacgtgctcttccat

SEQ ID NO: 14194 - DNA, 74 bp, Homo sapiens
aatcttcaggatggttttgtcatttatagcttgatttttttttcttagcttcagtctttgcaaccagccagaga

SEQ ID NO: 14195 - DNA, 70 bp, Homo sapiens
gcggggctgcagagccagagctcggggtcacctgtgccccctgagtccccggcatctcagtggtgacttt

SEQ ID NO: 14196 - DNA, 71 bp, Homo sapiens
gcgggtctggacgcgagctgggcatccgaccgcaccgcggcgggacggggagcgcggccgcctggagctgc

SEQ ID NO: 14197 - DNA, 73 bp, Homo sapiens
cccgccccacccctgctccccgcgccccttcgtttcggcctttgtctacaggccgggtcggaacgtcagcccc

SEQ ID NO: 14198 - DNA, 70 bp, Homo sapiens
tcattaaatcgatagcccgggtggtccatcacactgacagctgacgcgcgcaggaaggtcggttcacaat

SEQ ID NO: 14199 - DNA, 71 bp, Homo sapiens
ccagcctgatacattcttccagcaactcaaacaaactgagacatgaaagcagtgttgtccgtctggggtag

SEQ ID NO: 14200 - DNA, 74 bp, Homo sapiens
taggtttttgctttgtgtttactgtgagtcttacagaaaacctaattgtgcaaatctatatggaactgataaca

SEQ ID NO: 14201 - DNA, 74 bp, Homo sapiens
cagtataatattacacagtatagcacggcacagcaccacagagtataatatggaatagtgtagtgcagtatagt

SEQ ID NO: 14202 - DNA, 71 bp, Homo sapiens
taattccttgcactctggtgtgccacatgcacaagtagcatgggattcagcagtcaaaggaggcgtcagac

SEQ ID NO: 14203 - DNA, 73 bp, Homo sapiens
actcacaggaggggctgcaccaccctggggcgttttcaggaacattggctcaccctctatcagtgtcagtgat

SEQ ID NO: 14204 - DNA, 72 bp, Homo sapiens
tacaaaaggaatgtttctgttcaacaggccccatgcggctgtgcagacaactggggggcttcccaggagcag

SEQ ID NO: 14205 - DNA, 72 bp, Homo sapiens
taattttcaagtaatcctttagagatctatctatgattctcacttggagttttacgttatttggaaaagtaa

SEQ ID NO: 14206 - DNA, 72 bp, Homo sapiens
agtggtgcatcttgggggagacaccaggcctggtgcttctttctaagctttggtttccacgtttgtaaaatg

SEQ ID NO: 14207 - DNA, 74 bp, Homo sapiens
ctctgtcttgaagcgagaccgttaccatgactggcgccgggcgcccacatactgaggtgtttctgtagcacaga

SEQ ID NO: 14208 - DNA, 73 bp, Homo sapiens
gcggctttcttttgcggcagcccgtgagctcggccaccagggaactagctggcagctcacgcgggtggaaggc

SEQ ID NO: 14209 - DNA, 72 bp, Homo sapiens
gccaggccagagtgagaacgcgtcgtctattgttcaaagataagaaacgctgcagcatgaagatggccggtg

SEQ ID NO: 14210 - DNA, 74 bp, Homo sapiens
agttcgggtctagggagctcgcccaagtttgtgtagaatgaagcacgtctcctcgtggggccgtgggaatatga

SEQ ID NO: 14211 - DNA, 71 bp, Homo sapiens
actgtctcgagacactagcttgcacctttgcaactgcttgtaatattcagacagggcactgaagacgaagc

SEQ ID NO: 14212 - DNA, 74 bp, Homo sapiens
gcttcaggggcattggtgggagtgtggaacggaaaatttaaacatcagaaactccattaggggacgttgatgca

SEQ ID NO: 14213 - DNA, 71 bp, Homo sapiens
cacagcaagagctgggagtcgatgcagtaggagcctgtgaagggctgggctttctgttttttgttgcctga

SEQ ID NO: 14214 - DNA, 72 bp, Homo sapiens
tacttttgtaatccctgtaactggtttttaatggtcccgtggatcattttgatgaagttgatattccagttg

SEQ ID NO: 14215 - DNA, 71 bp, Homo sapiens
aagaaagcataatgaaaaccatcatattagtatttccacatctgctgttggtgtggttatcactaattcca

SEQ ID NO: 14216 - DNA, 70 bp, Homo sapiens
caggaggtgagcagagggcaggcaggcattactgcctgagctctgcctcctgtcaggtcagcagcagcat

SEQ ID NO: 14217 - DNA, 72 bp, Homo sapiens
atcatcccagtgttcaggtgtggacgccaaggctgagcatattgaggtagcctgtccacgcaggtggcggga

SEQ ID NO: 14218 - DNA, 71 bp, Homo sapiens
cagttccgcccgtccccgccccgccccggcccttccgccgccccgccccgggccaccccacctcggcgcca

SEQ ID NO: 14219 - DNA, 70 bp, Homo sapiens
gagcaggtctggcgggccctgaggcagggcaggcaccaccccgcgccctctgggaacccacggtctgcac

SEQ ID NO: 14220 - DNA, 72 bp, Homo sapiens
catcctcaagtcacgtcatgatttccttgctgtgtgcgggatgttattagctgttttgcgggtgtcatactc

SEQ ID NO: 14221 - DNA, 72 bp, Homo sapiens
cagacttgttggcctcattctgacaactgtgaaacacaccctccaatcacatgctcagggcgccatgccaac

SEQ ID NO: 14222 - DNA, 72 bp, Homo sapiens
tttgctgtctcaaactctgcatccactcgggccctccactgtaggttcctggcccagcacttagaggcttac

SEQ ID NO: 14223 - DNA, 70 bp, Homo sapiens
gtgcgcacctgtagtggatgtggtggttgcacaccggtagtcccaagtactcgggaggctgaggcaggag

SEQ ID NO: 14224 - DNA, 71 bp, Homo sapiens
gaggagcccggggagcccgcgcccgtacccccggggttcggggcggtgtacggggagccggacctggtgct

SEQ ID NO: 14225 - DNA, 71 bp, Homo sapiens
gacggctgtgtggagatagccatggcagagtccagcctctgggcccggaagagtcactgcagctactcctt

SEQ ID NO: 14226 - DNA, 72 bp, Homo sapiens
taggtcccgcagaactccctgagacactagctacactgcagcttaagtaggcgggtccgggatccagcaccc

SEQ ID NO: 14227 - DNA, 73 bp, Homo sapiens
gggtctcctagggtggaaggtattttctcaggcccctcattcccctcatcttccaccaataccagaaacacca

SEQ ID NO: 14228 - DNA, 73 bp, Homo sapiens
tcattgtccttcacagggagctgccctgggggccaagcagccccttgcatggctgtgctgacctggtctcatc

SEQ ID NO: 14229 - DNA, 74 bp, Homo sapiens
aataaataaaactgtggttaaaaatacatggcaagagatctagcctctaaaccaaattgtaggtacaggattgt

SEQ ID NO: 14230 - DNA, 74 bp, Homo sapiens
cacgggattatgggcatgataaaggaagttgataataataattctattattaacgattatggtgataatttgtg

SEQ ID NO: 14231 - DNA, 72 bp, Homo sapiens
caggtagacataagttgaaaaggctgtggaggttttgttagccctgttaacaaatgtgacctacttgaacca

SEQ ID NO: 14232 - DNA, 70 bp, Homo sapiens
tagttacgcatccagtggagccaggagggaaaaatcagacatcagtaacccacttgatgatactgcacat

SEQ ID NO: 14233 - DNA, 70 bp, Homo sapiens
tcagcttacctgagtattattttgtttcataagcaaggatttcacaaagtaatacccagtgtctgcaaat

SEQ ID NO: 14234 - DNA, 71 bp, Homo sapiens
gccaaaaagagacaaaacatttttccagtggctcttatacaactttaggggattggattgtttgttactcc

SEQ ID NO: 14235 - DNA, 72 bp, Homo sapiens
ttgcctttagcatgccccgtgctttttctcgttttctttttggtaaaaggctgacatgtattggttaataaa

SEQ ID NO: 14236 - DNA, 70 bp, Homo sapiens
ttcagtgaggtagtagtttgttaaacagagaaaataatgattatgtaacatgtcatgccttacttctata

SEQ ID NO: 14237 - DNA, 74 bp, Homo sapiens
caagtctttgctttgtagcttagctctgcgatgccagtcctttttttccgagagcaagtgagttggaaaggggc

SEQ ID NO: 14238 - DNA, 73 bp, Homo sapiens
attcttctagaatggatggaggtagaaatacttcccagctcattcaatgatgccagcactaatctattgccaa

SEQ ID NO: 14239 - DNA, 74 bp, Homo sapiens
gtatctatgaacactgcctgaagccccagagaaggaccctgagtatctatgaacactgcctggggccccacgca

SEQ ID NO: 14240 - DNA, 71 bp, Homo sapiens
tccgtccacagggatctgggacaatggctgaaagatcatggtgcttttagtcactagatagatggacggct

SEQ ID NO: 14241 - DNA, 70 bp, Homo sapiens
cagacctctttgtaaggaggcgatgcatgtttgcatacgttggattgtagtgggtactcaagggaccaga

SEQ ID NO: 14242 - DNA, 74 bp, Homo sapiens
ataatttcactgttttcagggaaaaaaggcttttcagctacattagagtatggccattttttttccacattagt

SEQ ID NO: 14243 - DNA, 74 bp, Homo sapiens
gggtgtcacacttgcctggattaaggggtatcctggattgaggggtaccgcacccggcccggacaccctagtcg

SEQ ID NO: 14244 - DNA, 74 bp, Homo sapiens
acgaaaggctttttcttgtcttcagatgaagccctgtcttgctgttttgatttgttggttgagccgttagttcc

SEQ ID NO: 14245 - DNA, 72 bp, Homo sapiens
aggggcgatgttgtctgaagccatggccattcccatggggatggccttcccaggtggccacccacgacggga

SEQ ID NO: 14246 - DNA, 71 bp, Homo sapiens
ccgactccccattggtcatggctgatttgctttatcctgcgaccccaaggggcaacgattacctgatttta

SEQ ID NO: 14247 - DNA, 73 bp, Homo sapiens
gcaggtgcagagtaccagttaagaccagttaggaggctgctgtagcctagctgagatagcggtgtcctaggca

SEQ ID NO: 14248 - DNA, 72 bp, Homo sapiens
ggaccagtggggctacttcgaggcccagcccgtgctggtggcgcgggcactcatggtcacctcgctggccgc

SEQ ID NO: 14249 - DNA, 73 bp, Homo sapiens
gctctgcagggcgcaggcgtcgcgtgtcgccgaggggcgcggcaggggccggcggctggggctccctcgcggg

SEQ ID NO: 14250 - DNA, 70 bp, Homo sapiens
aattgtttgtgtatttttagtagagacagggtttcgccaggttggcgagactggtctcgaactcttgacc

SEQ ID NO: 14251 - DNA, 73 bp, Homo sapiens
catccagggatgatgccacgtgagacattggaaacagaggtctggggctgaagggagggtccagcctgggggg

SEQ ID NO: 14252 - DNA, 73 bp, Homo sapiens
ctccctcctttgatttagctcatttctggaatggggcagattttcatctcagggagttgatacggtttcctag

SEQ ID NO: 14253 - DNA, 73 bp, Homo sapiens
ggacccagctctgtggggaaggcctggtaagctctggcctcacctggaactgggagggtccatagggataaag

SEQ ID NO: 14254 - DNA, 70 bp, Homo sapiens
caaatttggctcataggtcatagtttgctgacctttgctctaaaaatacgactcttaggccaaattcagc

SEQ ID NO: 14255 - DNA, 73 bp, Homo sapiens
ttaacagagaagcacagtcagatgtgccaatcccccaactgcccacctctgatgagccagctgtgagccgcaa

SEQ ID NO: 14256 - DNA, 70 bp, Homo sapiens
ctagaataaatgcaagtaattatgactgcattagtgcagcattaattaacattgctaattctttgtaatt

SEQ ID NO: 14257 - DNA, 74 bp, Homo sapiens
gatagaattatgggctgctgaggctaacgggtcagttggagggcaactgagcctccatttcctcccccagtttc

SEQ ID NO: 14258 - DNA, 72 bp, Homo sapiens
cgcctctgggaggagaggttagctctttcccagctatcacatgattgaaatgggaatgtctgttcctaggtt

SEQ ID NO: 14259 - DNA, 72 bp, Homo sapiens
aatggtgagtacattttctagcaagttccttgggactcctgaccaatgtcagcatgtccgcaatgccccatc

SEQ ID NO: 14260 - DNA, 74 bp, Homo sapiens
gagggccgaggggcccgactcttagcggttggatcagttggatcggttgatcagttgaatggcctcctctcttt

SEQ ID NO: 14261 - DNA, 72 bp, Homo sapiens
ggaggggtgtttgaccatgccctggagcagacccctagctgcagtctgcaatggccccagctcctgagccat

SEQ ID NO: 14262 - DNA, 72 bp, Homo sapiens
ctggcctccctcaggtcgaggagctcacagctcaggccctgacatgggtatttttctgcatttggaccctgc

SEQ ID NO: 14263 - DNA, 71 bp, Homo sapiens
tctggtccgtgcactgccagctcacttctctggctaaaacccgggggcggcgggggtgtgtgtgggggtta

SEQ ID NO: 14264 - DNA, 72 bp, Homo sapiens
gcatctgctcggcttctgctgagagctattgttgctgggtcaatacatggcgggaggccaaaggggaagcaa

SEQ ID NO: 14265 - DNA, 73 bp, Homo sapiens
ggcactctaggccatgaggacttgccaactcttggcaagtcctagtgttaaactaggtccagagacagtggat

SEQ ID NO: 14266 - DNA, 72 bp, Homo sapiens
tcagtggaaagatcgggtacaggaaggcatgcagttagcaccatctgatatggtttggttgtgtccccacct

SEQ ID NO: 14267 - DNA, 74 bp, Homo sapiens
ttcattagtcatacaaaggtggttttggtcccaagcaaaaagggcattagtctaagggagggactattattctt

SEQ ID NO: 14268 - DNA, 71 bp, Homo sapiens
taaatccccccgttcccccctcaaaaaaaaaaaatacttgagcaaattatttggagggatttggatggaaa

SEQ ID NO: 14269 - DNA, 71 bp, Homo sapiens
agtcagccttgagtcagacaccagcttctttgcttctcacacaataggtagctctacaggtggtcttctcg

SEQ ID NO: 14270 - DNA, 74 bp, Homo sapiens
cccatctggcctatcgataaaaggaaagctagaattcaacagaagacccctctccccatttgaggtccaatgga

SEQ ID NO: 14271 - DNA, 73 bp, Homo sapiens
ggatctgtgttctctagcagcaggtgcgtccacgccttcctgggtttggctagcatgctatgtttgattcata

SEQ ID NO: 14272 - DNA, 73 bp, Homo sapiens
acgccagtaccgtgctatttaggttactcccctacactaaactctgtagtataatttgaagtcaggtaatgtg

SEQ ID NO: 14273 - DNA, 72 bp, Homo sapiens
ggaaacgttgaccgcagggactctgggatcaggagtaccaggcaaagctggaagaggggatggggaattcca

SEQ ID NO: 14274 - DNA, 72 bp, Homo sapiens
gagtgaccctttccgcttggtagtgacaaaagtaatctgagtaaaggtcagctcagacacttaggatttaaa

SEQ ID NO: 14275 - DNA, 73 bp, Homo sapiens
aaaacctttgcagacttatttagacacttctgctgcactctgttcagtagcactggttttccttacagtctgc

SEQ ID NO: 14276 - DNA, 71 bp, Homo sapiens
cacttatgcccctcacaaaaaacaactgaaactcaattagagtgtcagagggaaagcattaaagtgtagca

SEQ ID NO: 14277 - DNA, 73 bp, Homo sapiens
gccctccgcccccggggcccgccaccgccggcccgcctgcgccgccttcgctttgacgttactgggggccggg

SEQ ID NO: 14278 - DNA, 72 bp, Homo sapiens
agttttagcatacacgtgcacaacgtgcaggttagttacatatgtatacctgggccatgttggtgtgctgca

SEQ ID NO: 14279 - DNA, 71 bp, Homo sapiens
aagcaccaggcatttggcttctctgggcttccaccagtacctcggacatctgttgacttagaaactttttc

SEQ ID NO: 14280 - DNA, 73 bp, Homo sapiens
ggctatgtgcaaatccatggttcagactccagactgtggaatcaaagtttctgggtatggagccaaggaatct

SEQ ID NO: 14281 - DNA, 73 bp, Homo sapiens
cacatcaacagtcattgcctggcccatagggacaccacctcaggtttccttatcgctgtgatggggactggga

SEQ ID NO: 14282 - DNA, 72 bp, Homo sapiens
cattccttctgaatcctgttagcagctggggctcttgctgtacaagaaaacaaggaccctctcctggcatcc

SEQ ID NO: 14283 - DNA, 73 bp, Homo sapiens
atgtatgtgagcatgtgtacatgtgtgtgcggtcgtgtgcaggctcgcacatgttcacgtgcacgtgtgaata

SEQ ID NO: 14284 - DNA, 73 bp, Homo sapiens
caccttgcgctgggctgtcagcatcataacccccagtggggtcatacagaggctctgagctcagagcagctcc

SEQ ID NO: 14285 - DNA, 74 bp, Homo sapiens
cttaaaaaggacgatgcattatttctaaccggggaatcaactcggaagttggggccagaagggaagcactttct

SEQ ID NO: 14286 - DNA, 71 bp, Homo sapiens
cctgccgcggcgcctcgcctcccggctcacctccccaccccacctgcccgctgcggctctccgcgggagat

SEQ ID NO: 14287 - DNA, 74 bp, Homo sapiens
gccctggggccggggcttcgagctggcccgggtctgcgcaagggcctgggcctgcccctctctccagtgcggcc

SEQ ID NO: 14288 - DNA, 70 bp, Homo sapiens
gtagttatagcagagctgggtttacgggaacttagttctcttcggcccacgcctcctcccctccccaggt

SEQ ID NO: 14289 - DNA, 74 bp, Homo sapiens
ggaactcaatagggtgggacccaagctgggtcccaggctggtttgggtttatgtttgggtccaatcagcagccc

SEQ ID NO: 14290 - DNA, 73 bp, Homo sapiens
gcatcgggtgccaggcccccccagtagcccggccggaagctgagtcggggggtggtcggccatgaatctttgc

SEQ ID NO: 14291 - DNA, 72 bp, Homo sapiens
tcccacccctgctcaaagccattggtccttagttgattggaccatggtgggcacttgacctggggcagccaa

SEQ ID NO: 14292 - DNA, 74 bp, Homo sapiens
gccagtcccgtgccgtgtgctcacactcctcagaccttgggtggtccatgggattggggcgccatggagcaggg

SEQ ID NO: 14293 - DNA, 71 bp, Homo sapiens
cccaggcctgggtggaggtggccgcagagggaacaagcagcctcctctgccctgcttctccctaggttgtt

SEQ ID NO: 14294 - DNA, 74 bp, Homo sapiens
gttccttccaaatatgtttggggacccactctgtgtctggctatagtgggtcctcaaacatggttggaaggaac

SEQ ID NO: 14295 - DNA, 74 bp, Homo sapiens
ttttcttatttcatctttccatgcctgtgtttgtgaatctgcacttctcaaccacagttgggttttgaaaggag

SEQ ID NO: 14296 - DNA, 72 bp, Homo sapiens
tctcaaactcctgagttcaaataatcctcctatcttggcttcccaaaatgctgggattacaggcatgagcca

SEQ ID NO: 14297 - DNA, 72 bp, Homo sapiens
attaagtgtgctgctgtcccattggccaaggcatgtcacatgggctagcttatactcacaaagaactttcca

SEQ ID NO: 14298 - DNA, 73 bp, Homo sapiens
aactaatatgcttgttcttgcccaagttcagaacctaccacagggtagaacaggagtcaggcaaatgaagagg

SEQ ID NO: 14299 - DNA, 73 bp, Homo sapiens
tagggtagcttatgtctgaagcaggcagctgggctgcaatggaaggacttagaatcagaagggctactttcaa

SEQ ID NO: 14300 - DNA, 73 bp, Homo sapiens
acagcaacggtgagctcttctacagcaacggtgagccggcgcctagcagccggcttccgggccgcacgcgctg

SEQ ID NO: 14301 - DNA, 74 bp, Homo sapiens
gctcctttgttggcttattatgtgcaactattggttgcattattttaataattgctttatggtctatagcatcc

SEQ ID NO: 14302 - DNA, 74 bp, Homo sapiens
gctgggcaggcagtggctcctcataggggtggttcccttccccctgcattgtgttggactgaaccttgtgtgtt

SEQ ID NO: 14303 - DNA, 73 bp, Homo sapiens
cctgcttaggggctggagtactgtcatgggcatgctaagtgacagaccattgctgccatccaggagttctcct

SEQ ID NO: 14304 - DNA, 72 bp, Homo sapiens
agagttatagaagggatgtcagtggcgctgagcagtagctttaagtcccagaaaagccttttcttactatgc

SEQ ID NO: 14305 - DNA, 70 bp, Homo sapiens
cgtccagatggaagaaactgaggcccaagggcaaagtgattagtccgaggtcacccagtgtctaggggca

SEQ ID NO: 14306 - DNA, 73 bp, Homo sapiens
cgtcagtttcttctcatgttgcccctggagctccaggagacactgtggcttatcagaagtcgtgagaacactc

SEQ ID NO: 14307 - DNA, 74 bp, Homo sapiens
gtgtgctcatgggtatccaggttcagggctatttgtgaaaacaccagctacatgtctgggccccataggtcagc

SEQ ID NO: 14308 - DNA, 71 bp, Homo sapiens
taattatccatgggcaggttgttcatattctaaaatgttttgtggatggccatatgtgtcacttaaggaat

SEQ ID NO: 14309 - DNA, 74 bp, Homo sapiens
ctcaggtgtgaagaaacagaggtgacaacagtgccactcaacgctggctgcacatttgactcacctgggagctt

SEQ ID NO: 14310 - DNA, 73 bp, Homo sapiens
taaatggcatggctttaccttatcatcacagcacactgagcgtgtgctcctgagagcagggcccctccacagt

SEQ ID NO: 14311 - DNA, 74 bp, Homo sapiens
aatattagcaatgtctgccatgcataacatgaggagctacagtggagccacctctgtgcaactgcactctcatt

SEQ ID NO: 14312 - DNA, 71 bp, Homo sapiens
tgctagctctcaaatgaaatgtcagggccatatgatagcagcatctgaggctaacccttcatgataccacc

SEQ ID NO: 14313 - DNA, 70 bp, Homo sapiens
tcgccatggctggctaatttttttgtctttttagtagagatggggttacactgttagccaggatggtctc

SEQ ID NO: 14314 - DNA, 70 bp, Homo sapiens
gaaaaggcagctgctatacaagctaagattttgatgttcgtaaaggtcacgcatgggctactgcatcagt

SEQ ID NO: 14315 - DNA, 70 bp, Homo sapiens
ttctatttcaacttatattgcttgtcatgtcttcagcgagcaagaaaatagctgtcttggaaaatttacc

SEQ ID NO: 14316 - DNA, 73 bp, Homo sapiens
ctcaccagatggctgccactccctaccacttagtctcagcatttctttacagtgttatgggggaggtggggaa

SEQ ID NO: 14317 - DNA, 70 bp, Homo sapiens
agtcaagcttctttatatatttggcaatgaatttggagattcttaagtcctccaaaggttagtatatgaa

SEQ ID NO: 14318 - DNA, 70 bp, Homo sapiens
gcttcttgttgggctgctctagtgttaggtgtatatatatttacaactgcggtatcctcttgctgaattt

SEQ ID NO: 14319 - DNA, 73 bp, Homo sapiens
cgaatgctttgttcagcagagcagggagggaaaaatagcttaagtctctgatgacattgttgaggaactaaac

SEQ ID NO: 14320 - DNA, 74 bp, Homo sapiens
ttcatttatggcttgattttatgacatttttataactgtgacaccctacatgggtcccaggaataaacagagct

SEQ ID NO: 14321 - DNA, 72 bp, Homo sapiens
gttcattttgagggagaaagagcaagtgcaaggaattcccatttttagcaccatgactaactaattcaaagc

SEQ ID NO: 14322 - DNA, 71 bp, Homo sapiens
aaaggtgatcatagtagcctggaatgatctttgtatttcagtgatgtcagttgcaatatctcctgtttcgt

SEQ ID NO: 14323 - DNA, 73 bp, Homo sapiens
ccaagggaagctgtgagggtctgagcctgaggaacatcggcacagatattgcacttgtcccacggtcttttca

SEQ ID NO: 14324 - DNA, 72 bp, Homo sapiens
atgcctgttactttgacagtagctcatgggccaaaacaagctacgaggctatgcctaagtccgaggggacaa

SEQ ID NO: 14325 - DNA, 74 bp, Homo sapiens
tcttatttggtaattgggtctttgcagatgctttatgatgcagaatataaagtatgaggccatgcaggattaca

SEQ ID NO: 14326 - DNA, 72 bp, Homo sapiens
gctctgtctaggcagcaggcaaggtgaacccactgggcagttacagtggcgtgggttcattttctagaccct

SEQ ID NO: 14327 - DNA, 74 bp, Homo sapiens
gaaaaatgaggttcagaaaggttaagtaaactgcacaagtttgcatagcttatcaagttgcaaaactaccattt

SEQ ID NO: 14328 - DNA, 73 bp, Homo sapiens
actcagctactacatgccatccacatagctccctggcatgtgtccatagatggctcacaatatagaagtttgg

SEQ ID NO: 14329 - DNA, 72 bp, Homo sapiens
tggtaaggaaggcagcagatattttgagagtaatgaactctaacatatgcaatatagcctagtccacatcca

SEQ ID NO: 14330 - DNA, 70 bp, Homo sapiens
actctatgttggactcttttttgccactcttttttggccatatctagcagaagagagggtactactccta

SEQ ID NO: 14331 - DNA, 73 bp, Homo sapiens
tctcagcccactcatttcacattggctcctaagtaccctagagccatgttggaaggaaaagtgttactagaag

SEQ ID NO: 14332 - DNA, 71 bp, Homo sapiens
ttcccagcagctaatgtcaccagctactgaaggtgaaaactgggacctgcagtttagagaagggaagtttg

SEQ ID NO: 14333 - DNA, 73 bp, Homo sapiens
ggggtggctggaagggtggggcctgaagtctcccaaaggctccctccttcacaagtctgatggtcaatgctgg

SEQ ID NO: 14334 - DNA, 74 bp, Homo sapiens
aggatatttctaggggtcatcaaaagggaggaaaccctccttctgccctatgaataactccccttaattttatc

SEQ ID NO: 14335 - DNA, 74 bp, Homo sapiens
agcatatactatggcatatagtgtggtctatagcatataggttacatagcataagatatgctatagcatatagc

SEQ ID NO: 14336 - DNA, 72 bp, Homo sapiens
agagaatcgcttaaacctgggaggcggaggttgcagtgagccgagatcgtgccattgaaatccagcttgggt

SEQ ID NO: 14337 - DNA, 73 bp, Homo sapiens
gctgctgccgccctggttcttctgattgcctgccatgctcagggtgcacttgctatgcagcctccagagcctt

SEQ ID NO: 14338 - DNA, 74 bp, Homo sapiens
taaaggctttcctgaactctgttcgtctttcccgtctctgattgtcccgcaacagcagaaaggaagacatttat

SEQ ID NO: 14339 - DNA, 70 bp, Homo sapiens
tctttgcagttcagcttgtccttagagaataaattccactgaggacgtacagtcaaaataacgtgagcta

SEQ ID NO: 14340 - DNA, 73 bp, Homo sapiens
ctccgtcctggctcatcccagtgggcggaggtcaggcaagttggtatcctgccccgcctgctggcggaggcag

SEQ ID NO: 14341 - DNA, 74 bp, Homo sapiens
tcccactgatagtatgccttgccttcacatccattctgtgcaatgttgccctggcatatggcttacctgtctgg

SEQ ID NO: 14342 - DNA, 72 bp, Homo sapiens
acttctggaaactgcctacatggtcacaggtgaatgtgaaggtgggttgtggaatatggaggtggggtgcca

SEQ ID NO: 14343 - DNA, 72 bp, Homo sapiens
gttagatgctagtgtttagaagatctgtgaagaaactaatatttttactcaactagtctccaggtatctaag

SEQ ID NO: 14344 - DNA, 72 bp, Homo sapiens
taatcagaaactggggacagaaagtttacagctcacccaagtaatccagcttactaggtgtcagtaccagta

SEQ ID NO: 14345 - DNA, 71 bp, Homo sapiens
tcagtcttactctgctcaatcgctagttgaaaaaatatcatatttgatgaggaggtggacgatggtgagga

SEQ ID NO: 14346 - DNA, 73 bp, Homo sapiens
gcatttaagggagaggttggagccaggtgagtaaatttgttagtcatctgcataaagaccagactggggggct

SEQ ID NO: 14347 - DNA, 72 bp, Homo sapiens
ggggctgttctgtttcctgggtaccacatggacctcagctggctgagggatggggtgggagaaaaaactgag

SEQ ID NO: 14348 - DNA, 73 bp, Homo sapiens
agatgtgggagttattgatcgggaacagggggtgaaaacccatatataggttagataggtgatacagatgcag

SEQ ID NO: 14349 - DNA, 71 bp, Homo sapiens
gatcacctggtccagggcttccagctgtgttcagcaggatggggtgggataggatcctcggagtgggatgg

SEQ ID NO: 14350 - DNA, 72 bp, Homo sapiens
atgactcaggctcagtcccctccatgatgggctccccacaagcatgtgggcagcccatgaggtcagtgtgct

SEQ ID NO: 14351 - DNA, 74 bp, Homo sapiens
tgtaaatatctggatattggcttcccatgaaaagtctaaaatcctgcatttctgcatgagaacagttgaccaga

SEQ ID NO: 14352 - DNA, 74 bp, Homo sapiens
cgagaaccatgttcatggtagagagttcatatctggccccatcctcctctggcaaggctcctggtgctcacagc

SEQ ID NO: 14353 - DNA, 72 bp, Homo sapiens
ggctcctctcgcccctggagccgcggtgtggacggcccggccccgtccgccccgccgctctgcgggagtgtc

SEQ ID NO: 14354 - DNA, 72 bp, Homo sapiens
tgggaggctgaggcaggaggataatttgagatgagcctgggcaatgtggtaggaccctgtctctacaaaaaa

SEQ ID NO: 14355 - DNA, 64 bp, Homo sapiens
tcctgtactgagctgccccgagctgggcagcatgaagggcctcggggcagctcagtacaggatg

SEQ ID NO: 14356 - DNA, 70 bp, Homo sapiens
aatgtcgccaaagttacttggctctggaattctgtggctattcacgtggactctggatggcggtcaccaa

SEQ ID NO: 14357 - DNA, 71 bp, Homo sapiens
aacagcttgatcacggggtgcgagaggtccatgatggcaacagaggaggataagccgcaatgttgtcctgt

SEQ ID NO: 14358 - DNA, 70 bp, Homo sapiens
atgttggccaggctggtctcgaactcctgaacttaggtgatccccgccggcgcgcccccccccccccccg

SEQ ID NO: 14359 - DNA, 73 bp, Homo sapiens
aaactcatcacaggtctgggcgtggggaaggactgggcaagttccaaaacaaatgcttcctccctgggcatgt

SEQ ID NO: 14360 - DNA, 73 bp, Homo sapiens
tatacaagttttcacaatgagaccagtcatggaggtggcaagctgagttgcgtggtcgacatttggagaaaga

SEQ ID NO: 14361 - DNA, 73 bp, Homo sapiens
ctccacaacctacacggtgaaaatggggtggactgctctggagcaggccagtgacatctggtgtgggctggga

SEQ ID NO: 14362 - DNA, 72 bp, Homo sapiens
gcctgtgtctctcgtggaaggacaccacaagtgaaaatggggccataaggtggtgtgggggggcctcaggga

SEQ ID NO: 14363 - DNA, 73 bp, Homo sapiens
ctgtttgcagcatacatgtcccaactatgcacttctggctggatttttcctgctttgtgtggaagcaatgaag

SEQ ID NO: 14364 - DNA, 72 bp, Homo sapiens
gtcctcctcaagaggaggggacaggctctgtttaattttctacacaggcccacctctctttcagacttgagg

SEQ ID NO: 14365 - DNA, 70 bp, Homo sapiens
ttctttgatgcctactttgttaagggtttttatcatacagggatgggctgatcagcagtttagtaaagtt

SEQ ID NO: 14366 - DNA, 73 bp, Homo sapiens
ctctttcgtttaattagatcctagttgtcaattttggctttcgttgccattgcttttggtgttttagacacga

SEQ ID NO: 14367 - DNA, 71 bp, Homo sapiens
gtgaaaacccgtaggcttagagggctctgtttgactggagaggctgccatggctgagcaccggggctgttg

SEQ ID NO: 14368 - DNA, 72 bp, Homo sapiens
aaggaacatcgactcatagtaaccctggcttgctgtccaagaaggcagaagccctgtgagagtctagaagag

SEQ ID NO: 14369 - DNA, 73 bp, Homo sapiens
aaacctcccacaactcttccactgctaaatttgactggctttacaaaaaggggtgcggggggcggatactgta

SEQ ID NO: 14370 - DNA, 71 bp, Homo sapiens
tgttgcagatacatttaggattgctatgtcttcatggtggattgatctttgtgtcattatgtaatgtgcct

SEQ ID NO: 14371 - DNA, 72 bp, Homo sapiens
atcacttcatcctctgatttcttggtttttttccttgggttgaagcttcgtaagagattataaagtggaggg

SEQ ID NO: 14372 - DNA, 72 bp, Homo sapiens
gtggttccagtctcaaagctgtgtgctcaaaaagttcatcattgctcacgagaatgcagtaagaagaaacat

SEQ ID NO: 14373 - DNA, 70 bp, Homo sapiens
agcacttgctctaacaggccacaactctgtcctttatggcggatggctcgagtggcggagtggatgttta

SEQ ID NO: 14374 - DNA, 73 bp, Homo sapiens
ggcccatatgagtaggggagctgggactggataccccactgttctccaatgccatcccacactggggcttctg

SEQ ID NO: 14375 - DNA, 73 bp, Homo sapiens
caaagtaacgcatggactggtggcaggaggagcctagcagcaaacagtggccatccaggcccccggaatgaag

SEQ ID NO: 14376 - DNA, 71 bp, Homo sapiens
attttctcttgctgctgccatataggaagtgcctttcacctcccaaagtgattctgaggcctccccagcca

SEQ ID NO: 14377 - DNA, 73 bp, Homo sapiens
agccttctgagtagctaggaatacagacacgcaccaccatgtctggctaattttttgtacttttagtagaggc

SEQ ID NO: 14378 - DNA, 73 bp, Homo sapiens
ggctgctcagatggcctccaggatgtcccctgcctcactgtgtgctgggacatcatgtctgcagcttcacaag

SEQ ID NO: 14379 - DNA, 73 bp, Homo sapiens
aagcatttgggctgaacctatgggattttctagatatagaatcatgtctgcaaacagaaatagtttggcttcc

SEQ ID NO: 14380 - DNA, 72 bp, Homo sapiens
caggctcctcctttgtataaggagcaaattcctgttgactccaccccacccttccagtgcacatgagggccc

SEQ ID NO: 14381 - DNA, 72 bp, Homo sapiens
acaagaactgctctgtccctgaagccctacaggctgaagctggacagcttgacgtaaatttcagcggcttgt

SEQ ID NO: 14382 - DNA, 71 bp, Homo sapiens
tataattcagcctttaaggagctcacagtctactgtaactgagtcttctcagagaaaggccagcattctgc

SEQ ID NO: 14383 - DNA, 72 bp, Homo sapiens
gtgagcggcaggtgatcatgctttacggtctgagctctgcctcccatcagatcatcagcagcatcacattct

SEQ ID NO: 14384 - DNA, 72 bp, Homo sapiens
cttaacctaataagagattataaaaatagggctgggtgtggtggctcatgcctgtaatctcagcactttggg

SEQ ID NO: 14385 - DNA, 74 bp, Homo sapiens
atctgcatttcagacaacctcagcggaatttatgttaaagtagaccctagtctgtgttgttactaggtgtctgg

SEQ ID NO: 14386 - DNA, 70 bp, Homo sapiens
tctgtcggtgatggctcaccttggatctctttcaggagatccacagttggccagtagaaagcacaccctg

SEQ ID NO: 14387 - DNA, 74 bp, Homo sapiens
cacccttgcccttcctgtaggtgcttccagtctggagctgaccgtgagctctgaactaggactcctcagtgggc

SEQ ID NO: 14388 - DNA, 70 bp, Homo sapiens
cctgtttcaatgttgcccctcacaaaaaacactgctctctacagcgagcagaggcagctttctaaaacat

SEQ ID NO: 14389 - DNA, 72 bp, Homo sapiens
tctttgtttccaccttctcctgcatccagtcagagctatatgcagcaaaaagaaaactcaggaaactcaccc

SEQ ID NO: 14390 - DNA, 72 bp, Homo sapiens
agcagggaaaataccacttgcacaaatgtatttctttgtcaaagtgtgtacacgctttctgtttgtcctgat

SEQ ID NO: 14391 - DNA, 71 bp, Homo sapiens
gccccttcttgtgcttaggaacattacacagcactccagaaggtttgggggccattttaaacaggaaaatc

SEQ ID NO: 14392 - DNA, 72 bp, Homo sapiens
gatttcttttttcttccatcaggatttttgtttcctttcagggcaagaatgcaagtgggagggcgggtgaac

SEQ ID NO: 14393 - DNA, 72 bp, Homo sapiens
gctactcgggaggctgaagtgggaagattgcttgaatccaggagatcgaggctgaagtgatctgagatcgca

SEQ ID NO: 14394 - DNA, 70 bp, Homo sapiens
ccacgcggccgccctcggggcccagcgcggccgcctgcggctcagccaggccgtgcaggaagccgccctc

SEQ ID NO: 14395 - DNA, 72 bp, Homo sapiens
ttagagtggccagatgacaggagtggtgttaagcatacattctcagcataccactgagtcagtcagacctca

SEQ ID NO: 14396 - DNA, 73 bp, Homo sapiens
gagtaaacatacattggatgacttgtggatagaagcaaacattctcatccttggtataaatcattggttttgc

SEQ ID NO: 14397 - DNA, 70 bp, Homo sapiens
tccataggtctacttgagtgtccttgtgacatggcagctggctttctccagaacaggtgattgagagaga

SEQ ID NO: 14398 - DNA, 74 bp, Homo sapiens
tcaaatttagctgagtgtccatattttatctggcacccctctttccaaccctagccaccctctgtggccctcag

SEQ ID NO: 14399 - DNA, 70 bp, Homo sapiens
agcatgccaggtttctgggttccctttccctgagtggtcctagcgaccctgctcgctgcaccatggccat

SEQ ID NO: 14400 - DNA, 72 bp, Homo sapiens
ctcggcaggccgagaggcgccgcagcgggagggtgagttccagcctccgctgcagcccctcgacgtcacgct

SEQ ID NO: 14401 - DNA, 70 bp, Homo sapiens
gcttgggtaatgtgactctgtcctgagagatgatcattttcccatttctgagtcctctggtggagagcca

SEQ ID NO: 14402 - DNA, 74 bp, Homo sapiens
tgtacttcaggagaaggttgcagtgagccaaggttgtgccactacactccaagtgggcaacaaagccgaccctg

SEQ ID NO: 14403 - DNA, 72 bp, Homo sapiens
tttaacttagcaaatggcctaaaaaggcgggagcccagccctgaaggggctgccatcctgggccttgcccca

SEQ ID NO: 14404 - DNA, 73 bp, Homo sapiens
tgcctcccatattctagaagatgtctgcacatagaatgtacagaaaaatgtctgtctttgcccatgatgggag

SEQ ID NO: 14405 - DNA, 73 bp, Homo sapiens
ttgctctgaaattgtttcctacatttttttgagagagaagcattgtctgaaactatctcaagcattttattct

SEQ ID NO: 14406 - DNA, 72 bp, Homo sapiens
actctgcctacgtggtgagagagtactaacgcgcttgcagaacactccagctcaccctcagctggcaatatt

SEQ ID NO: 14407 - DNA, 72 bp, Homo sapiens
cacagactgggtggttgagacaacagaaatgttttgtctcacagcgctggagactggaaatatgagataaag

SEQ ID NO: 14408 - DNA, 72 bp, Homo sapiens
tccaagaggggaactgacctgatgctgctggaatgctcctatatgaagtgtctggatactcctgtcgggagg

SEQ ID NO: 14409 - DNA, 74 bp, Homo sapiens
taaagagaataaacgtgagcaccttttgtttctcttctgtgatgaaaatgtttctgaagaggagataagacgta

SEQ ID NO: 14410 - DNA, 70 bp, Homo sapiens
atataaatttagtaacgtatttgactatctagatctttaaaatagtctagaaaattaaggcgttcctgga

SEQ ID NO: 14411 - DNA, 73 bp, Homo sapiens
gagtatgtctgtggttgagtggatggtttcacaaaatagtacccactgttatagccatatcccttattatcgc

SEQ ID NO: 14412 - DNA, 70 bp, Homo sapiens
gataagaaagtggcagatgttgttatattgcttgactgggccagaacatgctcttcacgctttccatatg

SEQ ID NO: 14413 - DNA, 70 bp, Homo sapiens
tttgcatcgatattgacaagtaattttgacctgtgatttttctttcttttaatgttcttgtcatttgata

SEQ ID NO: 14414 - DNA, 72 bp, Homo sapiens
cctcatctgaaacctgggaatgataacggcagtcaccatatcaagggatcaactgttgtattcacagattat

SEQ ID NO: 14415 - DNA, 74 bp, Homo sapiens
tctacaagtatttgagtttatggatgtatcataatttggcaccccaagtctgatgccatcttcagtgaaattca

SEQ ID NO: 14416 - DNA, 74 bp, Homo sapiens
agttgtgatgttgcccagggttttgttttgtttttttccctttaaggaaaagaatgtcagtggtgtatatcaga

SEQ ID NO: 14417 - DNA, 70 bp, Homo sapiens
ttgggccacactgcagcagctcccgtttaacctgtaaatccgcaggctcatcagacgtgttccatccaat

SEQ ID NO: 14418 - DNA, 74 bp, Homo sapiens
gctgagggtcctgtgatgctcacgatgctgggctgtgtttctctcagcagcattgtatgaaagccagcttcctc

SEQ ID NO: 14419 - DNA, 72 bp, Homo sapiens
cttctaagcaggtggactcagttgtgacttatggggtgttatcttagggacgactacaaatctccacctctt

SEQ ID NO: 14420 - DNA, 74 bp, Homo sapiens
acaaagccacagtgagttgcagatgctgggcattcctcttcaggctgagttaactggtttgctcctgcacagct

SEQ ID NO: 14421 - DNA, 72 bp, Homo sapiens
gctttccccatcaggtgtcagtgaaagtttatggggaacctggacttctctacccaattggcagtaatgagg

SEQ ID NO: 14422 - DNA, 74 bp, Homo sapiens
ctcccttcagatggttcaaattctgttctcccagcctagctcttctcctgggcaccacgtctgcatttgcaacc

SEQ ID NO: 14423 - DNA, 73 bp, Homo sapiens
taaagagtgtttcagacaataccatctgactaattggctggagttcttggttatatgtctaacatgttttatg

SEQ ID NO: 14424 - DNA, 72 bp, Homo sapiens
ttccttctcacgttctgagtcaaatctgaaccaaaattcacatttggtctcgtgaccatgatagatagaaga

SEQ ID NO: 14425 - DNA, 71 bp, Homo sapiens
cacaacctgacaaaattcatccttgaggttgccagaaaaaaagtcactggctgctcaaaaaattgaagcag

SEQ ID NO: 14426 - DNA, 73 bp, Homo sapiens
ggcttttgttgggtatatgttacaagtaaattacatatgtaatatatactgttaatattttatcccagtccgc

SEQ ID NO: 14427 - DNA, 70 bp, Homo sapiens
aatgccctctgcccaccaacattgggctagcaaattggctcagttcagcagaagtaccagtgaggggcac

SEQ ID NO: 14428 - DNA, 74 bp, Homo sapiens
atgctctccccttatggaaggtttggaagcctgggagctacattgtctgcaaggttccaggttagattctgcca

SEQ ID NO: 14429 - DNA, 72 bp, Homo sapiens
tgctaatgtggaagccactagaactggtttataagagaattaagccctaaagccctaaggaatccattggat

SEQ ID NO: 14430 - DNA, 71 bp, Homo sapiens
gcaagtgaagtatacctccaccataaatgaagtaggtattggtctccgggtatactctgatgcaaagcctc

SEQ ID NO: 14431 - DNA, 72 bp, Homo sapiens
gtccatggcaggcagagcctagttttagaccactatcgggttccaaagcttatcctctcagctgtgatggtt

SEQ ID NO: 14432 - DNA, 70 bp, Homo sapiens
gtgcgttcggctccgcgcccgccgcgccgggagcagcaccgcggggccaggtaggtgcggggccggcggg

SEQ ID NO: 14433 - DNA, 74 bp, Homo sapiens
aaaagaacagaaagcttgtcagagttgtatttaaaataacagtaaatacactgcttcacttgactagcctaaaa

SEQ ID NO: 14434 - DNA, 72 bp, Homo sapiens
caagactctttttgggccaccaactgtgtgtccagccgcactgtttggcctgagagtacctaccaactccac

SEQ ID NO: 14435 - DNA, 74 bp, Homo sapiens
atacacttgcaagatggttaactctcatgtctagtgaattggtggttactgttggctgagagtttattcaaggc

SEQ ID NO: 14436 - DNA, 70 bp, Homo sapiens
tttcacggctgagtttgattttgggtgtagtgttgaccacttgtgcctgtgattaaaactatagcatgtt

SEQ ID NO: 14437 - DNA, 73 bp, Homo sapiens
ctgccttgagcactctgtaggtgggaagcagcataactgatttccacttttcattccctcatcccactgctca

SEQ ID NO: 14438 - DNA, 73 bp, Homo sapiens
cacctgctgcccttccgcgcatacctggctgaccagttcgggtattcctaaggctctatcaatctcctccagg

SEQ ID NO: 14439 - DNA, 71 bp, Homo sapiens
tagtggctcctgttgtgtgattccatttatgtgaaatgtccagaatgggcaaatccatacaaaacaaaagt

SEQ ID NO: 14440 - DNA, 72 bp, Homo sapiens
cccttggagagggaatagctgatgtcttcatggggtttctggccctttttagaccctctccttaatatttaa

SEQ ID NO: 14441 - DNA, 73 bp, Homo sapiens
tttctatacttattgctgtgatgatgaacatgtgtacattaggaattattccagaagtgtggttactaagtcc

SEQ ID NO: 14442 - DNA, 73 bp, Homo sapiens
tgaggtccacagcatgtaggcagtgtatctcttgctagcaccatttctggctgagtggctgttcacaggtaga

SEQ ID NO: 14443 - DNA, 73 bp, Homo sapiens
gagtttgtaggcagatttcttgtctatacatacagacataatttgaagcaaatttaaataatatgttggatac

SEQ ID NO: 14444 - DNA, 73 bp, Homo sapiens
tcttctccccggcaaagaacaccccaatggctcttaagataaagcccagaatcccaaatagggtgttctctgt

SEQ ID NO: 14445 - DNA, 73 bp, Homo sapiens
gaaggctgaggctggaggatcgcttaaacctgggaggcagaggttgcagtgagccaagacggcaccactgccc

SEQ ID NO: 14446 - DNA, 72 bp, Homo sapiens
ccctgagcgggtgaggttggcggtccgtgctgaccgctcccgggattggtttcacgtggagtcgtatttcgc

SEQ ID NO: 14447 - DNA, 72 bp, Homo sapiens
tgaggagtaaatgagataatacgtataacaggaattgagtgcttggcacttagcaagcattcaacaaatgtt

SEQ ID NO: 14448 - DNA, 73 bp, Homo sapiens
tgcttgagcccaggaggtcaaggctgtagtgagctgggatcgtgtcactgcagcacttctacctgggtgcctg

SEQ ID NO: 14449 - DNA, 73 bp, Homo sapiens
ttgaggttgccttatttgggctaaatctagttggtgttctataaccttcttgtacttgaatattggttctttc

SEQ ID NO: 14450 - DNA, 73 bp, Homo sapiens
atacctcagtcgacctgggatgggtgacaatacttgtaattttaaatatgtatcccgaggttctaaatcgtgt

SEQ ID NO: 14451 - DNA, 72 bp, Homo sapiens
ggcaacaaggtagagagccgcggccagaagcagccccgggccataaacccgaggcctggatggcttaaggct

SEQ ID NO: 14452 - DNA, 70 bp, Homo sapiens
cagcatctttttatcttttgtaggggcttccaatgatggcagtcatctccatcatccaatgcatccacat

SEQ ID NO: 14453 - DNA, 72 bp, Homo sapiens
tttcagtgttttttacaaagtgaccttgcagtttatgaggactgctgggtctgtgtccttcctgcagtttcg

SEQ ID NO: 14454 - DNA, 72 bp, Homo sapiens
caagctgccaagtgatgctggtgatcagtggtccacactgtgaggagtaaggtgtagttagaaaagtgacta

SEQ ID NO: 14455 - DNA, 72 bp, Homo sapiens
ccttattacagtaatccagtcacttgtgccttccggaattcttggggtattgtgttactgaagtgatcttaa

SEQ ID NO: 14456 - DNA, 74 bp, Homo sapiens
gatcagttttacattaactgttgcccaaatttccaactatgagctaaattcatggatattttaagacagttaat

SEQ ID NO: 14457 - DNA, 72 bp, Homo sapiens
tatgtgcgttttctgatactatatgataaaatatagtttaccaggagatttaagtcagcatataagttgagt

SEQ ID NO: 14458 - DNA, 73 bp, Homo sapiens
ctcatcatatacgagaaggtgctccttctctccattgcttcctatgatgtgtcaagcccttaccatgtacttt

SEQ ID NO: 14459 - DNA, 70 bp, Homo sapiens
gaatttgtaacagatgtcccgtatcttctcagaggaagatgcagagtcatctcttaaggtaggtggtgtc

SEQ ID NO: 14460 - DNA, 74 bp, Homo sapiens
tgtgtctgtgtttatctcttatatagtgcatacagtgtgaacaagtgagtgtgtgtgtgtgagtgtgaacaatc

SEQ ID NO: 14461 - DNA, 73 bp, Homo sapiens
gactgccattagttgaaatcctgcaaaagtgagtgaccctgtaggcagacatgatatcaggcattttagcccc

SEQ ID NO: 14462 - DNA, 70 bp, Homo sapiens
aagcattcctaatcacaggatgctataggataaaaataaaattctgtacagcattttatgcttaaatggt

SEQ ID NO: 14463 - DNA, 73 bp, Homo sapiens
ttcagcctttttctccccatctttgaggatttatctagctttggtctgtgatgttgatgacctttggatgggg

SEQ ID NO: 14464 - DNA, 72 bp, Homo sapiens
ctgagaacttaccattggatctagcaccatggagatcattggtaacctgacaagaatagtgtagatccagtg

SEQ ID NO: 14465 - DNA, 73 bp, Homo sapiens
tgaggttcagagggtaaaggtgtgatgataagctcaaggtcacacagctagtaaagagtgacttgaacccagg

SEQ ID NO: 14466 - DNA, 72 bp, Homo sapiens
ctatttataagaaaggattttgtagtggctttcaagctcaaggttgaacatggtcactgttggaatctagac

SEQ ID NO: 14467 - DNA, 71 bp, Homo sapiens
cttgttaagcccaaagaattgctttatagcattgattagtttggatgccttgtaatgcactggtaaaacat

SEQ ID NO: 14468 - DNA, 73 bp, Homo sapiens
tgagccactgctccaagcctcacacttacttctggaagttgaagtgcaatcatgagcttagatttgtggttta

SEQ ID NO: 14469 - DNA, 72 bp, Homo sapiens
agacaggaactggggagggaaggcttccctgaggaagcgacttttcaactgcatgttcatttgttaggggcc

SEQ ID NO: 14470 - DNA, 72 bp, Homo sapiens
agctactcaagaggctgaggttgcttgagtccaggagttctgggctctagtgcgctatcccaatcgggtgtc

SEQ ID NO: 14471 - DNA, 72 bp, Homo sapiens
gctttggttcagatgggatctccacagagaggactttcctgctgtcttagatagtccatgccatgttcacat

SEQ ID NO: 14472 - DNA, 71 bp, Homo sapiens
tgctctggagtgaggcagtgcaatgatagttcactgcagcctacaactcttgggctcaagcgatcctcccg

SEQ ID NO: 14473 - DNA, 72 bp, Homo sapiens
aaggggtcagggagggctccctgggacggtatgggcaggagatgctgtactcccagaccctaccccacatag

SEQ ID NO: 14474 - DNA, 70 bp, Homo sapiens
agtacataactagtaatggcctcgaagaacatacatatcagttgttcatggaggacatctatgcatgaaa

SEQ ID NO: 14475 - DNA, 71 bp, Homo sapiens
gatgagttacattgactgacctatgaatgtttgatcagcattctttgttggaatgaaatccatgtagtcat

SEQ ID NO: 14476 - DNA, 74 bp, Homo sapiens
gacatgctaagtgctatacattatatattggctgcattattgcacacactttataagtaagaaaacatgtcaga

SEQ ID NO: 14477 - DNA, 73 bp, Homo sapiens
ttcatcatgtgacattttagaagaaaaaaagtaagctgggtgcagtagcttatgtctgtaataccagcacttt

SEQ ID NO: 14478 - DNA, 71 bp, Homo sapiens
atcagattgtagatacacattgacagtttaactggtggggtttgctgatgattgagtttatggtatgagag

SEQ ID NO: 14479 - DNA, 72 bp, Homo sapiens
aagatgtccagttttcccagcaacacttatcgaagtgattttcctttccccattgtgtgttcttgggacact

SEQ ID NO: 14480 - DNA, 73 bp, Homo sapiens
gtgatgtctgcaggttagcacctatgctttatgacatgcaaagaggcactgtttatggccaacaaggaacaag

SEQ ID NO: 14481 - DNA, 70 bp, Homo sapiens
ttccctttagctaagcacagatctaccttggtgatttggaccctggttgctttgtgtctagttttctaga

SEQ ID NO: 14482 - DNA, 70 bp, Homo sapiens
taatgcaaggtctcacaatcactgcactgtacctctcccaagtgcagtgatgccacgtgaccgctgcagg

SEQ ID NO: 14483 - DNA, 72 bp, Homo sapiens
aataagctcgttggtttcatgtttctcctttgccaacatgaaggctggtaaaatagcgtacttgtcaaagtg

SEQ ID NO: 14484 - DNA, 72 bp, Homo sapiens
acttttagcaccatttgatgctttgcaaaatattatggttcaccttgttggcattggtcaggccatgtgggt

SEQ ID NO: 14485 - DNA, 72 bp, Homo sapiens
taatatgtaggtgatgggatgatgggcacatatgtgcatggcacagatttacttatgtaacaaaccttcaca

SEQ ID NO: 14486 - DNA, 73 bp, Homo sapiens
tataaacacaatttcaacagtgggtgacaatattttgttgctccacactggaaaacataatcttgtgtaccaa

SEQ ID NO: 14487 - DNA, 73 bp, Homo sapiens
agattatctacatgtttacactgtgttggggtaaagtattagtgaaatacgtgatgcagatgtagagacagtc

SEQ ID NO: 14488 - DNA, 73 bp, Homo sapiens
ggcagatgccatcttgcagcccagccagaatggagaaaaaggttaatgcatacagggcatccccactctgtga

SEQ ID NO: 14489 - DNA, 71 bp, Homo sapiens
ttgctacattaaaataaggattggctagagacttcaaactgtaaaagtctgttttcatgtctttattatgt

SEQ ID NO: 14490 - DNA, 71 bp, Homo sapiens
attcttgccaattgaatattaatggaaatgatgtatctcatttctatgccaggatttataagaagcagata

SEQ ID NO: 14491 - DNA, 73 bp, Homo sapiens
tattaacatctgagaagccccacatcagttgtatctgcagtgggcagcagcattgggtgaggctattccaggt

SEQ ID NO: 14492 - DNA, 73 bp, Homo sapiens
tgtgtttaaatcttactgtggccgctgctcagtatttcatcatgggcaagtctcctcattgatctgagatttg

SEQ ID NO: 14493 - DNA, 73 bp, Homo sapiens
atatatatatatgcagatatttcctgctaaggcaatcttgattttctgtccttagggaatatttattagcaat

SEQ ID NO: 14494 - DNA, 72 bp, Homo sapiens
tcttcatctgttaagtgaggataatagctgatatcttataattagtgcttaccatttaacagattctgcacc

SEQ ID NO: 14495 - DNA, 71 bp, Homo sapiens
ttcagtaatactgctcatgctctaccaggccagcagcttctgggagatgtggggggagtctgattggaccc

SEQ ID NO: 14496 - DNA, 74 bp, Homo sapiens
ctttctccatgcactagtaagctccctttgaagtcagtattactatacttgaatcagcagtacaggacatggag

SEQ ID NO: 14497 - DNA, 74 bp, Homo sapiens
gaagtcttgactgcatagtctgactgacagatagctcttggtggttggaagactagtgattgaatgtagcatgg

SEQ ID NO: 14498 - DNA, 73 bp, Homo sapiens
tgcatagcagtgcacaagactgtggggtccctgtacttgtgggccttccagttttggatcaggctttctattc

SEQ ID NO: 14499 - DNA, 73 bp, Homo sapiens
ccagagaggcatttatgtgcaaatccatgaaaagctctgctattgtaggtgcattgaatgaagaacactgggc

SEQ ID NO: 14500 - DNA, 71 bp, Homo sapiens
tgcatgccaggaaatgtgctttctaaaatcaagggctgtggatagggccagtgaccagaagaaccctggta

SEQ ID NO: 14501 - DNA, 71 bp, Homo sapiens
cactttaggctgccctcctgggactggcttctctgctgagtcacttagcaggtgctgggcgttggcagcaa

SEQ ID NO: 14502 - DNA, 71 bp, Homo sapiens
acacttgtgcaagtgcttgagtagtgtgtgacgggcatacttagctcagtgcagatgtcttggaaatagta

SEQ ID NO: 14503 - DNA, 72 bp, Homo sapiens
acaagcgtgatgtgctctaggcgactcagtagcccagttggcctgaaacctggggctccagatcccagctca

SEQ ID NO: 14504 - DNA, 73 bp, Homo sapiens
tggccagtagccagcagcgacctggggcctgccaactaccatgtgagtgagctggggttaaaggctgaatcct

SEQ ID NO: 14505 - DNA, 71 bp, Homo sapiens
acctgactctggttggggaaaagtgttagaccttgccactttctgaaatttcggttgggaattaaaacaca

SEQ ID NO: 14506 - DNA, 73 bp, Homo sapiens
tcctcaggcaagatgctggtatcatcagtggtggagcccactatttaatgagtcagttatccagcagctcacc

SEQ ID NO: 14507 - DNA, 74 bp, Homo sapiens
gtgaagtccagaatttggctcctaatgtcatcaagagtgacacatgttattgatggcactggttcctggaatct

SEQ ID NO: 14508 - DNA, 71 bp, Homo sapiens
gttttctcccactttcctatgttctctattttgtaagcagctcctacactgagagggaaggaacatatttt

SEQ ID NO: 14509 - DNA, 74 bp, Homo sapiens
ggcagcctctgtaagagccttgaagaatgtcaagtagaacttgaagaggtcatggaggtcattagggaagtggt

SEQ ID NO: 14510 - DNA, 73 bp, Homo sapiens
caaactcagtgcactacagattacgtggctttagcaaatctccttggaaattaagagtcatgtataaaactgc

SEQ ID NO: 14511 - DNA, 70 bp, Homo sapiens
ctcaggacagggctccagcatcagaggctactgtgctgcctcctgtgcgggactctccttaccctgcaca

SEQ ID NO: 14512 - DNA, 74 bp, Homo sapiens
gtgagggagagtataccttttgttttgtactttactatatgttattgtatacctgtcttcctttactaggttct

SEQ ID NO: 14513 - DNA, 72 bp, Homo sapiens
gctggctcagatgccgataggaagtttctagctagagcagctgtcttcaagtaagaactgaaagccacatgt

SEQ ID NO: 14514 - DNA, 73 bp, Homo sapiens
ctggccgtgagctcctgggctcaatgatcctccagccttggcctcccaagtgctgggattacaggtgtgaggc

SEQ ID NO: 14515 - DNA, 71 bp, Homo sapiens
caggcttaccctagacccactgaatcaggacctctggaactggggcccaggaatgtgggttttcccaagcc

SEQ ID NO: 14516 - DNA, 70 bp, Homo sapiens
tatcaactgaagtaaatcccacgaagtcacaaagaacagtgatctccaggaaaggctttttgctttaaaa

SEQ ID NO: 14517 - DNA, 74 bp, Homo sapiens
tttaaggttggctgtgacatgatgagatttcactctgacagcagtgtggggttggagatggggggtgaggaagc

SEQ ID NO: 14518 - DNA, 71 bp, Homo sapiens
tctggactgtgccatctagatctagacagatctagatgtgtctagatccatcatgcacttactgacccatg

SEQ ID NO: 14519 - DNA, 73 bp, Homo sapiens
tgtggtagccataggaccccagtgtgcgatgactggattgggtttgcttcagatgggatcaggtggagttgct

SEQ ID NO: 14520 - DNA, 73 bp, Homo sapiens
tgaatagcagcattgtcacttcagtgtcatttgtggcattcctgaatttgtgtgtgaaaatgcttaccattat

SEQ ID NO: 14521 - DNA, 73 bp, Homo sapiens
tgaattttaatagggtatgtgccattagggcttcttgcactaaaggatgaacatgtactggtttatgtgagca

SEQ ID NO: 14522 - DNA, 70 bp, Homo sapiens
ttggacaattgtcttatatgttggtggttatggtgaacagccatcatattccagaagtcccaaagatgta

SEQ ID NO: 14523 - DNA, 72 bp, Homo sapiens
gataaggtaatgaaatgatacatgtagtggttaagagcagcaccacagagccagactgcatgggttccaacc

SEQ ID NO: 14524 - DNA, 70 bp, Homo sapiens
cacccaatcccaaaaaaaatctgtgggcatggtgactcccacctataatcccagctactcgggaggccaa

SEQ ID NO: 14525 - DNA, 72 bp, Homo sapiens
gtgatacaagctggggaagagagtgaggaaagccacactggatacttaaccacctcagccagaaagtgacac

SEQ ID NO: 14526 - DNA, 73 bp, Homo sapiens
tggcaggatctgaaacaaggccaggccccattatagggcaattacccttcaggctgattggtgcagagacgct

SEQ ID NO: 14527 - DNA, 73 bp, Homo sapiens
gaaaaggcaaccacagcttctgaaagtgtccttagggaacctcactattaggagccaggtctatccaagtcag

SEQ ID NO: 14528 - DNA, 71 bp, Homo sapiens
aacagctgtagactaagttctgttttagagagggaagtgtaaaacacgaatcagacgtgcggttgagatac

SEQ ID NO: 14529 - DNA, 74 bp, Homo sapiens
gagtattttcttttatgcaaataccctgtttcatacaaataatgaaaaccattgtattttatgaaaggagtctt

SEQ ID NO: 14530 - DNA, 72 bp, Homo sapiens
ccagtatcccacagtcttgatcatcgtagctatataatatgttctgaaatcagctagactgatggcttccat

SEQ ID NO: 14531 - DNA, 71 bp, Homo sapiens
ccaaagccagtgagggcttgtgggtcatcttgcacctttgcaaacgaggaattcccctctgtgccctgata

SEQ ID NO: 14532 - DNA, 70 bp, Homo sapiens
gccttttctcaacatgcactcctctttgaagggcagactagcagcagtgtttcaaagtgcacgtttgatt

SEQ ID NO: 14533 - DNA, 74 bp, Homo sapiens
gacattaatgttttgtctttatgacaccaacttttcagtagagaaaagatgaggttgtggtctggaattagaac

SEQ ID NO: 14534 - DNA, 70 bp, Homo sapiens
cttgaacccctggaaagggcccagctaatgttgctaggagagtgaagacaaagttctccagggaatgatg

SEQ ID NO: 14535 - DNA, 74 bp, Homo sapiens
catatcttccagttcagagtctaaaaaaagttggcgtttccgactcagcaggacactgaatttctggactgtat

SEQ ID NO: 14536 - DNA, 73 bp, Homo sapiens
tgtggtggcttatgtctgtgatcccagtactttgagaggccagggtgggagaatcacttgaggccaggagctt

SEQ ID NO: 14537 - DNA, 71 bp, Homo sapiens
ttcccacagtggagaagtcttccagtccgtgcatggatgatgccaccactggctaaatgtcctcttctcca

SEQ ID NO: 14538 - DNA, 70 bp, Homo sapiens
ctgggccttggtttcttgtctgtaggatgaagacactagaacttaaccttaccaggccttgaaagtgcct

SEQ ID NO: 14539 - DNA, 72 bp, Homo sapiens
tataatctcttttcctcctcctcctccttccccttcccacacacacagaagggggaaaaaagtacagagaca

SEQ ID NO: 14540 - DNA, 71 bp, Homo sapiens
tcctgggttgaatgccagctacaccacctactaggtttgtaaccttggcaagtcatttcagttccccatgt

SEQ ID NO: 14541 - DNA, 72 bp, Homo sapiens
agagttgcctggtacttctgagacggctgcgtaagtgatctgactcagcaggaaggtcttctctttgccttt

SEQ ID NO: 14542 - DNA, 71 bp, Homo sapiens
ttcttatgcagcactcatataggtatcctggtctgcagaagaaggagaaggtggggaaggtgcatctgcat

SEQ ID NO: 14543 - DNA, 72 bp, Homo sapiens
gaacagaacaaagacccataaagataaaatgtagtgactgcaagtggtttatgggtaggagttggataggga

SEQ ID NO: 14544 - DNA, 70 bp, Homo sapiens
ctgggattatgggcctgaaccaccacgcccagccagcattggtggttcagtggttttgtatcttcttacc

SEQ ID NO: 14545 - DNA, 74 bp, Homo sapiens
tgtggtgcgagtgtgtcttagctttccctacttgttttgatgcaggtattttcttagatatttagcttctacaa

SEQ ID NO: 14546 - DNA, 74 bp, Homo sapiens
aaaagagctggtggtgaaaatattttgtatcttgattcgggtgggagttataggttatatacatttgtcaaagc

SEQ ID NO: 14547 - DNA, 74 bp, Homo sapiens
tccccgctcgagcatcccaatggccacccgctttcaaattggctaagtggctcggagaggcgccaggcacaggg

SEQ ID NO: 14548 - DNA, 73 bp, Homo sapiens
acgttatacaacatgttatgcacgactcattatatgcataactcattagataatgttaccataagatttgagg

SEQ ID NO: 14549 - DNA, 72 bp, Homo sapiens
ctaatttataaaagaagggcatatcttcacctactcagaatttacaatgggatatgccctacagtataaaaa

SEQ ID NO: 14550 - DNA, 71 bp, Homo sapiens
ttcctcagcttttgatgccatcaacttggtcaaggccatgaagtttggctgtggaatgtgtgccatgaagt

SEQ ID NO: 14551 - DNA, 71 bp, Homo sapiens
atctgtcttaataaggcactacttctcatgggggagagcaccatttgaggctgcccattgtcaagtatgct

SEQ ID NO: 14552 - DNA, 72 bp, Homo sapiens
ctctaaatcatgtttgagcatgcagtggggctggcagtttgcttatttgccctagatgatatgttaataacg

SEQ ID NO: 14553 - DNA, 73 bp, Homo sapiens
ctctggcttagcacctccaggatagggaatgggtttaggttcttagggtctggcatatactaggttcctggag

SEQ ID NO: 14554 - DNA, 73 bp, Homo sapiens
tttgacaagatccgttgctatggtgatggtctgctcggccctggcggagcgccttcaggtggcttcagttttg

SEQ ID NO: 14555 - DNA, 74 bp, Homo sapiens
tccctcatcttccagcagaggtcctacagtgcagaaagagtctgtgcacctggaggagggagagtacagagagg

SEQ ID NO: 14556 - DNA, 71 bp, Homo sapiens
atcaccggttaacaggactattagtccagcctttctggactaatagctactggggtatttatgggtatgaa

SEQ ID NO: 14557 - DNA, 71 bp, Homo sapiens
cagtctagttcctgtgggcagggaatcttatgaggatttctctctctctctttctctccctgtgtcacaca

SEQ ID NO: 14558 - DNA, 70 bp, Homo sapiens
ttatttagcttctcagtgactgcaactttattctttggtgtcttgcccctgtgagaatagctaagaatgg

SEQ ID NO: 14559 - DNA, 73 bp, Homo sapiens
aaatagtcaaaaaacagcaggtgctagtgaggctgcagagaaaagggaatgcttatacactgttgtttggaat

SEQ ID NO: 14560 - DNA, 74 bp, Homo sapiens
ttccatccctgttcgggcgccactatgtaacccgcacagacctagggggattaaacaaagggggcaaacacgga

SEQ ID NO: 14561 - DNA, 71 bp, Homo sapiens
caactgagcttatcactggtattttcctgcaattctgcaaattcttgattacctgaaagttagtgaaggct

SEQ ID NO: 14562 - DNA, 72 bp, Homo sapiens
taccttgtctgtggtgtggatatttttatatgtactatactacatgcccctaaatatacttattttttaaat

SEQ ID NO: 14563 - DNA, 70 bp, Homo sapiens
tattgtgtgggaaggcaaaggcatcactagtggtttacaaagtgatgtaaatattaccctaaatatgaaa

SEQ ID NO: 14564 - DNA, 72 bp, Homo sapiens
gaatgataggacacacagctggagtccactggagaatctggtgtcagaagtgctgtgttcagtggttatgtg

SEQ ID NO: 14565 - DNA, 73 bp, Homo sapiens
acccactttggcatggtgtgtcaagcacccagggcataaggaaagaacagcaggctggagtgaatggttacac

SEQ ID NO: 14566 - DNA, 72 bp, Homo sapiens
cctcatggaagaaaagtccagtgcctttgaagtgtttataattttgaggggaagtaaggtaaatatacatga

SEQ ID NO: 14567 - DNA, 72 bp, Homo sapiens
gcacacatttagatttcatgataaggcaggtacggctatatggactgctgtttgttttgactttgcaaagtg

SEQ ID NO: 14568 - DNA, 73 bp, Homo sapiens
actgcctattgaggtgcacactgagaatggaggaaggattttatgcaaagtgccctttgaaggctttcatagt

SEQ ID NO: 14569 - DNA, 74 bp, Homo sapiens
aggcttatttctgggcccttttagaatcagttaaattcacttctcttgactatctagaaccagaagaaaatctc

SEQ ID NO: 14570 - DNA, 73 bp, Homo sapiens
aatagctttgtccaaaatggcaatggtaatatggacaatattaggtccaggttgacgtggtctcagatgcaga

SEQ ID NO: 14571 - DNA, 70 bp, Homo sapiens
cctcacctagcactgggcctggcagtacaattgggtggctcagttcagcatttcagtttccagaccatgc

SEQ ID NO: 14572 - DNA, 74 bp, Homo sapiens
aatcacagaacagtctatatcacagtctccgtgatgtttttatattcataagacatttatggactactctgttc

SEQ ID NO: 14573 - DNA, 70 bp, Homo sapiens
cacacaaagcacttgcggttttaagcatatttttaaaaacacacattgctttgggaccgctgtgccataa

SEQ ID NO: 14574 - DNA, 72 bp, Homo sapiens
atctttctacctttttctccattaattgccaaaggtggagaagaatatagactgagtatgaagcaccttgtc

SEQ ID NO: 14575 - DNA, 72 bp, Homo sapiens
ccacttgaatgattattttcagtccttgtatctgggatttcacttcctgagtattccagtctcttgagcttc

SEQ ID NO: 14576 - DNA, 74 bp, Homo sapiens
gttctaatgatggtggctcccaagctaaaacctcaaaccagacttctccttggagctccagcctgtatagcaac

SEQ ID NO: 14577 - DNA, 72 bp, Homo sapiens
ttggattattgtggtggtgatggcggcagtggcagtggtggtaatggtggttgttgtcagtggtggtggtgc

SEQ ID NO: 14578 - DNA, 72 bp, Homo sapiens
ctaaggagccaacaacccagtggtgacaagtgccatggaaggcaataaaaccgggtgatgagaaatcccagg

SEQ ID NO: 14579 - DNA, 74 bp, Homo sapiens
aacttggattctgtggggtaggtaattttttagtaaggacagcctcttctaaaggctccctacaatgggactgg

SEQ ID NO: 14580 - DNA, 73 bp, Homo sapiens
tttgtatttcccagtgtcattcactgtgttgagcttatagcaagtgcacaatgaatacttactgttcaaataa

SEQ ID NO: 14581 - DNA, 70 bp, Homo sapiens
caccatgacgtgggaggtctgagaacaaatggagcatttagttctgagctgggtggggatagcctaacga

SEQ ID NO: 14582 - DNA, 72 bp, Homo sapiens
tccaccatgaaactgtcacaaaatccttagcatctcatcgcttaggcaaaagcagcttcaaatgccggactc

SEQ ID NO: 14583 - DNA, 73 bp, Homo sapiens
gccctggccttgggtaagttagtcaccttcatgtgctaatcagcactcaattgaagatttaataaaggggacc

SEQ ID NO: 14584 - DNA, 73 bp, Homo sapiens
tgtgcaggaaacatcatgccagtatctgcttctggggaggcctcaggaagcctttactcatggtggaaggtga

SEQ ID NO: 14585 - DNA, 72 bp, Homo sapiens
gcagagaaaggttctttgcagctgcagtcatgatgtgctggttttgcaaatgttttttgtttttgtttttgt

SEQ ID NO: 14586 - DNA, 72 bp, Homo sapiens
gagttttatacactgaatgtggaagaaccgggtatcatatcttttttaaaaaatgtcagtgtagaaaacatt

SEQ ID NO: 14587 - DNA, 74 bp, Homo sapiens
tgctagggagatgaaagtagtttttgtttcttcattagcgtaggatgtgtacattgaaagccatgttcccttgt

SEQ ID NO: 14588 - DNA, 72 bp, Homo sapiens
tgctcagaagaattggggttgatctttctggaataaccaagaatcccaaatatgatcaccccaagtgataat

SEQ ID NO: 14589 - DNA, 74 bp, Homo sapiens
tggggaaaagagaggtttttacactaaatatggttttacttctctctgtctcaaacagaaatgaaaacaagcat

SEQ ID NO: 14590 - DNA, 74 bp, Homo sapiens
ctcgacctcccaaagtgctgggattacaggcatgagccaccacgcccagccttacagtttatttttggccagag

SEQ ID NO: 14591 - DNA, 74 bp, Homo sapiens
gtgccgccacctccccgcgggacgcactctcctcgctcccccgggccccgcgtcctccccccggccacccttcc

SEQ ID NO: 14592 - DNA, 71 bp, Homo sapiens
ctcccaacaaaatgcatatgttgctcaggtagctatcaagtagttcttcagttgtgtgttaattgaggaca

SEQ ID NO: 14593 - DNA, 72 bp, Homo sapiens
ttctccctccctctccccactctacccctaaaaaacagcccccactgaggtagtagtggtgtgagccaggct

SEQ ID NO: 14594 - DNA, 74 bp, Homo sapiens
ggaacaggatgtttacatagtctcaaagctgccacagatgactgatcatttacagaggagaaaaagaggtgtct

SEQ ID NO: 14595 - DNA, 74 bp, Homo sapiens
atcagagcgcgcagaggcctcccttcccccgccgccgtcccgcgccaaaattccaaacgggctacgcaccgctc

SEQ ID NO: 14596 - DNA, 74 bp, Homo sapiens
caaagtagcttgctgctgacttaatgacacttgacagtctatcagagagagtcaggcccacctgttttaggcaa

SEQ ID NO: 14597 - DNA, 72 bp, Homo sapiens
tgacttcgagcccactgtcttaaccacttcagataactgcctctaatgcaaagacccctctcgaaggtcaga

SEQ ID NO: 14598 - DNA, 73 bp, Homo sapiens
accagccagcggttcttaaaactaggcttcaggcagtgcattttctttgaaggctttctgatcaaagcacggc

SEQ ID NO: 14599 - DNA, 72 bp, Homo sapiens
tgagccttactaagtcatggataaatgttcacattaagaacatattagttcattagactgatagacaaaggt

SEQ ID NO: 14600 - DNA, 70 bp, Homo sapiens
ggaggataataataaccaaatatgttcggcaatagtaaaacaaatattatgggtctttattacctaggta

SEQ ID NO: 14601 - DNA, 73 bp, Homo sapiens
agggtctagggataaggccagtgatgggctcagaggagaagtttggtaagcatttggaaatcctttctactct

SEQ ID NO: 14602 - DNA, 74 bp, Homo sapiens
tccaggaattgagaactccacttgtcaagacctcataatcgtagacttgattttaatgtttgctctttgctgga

SEQ ID NO: 14603 - DNA, 73 bp, Homo sapiens
gggcccctctttctctttgcctggttgactcagtttcagtgcacatgtcaacttttcggagagtcattctcag

SEQ ID NO: 14604 - DNA, 72 bp, Homo sapiens
cagataaacaaggagaaaagtctagactaatccacatgatcatggattagaggtggagacatccatatgcac

SEQ ID NO: 14605 - DNA, 72 bp, Homo sapiens
agtctcccctctcagccagagtcccactgcatgaaggcacagagttccccgtactggccaccaggttgtgag

SEQ ID NO: 14606 - DNA, 73 bp, Homo sapiens
gaccccattgtcacagcacccttttatattaaaagtcactagagatgtcacaaagataaattggggtttatgg

SEQ ID NO: 14607 - DNA, 73 bp, Homo sapiens
atgctgcttccctggactggacagttcttcccccgcattgcacttactctaactcacctttcaggtctcagct

SEQ ID NO: 14608 - DNA, 72 bp, Homo sapiens
cttctttcttgctgccattgacatccatggctcatgaatatgcactctttcatgagcacatagggcatgagt

SEQ ID NO: 14609 - DNA, 74 bp, Homo sapiens
atgcaatcacagtgggaacaagcagggagaaactccggtttctggtagacactggtagacgctgcagtgtgcca

SEQ ID NO: 14610 - DNA, 70 bp, Homo sapiens
aagccctgccagaccatcttcagaacacggttgtgatgaccctaagaggtaagaataagaggatggctgg

SEQ ID NO: 14611 - DNA, 71 bp, Homo sapiens
atggatacaggaattgctctggccaccataatttgggtggaaatggtgcataccacttccagttcttgccc

SEQ ID NO: 14612 - DNA, 72 bp, Homo sapiens
tcacccagcagctatttggggatgatcagggaaaacgaaagatcaggttcctcttcttttggttttaggtgt

SEQ ID NO: 14613 - DNA, 73 bp, Homo sapiens
agcgttgggaatgtagagactgaccaaagtatggtctctaccttcaaggagctcacagtctattggggaaaaa

SEQ ID NO: 14614 - DNA, 71 bp, Homo sapiens
gagaaaatcctttttcatagtggcttaccaacttactgttagtaagtttccatagtggctgtgttaactta

SEQ ID NO: 14615 - DNA, 70 bp, Homo sapiens
tctaatgaacaattattgcatatctgccatgtgtcaggcactatgctggcatagataggtaagtcagtag

SEQ ID NO: 14616 - DNA, 72 bp, Homo sapiens
aggatagcatcctagctatgccatctctttataaggctgatagatttggggtgatgtatagtatgtgatgta

SEQ ID NO: 14617 - DNA, 71 bp, Homo sapiens
acagcctcacagataggtactgttattatgatgacactggacttggagtcaggagacctgggaagctggac

SEQ ID NO: 14618 - DNA, 73 bp, Homo sapiens
gggagaagctgggagggttgtttggtgctgtcatctgaaaactgttgaggtagatccaacatggccctgaggc

SEQ ID NO: 14619 - DNA, 70 bp, Homo sapiens
acttcatttaatccttaccatgtgcacagacatgttcacgttacagacgagcaaacaggtctaggctggt

SEQ ID NO: 14620 - DNA, 73 bp, Homo sapiens
ctttcaagcttcaaggaggtgccctcttgcctaccaagcagggactagcttactgagtgagcaaatccatatt

SEQ ID NO: 14621 - DNA, 73 bp, Homo sapiens
ttctaagtgaaacacgggctctatattgatgagtaaaggtcccagaaccgctggcctggatctaggagtccta

SEQ ID NO: 14622 - DNA, 72 bp, Homo sapiens
atctcagatctgcaagtgcaggtgtgatcgagttagctttcctcttactgaagcactttcaggaattcaagt

SEQ ID NO: 14623 - DNA, 74 bp, Homo sapiens
ggctgttctcacccacccccatccccagggaagcgtgtgcactcgcaacagggctgggggcaggtcacagatct

SEQ ID NO: 14624 - DNA, 74 bp, Homo sapiens
ttggagcttaggcagtgtagtgttaggatgattattggatttcctccacagttcctggctcattcttttgtagc

SEQ ID NO: 14625 - DNA, 70 bp, Homo sapiens
taatcaactggcttcaatctacttgattggcttctctactggcgggagaagccccagtaggattgaagct

SEQ ID NO: 14626 - DNA, 71 bp, Homo sapiens
gatatatggtatatatatattcacacagtatatatggtaacatatatggtgtgtatatatatgttatatat

SEQ ID NO: 14627 - DNA, 73 bp, Homo sapiens
acaaaagtagccagcctgccaacccctgggcaaaggagctcaaacagtgtatgaaacccacgcaggctgggcc

SEQ ID NO: 14628 - DNA, 70 bp, Homo sapiens
aagtgctgcaaggtcgggtcatagggaggtgagatcggaaccatgcagtaatatggcaggaacaggagaa

SEQ ID NO: 14629 - DNA, 70 bp, Homo sapiens
ggcggggggcagggggcgcggcgagagctggggatcggcggcgtccgcactgagaaagcagcctccgccg

SEQ ID NO: 14630 - DNA, 72 bp, Homo sapiens
cccaagcagttggaccaatgcattcccaccagcaatgcacggccactcctacggcttgactatcctcagtgc

SEQ ID NO: 14631 - DNA, 72 bp, Homo sapiens
ctgaatagtctatgaatgtcactattgacttaaaaggatatgaggtcagctcatcctcaaggttgattctgc

SEQ ID NO: 14632 - DNA, 72 bp, Homo sapiens
tcctgcaggggctttgccagctccgagaggatacacaacagacaaaggtgcaatggtttatcaagctcccta

SEQ ID NO: 14633 - DNA, 72 bp, Homo sapiens
tgatcttagacttcccagcctccagaagtgtcagaaataaatttctaagctgcacagtttatggtattatgt

SEQ ID NO: 14634 - DNA, 72 bp, Homo sapiens
caaaagggactgagatgtgccatagagtagagccttggagactggactactaggtacggatccatgttccac

SEQ ID NO: 14635 - DNA, 73 bp, Homo sapiens
aggacaaacatccagagcagcatttgcaagttaccgtcatgctggatggctggaggaatcaaaacggtcactt

SEQ ID NO: 14636 - DNA, 73 bp, Homo sapiens
gtctatatagcatgtgaaggacaggggactaactttacagtaaatggaatgtttgggtgggggtggaatacga

SEQ ID NO: 14637 - DNA, 74 bp, Homo sapiens
tagggagacaggtcacacttttaaacaagattattatggaggtctttgaggagaaggtggtatttgggtcaatg

SEQ ID NO: 14638 - DNA, 71 bp, Homo sapiens
taactttctaccttttggaagacttctgaagagaaggaaaaggaagggaaggaaactaaaataatgtttat

SEQ ID NO: 14639 - DNA, 70 bp, Homo sapiens
aggaggctagataactttcgactctacttctatctatcaagtagttcgaatactttctctgttcatcctg

SEQ ID NO: 14640 - DNA, 73 bp, Homo sapiens
gctcagtaattgtccttctctgtatgtcagatccaacagtgggaactgcagccactcaactacaatatttaaa

SEQ ID NO: 14641 - DNA, 74 bp, Homo sapiens
ggagtcagcttgcaccagttaagtccttgaggaaggggctgccagtgaaagaggcaagatggagtctgtctggc

SEQ ID NO: 14642 - DNA, 72 bp, Homo sapiens
tttgagcccaagcctgcacgtatacatcccctggttcgatcccaggtttcggcaccaaatttcaagcacgtc

SEQ ID NO: 14643 - DNA, 72 bp, Homo sapiens
aacctgtatttttggtgtatggtgatgaaaatattctggaattaatggtgatgattatacctataaatatac

SEQ ID NO: 14644 - DNA, 70 bp, Homo sapiens
gagaatagctcagcctgatgaagaggcagaagcacatttgaaatatttatggttcaggaagctaggaagg

SEQ ID NO: 14645 - DNA, 74 bp, Homo sapiens
ccagataaaatcaccagtgctggccaataagttctgcatggctgctattgctaaaacatgctcatcttatgcct

SEQ ID NO: 14646 - DNA, 74 bp, Homo sapiens
agacttagctgggccaacatttgactgcggccttgggaaaccctggagaggcgactcatgatggatacagacag

SEQ ID NO: 14647 - DNA, 70 bp, Homo sapiens
aaaggaggaggaacagcctcagggcaggaagaggatgggctctgtacctgactcacctctgtattttgga

SEQ ID NO: 14648 - DNA, 71 bp, Homo sapiens
cacgcgatagccccctcgagaccacctggggtaggaacacgaggctcgggctggggcgcacctattccctg

SEQ ID NO: 14649 - DNA, 71 bp, Homo sapiens
aaagcaccaggacgcagctcagcctcagaggcaccaggcagagcactggctgctggcaccgtgggctccag

SEQ ID NO: 14650 - DNA, 70 bp, Homo sapiens
agcctatggagatggcagcattcctaggtctcaccactgattggtacccatcgccccatgcagagctctg

SEQ ID NO: 14651 - DNA, 71 bp, Homo sapiens
tggtcccctgacggaggcacacgggactcaggacacccttcctcatccccagcacctccacccggggcaca

SEQ ID NO: 14652 - DNA, 73 bp, Homo sapiens
taaagcgatctcatggttctaagaggggcagtggtctgtgcgttgtcactgccagcccagggtgatagacgtt

SEQ ID NO: 14653 - DNA, 72 bp, Homo sapiens
aacctgggtaggagtgtgcatggcattcttcatcaccgcttggactgcatggcactgaatacccacggagag

SEQ ID NO: 14654 - DNA, 72 bp, Homo sapiens
ttcctctaaaggtttgtatttgtttgcttggaaacaagttactaccaaatggagaccctttgagtagatttt

SEQ ID NO: 14655 - DNA, 71 bp, Homo sapiens
gggttgagtcggttccaacctggtaacgggagcatggggacaggatagagggagccgagctaaggagcaat

SEQ ID NO: 14656 - DNA, 72 bp, Homo sapiens
ttctggacctgggcttggagagaagggcagttcctgtctctaggccgcttgctcttggaatccggctgctgc

SEQ ID NO: 14657 - DNA, 71 bp, Homo sapiens
cagggaatctgggcccggatgaactgatgccctggcctctttcctccagggacaaggtcggtctcaggaaa

SEQ ID NO: 14658 - DNA, 73 bp, Homo sapiens
ggattgctgagtcatatgttaacttcagaagaaaatgtcagttttccaaagaggttgcgccattttcccgtcc

SEQ ID NO: 14659 - DNA, 72 bp, Homo sapiens
tcccagagctgcgcgtccccgccgtagatgtccgggaaggcgggctccgggggcgccgcgggacctgcgggc

SEQ ID NO: 14660 - DNA, 73 bp, Homo sapiens
gcgggtgcgctggggaataaatggggcttccctcggaggcgaggccccgtaggcagcctgcacgctccactgc

SEQ ID NO: 14661 - DNA, 74 bp, Homo sapiens
ctttgtctgccttaaagatttcaatttttggtgttctgactataatcaatgaggcatatgaagaagcaaggcat

SEQ ID NO: 14662 - DNA, 72 bp, Homo sapiens
ctagtggccggctccctggacggtgaggtcttaccgggtccccggtagctctttggaggatggctcaggggg

SEQ ID NO: 14663 - DNA, 73 bp, Homo sapiens
ccagtggccggacgagtcagctgggagagcacctgcctgggcaggcagggtggtctgaggatttgtgtcaggg

SEQ ID NO: 14664 - DNA, 72 bp, Homo sapiens
cctgcctttcaactactccggagttgcagcccaggaatctgcgccccagacccggaggaagaacggggaggt

SEQ ID NO: 14665 - DNA, 73 bp, Homo sapiens
cacagccgcgctattctcagcgtctctccttttatggctccggaagtgagctggggttgctggcagcctggct

SEQ ID NO: 14666 - DNA, 74 bp, Homo sapiens
tcagtcccacatggcttgcttacgaagcacatcagctgcttcatcgggggtgctccacttggcgtttatgggga

SEQ ID NO: 14667 - DNA, 70 bp, Homo sapiens
cccggagctccggggccagcaggggcatccagcactccgagtgggaggggaagcctctcggcgcctgagc

SEQ ID NO: 14668 - DNA, 72 bp, Homo sapiens
ctggtgacaacagcctgtgtgtgtgacagaacagcctgtgcgtgtgacaggacgtcaagaactacatacaaa

SEQ ID NO: 14669 - DNA, 70 bp, Homo sapiens
agtcccccccgccgccctcttgggttccctcctcgggatgtgtccgcagcgatggtcaccggcggccggg

SEQ ID NO: 14670 - DNA, 71 bp, Homo sapiens
cacacaaaaacaggccaacacccaaagaggccctttacagtaaagaagggcaccaccaggagacctgagtg

SEQ ID NO: 14671 - DNA, 70 bp, Homo sapiens
tttggcacaacagataatcgctttaattgaattcaaaagtgcattgttcagcagcactgtggccgctcac

SEQ ID NO: 14672 - DNA, 72 bp, Homo sapiens
gggcggagtggacgggagcggtgggtggagggccaggggcccgggcactcggccctcctgggctccccagcc

SEQ ID NO: 14673 - DNA, 72 bp, Homo sapiens
catggagtagggctgctggtaaacgaccagcattggagaaagctcacaagaggctgcagacgtctggccagc

SEQ ID NO: 14674 - DNA, 73 bp, Homo sapiens
cctgcttctgccgcagggccgcctgctccgcctgtgcccgccgcgccgcctcttgctcggcctccttgcgcag

SEQ ID NO: 14675 - DNA, 73 bp, Homo sapiens
gttctttataccgactcagtcgtctccaatgttgcaatgggaaagttctcagctgcacgcaggaagcaaggtg

SEQ ID NO: 14676 - DNA, 71 bp, Homo sapiens
gagctccggacacgatctgtggccagggtctgagtgactgagcgtggccaggtcggctctgcttctgcaac

SEQ ID NO: 14677 - DNA, 71 bp, Homo sapiens
tcccgcctcccccgcccgcccccgcagatcccgcgccccaggccccgagcgaggcaggcgggactggggtc

SEQ ID NO: 14678 - DNA, 71 bp, Homo sapiens
gcccccagaatgcctgcccagccctgctccctaccccagaggactttggtttgggggcccccaccccaccc

SEQ ID NO: 14679 - DNA, 73 bp, Homo sapiens
ccccaggcctcaagacaagtttcctgcagatgtctgcttgcaggtgccttcttggggtttccttgggtgccct

SEQ ID NO: 14680 - DNA, 70 bp, Homo sapiens
ggacagccgaggtgaagctttcactgttgcttttcccagggtgacattgagaggcctgtttgtgtcagca

SEQ ID NO: 14681 - DNA, 72 bp, Homo sapiens
tgacgtccctgagaccctcgtttacagcatgtgccggaatcacagacggcgtccaggaacagtgtggggctt

SEQ ID NO: 14682 - DNA, 73 bp, Homo sapiens
ctgaggtgttcccttgctctcttggtgcttaaccatgcattgtcctactaacatcctcagtcccagggtccac

SEQ ID NO: 14683 - DNA, 70 bp, Homo sapiens
actccgcccccccggtgtcccccgccctaccagggaggggtctgcctgggacctggggcgagagggaagg

SEQ ID NO: 14684 - DNA, 71 bp, Homo sapiens
cttggttgcccaggctggagtgcaatggcatgatctcggctcatcgcatcctccacctcctgagttcaagc

SEQ ID NO: 14685 - DNA, 72 bp, Homo sapiens
aaagcacaaagcagcagcacaggaggcccacattctgtgcaaatccatacaggtgtgttttcagagtagata

SEQ ID NO: 14686 - DNA, 72 bp, Homo sapiens
aaaccttctcaaccagaacttctgggaggggatatctccctccctcccaggaatccacaattgcaatgagaa

SEQ ID NO: 14687 - DNA, 70 bp, Homo sapiens
cctgttacagagagtactttgcgaggttaacaagaatccagttataaattgtgtggggtggggctgtgtg

SEQ ID NO: 14688 - DNA, 71 bp, Homo sapiens
acatcagaagcacaacgatgttgcccaggagcagtggctcatgcctgtaatcctagcactttgggaggccg

SEQ ID NO: 14689 - DNA, 74 bp, Homo sapiens
tgatgaggtgtgtgtaactgagcccaggggacagacacatgaatctatgcatgtctgctccctcctcgacaccc

SEQ ID NO: 14690 - DNA, 73 bp, Homo sapiens
tggatatatatctaagagcagttttcccagggaaccctatctaaaagttgaattcgttctcaactgtttttac

SEQ ID NO: 14691 - DNA, 70 bp, Homo sapiens
aaaagcaggaggacaggggattgatctcccaagggaggtcccctgatccgagtcacggcacgaaacttca

SEQ ID NO: 14692 - DNA, 74 bp, Homo sapiens
aagtagggactggagtctggcagacttgtcagctgtgcttcttctggagtgctgctattggctagtttttctag

SEQ ID NO: 14693 - DNA, 74 bp, Homo sapiens
tgcacactctttacataaccttgtcatcatgattctagctccacctgatgggaacagaaactgatgatggctag

SEQ ID NO: 14694 - DNA, 72 bp, Homo sapiens
actggtaacttgtcgtgcggagcgaacggcggcggcggcggcggcggcggcaccatccaggcgggcaccatg

SEQ ID NO: 14695 - DNA, 71 bp, Homo sapiens
aggatctgtaggtgccgacggtcagaattccctctaaaaatggcaaggtactgaacaaaaccatgtataga

SEQ ID NO: 14696 - DNA, 73 bp, Homo sapiens
agtgctacccattgcatatgccacccacaaagcccaactgggtgtggctgagtctaagcaagacataatcata

SEQ ID NO: 14697 - DNA, 71 bp, Homo sapiens
tcagttctcagtaaaacaattctgaggcctgtccagtacaatttctcaggggatctttggaactgagccac

SEQ ID NO: 14698 - DNA, 70 bp, Homo sapiens
taaataagataatcacatgggggaagtgttcaggactggaagtcagaagcctgaactgtctgtcttatta

SEQ ID NO: 14699 - DNA, 70 bp, Homo sapiens
aggtgatgctacacagctcataaagtgactgttaacagtgaacaagttattgtttgtagaagtgcctcat

SEQ ID NO: 14700 - DNA, 70 bp, Homo sapiens
taggaaaaataatcatttattcaaatgctcagccaatttactttggcctatttgtagcttatttttcctg

SEQ ID NO: 14701 - DNA, 72 bp, Homo sapiens
aacaatagtgaaaacagtttatttttgcttagtgagcatctaagtatgtgtgttttctgtttgtttgtttgc

SEQ ID NO: 14702 - DNA, 70 bp, Homo sapiens
attctagagagctgtcaaatgtgattgctgaaatgatttcagtatgagcttatcagactgtttaggaaca

SEQ ID NO: 14703 - DNA, 79 bp, Homo sapiens
actgtcctttttcggttatcatggtaccgatgctgtatatctgaaaggtacagtactgtgataactgaagaatggtggt

SEQ ID NO: 14704 - DNA, 72 bp, Homo sapiens
gggatgctggtgatgatggtggtggctgcatatgtgccacagcagaactggcttctaggactttatatggca

SEQ ID NO: 14705 - DNA, 73 bp, Homo sapiens
cataacaaaataccatggactgggtgatttataaagaaaagagttttatttggtgtctggttctggaggttga

SEQ ID NO: 14706 - DNA, 70 bp, Homo sapiens
atttacgttaaatgggcacccctggtcaactacccttagggtttgtacctgctaaatagcccgcttggtt

SEQ ID NO: 14707 - DNA, 70 bp, Homo sapiens
tggatgctgctactaatcaggctccctggtttggtccagcattttaatttatttaatttatttatgtata

SEQ ID NO: 14708 - DNA, 74 bp, Homo sapiens
tcacctgtgacttccttgcttatcaaactgatgccctgtatagaactttggcgttggagtggcagacaatgtgg

SEQ ID NO: 14709 - DNA, 72 bp, Homo sapiens
gttagctattattggaaattggcacttttagtccattggtggtaaactttagtttcattttccaatttctga

SEQ ID NO: 14710 - DNA, 71 bp, Homo sapiens
tctttaaagcaaaattcacattgagaaccctgtaaaataatcataggagggcttcgcaaatgaaagaggct

SEQ ID NO: 14711 - DNA, 73 bp, Homo sapiens
gtgctatgaagtataagcagcattgtacatttgattggtttttggaaataattgcttgtgttaaaaggcatga

SEQ ID NO: 14712 - DNA, 71 bp, Homo sapiens
agttgtacctggttgatttcatggcctcagcctctgccatgtcttcacacccgatatttcaaccagggaga

SEQ ID NO: 14713 - DNA, 72 bp, Homo sapiens
ttgttatcacaaccatgtagccataacataggaaggccatcattggctctacaacactattgtctgtgaaac

SEQ ID NO: 14714 - DNA, 72 bp, Homo sapiens
agactagggggtgggcctgagattctaacaagctgtcacttggtgcccatgctactagtccatgaaccatac

SEQ ID NO: 14715 - DNA, 71 bp, Homo sapiens
attctcaataatgctccctacagcagctcaggatcagattctgagctactgcttccagaagttttgtccag

SEQ ID NO: 14716 - DNA, 71 bp, Homo sapiens
ttactttgatccccagtgaatgcattttaaagtaacattattacttttggtgctagctatggcttacctgt

SEQ ID NO: 14717 - DNA, 71 bp, Homo sapiens
atctccatgctgagaatcacagaagcacatctggatttgttatattcctgtccatccagcctaaggaggag

SEQ ID NO: 14718 - DNA, 74 bp, Homo sapiens
agtatgttatacatgtggcttcaaaaacccaaggtggctcaccaagaaccataattaggaaatgtgaggtgcac

SEQ ID NO: 14719 - DNA, 70 bp, Homo sapiens
taaaaactttgaagttccaggattgacctagccatgaaaattacaaggacaacttgggtggggcacggtg

SEQ ID NO: 14720 - DNA, 70 bp, Homo sapiens
gagccctcacacagagtcccacctgggatactacctagtggagctgtgagaagagggccagtggcctcca

SEQ ID NO: 14721 - DNA, 74 bp, Homo sapiens
gggacttgcaccatctgaggctaaggcctgagctctacattgggcccttttagccacagctggatcatagggca

SEQ ID NO: 14722 - DNA, 74 bp, Homo sapiens
gaagcgctgggaactgtgtatgtttatattttccataatgggagagatagagagagaatagaaaataaattggc

SEQ ID NO: 14723 - DNA, 73 bp, Homo sapiens
atgggcctaaaatttccatagatttataactgccaaagcttatcagtgactactctagttttttaaggaccca

SEQ ID NO: 14724 - DNA, 74 bp, Homo sapiens
tgaagtccacatctaatccttgatggagcagccccaggattgccacgtgctgctgcatcaagagagctctgctt

SEQ ID NO: 14725 - DNA, 71 bp, Homo sapiens
tgaagataatgaatgctccactgctctgccctggagccacagaacagcaggtaacatgtcttagctttttc

SEQ ID NO: 14726 - DNA, 74 bp, Homo sapiens
tttttcatggttattgggggtcaggaatccaggagtagcttatcagagtgattctggctcagggtctctcatga

SEQ ID NO: 14727 - DNA, 72 bp, Homo sapiens
gactgtatatatatctacatacattttagataaatatataaatgtctaaatatgtattttagatatataaat

SEQ ID NO: 14728 - DNA, 74 bp, Homo sapiens
ggttccttttaatgagaggtggtaatgctccatgataaataatcagcttaaggattaaccctctaagcaagtgg

SEQ ID NO: 14729 - DNA, 71 bp, Homo sapiens
agcacctaacctataggcctgtgatgagggttatattaattaatgcacgtaagttcttaaaacagtgcctg

SEQ ID NO: 14730 - DNA, 70 bp, Homo sapiens
gagttccccagtcaggaaactgtggagtgagaagcttctacagagactcttgaagaaccacataggcaac

SEQ ID NO: 14731 - DNA, 74 bp, Homo sapiens
aaaaaaggctgagcacctgcaggtgaggggaagccaagcaataaggtgaatctcatcacagaacccagaggact

SEQ ID NO: 14732 - DNA, 71 bp, Homo sapiens
cttgcactctgcacacaagcagagttggtatttgtgccaaggcctacttcttgtgttctccagagtggtgg

SEQ ID NO: 14733 - DNA, 71 bp, Homo sapiens
caacctgggcctggcatgcatcgtttcttggtacagaacttgaagcagacttatccatgcatgcatctaaa

SEQ ID NO: 14734 - DNA, 70 bp, Homo sapiens
ggctccgggacccccattgtgctccctggaggagggcagggtggtggtgaagaacaggggctctggatca

SEQ ID NO: 14735 - DNA, 74 bp, Homo sapiens
tttcttttagtctttgcagttaaggggactgagatgccagttaagacagacatcactgtgacaaccactaaggg

SEQ ID NO: 14736 - DNA, 73 bp, Homo sapiens
ggttattccatgagttccatggtgaaacatcaagctataccaagctaaacaggtttccctagccattcactta

SEQ ID NO: 14737 - DNA, 72 bp, Homo sapiens
tgggagagcagtggcacaaataccccatgagctgccctggctggtgtctcagtaggtcacatgccacccaag

SEQ ID NO: 14738 - DNA, 72 bp, Homo sapiens
ttaaattcactgccgaaagctatggcctatcactatatgtgagaatttctatggaagggcagtgcttttgta

SEQ ID NO: 14739 - DNA, 73 bp, Homo sapiens
ttgtgtctcccaacaaggtatgtcagagtcctaacccatggtaactgggaatgtgaccttatttggaaatagg

SEQ ID NO: 14740 - DNA, 71 bp, Homo sapiens
gatccctctgtatctcctgccttaacaataacgaccagcattattgagctgggtgggccagggtctgggct

SEQ ID NO: 14741 - DNA, 73 bp, Homo sapiens
ttgtagtgcttcttcatcactgtgttgaaaacagtagtagcagcagtggtaaagtggttaataccttcatagc

SEQ ID NO: 14742 - DNA, 70 bp, Homo sapiens
aaaatgggtgcttaaaaataattgctgggacaccatccaccatctgattattgcccagttctggactcag

SEQ ID NO: 14743 - DNA, 75 bp, Homo sapiens
agaataaactgccttttgatgaccgggacgaattgagtgaaatcgtaacggacagatacggggcagacagatttt

SEQ ID NO: 14744 - DNA, 75 bp, Homo sapiens; identical to SEQ ID NO: 14743

SEQ ID NO: 14745 - DNA, 73 bp, Homo sapiens
gaataaaatagttctgagctgggcatagtggctcatgcctgtaatcgcagccttttgggaggccacagtggga

SEQ ID NO: 14746 - DNA, 72 bp, Homo sapiens
tgagccctctccatgttgcttagtattatgctaagtgccctacaggatcgtctcaaagatgaacactattgt

SEQ ID NO: 14747 - DNA, 70 bp, Homo sapiens
aagaaaaaaatattaagactactatttgttatcttttttaaaagagggaataaattagtccatgttttta

SEQ ID NO: 14748 - DNA, 70 bp, Homo sapiens
cctctgacccatattgaagtgttgtgttcagtggggattaaaagccttgtgaactggagtaagaagagct

SEQ ID NO: 14749 - DNA, 73 bp, Homo sapiens
gttgaacccaggagatggaggttgcagtgagccgagatcgtgccattgaactacaggctgggcaacaagagtg

SEQ ID NO: 14750 - DNA, 73 bp, Homo sapiens
ttagtagctgagagctgccacctttaatactttttgcctttacagggtttgtttgcatctgtagtcctgagca

SEQ ID NO: 14751 - DNA, 73 bp, Homo sapiens
tagatcttttggaaactctacagtgggttctattgcatagccatagtgggacccctttgccttagggagaaat

SEQ ID NO: 14752 - DNA, 74 bp, Homo sapiens
tgtctttctagtaatccagatatctcttcccccatgcctttggtgtggtttcggtagagtcatacagagcagca

SEQ ID NO: 14753 - DNA, 73 bp, Homo sapiens
tttgcaggcagttgtcatgttttggttgagaccagaatgtccaactcaactacatgggctatgtttaaatgtt

SEQ ID NO: 14754 - DNA, 70 bp, Homo sapiens
ataaagtatttcaaaatatctccagggtccttatatatcccaatgtgtgattaatttgaaataactttca

SEQ ID NO: 14755 - DNA, 73 bp, Homo sapiens
tgctttcacatagctttggggcaacatttggtttacaggtcaaaagggtttctaaattaagtttgcatatagc

SEQ ID NO: 14756 - DNA, 74 bp, Homo sapiens
tggcggcggcggcggcgggaaaggggactggaagccggcggaacccccgccccacccgcgccgcgccgcgccgc

SEQ ID NO: 14757 - DNA, 73 bp, Homo sapiens
tcatttgaaggttgggatggaaacagaaatacccactgaaaggaattgttttgttgagtccattcttaatttt

SEQ ID NO: 14758 - DNA, 72 bp, Homo sapiens
ataggaaaaactgtgagatttgattttggcatatgcaacgcccatgtgaccaaatattttatgtttggaaaa

SEQ ID NO: 14759 - DNA, 72 bp, Homo sapiens
ctaatatacaattattgatctaaaggttacaagttcaactccaatatagattagtaatgatgtattaacatt

SEQ ID NO: 14760 - DNA, 73 bp, Homo sapiens
ccttgggggaggtgcagcagcaaacattgaggctgcagggcctccctgcaggaactgtaactccagccaaggg

SEQ ID NO: 14761 - DNA, 74 bp, Homo sapiens
acttctgtcaacttgtcaaattcattgtccacccagctttgttccattgctggtgaggagctgcgatcctttgg

SEQ ID NO: 14762 - DNA, 70 bp, Homo sapiens
tcactaagtcaaaccctgtccctggaaagcctgttccaggaggaagagaggtaaatggctgccagtgggc

SEQ ID NO: 14763 - DNA, 72 bp, Homo sapiens
caactgtagagactagtttcccaggtgtgcctgcaatgttaggggtgagatgaagcaccaatggggactttc

SEQ ID NO: 14764 - DNA, 70 bp, Homo sapiens
tagaagtggcgtagtaatctgtgcacattggtgtcagaagtgttgtgttcagtgagagcagagattagga

SEQ ID NO: 14765 - DNA, 72 bp, Homo sapiens
gttgagtctctgaatcagcggctgtaccacaccagcatgggccacgggagtagggactcggctggcaggacc

SEQ ID NO: 14766 - DNA, 70 bp, Homo sapiens
gatttggggttgaattattaggaagccctttgcagatagatttaaaccgcattctctaatatcagcttca

SEQ ID NO: 14767 - DNA, 71 bp, Homo sapiens
ctgtctctttgtcaatgtgggtaatcagtaagacagtatggcacagtaaattactagattaagaggcagcc

SEQ ID NO: 14768 - DNA, 74 bp, Homo sapiens
tattcataggactgggaacatggtcacatggtgagtctattcattataaaagcatatgtctttccattctggga

SEQ ID NO: 14769 - DNA, 72 bp, Homo sapiens
attcacccttgtgattgcatggctgaccggaagctgcagcttgctaatgccgcacagcatcacaaaagaatg

SEQ ID NO: 14770 - DNA, 72 bp, Homo sapiens
cctcaactttagaaaatgacctattttaactatctggtcccagattagagtaggagggaaaatcagagagcg

SEQ ID NO: 14771 - DNA, 72 bp, Homo sapiens
aaattgaaatgtaagaccatgtccacagaagtctttaaaagaatgtccatgatctgccatatcaatctggag

SEQ ID NO: 14772 - DNA, 71 bp, Homo sapiens
acccaggctggagtgtagaggcatgatcacagttcatgcaatgtctgcccgccccaggggttcaagcgatt

SEQ ID NO: 14773 - DNA, 72 bp, Homo sapiens
ggtcttgaactcctgagctctacagagcctccaacctcaggctcccaaagttctgggatcaggtgtgagcca

SEQ ID NO: 14774 - DNA, 74 bp, Homo sapiens
ggctggttctgtgaagcatgcaggccggactgcacctcccccactgcagctggcgctctcgcagtggccactcc

SEQ ID NO: 14775 - DNA, 71 bp, Homo sapiens
ggtagatgatgatggcctgcacggagacgctgaagccctggtaaaggccccggatgccgtcggacttgctg

SEQ ID NO: 14776 - DNA, 73 bp, Homo sapiens
gccttcagttttactccagttctcaggccagtgactttcagtgagaagtgatttagaaggtactctttagtac

SEQ ID NO: 14777 - DNA, 73 bp, Homo sapiens
atgtgtctgttcttgtaccggtaccatgctgttttggttactgtagccctgtagtatagcatgatgcctccag

SEQ ID NO: 14778 - DNA, 72 bp, Homo sapiens
gaacccaggcggcaggggttgcagtgagctgagattgcaccattgcactccagcctgggcaacacagtgaga

SEQ ID NO: 14779 - DNA, 73 bp, Homo sapiens
ctgggatcggttcccggcccatgccagttttgcagagcacacctggtgtagagccctgtgactggggcctgga

SEQ ID NO: 14780 - DNA, 74 bp, Homo sapiens
atctgtggtggcacagttagtaacctttagagctgggagtcaaatccaggcattttgcttccagtatctgtgct

SEQ ID NO: 14781 - DNA, 72 bp, Homo sapiens
agaaagagcagcaatgcaatattggaaagactagcagtaaggagactgcaggttcaggagagtgggctcagc

SEQ ID NO: 14782 - DNA, 71 bp, Homo sapiens
aggtgttcaggaaatgatggatgaagtgattaattctgacatcagcactctgataatcttcacagaacaag

SEQ ID NO: 14783 - DNA, 72 bp, Homo sapiens
ttctgaatttaaaagtttcatgccgtatgccacttatatgatgtataatggtttacatggctttatttagaa

SEQ ID NO: 14784 - DNA, 72 bp, Homo sapiens
aggctgagctgcagttgccccgacatgccacatgccacatgtttgccagcaggctgagtcccagctgttttt

SEQ ID NO: 14785 - DNA, 74 bp, Homo sapiens
agaatgagtagagtaggctggtccgagtgcagtggtatttacaacctattgatcacaaccagttacagattgct

SEQ ID NO: 14786 - DNA, 74 bp, Homo sapiens
tctggctgggtgcagtagctcgcgtctgtgatcccagcactttgggaggccgaggcgggtggatcacaaggtca

SEQ ID NO: 14787 - DNA, 74 bp, Homo sapiens
ttctcctccaaggtgaacagctctgtttcctccctgaagcctcatgggatgaatgattcctcttttggctggac

SEQ ID NO: 14788 - DNA, 72 bp, Homo sapiens
atttagttctcttcatataggcgactcacagtatgggtttttgggggttgggattgggggagacagccattg

SEQ ID NO: 14789 - DNA, 73 bp, Homo sapiens
agcagagagctgacctgatgaaggtgagggagaaatccatgcagaggtctgtgggaagatgttctgggtagag

SEQ ID NO: 14790 - DNA, 72 bp, Homo sapiens
aggcactgaagcagggtagaagagagtgaggagctcggatgatgagagagccattacccttttctgggaccc

SEQ ID NO: 14791 - DNA, 70 bp, Homo sapiens
catggataggagatttgtcaaagatcagaggtatctccactcacaatccctccgtggttaccatccttca

SEQ ID NO: 14792 - DNA, 73 bp, Homo sapiens
taggtgtatatacaggtatggtgatgagcattgtgtctagcatgctatcaaattggcttataaacaaacaagc

SEQ ID NO: 14793 - DNA, 72 bp, Homo sapiens
ccatcacagctggtactgcgtctgtggtgaacctgacagcaggtaggccggatgctagcttccgggtgtgtg

SEQ ID NO: 14794 - DNA, 74 bp, Homo sapiens
ctgggccccgcgcgcgccgctcgtccgggtcaggtcgcctcggcccggcccgtctccgctcgctgcgccggcgg

SEQ ID NO: 14795 - DNA, 73 bp, Homo sapiens
ctaaaccaaggcaaacagaacctgctgggcgggctggggagaaacccccgccccggccaccactcccaggcct

SEQ ID NO: 14796 - DNA, 73 bp, Homo sapiens
tggtttatgatattttacagatgaatcaacagtaagaccagccgagggtcttctgtgaatcctgtcaaatcta

SEQ ID NO: 14797 - DNA, 72 bp, Homo sapiens
gactgaggctgaaagtgcgcggcggcggcggctgctgaggcggcggcggcagcgaccgcggcggccgcgctt

SEQ ID NO: 14798 - DNA, 71 bp, Homo sapiens
gcttgaactcaggaggcggaggttgcggtgagcccagatcgtgtcactgcagcactctagcctgggcgaca

SEQ ID NO: 14799 - DNA, 74 bp, Homo sapiens
cagacacgccgcgcccccagcgcgccgccccacactgccggcccggagcgaggaaagggtaggcgctgcgcggc

SEQ ID NO: 14800 - DNA, 74 bp, Homo sapiens
ggacagactcacagggccctcaccagctcaaagcgctagcagtgcccaggtagagtgtaggcccagctttctct

SEQ ID NO: 14801 - DNA, 72 bp, Homo sapiens
ccgtcgagggcgcgcgggtcggttctagcgtcccatgggtcgcggttcgcgttttcgggcagcgcgtgcctc

SEQ ID NO: 14802 - DNA, 73 bp, Homo sapiens
gataaacagcaggctcagacaggcaggagggacttcccggggacgtctagactctcttcagcctggcagctgc

SEQ ID NO: 14803 - DNA, 74 bp, Homo sapiens
acaccaaaccgcatttttagccaggtgaataatgagtgttgaattacgatgcagtcgacgcgtcgcatctgtgc

SEQ ID NO: 14804 - DNA, 72 bp, Homo sapiens
tctccatcacatgcggtcatcgggagctgggaagtggaagctcctgtatttactcagatctagaaccgtcac

SEQ ID NO: 14805 - DNA, 72 bp, Homo sapiens
gtgggtagaaccgcatttctccattcattcaagcattgttcattgaactaggctatatggaacccaaccatg

SEQ ID NO: 14806 - DNA, 72 bp, Homo sapiens
gtgatatggacggctgatgcggtctcagatgaaaatgaggaacttactgggacttggaataaaggtcatgcc

SEQ ID NO: 14807 - DNA, 73 bp, Homo sapiens
tcaggctatcgtagcagtgttctggaatcctgtgtgactgacaaacattgagaccccagcagcagtgttctgg

SEQ ID NO: 14808 - DNA, 72 bp, Homo sapiens
actcaggctgggatccagagcaaagcactgtaaacttgaatgtgcatatgaaccacctggagaccttgtcaa

SEQ ID NO: 14809 - DNA, 74 bp, Homo sapiens
gggttatcaggcagaaccagtggccaaaatgtcctagaactggagaggtccttagggatgatctaaggtgacct

SEQ ID NO: 14810 - DNA, 73 bp, Homo sapiens
ctaggagaaagatgagagcttgctgagacatacaacacactgagtaggaacatggtctttgacatctgatagt

SEQ ID NO: 14811 - DNA, 74 bp, Homo sapiens
gtgaagctgcttggtaagtggtcatttcctcatagacttttgttttgtactctactctaccatgtatttacaac

SEQ ID NO: 14812 - DNA, 72 bp, Homo sapiens
cccataaggctgtattaccatctactgtatttgggctgacctatgaatcagtactgggtttatataaagatg

SEQ ID NO: 14813 - DNA, 72 bp, Homo sapiens
atttaccttgaagttttgatgtatgagtttatgtgcacatgcgcatgcacacacatatatacacacacattc

SEQ ID NO: 14814 - DNA, 70 bp, Homo sapiens
actggccaagaacatcttctacatgccctattggatgatttatggggaagtgtttgcggaccagatagac

SEQ ID NO: 14815 - DNA, 72 bp, Homo sapiens
actggcacgggaggggtgtctcgaaggtactccaaaacaatcgagatcacattgggtcctccttccactatg

SEQ ID NO: 14816 - DNA, 73 bp, Homo sapiens
aactcttaataatcagctatataggggattgtcgtagaacacatttgtcagtttactgggctgagacctagag

SEQ ID NO: 14817 - DNA, 74 bp, Homo sapiens
ggtggcatttcaagagcaacgaaaacacgcatgcatgtgcaaatttgcatgcagatgttcatagcagccttact

SEQ ID NO: 14818 - DNA, 74 bp, Homo sapiens
tattcccgatacctctgattcagtagattgcgcgacgtctggcaatccaattttttctaagtgccccaggggat

SEQ ID NO: 14819 - DNA, 73 bp, Homo sapiens
tggctacatctcccggtgcttcacgcggaaatacacgctgccccaccggtgtggaccccactcaggtctcctc

SEQ ID NO: 14820 - DNA, 74 bp, Homo sapiens
atatttaactgcatatatagatgggtttcatcttttttagttaattagcttatcttcattatggggtcctgaat

SEQ ID NO: 14821 - DNA, 73 bp, Homo sapiens
cgggtatatactattggcaaattcatatagataacagtgcaaatccatgcatttgcactggccataattagta

SEQ ID NO: 14822 - DNA, 72 bp, Homo sapiens
tcaggtgccaactgtggtgggtggggcaggtgatccctaggcccctggatggtgtgctccagcactgggtgg

SEQ ID NO: 14823 - DNA, 70 bp, Homo sapiens
cataggagcatggaccctattgtgtactgcgcatgtgagggatctaggttgtgtgctccttatgagaatc

SEQ ID NO: 14824 - DNA, 72 bp, Homo sapiens
aacagcagcctctcagtggtcaagctaaatccatttagcttatgtctgacttgtggatcttctggggtggaa

SEQ ID NO: 14825 - DNA, 73 bp, Homo sapiens
gaagtaattagagcagccatatcgtcaaagataacctacactttaatggctggactttgagccatttctaaga

SEQ ID NO: 14826 - DNA, 74 bp, Homo sapiens
ctcagtctcccaagtaggtgcaactacaggcacgcgccaccacgcccagctaatttttgtatttttagtagaga

SEQ ID NO: 14827 - DNA, 73 bp, Homo sapiens
ccaaatgctttcctacctctcggaatgtacacagggtcattctcccactggtttgctgggctgaagccaaact

SEQ ID NO: 14828 - DNA, 72 bp, Homo sapiens
tttgttgtcagttcactccagcaaaacttcagagaaagtggaagggaagattttctgccctgacagcaacat

SEQ ID NO: 14829 - DNA, 71 bp, Homo sapiens
cctgacgcatgggcttgtgggccaggcctgaattctagtcctgtcactgactcactggggcaaaacttcaa

SEQ ID NO: 14830 - DNA, 72 bp, Homo sapiens
tagtttggggcctcagagctggagagtcaatcgtgtagattccagtcctggtttaagggcctgagaatcagg

SEQ ID NO: 14831 - DNA, 73 bp, Homo sapiens
ttttatctggctggaggcagggctggtctggcgggaccaaaagtgcccattgcctccaagggcattgctgaaa

SEQ ID NO: 14832 - DNA, 70 bp, Homo sapiens
aaagccttagttcacagccaagccttggtcactgccaagatctgggctgtgccattgaagtgtcatggaa

SEQ ID NO: 14833 - DNA, 72 bp, Homo sapiens
aggaggttgggggcatatacagtagactcattatggagggtctttgacacccccaacaacccctgctgagtc

SEQ ID NO: 14834 - DNA, 70 bp, Homo sapiens
tggtgactccatgatgttgtgaattcggttccttttatatcgacgttcatcatccttgcaccattgtgtc

SEQ ID NO: 14835 - DNA, 72 bp, Homo sapiens
aaggggttattacaaggatatgtgctctcccagggacatggcactcgccattacgggaatgttctcatcact

SEQ ID NO: 14836 - DNA, 72 bp, Homo sapiens
gccacacagtagtctggtgatgtgtgcatgcctggcccaaaagccagctcagtagtggccctgctgccccag

SEQ ID NO: 14837 - DNA, 70 bp, Homo sapiens
tttttaaaaatgtatttggagagtggggccaagatggccaacttagatgcagtgtgattggaggctctca

SEQ ID NO: 14838 - DNA, 71 bp, Homo sapiens
atctcttttctccattttttagtgacttgggattgcagaattatttagcttgctgagtcagtggaaatggg

SEQ ID NO: 14839 - DNA, 72 bp, Homo sapiens
tgtagcctcagcctccattttgagtataagcttgactttttatcacatcagaagcagggctttgtcaccgtt

SEQ ID NO: 14840 - DNA, 70 bp, Homo sapiens
aaataacctggtctaggcacaaatggaactgaggagtccagttttcccacgtgcgcaagaggacagaaga

SEQ ID NO: 14841 - DNA, 72 bp, Homo sapiens
actgatagcttatcttcacaggtttgagacagaaagtcatccttctgctcacctgagacaaatacatatctg

SEQ ID NO: 14842 - DNA, 70 bp, Homo sapiens
ggcccaagctagggcagtagtggggcagggacataccagtgattcctattccagtggccgccatgctgct

SEQ ID NO: 14843 - DNA, 74 bp, Homo sapiens
gtgacttgcacatttgcttagggacccgtgcctaaaaggaccctgtacttggcgtaatggtctgctatcatcac

SEQ ID NO: 14844 - DNA, 74 bp, Homo sapiens
attgattggcagttgcctcagctgggcagcttggctttaaggtaaaggtctaactggttggggctactcatagc

SEQ ID NO: 14845 - DNA, 74 bp, Homo sapiens
tgacctgtagtggcggttcactacagcaagggctttaatcttaactgttagtggaataagaaaaccaccagagc

SEQ ID NO: 14846 - DNA, 70 bp, Homo sapiens
ttggtttccagtgctttggggggttcctcagagcctgcccttgtcctgtgttgctatgggttatcactga

SEQ ID NO: 14847 - DNA, 72 bp, Homo sapiens
aggtcactgaggggctagtccttagggtccctactgagcaggccacattctctcaagccttaactccctcat

SEQ ID NO: 14848 - DNA, 71 bp, Homo sapiens
ggctattcaagatgttccaagatgaaggtgtcattaatgatgtccaatgtctctttacactacctttatct

SEQ ID NO: 14849 - DNA, 72 bp, Homo sapiens
gacccagcacaccatgtaaatagaccggtgctcccaacttgttttatctgtatgggtcagatccttgattaa

SEQ ID NO: 14850 - DNA, 72 bp, Homo sapiens
catagaaggagacctgtcagaaacaccaggctattttgactgggtctgggatggggatttccagggctgttt

SEQ ID NO: 14851 - DNA, 74 bp, Homo sapiens
actcctcctgggaccaccaggccaccccagcctctgcttctccagcctcctcctgggaaaggtcctttcttctg

SEQ ID NO: 14852 - DNA, 71 bp, Homo sapiens
tgacatggctgagtgatccctaggctcccaggtatgctctggtattggggatggtgggggagccaggccag

SEQ ID NO: 14853 - DNA, 74 bp, Homo sapiens
cccctatgcttctcttcagtacccactccctaccccagtgggacaaagtggctggaatgggctggagttgagta

SEQ ID NO: 14854 - DNA, 73 bp, Homo sapiens
tcttctgagccttcccttgtttgatgtaggaaagattaactgagagtttgacacctttgaaggtgggaaacat

SEQ ID NO: 14855 - DNA, 72 bp, Homo sapiens
taagccctcatcagacgtgattatggccgcaggttaatctagcggttcctcctaattaatagcctggagtat

SEQ ID NO: 14856 - DNA, 70 bp, Homo sapiens
gggtgggtggagaaggttccagttttccctggaatgaattgtcaagactttcccctccaggcttgaaaca

SEQ ID NO: 14857 - DNA, 72 bp, Homo sapiens
ttggtgacaatggcaacagcatctcaatcttttcctaagagatatctgagccttattcaccagccctcatag

SEQ ID NO: 14858 - DNA, 70 bp, Homo sapiens
acctcctcctagtcctgcagcctcacttgagagtgctgtgactcttagcggaggacaggtcctggggcat

SEQ ID NO: 14859 - DNA, 72 bp, Homo sapiens
ggagagaactcagataagttacgcgatagctatctaactgggtcacgcgttcattctgctaactctgtagct

SEQ ID NO: 14860 - DNA, 71 bp, Homo sapiens
agagtcctgcagtggctaagttccagaaaagctgtttccttatcattccacaaatgtagctctcttacagc

SEQ ID NO: 14861 - DNA, 73 bp, Homo sapiens
gcttctgctgagaaatctgccattagactgataggttttcccttataggttacctgatgcttttgtctcacag

SEQ ID NO: 14862 - DNA, 71 bp, Homo sapiens
ctctccgtcccgctccggggacagtggctcgcctgctatgcgcggcagcccgcgccggggccggcaccagc

SEQ ID NO: 14863 - DNA, 72 bp, Homo sapiens
tttgttgacaacgtgatgggaatgatcctgacctttgtgcaagtccatgcaaccagggagcagactatcaca

SEQ ID NO: 14864 - DNA, 73 bp, Homo sapiens
tccgtccgcctgcctcgcactgggggctcggccgggcggtgacggggctggtccagcgggcgtgggtcggatg

SEQ ID NO: 14865 - DNA, 70 bp, Homo sapiens
gaagatcccaccccacctccccgcccttggccgagcgcggcggggcgcgggagacgggggcgggcgggga

SEQ ID NO: 14866 - DNA, 71 bp, Homo sapiens
atgtcaaaggattcttctttggtgaaactgagaaaccaaagaaaaatgacctattaattggcataagacca

SEQ ID NO: 14867 - DNA, 73 bp, Homo sapiens
gcctccaaagtgcaatgtctgcagacattttttattgtcacaacttggtgagaaggatgctgctaaccatcct

SEQ ID NO: 14868 - DNA, 71 bp, Homo sapiens
ggtcgatgctcctggcccagggcccacaatttgggaaccactggtctgacctaaaggcgtcaccaaccgca

SEQ ID NO: 14869 - DNA, 70 bp, Homo sapiens
gctgtctccgactgttgccttcccagagggactttcaacagtctctcagtcgtgtgacctactttgtcta

SEQ ID NO: 14870 - DNA, 70 bp, Homo sapiens
gtaggtgtttgcatggaggtggtctcagctggaggactcctggagtctgcccaaaggattcccatgacct

SEQ ID NO: 14871 - DNA, 73 bp, Homo sapiens
cttcctgaggcctccttagaagctgagtagatgttgacatcatgcttgttgtacagcctgtggaaccgtgagc

SEQ ID NO: 14872 - DNA, 71 bp, Homo sapiens
atgaatgctcactgtggctaaggtgggctgggcagatggacagagggggcctgtgctgggttgggtgggca

SEQ ID NO: 14873 - DNA, 74 bp, Homo sapiens
atttctcatcccttgcaacattgatgctactctgagttcatattcccatgaagatcatgttcttggaaggatga

SEQ ID NO: 14874 - DNA, 72 bp, Homo sapiens
accttattggacccccacatctatcctagtccttcacaaacaacctgaagacagattagatgtattcattga

SEQ ID NO: 14875 - DNA, 72 bp, Homo sapiens
ctccatagagaaacgctgcccgtgtaacaatgcagttacgcaacccggtgcatgacacatgaattgcagcgc

SEQ ID NO: 14876 - DNA, 71 bp, Homo sapiens
caaagctgaagctggttaggtaccattaaagtagaacagaaaaaaatttggtagccaggaagccagagtca

SEQ ID NO: 14877 - DNA, 72 bp, Homo sapiens
tcaaatgataacaagtgtttgtgagggtgtagagaagagggtgcccttgtacactgttggtgggaatataaa

SEQ ID NO: 14878 - DNA, 71 bp, Homo sapiens
ttattatacaaaagtcctactgatgtggtgaggaggcacttatgtgggagaggaaatgttcgataatcctg

SEQ ID NO: 14879 - DNA, 70 bp, Homo sapiens
taatgactaatgatgtatcttttgcacatttaaccaaataagagatgtgcaaaagatacgtcactagttt

SEQ ID NO: 14880 - DNA, 74 bp, Homo sapiens
gtgatctgtgcgtgtgacagctgtctgtgccggctgtgtgcaccagcgtgcaaagcttcctcaggccagtgcac

SEQ ID NO: 14881 - DNA, 74 bp, Homo sapiens
ggatttgttaaaattacagcagatccatgcatggtcaataaagaacaaaatgcatgtgatctccaggcgccgtg

SEQ ID NO: 14882 - DNA, 71 bp, Homo sapiens
agctagaagcgcatccgagagcgcgggtgaacggctgctgctggaaacccgtggacggtgtgacgcatgct

SEQ ID NO: 14883 - DNA, 70 bp, Homo sapiens
tgtggctaccaaggtgatgttggccagctcactaaaaaccttaacatcattgactgactcttgtgagcca

SEQ ID NO: 14884 - DNA, 72 bp, Homo sapiens
gtgctgcagcccccggcacctctgttgaatgggccttgctccaaagacacaggtgaggcggcctgggctccc

SEQ ID NO: 14885 - DNA, 73 bp, Homo sapiens
ggaggtgcatggcactcacttactggggcaagacaatcagaaggcttgacccgatttggctggtggtcacccc

SEQ ID NO: 14886 - DNA, 72 bp, Homo sapiens
cgaatgtcttgctgctggggacactggctctgtgtgacgccagtgccttctggcagcctctgggccagtggg

SEQ ID NO: 14887 - DNA, 72 bp, Homo sapiens
ccatcggaggttttccaagtgcaaaaagatacattgttttgcaggttggaggccaagtctggatctcagatg

SEQ ID NO: 14888 - DNA, 74 bp, Homo sapiens
gcagggccctgtggactcagttctggtcaggacacccatggtactgggctccttccataggttggccctgtgct

SEQ ID NO: 14889 - DNA, 74 bp, Homo sapiens
tcgtgtagcaaggcctggtcaccatggcagggtcacagttactgatgctgccccactgggcgtgggcaccatgg

SEQ ID NO: 14890 - DNA, 73 bp, Homo sapiens
gccggcgccttggccggcactgctcctattcataagcctcggtgtcctacggggcagaggccctggtgccagc

SEQ ID NO: 14891 - DNA, 71 bp, Homo sapiens
gttatacaggacttaggtttatggtgggagagatccccaatgtgacttctcttctcccctgtcaccctgtg

SEQ ID NO: 14892 - DNA, 72 bp, Homo sapiens
gcatgcacacacacggactctttctcatctagcatatattagtctgcacattgtggctgatgtattctgccc

SEQ ID NO: 14893 - DNA, 71 bp, Homo sapiens
cacctggatgccaattggcttatcagactgggaagacttggagctgagcggtgttgtctggtagccttgtg

SEQ ID NO: 14894 - DNA, 70 bp, Homo sapiens
accagaatgagttgagttggtaattagtttaaaccaaaacaaatgatttcgactcattaaattttaggac

SEQ ID NO: 14895 - DNA, 70 bp, Homo sapiens
aagtgttttatgcttcatatggctaagttgtagtttggcagagttaacagcataagaataaacatgctgt

SEQ ID NO: 14896 - DNA, 73 bp, Homo sapiens
atcatcgcacaggggctcctagcctaagaaagtgtcagcagcactgccctgctgcgcctggaatgggcctcct

SEQ ID NO: 14897 - DNA, 71 bp, Homo sapiens
taaatgaggataggaaggcttcattagttagcgatgacattacctatcctgaacctgtcactcagtcccag

SEQ ID NO: 14898 - DNA, 74 bp, Homo sapiens
acttattctggattccgtgggttgtcttataagcaatcacatgtgactttataagacagacacacagagaagag

SEQ ID NO: 14899 - DNA, 74 bp, Homo sapiens
acagcattcaccactggctgtttattcagacgagtaccaatgatgttaactcctgagaaccaccagacattgaa

SEQ ID NO: 14900 - DNA, 74 bp, Homo sapiens
tgtgtggtttttttttttaagtgttagatgtttttgatattttaaaaaagcatctaggctgcttgtggaagtca

SEQ ID NO: 14901 - DNA, 73 bp, Homo sapiens
ggacttgccattcctcatgatttccgggctacagagtcatcattagcagagagaatcgtgagagaagagaacc

SEQ ID NO: 14902 - DNA, 74 bp, Homo sapiens
ggcacaaatacctaactgaatctctaggggcttcaattcctgaaaacctcagaggtgggagaattcacgagtgt

SEQ ID NO: 14903 - DNA, 70 bp, Homo sapiens
ccagaatctagtgaatagaggctaaggatgctgttgctgaacagcctctgatgcacagaacagcccccac

SEQ ID NO: 14904 - DNA, 74 bp, Homo sapiens
aagaagttgctgcacctccaaagttttgttctttccactgaatattccactattaggtcagcaggctcattctt

SEQ ID NO: 14905 - DNA, 72 bp, Homo sapiens
tcaaacattgctggtagaaatgtaaaatggtgcagccactttggaaaaccgtttggtaattcctcaaaatgt

SEQ ID NO: 14906 - DNA, 73 bp, Homo sapiens
aataccagtggttacaggtgcatgccaccatgcctggctaattttgtatttttagtacagatggggtttcacc

SEQ ID NO: 14907 - DNA, 70 bp, Homo sapiens
agaagccctgccctatagggatgtcagaggtcatctactcccatcacctgtttgggaggcgctaagatga

SEQ ID NO: 14908 - DNA, 72 bp, Homo sapiens
ttttggtgttttagactgtggtccagaaatataaattacattctttgacaccatctgcatagccagcctttc

SEQ ID NO: 14909 - DNA, 72 bp, Homo sapiens
gtgtgcagggatctattagcaatgtctgctatagatacagaagctaggattggtgacacttgtgccaagtat

SEQ ID NO: 14910 - DNA, 73 bp, Homo sapiens
tttgttagctatggagactttttagaggatacgaggtgagtaagactggcctattctcaagaaacctgcattc

SEQ ID NO: 14911 - DNA, 72 bp, Homo sapiens
aatttccttggccaagctgtattatcatctctatatatcatatacatgagatgatatatatatgtacataga

SEQ ID NO: 14912 - DNA, 73 bp, Homo sapiens
aagttattgggcagagaccttctgtctgagctaaaaggcctgatatgatttgcctctaacagagacttgactc

SEQ ID NO: 14913 - DNA, 72 bp, Homo sapiens
aagagtgtagaatgagatgtgaaaactatgctgtatttctacccatctcatcccactcgactgtgtttaata

SEQ ID NO: 14914 - DNA, 72 bp, Homo sapiens
acaacatagcatatagatccaaatagatgagtgagttccaacttattagaaatatgtgagatgtagtgcgtg

SEQ ID NO: 14915 - DNA, 70 bp, Homo sapiens
acagaaaatgaaccatccctgagaccctaggaacaaatgcctgctcaaggatgaggttgaacctgtccaa

SEQ ID NO: 14916 - DNA, 72 bp, Homo sapiens
aaatctttcacaacacttttatttttgtctcagtgaccagctcttgccatgtggtcacacctggatgaagga

SEQ ID NO: 14917 - DNA, 71 bp, Homo sapiens
tgtgataatcctgactcctcccttcctaacatgttggctcaagctagtggtggttctgggtgttacatcca

SEQ ID NO: 14918 - DNA, 74 bp, Homo sapiens
cacatacatatacatctatacatgtgggtatatatacacatgtacatgtatgcacatgtatatatacatatgta

SEQ ID NO: 14919 - DNA, 73 bp, Homo sapiens
ataaacaatcaggtgtagcttatcatacctgcaaaccaaactgcaggaagcatggctgcaacttggtctcagg

SEQ ID NO: 14920 - DNA, 73 bp, Homo sapiens
atcaggaagttgataatcacattgggtcctctgcacttattggcgcagttgctatttttcatgagcaattctg

SEQ ID NO: 14921 - DNA, 74 bp, Homo sapiens
gctgaccccatctctagtcttacctcatcagcccaacacttaactgtcaatagagggttgggttctgcttaaat

SEQ ID NO: 14922 - DNA, 72 bp, Homo sapiens
tctcacatactactgctgcaaccatgatgcacgaaagaacactttctgcctttaacatttgtggtaagtatc

SEQ ID NO: 14923 - DNA, 70 bp, Homo sapiens
gcttgcagaacagcctcagatgcccaacaagggtgcttactggtggctgctgccatagttccttcaatag

SEQ ID NO: 14924 - DNA, 71 bp, Homo sapiens
aaccaaccatgttgttgctcatatgtgaagtcaacagcactaagacattccataacatgagcaggttcaga

SEQ ID NO: 14925 - DNA, 72 bp, Homo sapiens
tgggtttatgttgcccaggtaaccaatgaagaaacagaagcataacttggggatcctgaatgcccagtccca

SEQ ID NO: 14926 - DNA, 71 bp, Homo sapiens
cctctgggtgggctccaggagacactggctaactcccttacttagctgcacaatcctgggctggatttaag

SEQ ID NO: 14927 - DNA, 74 bp, Homo sapiens
aataatccccagtacgaggtccatctccagtcaacaggggacagctggtcctaggtttggttgcattcagcctc

SEQ ID NO: 14928 - DNA, 72 bp, Homo sapiens
ggggaagaatagattgttctcaacacaaatattttgctatctactgaatgtcaaggtgtgggaataaaacta

SEQ ID NO: 14929 - DNA, 72 bp, Homo sapiens
tgccacatttccaatggctgctggctccctctacttctagtagactctcatattggcttaaaagaagtgaaa

SEQ ID NO: 14930 - DNA, 72 bp, Homo sapiens
cacaaaatattatcactgcagcatgtaattaatataaaattgttaatgagatgttgcacattcactttgttg

SEQ ID NO: 14931 - DNA, 71 bp, Homo sapiens
ctactgacatcttgggttggatacttctctgttgtgggaggttgacctgtacattgtaggatgtttatcag

SEQ ID NO: 14932 - DNA, 73 bp, Homo sapiens
tcattgagctgtagttcctggcatacgaatgcttaatgtccaaaaatgcaatgtctgccacccagataagtga

SEQ ID NO: 14933 - DNA, 73 bp, Homo sapiens
gtgctgggattacaggcatgagccactgagcccagctggctatatgtccataattttaaagattacaaatgac

SEQ ID NO: 14934 - DNA, 72 bp, Homo sapiens
gaggcaagagaagcagtaaagaagtgctcacaaaattctcaggaccctatgaacacttctgaaaaaggctta

SEQ ID NO: 14935 - DNA, 73 bp, Homo sapiens
ggtgtgaggtctgaggtctgagtcctaggagatctgggaacaggtgatagtcaatgtcaaaaaccccattttc

SEQ ID NO: 14936 - DNA, 72 bp, Homo sapiens
ggtacaactccaaatttttcatttgagtaactgggtgattaagagtttcatgaaccaaccaggtgtggtgcc

SEQ ID NO: 14937 - DNA, 73 bp, Homo sapiens
gtcagtgattgtaactgtcattcctagaacttgtgtggttcttttcatattatttgtggtcatatataatgat

SEQ ID NO: 14938 - DNA, 73 bp, Homo sapiens
agtcatctgaatagtctgactatttggtggtacctaattacctaaacagaagatccagaattgaaacagatgg

SEQ ID NO: 14939 - DNA, 73 bp, Homo sapiens
ctgccagtgtctgtgtgtcaggaatctgggcgtgggttacttgggttttctggttctagaacttttacaaggt

SEQ ID NO: 14940 - DNA, 71 bp, Homo sapiens
atgtaaagtaatctgagactgtttgtgtagttaggagagagtataggatccacacatgcactcagactggc

SEQ ID NO: 14941 - DNA, 73 bp, Homo sapiens
aagatcgtaatactaaatattcagccaagtgtgacttgcctaaagccacatagctagtaagtggaaaagctga

SEQ ID NO: 14942 - DNA, 70 bp, Homo sapiens
tccacttgcccaggcctgagaagatggggggggcctttggtctcagaccccagatccttgtccttccagg

SEQ ID NO: 14943 - DNA, 72 bp, Homo sapiens
tcttcttcctcaacgacccaccaacctggaggggcttataggggtccatctccaccacaagggccctccagc

SEQ ID NO: 14944 - DNA, 70 bp, Homo sapiens
ctgcagtggggggcccaagtcagtggagtagatactgtttacagccaagtcaaggcctgattggcaggca

SEQ ID NO: 14945 - DNA, 74 bp, Homo sapiens
ggggacaggcgagaggtgagtctgtggcatgagctgcacagcaggcacagccaggcctctgatccccaccccag

SEQ ID NO: 14946 - DNA, 73 bp, Homo sapiens
ctggggcggcggcgcccgccgggccttttgaagtctccgctgggggcggggagggggcgctgaaggcggcctt

SEQ ID NO: 14947 - DNA, 74 bp, Homo sapiens
agctggcacgcatgggcactgctctgggccagtcacaggcagactcatgacatccgcagtgcagtgctgtgaag

SEQ ID NO: 14948 - DNA, 70 bp, Homo sapiens
gtgggcgaatcacttgaggtggggagtttaagaccagcctggtccacatgaggagacccagtctttacta

SEQ ID NO: 14949 - DNA, 72 bp, Homo sapiens
tcacttgacactgtatggctcagttcagctggaagcagttttctgttttcacctagtgtcctgtggatgaaa

SEQ ID NO: 14950 - DNA, 73 bp, Homo sapiens
aaattctatggtttctctgagtaatcactgaatcatctctttattacagtgaaacttcacagtgccattattt

SEQ ID NO: 14951 - DNA, 70 bp, Homo sapiens
ctatcccaaacagaaaggaaggggtagaacagagttctcttctctcactcagatcctctttttgaccaaa

SEQ ID NO: 14952 - DNA, 73 bp, Homo sapiens
tgtaaatgtttaaatatataatatgcatttgtatgtatactacatgtgtatacatatttgtatatttaaatat

SEQ ID NO: 14953 - DNA, 73 bp, Homo sapiens
tgtccttcacctgttagcctaagttgaccttaaggaaacctcagaaggccctggctagagaacaggatcgagg

SEQ ID NO: 14954 - DNA, 73 bp, Homo sapiens
agtcagacaaattgatttcaactctcagcctcctcaaacatggaaacttagcagacttggagctccatttgtt

SEQ ID NO: 14955 - DNA, 70 bp, Homo sapiens
gttcctatattatcaccaaacctactgacctctttgagcttatcggcttgaagagtcagggagtcaacag

SEQ ID NO: 14956 - DNA, 73 bp, Homo sapiens
tcaggtgatcaccatacctctgagcctcaatttccctatctgttaatttaaataagggtgttggtatgtcacc

SEQ ID NO: 14957 - DNA, 70 bp, Homo sapiens
ctttcaatttcagggatcgcaattaccagggcaggagttagtaacagccatgcctggaatgcttaagtga

SEQ ID NO: 14958 - DNA, 74 bp, Homo sapiens
gctgtgcaaaggctcacaggggtgattgtgccttgcatatttgaggaagatcatagaggctaatgtgctgggtt

SEQ ID NO: 14959 - DNA, 73 bp, Homo sapiens
tgagtggtggctgtctagagatagttgtggccctattcttgtgtgaggtgagaagatcctctaatggtgactg

SEQ ID NO: 14960 - DNA, 73 bp, Homo sapiens
cctcagtcagtcagcagggcttggcctggaggtcaggcctctctgtggctcagactctacccttgtcattctg

SEQ ID NO: 14961 - DNA, 73 bp, Homo sapiens
ccatgcatgtggcattcagatgctgagtcccctgggttggggtgtgggggttggggttgacaagtcagactta

SEQ ID NO: 14962 - DNA, 74 bp, Homo sapiens
cagaagcagagtgactggatacttcactcaggatctcatcagactgaaattaacgggtcatctagggctgtggt

SEQ ID NO: 14963 - DNA, 72 bp, Homo sapiens
actgggggctggtgttcatcgacaagtgatcaacaaagcttatcaggagtctgttgacatttgcctcctttg

SEQ ID NO: 14964 - DNA, 74 bp, Homo sapiens
gccaatagcaccattactttagttgtgacaaccaaaaatgtctccagacattgccaaagtcccctggggtgggg

SEQ ID NO: 14965 - DNA, 72 bp, Homo sapiens
tggattcaagtcaaggtactgccatttatcagtggttagaccttatacaatttattcaacaccattatcttt

SEQ ID NO: 14966 - DNA, 73 bp, Homo sapiens
ggctagcaaggtggggggcgtactccagacagatccagagatgtcataactgaaagggtccttatttcacaca

SEQ ID NO: 14967 - DNA, 71 bp, Homo sapiens
ttgctcccacaagctattttgatctttggaatctagtccctacctctggactcagactgcctctagcgtgg

SEQ ID NO: 14968 - DNA, 72 bp, Homo sapiens
taggaagcaggaacaatgcccagagttcctgagcttggggcaaactgtcaggggactggggcaaatggtcaa

SEQ ID NO: 14969 - DNA, 74 bp, Homo sapiens
catcctggccaatcagaaccttccctgggactttttcaccagcactgttggggaagatgctgattttaggccag

SEQ ID NO: 14970 - DNA, 72 bp, Homo sapiens
actctttggcaccacagttacggggaatcaggctgattctagccctcaggataccctgtgcacagtgacaaa

SEQ ID NO: 14971 - DNA, 74 bp, Homo sapiens
gctgccagatgccacagtttatggggcccatgcctttagaggaaagaacattgtgcagtgcatcccatgctagt

SEQ ID NO: 14972 - DNA, 70 bp, Homo sapiens
cccctaataaaaaataagacaacaaactggctgtgtctcacagtctgcttagttgggtattagaccttgg

SEQ ID NO: 14973 - DNA, 70 bp, Homo sapiens
ttcttagcagaaactttacaggcttgtgggatgacatagtcaaagtgctgaggaaaagaaacatccaacc

SEQ ID NO: 14974 - DNA, 74 bp, Homo sapiens
gcaggcccgctggccgaggcactgccgaggccgtccgagatgggagctggcggtgcctccttccgcgccctcgc

SEQ ID NO: 14975 - DNA, 73 bp, Homo sapiens
ggtaggccagaattgtgatacagctggggtctatgcaggcgattcctccaccctgtatctctcctagtgagtc

SEQ ID NO: 14976 - DNA, 70 bp, Homo sapiens
atcgatattcctgggccccagcctcagcaattctgatttaatcgatctgagatgagacctgggcatgtgt

SEQ ID NO: 14977 - DNA, 72 bp, Homo sapiens
attgagcttttggacctgtgggtttataattttaataaaatttggaaaatatttgcccattatttcttcaga

SEQ ID NO: 14978 - DNA, 73 bp, Homo sapiens
ctcaggctcgggttgacagcggcagtcaccgcatcgagacggggtccgggaagggacaatcgccggccgagcc

SEQ ID NO: 14979 - DNA, 74 bp, Homo sapiens
ccatcaggggctagatgggggtcaggaggccaccctagcatggtctctgacctccatttctcacccacagtgaa

SEQ ID NO: 14980 - DNA, 74 bp, Homo sapiens
gcaaatacctgggtatgagggagacatcattgcagttgtctgcctagcatattggagtctagtttgccctttta

SEQ ID NO: 14981 - DNA, 72 bp, Homo sapiens
ggaaaaggccttgcccaccccaccacgggttcggaccctcaggatagctggcacaatgtggatgtaggaggt

SEQ ID NO: 14982 - DNA, 73 bp, Homo sapiens
gtcttattgcattaggtaggatttccagtatgatgttgaaaagccatggtgagagggagcattcttatcttgt

SEQ ID NO: 14983 - DNA, 72 bp, Homo sapiens
acccgaggcctttataagatgctgcttggcatatcaaaaagaagattgatttgatgtgcaccagctggcaca

SEQ ID NO: 14984 - DNA, 73 bp, Homo sapiens
tgcttactaccctttagtcactgagaagcaaatccaagcttatcagagtgtacttgaactgaggtcctgacca

SEQ ID NO: 14985 - DNA, 72 bp, Homo sapiens
agtccagggattctcaagccaggtcagcaaaggggctcttcctctaatggcccctttcctggccatcgatcc

SEQ ID NO: 14986 - DNA, 72 bp, Homo sapiens
accactgttccagccactgtcgtcctgagtccacggggattcaatggccccttcgatgtaccacgggctcat

SEQ ID NO: 14987 - DNA, 72 bp, Homo sapiens
aacactggcttcttaacgcctgcctctcgctctctctagataccttggagagccaggcagccttcagcagct

SEQ ID NO: 14988 - DNA, 74 bp, Homo sapiens
caccacggcgggcggcagccggacagcaggctggccctgtccgtccgtcctcctcctcctccccgccctggtgg

SEQ ID NO: 14989 - DNA, 89 bp, Homo sapiens
ctgatggctgcactcaacattcattgctgtcggtgggtttgagtctgaatcaactcactgatcaatgaatgcaaactgcggaccaaaca

SEQ ID NO: 14990 - DNA, 73 bp, Homo sapiens
tccttttcacagtggctcctggaacacaagttcaattatcagaaaatctgtaacttgaaccttttctggagag

SEQ ID NO: 14991 - DNA, 71 bp, Homo sapiens
tcctgtcatcccagcgaggcctccgaccctgcaaaaggctgtgagaaaagtgcctgctgctggggggcctt

SEQ ID NO: 14992 - DNA, 72 bp, Homo sapiens
ctctttatcttactgttccatctcacctgagcctctccctgtctggagtgctctgaggctcctgatggatct

SEQ ID NO: 14993 - DNA, 72 bp, Homo sapiens
catgtgattagagtgttggggctttgagggagctggagattgagttcagtcataaggccaatgattcaatca

SEQ ID NO: 14994 - DNA, 73 bp, Homo sapiens
taaaaatgtaaatagtaataatagtagctgttgttgacattgttgtcattattattcttattattgagacaga

SEQ ID NO: 14995 - DNA, 72 bp, Homo sapiens
cagctttgaccaccactcccgcccccaaccatgacacttgagtgcaggtgtctgatctctgcggtgtaagcc

SEQ ID NO: 14996 - DNA, 73 bp, Homo sapiens
ctgtggctcagagaattacactgttagcccaaggcctcagcttaggtttcagcctctgtcttggaagagccac

SEQ ID NO: 14997 - DNA, 74 bp, Homo sapiens
gtttttatgagtgtttgtgcaaatacatgcatttgatgtgcatttgttttggttagtaccgctttatgtaggag

SEQ ID NO: 14998 - DNA, 72 bp, Homo sapiens
gtcacctgtcagtacagggccacagggtgtgtccgtggactcccttgtgtttccccagtacttggtggtggt

SEQ ID NO: 14999 - DNA, 71 bp, Homo sapiens
ccgcgaggcccgcagagcgcgcccgtctcgccgcgcattccagccgcgtgattgacgcgcgtaccggggcc

SEQ ID NO: 15000 - DNA, 71 bp, Homo sapiens
tccacctgacctagtggccacactaaggtctgcagcctgacctctgcggcctctgagtggacagacactgg

SEQ ID NO: 15001 - DNA, 73 bp, Homo sapiens
acttgaatctgagaggcaaaggctgcagtgagctgagatcacgccattgcgctttagcctgggcaacaagagt

SEQ ID NO: 15002 - DNA, 72 bp, Homo sapiens
ttacaatgcaaattgtctgagggggcacagaaatgttttaaccagcagaactcatccccacatagttgtgat

SEQ ID NO: 15003 - DNA, 70 bp, Homo sapiens
agggaggctggtggtataacgcctgtgcccactccaacctcaacggggtctggtaccgcgggggccatta

SEQ ID NO: 15004 - DNA, 72 bp, Homo sapiens
gcagcacccctgccctggctcaacagcttcacacgatcacatgcggtcaaataaggccaggatgggaaggga

SEQ ID NO: 15005 - DNA, 72 bp, Homo sapiens
agtaaaccccagcttaggaaacagggttgttcttcatgtggatgactctgtgccgaaagcatgggaacagcc

SEQ ID NO: 15006 - DNA, 73 bp, Homo sapiens
gggccagggtggcagactccagccctttgggatctgtctgtgggctgggtgcactggggctggctgggggccc

SEQ ID NO: 15007 - DNA, 72 bp, Homo sapiens
gagcttgctctgaaagctgtcctgttcctggcctgagctgggaactggggacaaagcagtgacatgagccct

SEQ ID NO: 15008 - DNA, 74 bp, Homo sapiens
ggacaggctgcagccctccctggggttgcaaagactcccagcatggacagtgatgacagcctggctgagctctg

SEQ ID NO: 15009 - DNA, 74 bp, Homo sapiens
gcccggccaggcagagcagttttaagaacgaacaaggaggagccccagctgatgggcgaggccaggctgatggt

SEQ ID NO: 15010 - DNA, 72 bp, Homo sapiens
gtctcctgattcctttgatctgaccccaccagggtgggggacatgtggcgtaaagggcagtgattgtgactg

SEQ ID NO: 15011 - DNA, 71 bp, Homo sapiens
accaactcggggggggcccgggcatcccgacgtcggccctaggggtgcaggcccagggctcccggccccga

SEQ ID NO: 15012 - DNA, 70 bp, Homo sapiens
agatgaagacaccagtggaaagttttgagatttaacttttaatcatcttgccatttccccaactgacgtc

SEQ ID NO: 15013 - DNA, 73 bp, Homo sapiens
cgcggacgcccgctgccatggcgactctgctgcgccctgtcctccgtcggctctgcgggctcccgggcctaca

SEQ ID NO: 15014 - DNA, 74 bp, Homo sapiens
ccccctcccccgaccaaggaccagagcttgattcccaggctccagcaggctcctgggtacctcggggctagcag

SEQ ID NO: 15015 - DNA, 71 bp, Homo sapiens
atttgaaatgagaataaggggccgggctcacgtctgtaatcccagcactttgggaggctgaggcaggcgga

SEQ ID NO: 15016 - DNA, 72 bp, Homo sapiens
ctcgaactcctagcctcaagtaatccgagaatcgcttgaacctggaagccggaggttgaagtgagccatgat

SEQ ID NO: 15017 - DNA, 74 bp, Homo sapiens
tgaacatttctccaaggcctgtgatgggaatctgaggcactggcctgtctgacagcaaggagtaaatgaccctg

SEQ ID NO: 15018 - DNA, 71 bp, Homo sapiens
cctgtactcccagctactcaggaggctgaggcaggagaaatgcttgaatccaggtggtggaggttgcagtg

SEQ ID NO: 15019 - DNA, 73 bp, Homo sapiens
gagcccagcaagcactcgggctcctcccacagtgtggcctcggtgagcagcaggtgccagggctccagggctc

SEQ ID NO: 15020 - DNA, 72 bp, Homo sapiens
ggatgagtttcaggcctcaggaggtgtaggggagcgcctgcagaaggggctggagcgtcgggccaggaagac

SEQ ID NO: 15021 - DNA, 71 bp, Homo sapiens
catcttgaatggggctgggtaaaatgaggcaagacctactgggctgctgcattctcagacggttaaggcat

SEQ ID NO: 15022 - DNA, 72 bp, Homo sapiens
gcatcccgccccacaaataccactacatcgacgacctggtggtcatcctgccccagaacgtctgggagcacc

SEQ ID NO: 15023 - DNA, 72 bp, Homo sapiens
gcgttgtcccccagcatctgtagtaaagggtaacttcctttaacaggaacgcttttgtcatggcctgggcac

SEQ ID NO: 15024 - DNA, 73 bp, Homo sapiens
ctctgtgagatgcgatgtcaccatttctcagctccgggtgccctgaccatgcggctgggggggggagctcctt

SEQ ID NO: 15025 - DNA, 73 bp, Homo sapiens
ccctactgacctgcaggccaggggtccctgcaggggacacagggtttccatccttcagccacatcagtgtggg

SEQ ID NO: 15026 - DNA, 73 bp, Homo sapiens
agcaacccagtgttcactgatggatgaacggatgaatgatatgtggtccatccatacaaaggaatatgatttt

SEQ ID NO: 15027 - DNA, 73 bp, Homo sapiens
gctggctgagttgaacgagggcgttttggccccaggacttctgtgggccgcaacctttctggagggcatgcac

SEQ ID NO: 15028 - DNA, 74 bp, Homo sapiens
tgcaggtccagtgttcctgactgaggtccggctcacatccgcccggccagggctttccccgccagcctcctggg

SEQ ID NO: 15029 - DNA, 70 bp, Homo sapiens
ctggagccggcgggagccccgcgctcgccatgtcgggcgagctcagcaacaggttccaaggtaggcgccg

SEQ ID NO: 15030 - DNA, 73 bp, Homo sapiens
gaggatagcttgagtctgtgaggttgaggctgcagtgatcctgcagatcgtgccactgcactttaggcttggg

SEQ ID NO: 15031 - DNA, 74 bp, Homo sapiens
gagcccgcggcgcaagcggagccggcccgacggcaggcgccgggccagggagccgcgcagcccttgcagccgcc

SEQ ID NO: 15032 - DNA, 72 bp, Homo sapiens
gagtgggcatggtgggagagcagcagccagctcctgggggtgggttagcaggtgcttttatggggccctgga

SEQ ID NO: 15033 - DNA, 70 bp, Homo sapiens
aaatataattcccctcttagggctataacaactttgtatctggagtctagtctggacacgggagccaccc

SEQ ID NO: 15034 - DNA, 72 bp, Homo sapiens
ttgcgccgcgcgcgccgctcgccccagcctcccggcctccgggcctcgctgcctccccgcgcccggcggcgt

SEQ ID NO: 15035 - DNA, 71 bp, Homo sapiens
tgcatttcctcattaagtcctatcctgtgaggatcattgtccccatgacacagatgaggaaactgaggcca

SEQ ID NO: 15036 - DNA, 74 bp, Homo sapiens
tgctctgagggctgctgggtttctgtttgccagccgtactcgtgtgtgagctcttctagcctttgatggccctt

SEQ ID NO: 15037 - DNA, 72 bp, Homo sapiens
agtcagtgctcagaccctcaaaaggacagatccatttgtccagtctgctgcacggtctttataaacgatcat

SEQ ID NO: 15038 - DNA, 72 bp, Homo sapiens
ctttttttcgggtggcccagtgttcagaagcaaagtattcctgtgttgctggaaggcagagatgctctcgtg

SEQ ID NO: 15039 - DNA, 74 bp, Homo sapiens
tgtaggtcagaaatctggtatgggtctaactgggcttaggtcaaggtatcagccagagctgtagttctcacctg

SEQ ID NO: 15040 - DNA, 73 bp, Homo sapiens
gtcgagtcactgggtcccaggaaccactgttttggagagttcatttgtttcccacagccctgcactccaccgc

SEQ ID NO: 15041 - DNA, 65 bp, Homo sapiens
taggtcggtgcaaaagtcatcacggtttttaccattaaaaccgcgatgacttttgcatcaaccta

SEQ ID NO: 15042 - DNA, 74 bp, Homo sapiens
aggatctgggtgaggcaggcggcaggggttggtatccgagcagggatccgaggctgtccccagcctcggcctct

SEQ ID NO: 15043 - DNA, 73 bp, Homo sapiens
ggctctgcgcggccccgttgtcattacagggactccgtccctggggaaacttcccacgtgtcagaaccttccc

SEQ ID NO: 15044 - DNA, 72 bp, Homo sapiens
gagaacagggtgggggtcactttgagtttatgggcaaatgcctggatgttggtttaaaggacacagtgggaa

SEQ ID NO: 15045 - DNA, 74 bp, Homo sapiens
gagcttctggagcgcaggtactgggtcttgctaagtgaactgtttcccaggaacacctctcgggcccatctgcg

SEQ ID NO: 15046 - DNA, 74 bp, Homo sapiens
ggctctgctgctccacccactctcgctcccctctgtgccctgactcagcaggaacagaggcttgagctccaggc

SEQ ID NO: 15047 - DNA, 72 bp, Homo sapiens
ctgccagggggacggtagcagctgcacccacgtgacgggcaactatcgcaaggggaatgcccaccttggtaa

SEQ ID NO: 15048 - DNA, 73 bp, Homo sapiens
cagcttctcggcctccaggtgtctcgagcgtcactgccccccactgcgcccgcccccgccccgtgctgtccag

SEQ ID NO: 15049 - DNA, 72 bp, Homo sapiens
cgggctccgggacgcgggcgggcggctggagggtgcgccccgggcctccgagacgcgacctcaggaggcgcg

SEQ ID NO: 15050 - DNA, 71 bp, Homo sapiens
tccaccagccagcagcatctcatctgcttggggttctttagccagcaggctgacttatgctttcgctcccc

SEQ ID NO: 15051 - DNA, 73 bp, Homo sapiens
agcctggcgggagcgcgcgcgcggggcggggggcggggcgtcggtgcgcgcgggcaggtcggccccgcccggg

SEQ ID NO: 15052 - DNA, 73 bp, Homo sapiens
ctgggtgagggctgctgggtgcctggagcgcgtatgtccccaccggggcaggccagccccgcactccacccgg

SEQ ID NO: 15053 - DNA, 70 bp, Homo sapiens
ccggcgcggccggcccgggcccgggcggcggggagccggcggctgcggtggcggcggcggcgcgcggagg

SEQ ID NO: 15054 - DNA, 73 bp, Homo sapiens
ggaccaagtgacggcctctctatccaccccagcgtggcgcatgctcagggccctggtacccagaggccttttg

SEQ ID NO: 15055 - DNA, 73 bp, Homo sapiens
ggtgggaggtggagtcggcaagggctgggtcaaggcttcggaacttttctcctggtttccagcaactcctgtt

SEQ ID NO: 15056 - DNA, 71 bp, Homo sapiens
ctaagactagtctgcctcactgggtttcgggcgtgcttggggcctgttatcctgtcttcttcaccagttat

SEQ ID NO: 15057 - DNA, 71 bp, Homo sapiens
cccctggacatgtggatgcagcttcagagctggataatgggtagaggctggaaaagttttgaggtgtgtgc

SEQ ID NO: 15058 - DNA, 70 bp, Homo sapiens
cgaggcgtcttcggttccttctgctgggcttctgctcgctgagaggttactggggaaacctccaagagtc

SEQ ID NO: 15059 - DNA, 72 bp, Homo sapiens
gacaggaagaaggctggaccacctcactcccggcttctggggtcttcccgggtgagggctggctaccaagta

SEQ ID NO: 15060 - DNA, 74 bp, Homo sapiens
aaagcaccgcagcttgtcacaagtcgggggaccctggggtctcctctctctctctcccccgctccccaggctgt

SEQ ID NO: 15061 - DNA, 74 bp, Homo sapiens
gaccatacccaagaatgactaagggcagtttggaggttacactgttataagttttgcaaagatgtgtggttttt

SEQ ID NO: 15062 - DNA, 70 bp, Homo sapiens
gcctggcgtgtgcacacgcagccagagggccaggggggtcccacatctggccgaagggcttcgaggcaca

SEQ ID NO: 15063 - DNA, 71 bp, Homo sapiens
cctggcctggccctgctccctaactgtcccccaggaaggcctggctggggagggggcaacaccactatggg

SEQ ID NO: 15064 - DNA, 73 bp, Homo sapiens
ttaccgcatagcacgctggactagagcagtgcagtcctggcgttgatctcggccactgtgcgttttgtacatg

SEQ ID NO: 15065 - DNA, 72 bp, Homo sapiens
gacaccctcgtgtggattgtggcacatggacccagtccctgtcaccctagtccaacatggtcaggtgccagc

SEQ ID NO: 15066 - DNA, 72 bp, Homo sapiens
ctctgcactccagcctgggtgactgagcgacaccctgtctcaaaagagcatgggttcctttggtccccccaa

SEQ ID NO: 15067 - DNA, 70 bp, Homo sapiens
aggttgctgatttttggaactagttctcgagtctctaaaggactcagtaaggtcagctaagaagcctgtc

SEQ ID NO: 15068 - DNA, 74 bp, Homo sapiens
ggggacccgactcacaagccaggtgtcacaggaggcgactccagggcactgctcgctggaagcaggtagggccc

SEQ ID NO: 15069 - DNA, 74 bp, Homo sapiens
ctgccaggaggcccttgtggtcaaaccgttggcttttgtggggcacagtggcatgggctttggctggcagccac

SEQ ID NO: 15070 - DNA, 70 bp, Homo sapiens
cggggcaggactggcccggggccagggcggaggtacccacccctcccggcgcatctgcgcagctgcctgg

SEQ ID NO: 15071 - DNA, 73 bp, Homo sapiens
aaatcttcactgctgtcaacgcaaaactgttcaatcaacaggaatatgagttgtgtgttttgtgaaattagca

SEQ ID NO: 15072 - DNA, 74 bp, Homo sapiens
ggggtcccaggcggttgggcctgtgccctccggtgcgcgaggggcccggccccgcccggctgcacctctctcag

SEQ ID NO: 15073 - DNA, 72 bp, Homo sapiens
ctgccgagggggccctggcctggatccatgctgggcagaagcagctggacactgaccaggaccccccagggc

SEQ ID NO: 15074 - DNA, 73 bp, Homo sapiens
ccatttccaggggtgtaaaccaggtgcccacgatcatatcagtggtgaggggcaaaacccaagtgggcctaac

SEQ ID NO: 15075 - DNA, 73 bp, Homo sapiens
gcctccggcgcgaccgctctccaggagtcagcgccgccatcttggcgccggctcggcgggacgggaggggtgc

SEQ ID NO: 15076 - DNA, 70 bp, Homo sapiens
aggctctgctggaaaggcggccgccgcctctgtgtgatggtgtctgttcggatggcgcatgctcccctcc

SEQ ID NO: 15077 - DNA, 72 bp, Homo sapiens
ccacggcctcgcaccttcttctcctggcttgccagccagaggcgctgaggtgtgctgggtgcactggagcca

SEQ ID NO: 15078 - DNA, 72 bp, Homo sapiens
ccccgtccctgcctgactcgggacacagagcccagggcctgggagtgctcagggcaggagacgcggcagatg

SEQ ID NO: 15079 - DNA, 74 bp, Homo sapiens
gctggacaggggtgctgggcttgcctccccccaccgcccgctgggagccctgatgatgcccactcctgagcttc

SEQ ID NO: 15080 - DNA, 73 bp, Homo sapiens
ctgggaggaatggcaaccatgaactgttgtccagacctttgccccagcaccctcagagggggcctgcctccca

SEQ ID NO: 15081 - DNA, 72 bp, Homo sapiens
gctggcgatggtgtgcctccgacgttcccctcgggcacggggagcccgccgggcatcccctgagtccgcctc

SEQ ID NO: 15082 - DNA, 71 bp, Homo sapiens
ggtcccaaggcgcctccccacgcgccgcagcactagctcgcccgccgcgccggggcgccttttaccttctt

SEQ ID NO: 15083 - DNA, 72 bp, Homo sapiens
gcctcgctctccggggtgtgctctgctggccaccctgggtgatggtcgctccccgtcctcccaccctgaact

SEQ ID NO: 15084 - DNA, 70 bp, Homo sapiens
cccccacctcagggtcagcttgccgtggggccgacccccagcgcctctgccgtacccctggtgggccgag

SEQ ID NO: 15085 - DNA, 70 bp, Homo sapiens
tcgccgccgaggcgggcaccctccactagagccccacgtgcccaggggggcctgtgcctgtcctctggct

SEQ ID NO: 15086 - DNA, 74 bp, Homo sapiens
atacagcccttacgcggttcccggtattttgtgcagtatgtgcacggtaccgtgctgccatatgcggtgtgtat

SEQ ID NO: 15087 - DNA, 70 bp, Homo sapiens
ttgctgtccagttttccccttcaccaattcacacgaggtcacgagcctggcagctgtccgggaaagctga

SEQ ID NO: 15088 - DNA, 72 bp, Homo sapiens
tctgcctgtgaaatggcaaaagcagtgccactcctagagtcattaggaggattcttggtatgcgtcaggtgc

SEQ ID NO: 15089 - DNA, 72 bp, Homo sapiens
tgctggtttcgtaggatcttatcgggacctcactcatcttttcactaggaaatcagacactgcaaaggactt

SEQ ID NO: 15090 - DNA, 72 bp, Homo sapiens
cgctccttacatgtagaatgtggaactgaatcgcagctgttactgttacgtaatccagggatactaggaagt

SEQ ID NO: 15091 - DNA, 74 bp, Homo sapiens
tccattcctcgtcctacagtgttaaagatagaaccttactctagggagtaggagctttacatggtgagagagag

SEQ ID NO: 15092 - DNA, 73 bp, Homo sapiens
aagttgatggaatggagcagcattgcgtgacgccaatcactgattcacttatgctttctatgtggtttttccc

SEQ ID NO: 15093 - DNA, 72 bp, Homo sapiens
tgaagagcgttactggcaccaggtggatggaggccaggaagctgctgagagtcctacagtgcacaggacagc

SEQ ID NO: 15094 - DNA, 70 bp, Homo sapiens
agcaccgcgggtcgcggctaagggctctgccatgcacatggaaccctggggcctcctccttctgcccaga

SEQ ID NO: 15095 - DNA, 72 bp, Homo sapiens
gagagagcagtgccacgtgaagtcaccttgggaagaacgggcccacctagagtgtgaactcagagcagaggc

SEQ ID NO: 15096 - DNA, 70 bp, Homo sapiens
agagctagcagcaatgcccagccagtccctctcatgccggcttctttttctgtttctctctctttcacct

SEQ ID NO: 15097 - DNA, 73 bp, Homo sapiens
tatctgggtttgacattcgttttactcacagcaaatcagaattgtgctgcaagtgcctgtcctggacttccca

SEQ ID NO: 15098 - DNA, 72 bp, Homo sapiens
caatggcagggcccagaagtgcccgtcagctctgacactgacccactggcatggttgcagaaccctccattg

SEQ ID NO: 15099 - DNA, 72 bp, Homo sapiens
tggcagggcctcgctgactgatggcagtttatgtttgattgttttgagaaactgccaactgtttcccaaagt

SEQ ID NO: 15100 - DNA, 73 bp, Homo sapiens
catggctgctggtgggacctggtggtctgacaacagaacaccacaagacatccctcagggaccgtgtgtcctt

SEQ ID NO: 15101 - DNA, 70 bp, Homo sapiens
ccctttcctgggctctcctgcctgctgcgccaccctcccccaaacacagcctcagacccatggtgcccac

SEQ ID NO: 15102 - DNA, 72 bp, Homo sapiens
gcgggtcccccaatagctgatggcgaagctgtgaattcagacccccacttcgcttgagcagtgacgggaagc

SEQ ID NO: 15103 - DNA, 72 bp, Homo sapiens
agaagctggaagttaagggcaggcccaccttaggtaagcaaagcctggctgtgggaagcagctgcaaggggg

SEQ ID NO: 15104 - DNA, 70 bp, Homo sapiens
tgccaatagcactgggtaataaacacgtaagttattgtcatgggtgatttgcaaacctgccagcaaggca

SEQ ID NO: 15105 - DNA, 74 bp, Homo sapiens
aaatggactgtcgcatgattctaggtctagaggaagctgattgctgctactggaagggtcaggctttgaaggac

SEQ ID NO: 15106 - DNA, 73 bp, Homo sapiens
atacacaggtgtgtatatctgttaaatgtggtaatttacatacccagcagcattgtatgaaagtgtatgattc

SEQ ID NO: 15107 - DNA, 73 bp, Homo sapiens
gactgaatcaaccacatactctatgcagtcaaacatgtgcattagatacgtgaagattggcatggatctcaag

SEQ ID NO: 15108 - DNA, 72 bp, Homo sapiens
ccatgtggccagtgctctgtgagccacagtcacttgtgacgtttgtcaacatgggtgctggaaccaggaatc

SEQ ID NO: 15109 - DNA, 71 bp, Homo sapiens
aaaattttatatttattttaaaataatgttttcagtattggctgagtaagctcatactgaattgacccttc

SEQ ID NO: 15110 - DNA, 72 bp, Homo sapiens
gtgaattactgttggaggtgatgacagtttaacagattgtgagacactgtcattaggtcagcaagttacggt

SEQ ID NO: 15111 - DNA, 72 bp, Homo sapiens
tttctcattaggtccaattagtatggtgtcaccaatatatggatccatgcgattgattatctgtggagtgtc

SEQ ID NO: 15112 - DNA, 71 bp, Homo sapiens
aacagcgagggcctttccagcaactgccacggactgctgggtaggaagctgcgctctcctcacgctgggca

SEQ ID NO: 15113 - DNA, 72 bp, Homo sapiens
tgcaagccctttgtcgctccgcttccacgtatgggaatttatcctaagggaagagtcttgggcacaaagacg

SEQ ID NO: 15114 - DNA, 73 bp, Homo sapiens
tacaaactcagtctgtctggcctcaaagactgtactcttaaccacagtgtacactgtctcacctgccgtacag

SEQ ID NO: 15115 - DNA, 71 bp, Homo sapiens
ttatttgttttacggcctctaacattttattttgaaagggactagtctttaaaacttggctgtaaaacaaa

SEQ ID NO: 15116 - DNA, 70 bp, Homo sapiens
agtaaggcctgctatgcccagaacctacccaaaatgaaagtctcaaagcacagtggagccagctgtttca

SEQ ID NO: 15117 - DNA, 71 bp, Homo sapiens
agaaactttatctgaggctggtccgagtgcagagtgtcaattgatcacaaccagttgcagatctcttttct

SEQ ID NO: 15118 - DNA, 72 bp, Homo sapiens
agtgcttcttgggaaaattatattaaaccatcagcagcagcatcatatgatggtttgatctctatcgttcat

SEQ ID NO: 15119 - DNA, 72 bp, Homo sapiens
atttctagatatagttgctggaatgtgtgtctattagtttagacaatcacattgccaaaagcaaagtcctct

SEQ ID NO: 15120 - DNA, 72 bp, Homo sapiens
tgcccattcttctgggctggcttggcatgaagagcaaataacagcagtgttaatccccaggatttggaaggg

SEQ ID NO: 15121 - DNA, 73 bp, Homo sapiens
ggatggttatcctggattattcaagtggactaaatgtcatcaaaagggtccttaaaagtagacaggggagatg

SEQ ID NO: 15122 - DNA, 70 bp, Homo sapiens
ggtgacaacatggcagggtcaggagtcctcacagtagtcaagcgtccgctccctgcagttcagatcacca

SEQ ID NO: 15123 - DNA, 72 bp, Homo sapiens
tgatccttcctatgctggatcttagtacagtcactcttcaaccacgggtaggatcagattcacaagacacct

SEQ ID NO: 15124 - DNA, 72 bp, Homo sapiens
tacactgagatgggatgagtgccacaggatgcttaaaagctgcctgttaaaaattcaaattcagggcagaag

SEQ ID NO: 15125 - DNA, 71 bp, Homo sapiens
gaaagaagtaaccacactgctaatgcagttagtgtggctgccccacatgagtactgtgagcactgagggat

SEQ ID NO: 15126 - DNA, 70 bp, Homo sapiens
ttagcctaagttcctgaaaaatgacagcagtgtcacctatgtcagtagcaatggcattttattgagcttt

SEQ ID NO: 15127 - DNA, 72 bp, Homo sapiens
gaacattcatcattaggtcctgctcaagtctggggaatcagaaatggcttttctggggaaatgatgttcaag

SEQ ID NO: 15128 - DNA, 72 bp, Homo sapiens
ctcacactcacaggcagttcatggggtgaaaggcaacgtgccagccccacagtcaaaggagcctgggcctga

SEQ ID NO: 15129 - DNA, 70 bp, Homo sapiens
cagatgcatagacaagaggccatgattaagagctcctgctaaggactctgaattgtaccctgtaagccaa

SEQ ID NO: 15130 - DNA, 70 bp, Homo sapiens
tctgttgttgaagccactcggtctgtggtattttgtaatagcagcccaagtagactcatacaatggtgaa

SEQ ID NO: 15131 - DNA, 71 bp, Homo sapiens
cctggtgcctctcattttaatctctttctgcaagtcgcttatgatgaaagaggtttcttgagagtgtgtca

SEQ ID NO: 15132 - DNA, 72 bp, Homo sapiens
gagataattccgtgagaaaatgtaattgacaaccatatagtaggtcgagaagattttgacaaggacagtctt

SEQ ID NO: 15133 - DNA, 71 bp, Homo sapiens
gaggaaagtattcaacttttctaggccgcagcttcttcgtttgcagttgcctggtgacgcctcccctccac

SEQ ID NO: 15134 - DNA, 71 bp, Homo sapiens
acaaaactcatcagagcacttaccaaagtcagtggagagcagctggtatagggtgcgcgtcaggaatgagt

SEQ ID NO: 15135 - DNA, 71 bp, Homo sapiens
ctcagagagggttgacttgtaccagccatatcccacttaaggttctagagaatcagacagtcaaaaccctc

SEQ ID NO: 15136 - DNA, 71 bp, Homo sapiens
gttagagctagaatttgatttaattcgggcccgtgagagcaggatctttgtttaattcagtgctgtatcct

SEQ ID NO: 15137 - DNA, 74 bp, Homo sapiens
agggtgtcatggagaggggctacatgtgatgaatattaacatcacctgcgagaagtcatgttgataatgtaccc

SEQ ID NO: 15138 - DNA, 72 bp, Homo sapiens
gaccatatagggtaacttatgaatgttgccatggcatttgtaaactgtcatggcactggtatgagtttcctt

SEQ ID NO: 15139 - DNA, 73 bp, Homo sapiens
ctacaggcgcccacccccgcgcccggctaattttttgtattttttagtagagacggggtttcatttgccacag

SEQ ID NO: 15140 - DNA, 74 bp, Homo sapiens
ttttaaaaattttttgacatttctttgacatgttatttagaaatatgttgttaatgtccagatgttttgggatt

SEQ ID NO: 15141 - DNA, 72 bp, Homo sapiens
ctccacctcctctttctccacctaccccttgtagggaaggataggggcacacagctgacacaggtgtatctc

SEQ ID NO: 15142 - DNA, 71 bp, Homo sapiens
gggtcggcgagagcctcagagctggagcaaatagccgaggtaaaggtggacggtgtgagtacgctgccgat

SEQ ID NO: 15143 - DNA, 74 bp, Homo sapiens
aggtactaagtgagttgtcagtggttcaaataccctcaggggtcaaatggcaaatgttgaaatagctcttggac

SEQ ID NO: 15144 - DNA, 74 bp, Homo sapiens
aaagggcctgcctctcaatgatgccaccttgggaattaaatttcaacctgaggccaggcacgatggctcacgcc

SEQ ID NO: 15145 - DNA, 71 bp, Homo sapiens
ggagatgcctctttttgccaccaatcccttcgatcaggatgttggtaagtgtttttgcctctccctgccca

SEQ ID NO: 15146 - DNA, 74 bp, Homo sapiens
aggctggagtacaatggtgcaatcttggccccctgcaacctctgcctcccaatttcaagtgattctctggcctc

SEQ ID NO: 15147 - DNA, 71 bp, Homo sapiens
tcctgtttattcttgcctggatgatctattccatttagatagctagaacattcagtagctctcttgaggga

SEQ ID NO: 15148 - DNA, 71 bp, Homo sapiens
cagtctggagtcaacgtgggatgaccgagcttggtgggcatccgccattactgagtcttcaggaggctgtt

SEQ ID NO: 15149 - DNA, 73 bp, Homo sapiens
agagactcattgttaagggtttttatttagggctgatcacattgggtccctgatctttggaaccctgagtgtt

SEQ ID NO: 15150 - DNA, 73 bp, Homo sapiens
ttaaggttagactggacttcttcacatgtattttaatgatgaagctactaaggcccagtttaatgcggcccag

SEQ ID NO: 15151 - DNA, 72 bp, Homo sapiens
agtggtatcccattgtgattttgatttgcattttcatgacgactcatgatggtgttacatgatctttaatga

SEQ ID NO: 15152 - DNA, 73 bp, Homo sapiens
ttagcagagtagctgatactacccactgttctctatgatattgtggggcatatttagaaagcttcattgtgta

SEQ ID NO: 15153 - DNA, 73 bp, Homo sapiens
gtgattgtgcccaaactgagttgttaggatttttactgaaggagggtcaggatgattagatagcaagggtggg

SEQ ID NO: 15154 - DNA, 73 bp, Homo sapiens
ccacgcctggccgttttaatttttattattatacttcaagttctgggatacttgtgcagaacgtgcaggtttg

SEQ ID NO: 15155 - DNA, 71 bp, Homo sapiens
acttgcggttaaatgaagggtgcagagaaatttgagaaagtctcaaagccactcccatctctctggactgc

SEQ ID NO: 15156 - DNA, 74 bp, Homo sapiens
aggttagataacttatgtaaggtcatagagataatagcggccgagttgctacttgaacccagtttgtctgactc

SEQ ID NO: 15157 - DNA, 71 bp, Homo sapiens
gatgttttgcctaccttcactgcccttgagatgtcatcaattctgcgtcactgctgtgatctgataggcat

SEQ ID NO: 15158 - DNA, 73 bp, Homo sapiens
ggggtgagaaggagaggacaaagctaaagttgagagacattgcaaaagtcaaatccatgcaactgaccacaga

SEQ ID NO: 15159 - DNA, 70 bp, Homo sapiens
gcacacacatcaggtggggatttagctcagtgatcttgattctcgttgttcgatgcatttctgcttgata

SEQ ID NO: 15160 - DNA, 74 bp, Homo sapiens
tacacaagcacatggccattggttatcaatttgttcttcctcagaaactctcccttgtggtctggattgtataa

SEQ ID NO: 15161 - DNA, 73 bp, Homo sapiens
catttgaaggcatttcgggggtagacagagatttcctcgtgtccactgaatctcacttttatttagcctttgc

SEQ ID NO: 15162 - DNA, 72 bp, Homo sapiens
ggtggtgttctgccctctactatcacccctggaataaaaaatataggtgagaagacaccagtcatcactttc

SEQ ID NO: 15163 - DNA, 71 bp, Homo sapiens
gcagactgagcatgtttcagagccttcaaaagccttctcggaaagccccaggtggtgaaattgccctcaag

SEQ ID NO: 15164 - DNA, 74 bp, Homo sapiens
ctagagactgatggtggtcttattcagagggtgggtgggagggtgattgtgggtaagaaagccgttgggactag

SEQ ID NO: 15165 - DNA, 74 bp, Homo sapiens
tctgtccgtccgtccgtccgtccgtcctcaggcgcgctctccggggactgggggctgggctctgccagggcagg

SEQ ID NO: 15166 - DNA, 70 bp, Homo sapiens
catgtcctctaaggtttacaatctttgtgggaagatagaacatctgtcttaatattataagataaaacag

SEQ ID NO: 15167 - DNA, 70 bp, Homo sapiens
gtctggtgctgtatgcttgtctctatttcagttttgtgaactatgcctgggacctgccatgttaccaggc

SEQ ID NO: 15168 - DNA, 72 bp, Homo sapiens
ttcatataaatgctttgactcatgctgaaattgctgttcttcagtttgcaatttgagtttatgtgtgtgtat

SEQ ID NO: 15169 - DNA, 73 bp, Homo sapiens
agcgccttccgacggcggtgactgcctcgttgaacggttaggactgctggacgaggcgccggcgctgggaggt

SEQ ID NO: 15170 - DNA, 70 bp, Homo sapiens
tgtctgagtactactttgatgggaaagggaaagcctttcgaccaattattgtggcgctaatggcccgagc

SEQ ID NO: 15171 - DNA, 72 bp, Homo sapiens
acattgcctgtgtcattcatgatccttctctatgatctgtgtttatggagtagatctatgtatagcctctct

SEQ ID NO: 15172 - DNA, 71 bp, Homo sapiens
gctggacgatgcacccctgccggaggaggaaacccccgaacccacggccatctgcaggcaccggcaccgct

SEQ ID NO: 15173 - DNA, 74 bp, Homo sapiens
tgtctgctatttattcccagtgttcagacttgctcttaataactgtgcaaagaattacttggtgaataaaagca

SEQ ID NO: 15174 - DNA, 73 bp, Homo sapiens
ggtggcggtgcaagttgaaaaggctttgggacacctttagccctaaggcaggctttccagagtcatgctacct

SEQ ID NO: 15175 - DNA, 72 bp, Homo sapiens
tttgactaacttgagagagaatataagagttgacacatgcctttctacatctcaagaagagtatagattgct

SEQ ID NO: 15176 - DNA, 73 bp, Homo sapiens
ttgctggtgtttggtgtgttctataggcagcatttcagtatgacttactctaaactgaaatgttttggactcc

SEQ ID NO: 15177 - DNA, 72 bp, Homo sapiens
gcccttctgggctcatctctgtctaactgctgctcaagaccaactatccaaccttcacattgtccagagggc

SEQ ID NO: 15178 - DNA, 72 bp, Homo sapiens
tgataacaccttggtacttgtccattagtatctttttatagacttggggatatgtggacaaatgtatcttat

SEQ ID NO: 15179 - DNA, 72 bp, Homo sapiens
actcataagatgttggctgtcggtacagggatttccatcctaaaccttgcttgctaagattttatcatgaat

SEQ ID NO: 15180 - DNA, 73 bp, Homo sapiens
taaatatccaaataatgattgttattgatatcaacatacttataactgtgatgatgactgtaacaccattaaa

SEQ ID NO: 15181 - DNA, 72 bp, Homo sapiens
gtcctgcacatatagaacaatatactaagggaatggtgccatgttggactgttcgtttttctttggcttggc

SEQ ID NO: 15182 - DNA, 74 bp, Homo sapiens
aaacagttcaacatgtagcctatcatactgatgttagtgagtcagctgacattaatatatttaggcgattttga

SEQ ID NO: 15183 - DNA, 73 bp, Homo sapiens
gtgttggctccttaaccattgcatttcgtgacctgtcagctttccatcccaggacataatggaggttcccact

SEQ ID NO: 15184 - DNA, 73 bp, Homo sapiens
actcaggacacgggaatgagaggcttggagagtcccgatgtcatctcttccattggcttttttcttcccttcc

SEQ ID NO: 15185 - DNA, 70 bp, Homo sapiens
acaacagggaaaatttctttatttcatttttttatcattattacttttgagacggagtcttactctgttg

SEQ ID NO: 15186 - DNA, 74 bp, Homo sapiens
ttgagccaggcacggtagcttgcgtctgtgatcccagcactctgggaggctgaggtaggaggattgcttaaggc

SEQ ID NO: 15187 - DNA, 71 bp, Homo sapiens
cctcctcccccgccacctctggagctgaggttagcaaagccgtgcctacatcagctgagctggggagtttg

SEQ ID NO: 15188 - DNA, 71 bp, Homo sapiens
aaattgtccagtttttccagcttagacgttactactattagtaggagtttagggtcaattctctggacaac

SEQ ID NO: 15189 - DNA, 71 bp, Homo sapiens
tttgaaaattctatgcttatcagactgatgctgaaaagttatttagtctagtaaaaaagcatttctgaaaa

SEQ ID NO: 15190 - DNA, 72 bp, Homo sapiens
agaatggtgcctccagcaatgtgagtgagagcactggtattttcctgactcataaggacaggagtgtgccgc

SEQ ID NO: 15191 - DNA, 72 bp, Homo sapiens
acttcacagagaaacttgagtgtgtcggggaacttcattcacgtcccacctccccatacctgcaggttcact

SEQ ID NO: 15192 - DNA, 73 bp, Homo sapiens
agcctttttgaaaacaacctccacaaggcttgtcagtccagttttccctaattgtttacaagctataggctac

SEQ ID NO: 15193 - DNA, 72 bp, Homo sapiens
ggtaaagatcgactctaatgccataatagcaggaaacatcaacacagcagcattggacaggtcatctagaca

SEQ ID NO: 15194 - DNA, 73 bp, Homo sapiens
atgggaactctcactgtttgactttcccaagaatccccagaagggatgctttttaagtaaactatagggcctg

SEQ ID NO: 15195 - DNA, 73 bp, Homo sapiens
tttcttttctttttttggcttattgtcaacatgttgtgttgacacactttttagcctaaaacagagagaggac

SEQ ID NO: 15196 - DNA, 71 bp, Homo sapiens
ctctgaggactgccagcacgctgtcacctctcaaggtcttcacttcgatgttgctctcttagacaaatgca

SEQ ID NO: 15197 - DNA, 72 bp, Homo sapiens
catggtggagcagggagatggaaacctttcatggacagtttccggccttctaactttctctgattccttaca

SEQ ID NO: 15198 - DNA, 74 bp, Homo sapiens
gaggcaataatcacatgttgtggggacccaagtcacaaagggacctgtgggttgaaactgacagtttgagcggc

SEQ ID NO: 15199 - DNA, 70 bp, Homo sapiens
atcctaatcaacttatatttaggttcactgccaacttaaagttggtcatgatttttttgtgtgagaaata

SEQ ID NO: 15200 - DNA, 73 bp, Homo sapiens
cctgcttgtaacagcaacaggtagccagtcatctttttggaacctgctgacatctggttacatgggattgctc

SEQ ID NO: 15201 - DNA, 72 bp, Homo sapiens
gactccagccccagagtttctgattcagcaggactgatggggcctgaatatttacatttctaacagttccca

SEQ ID NO: 15202 - DNA, 74 bp, Homo sapiens
gggagaatcgcttgaacaagggaggcagaggttgcaatgagccaagatcgtgccactgggcgaaacctgtctcc

SEQ ID NO: 15203 - DNA, 74 bp, Homo sapiens
attgatcctgacaatgatttatttttgcagtttgcacagagcccttaaaaggagatatttcttgaaggatgaat

SEQ ID NO: 15204 - DNA, 70 bp, Homo sapiens
cctggtgctgcctttcttacttgtggtcatattgtccacaggtctctctcgtgtgtacacctgcccgtcc

SEQ ID NO: 15205 - DNA, 70 bp, Homo sapiens
agctggcatgccaagagatcaccgtgccgctgtgtaagggcatcggctacaactacacctacatgcccaa

SEQ ID NO: 15206 - DNA, 74 bp, Homo sapiens
accaaagtcaccgtgggctccactggctgccaatccagccctgccttgctgacttactgggcattggtttcgtt

SEQ ID NO: 15207 - DNA, 73 bp, Homo sapiens
tggcagttcctctagtatactgtctcagggctccttaggcatgtttacccatgagagcaggagaccggcagag

SEQ ID NO: 15208 - DNA, 70 bp, Homo sapiens
ttctgtgttagtttgctaaggataatgcactccagctgcatccatgtccctgtaaagaacatgatctcat

SEQ ID NO: 15209 - DNA, 73 bp, Homo sapiens
attttagtggtacaatttctcacaggcagccattttaaggtgttaagaatgaatgattttgtatccagttgaa

SEQ ID NO: 15210 - DNA, 71 bp, Homo sapiens
aagcactttattagaaggttgcagatttctgcagatttcctcaaagaaatctgaacaagacggatggaaat

SEQ ID NO: 15211 - DNA, 72 bp, Homo sapiens
tgggggaaatttttggtatgtatacatatatgtaccttatggttgtattgcacttgaaaattttcaaagcat

SEQ ID NO: 15212 - DNA, 70 bp, Homo sapiens
tgatcatatccgcagcagcagaggtaggtcttttcagagtctgctttacatcttacagtggacaaggata

SEQ ID NO: 15213 - DNA, 72 bp, Homo sapiens
tgtaaacaaacaaagcatagcttgttaaacttttatagctggctgagtcagccagttacagaagctgagcta

SEQ ID NO: 15214 - DNA, 72 bp, Homo sapiens
ttgatttctggcattttgagttttctgctacaattagctacattacttggtgccaaagatcagtggggaatt

SEQ ID NO: 15215 - DNA, 71 bp, Homo sapiens
gtgtctcgcccacccccgcggggcccgtccgactcgacgggtgagcccgtggttcccggctccgcaccgtc

SEQ ID NO: 15216 - DNA, 72 bp, Homo sapiens
acttgaaacacgtcggtccttaacttgttaactgagtagacaggctgatggctgatctaggtaaaggtttca

SEQ ID NO: 15217 - DNA, 72 bp, Homo sapiens
ttgcctaaggaggcattcaggaggggtagtacctgcaccctgtgctgcgccttcacttgctgccactacaca

SEQ ID NO: 15218 - DNA, 72 bp, Homo sapiens
gatcaggtcacagaagaacgttctcaagttaggtgggaaacagctggagactctgggatgtcctcaggacct

SEQ ID NO: 15219 - DNA, 70 bp, Homo sapiens
tcccacagcaatggcaggtcctgtcagcacccccgccccaacagtatggtaaatcctgtcagtgtccccc

SEQ ID NO: 15220 - DNA, 72 bp, Homo sapiens
tttcaatgtacgctgagtgtcgtttagaaagggagggagctcagtgttttttttttttttttagctgacctt

SEQ ID NO: 15221 - DNA, 73 bp, Homo sapiens
tgtgacacaggccgttggcatctgacacaatgcaatcgcagatgagactgatgttgacaacaactcccgtttg

SEQ ID NO: 15222 - DNA, 70 bp, Homo sapiens
acctcagtggcacagccttttgccaggcatgaagtccagggtcctcaggctggacgaggcgcatcctgag

SEQ ID NO: 15223 - DNA, 72 bp, Homo sapiens
ttacttgagatgaagcaccagcaagcctcagaactgagatctgaatccgctgctgagttctgcgctgtctag

SEQ ID NO: 15224 - DNA, 74 bp, Homo sapiens
ctgatttcaactgtgctaacaaggcaagcttgacctgtgtctttgcctgggttttagaaaaagaggaggcttca

SEQ ID NO: 15225 - DNA, 73 bp, Homo sapiens
tgaggctctacttgggagctcagttcagcagctgtgagccctgattatcagctctctaggtcctaggaactca

SEQ ID NO: 15226 - DNA, 73 bp, Homo sapiens
tgtctcagcattctcagtgatcttccctgggagtggattttgggcttcatggaggaaaatcctgcaagtggtg

SEQ ID NO: 15227 - DNA, 73 bp, Homo sapiens
gctgttgggagagttcagctcctgtggtcatgagactaaggtctctattttcttgctggttataaactaacag

SEQ ID NO: 15228 - DNA, 71 bp, Homo sapiens
tcctgcgcagccttaacctgagtggggtcccttcgcaggacaaaaccagggtggagccgccgcagtacatg

SEQ ID NO: 15229 - DNA, 70 bp, Homo sapiens
cccgagaggccactgtccctgtctggagccatgtccattctcaacatcagcctagcttgggtttgcagga

SEQ ID NO: 15230 - DNA, 73 bp, Homo sapiens
acagctcttcacagacctgcaggcacctgaaccccctggttctcctgcctgagaccctacactttgaacagct

SEQ ID NO: 15231 - DNA, 70 bp, Homo sapiens
aggaaggagcctggagactgtacagcactctagatgaggagtggtggtggcccagaccaggtgagcagtg

SEQ ID NO: 15232 - DNA, 72 bp, Homo sapiens
tgtacacctatatatcatatatatgagatatatacgcctatatatcatatatatgagatatgtacacctata

SEQ ID NO: 15233 - DNA, 74 bp, Homo sapiens
gggagagaaggacaggctcgcaggcgggctcaactgagtccgctgagtacatgccagtgttttcacatagaccc

SEQ ID NO: 15234 - DNA, 70 bp, Homo sapiens
aatgccctcttgcccataatgctaccacctctagagtactccctcacccctgggtggctgggcaccccca

SEQ ID NO: 15235 - DNA, 70 bp, Homo sapiens
atcttgggttagtgtggcaatgccaatgtacaccaattatttgtggtcacattgtgatgcctcagtctca

SEQ ID NO: 15236 - DNA, 73 bp, Homo sapiens
ggacttaaagaggaggctagataaagaacttaatcaagatcacctgctggcttcttgcctgggcctagcatct

SEQ ID NO: 15237 - DNA, 73 bp, Homo sapiens
ggaagctgaggcaggtgaatcattaggtcaggagttcgagaccagcttggccaacatggtgagaccctgtctc

SEQ ID NO: 15238 - DNA, 73 bp, Homo sapiens
tatggatatcaaattcttaaaagtgacaggttatatgaaatgtccaggaccggaaacactttagagacagaaa

SEQ ID NO: 15239 - DNA, 72 bp, Homo sapiens
aagattttggaagaggtcttgtggaggaatggcttcagcagtgggtctttataaaatccatctcccgagcat

SEQ ID NO: 15240 - DNA, 73 bp, Homo sapiens
tgaagagcagcacctaacagcgtgggcatggaatgacagattgcggcaggatgcacttttattgtacttctca

SEQ ID NO: 15241 - DNA, 74 bp, Homo sapiens
gggattatcctggattatatgggtgggctctaaatgtaactgcaagggtccttatgggagagaagcaatgaccc

SEQ ID NO: 15242 - DNA, 70 bp, Homo sapiens
atgtatatatatgtgtgcatatcgtatatatgtatatacacatatatatgtatacacatgtatatataca

SEQ ID NO: 15243 - DNA, 74 bp, Homo sapiens
taaatgaaaccacatggatagagaaatgacttcacatgactggtgagaaataccccaagtcatttgctccttct

SEQ ID NO: 15244 - DNA, 74 bp, Homo sapiens
tttatatgaatatatatgatatgatatatatatgaatacatatgaatatatatgatatatatgaatacatatga

SEQ ID NO: 15245 - DNA, 73 bp, Homo sapiens
aaaaagcaagccactcagtgcaatcaaggaagggtgagtttggcagtcctaattagatttcactttttggttt

SEQ ID NO: 15246 - DNA, 72 bp, Homo sapiens
aattatatgtaagtatatactacatatgtataacatatgtgggattatacatatttgttttgcttttttctc

SEQ ID NO: 15247 - DNA, 72 bp, Homo sapiens
atgggagaatagggaaacaaagcagctgggctgatcaggatcagctgacaaaggaaactccccattgcaggg

SEQ ID NO: 15248 - DNA, 71 bp, Homo sapiens
tgttttatctgcattcattacacttcagctcagcacagaagtgttgagtctagtgtacatatagaagagct

SEQ ID NO: 15249 - DNA, 70 bp, Homo sapiens
ttagaagaaaaggcctttgacactggtagcatctatgcagctttctgtaacagcagtcttctgttacttc

SEQ ID NO: 15250 - DNA, 72 bp, Homo sapiens
aactatgttttctatcattgacttttgtgatttcagcattccagtcgatgataaatccataaactgatctta

SEQ ID NO: 15251 - DNA, 74 bp, Homo sapiens
cgttagtcttcccattgggaagccgttcaatccttatggatcagaaaggaagagaatggccctgggagttctaa

SEQ ID NO: 15252 - DNA, 74 bp, Homo sapiens
agctcttgtgaatggattaatatcatcatctagggtgtgagttctcttgggagtgaatcagttttcacgggact

SEQ ID NO: 15253 - DNA, 71 bp, Homo sapiens
ttaaagcatatagggggatgtgcatagattatatgtaatattatgccactttatatgaagttcttgagcat

SEQ ID NO: 15254 - DNA, 72 bp, Homo sapiens
tatgctttgtcattaagaggatagaaaataggttaaatttaaaaagccaactcagaatgacgaagaaccaaa

SEQ ID NO: 15255 - DNA, 74 bp, Homo sapiens
ccataaaataattgctaataacactatctgaaataagtccctgcaacttagtgttgttctctgtcagatagtct

SEQ ID NO: 15256 - DNA, 73 bp, Homo sapiens
gaaattcagtacagtgctgtaacaccgtaactcagtgagctggggaagggcagtcagggagccacttactaga

SEQ ID NO: 15257 - DNA, 72 bp, Homo sapiens
tctgcagaagctgtgagaattactcagtgtcatttgcactgctgagtacagccaaagaccttattattagtc

SEQ ID NO: 15258 - DNA, 74 bp, Homo sapiens
acttctgtcagtttgtcaaattctttcaccgaccagttttgttcccttgctggcgaggagttgtgatcctttgg

SEQ ID NO: 15259 - DNA, 71 bp, Homo sapiens
ctctagcaaggttttcattaagtatgatgtcttcttctaggcattaagaaaatctttagataattgaatgt

SEQ ID NO: 15260 - DNA, 71 bp, Homo sapiens
ctcactcacctcgggatcctgccgactatgccaatctttgcaccttggcattggccacttgggtccctgct

SEQ ID NO: 15261 - DNA, 71 bp, Homo sapiens
agcagagtctcatctatcgcttttctatgagaacgttttgaggccctagaacgccggcactgtcttgcata

SEQ ID NO: 15262 - DNA, 72 bp, Homo sapiens
gcaagagcactgggatttggcagtgtctgaccgggagcactcccatgtctcaaactctggctccccaggaga

SEQ ID NO: 15263 - DNA, 70 bp, Homo sapiens
tccttcctgtgggccgggcctgtgaagcagtgatggcgagtgttgcagcagaagcaggccctgtcttacc

SEQ ID NO: 15264 - DNA, 71 bp, Homo sapiens
tctgtggtttaagctgctcagtctatggcattttgttatgcaaaccctggctgactaaaatactgtcagtg

SEQ ID NO: 15265 - DNA, 73 bp, Homo sapiens
gttgctgtatgggcttgcatgcctgagtcattgccgtaccactgggttcagggtggcatcattgtgctgcagc

SEQ ID NO: 15266 - DNA, 71 bp, Homo sapiens
cccctcagaagaacttggctcagttcaccaggagaaagccagacacagtttgagaagcaggctccagaaag

SEQ ID NO: 15267 - DNA, 74 bp, Homo sapiens
ccccgccccgtccgtgtcgctctcgctggcgctgtccgccatggccgcggcgggctggggaaaggaggaggagc

SEQ ID NO: 15268 - DNA, 70 bp, Homo sapiens
catgagaccaggatcttgaccaggatcttcccaagaaatgatccttgggaaaccagagatgaggtgatgg

SEQ ID NO: 15269 - DNA, 73 bp, Homo sapiens
aaactcccggtctgtaagaaagcattaccttaaaacccagtgcctgagtctgggctttcttcatggatcctga

SEQ ID NO: 15270 - DNA, 73 bp, Homo sapiens
atctaagcagcattgtacagaacttcccctttcttcccgtcttgtggcagggaggtatccagtgctgacttgg

SEQ ID NO: 15271 - DNA, 73 bp, Homo sapiens
agttgattttacttattttttacttttttgagacagggccttgctctgtcacccaggctggagtgcagtggtg

SEQ ID NO: 15272 - DNA, 72 bp, Homo sapiens
gctttcttgctggcccacctacctggatatataattaacttcagctctggaaggcttctgatagatttgggc

SEQ ID NO: 15273 - DNA, 72 bp, Homo sapiens
acagtgtctagaaacagcgttctaaccaacagtgatgaatgggcttgggcgtttgtttacccctgatattga

SEQ ID NO: 15274 - DNA, 72 bp, Homo sapiens
aaggtgggcttgttgacaaggaccatttcagaggtaaatgatttctgaggtagtagtggttatgagtgcaga

SEQ ID NO: 15275 - DNA, 70 bp, Homo sapiens
gaaaggggcggtgtacctccgattcgggcgtggttcccgccggggtcggcccccagggagtcgtcccctg

SEQ ID NO: 15276 - DNA, 72 bp, Homo sapiens
tatatgccctgagacttctttacacagttgtcatttgtacacctttaaaattaagtttcagtgtatacaaaa

SEQ ID NO: 15277 - DNA, 70 bp, Homo sapiens
aaaaaggatattttcttgtcacgagcctctaaattactggcacaagaagaatctgacatatgttcccagt

SEQ ID NO: 15278 - DNA, 70 bp, Homo sapiens
agagacacatgggcttgcatgtcagagccaaacagagctgcagagctctcctcggcctctcatgagtctc

SEQ ID NO: 15279 - DNA, 70 bp, Homo sapiens
aagcccttcgccacatctaatatccataggaatgttttaagctaatatggatgaattgctgaaggctcca

SEQ ID NO: 15280 - DNA, 74 bp, Homo sapiens
atggtggtggttacaagcctcaggtagcttctgagaaagtggctgcagtagaggcttgaaatagatagaaacca

SEQ ID NO: 15281 - DNA, 70 bp, Homo sapiens
agctgccgcccgtccccgcccccactccattccctgcgcaccccaggctgatgcagcgtagctcttaggg

SEQ ID NO: 15282 - DNA, 74 bp, Homo sapiens
ggttcagcagcaaactacaggtatggccacaggtttctccatggatagactacaccacctaccaagggtttgct

SEQ ID NO: 15283 - DNA, 72 bp, Homo sapiens
ctcatgtgtctaaatgccaggccactctttatagattccagtggggtcacattgccaggaatatgtcatatg

SEQ ID NO: 15284 - DNA, 72 bp, Homo sapiens
tatttaatgattagaggtcttaggattccatttcaataaggcagatttcaaaggagtcccttacttctgttc

SEQ ID NO: 15285 - DNA, 72 bp, Homo sapiens
gaggtgggaagggcacctagcaggactctggctttgcggacagtccctgtttccctttctttccttttcacc

SEQ ID NO: 15286 - DNA, 73 bp, Homo sapiens
agtcccttgatttaacccagtgtttctcagcgtgtggtcctcagatcagatggcattggtggtatcacctgga

SEQ ID NO: 15287 - DNA, 70 bp, Homo sapiens
tgttggaattttagagaaatgcacatgtctgggcctcatgcccaggcattgtggttcagtggatctcagg

SEQ ID NO: 15288 - DNA, 70 bp, Homo sapiens
aattacaataaaggactgcagaggcaagacagcaatcagaatagtctgactactgtagggctctggaact

SEQ ID NO: 15289 - DNA, 70 bp, Homo sapiens
agacataccctagactgggtaatttataaaggaaagaggtttagttggctcagttcagcatggctgggga

SEQ ID NO: 15290 - DNA, 73 bp, Homo sapiens
aaaaacaacctctcactaaatctgacttttctttgttttgagctgtgtcattgccaggtgtgaggtattgaaa

SEQ ID NO: 15291 - DNA, 74 bp, Homo sapiens
ataacaaacaagctttcaaatttcctggcaacaaaccagggaagagagttaaaatattttaaatcctattcggt

SEQ ID NO: 15292 - DNA, 72 bp, Homo sapiens
ggtttaattggacttacagttccacatggctggggaggcctcagaatcatggcaggagcctaaaggcacttc

SEQ ID NO: 15293 - DNA, 70 bp, Homo sapiens
aaaaggcctatttgtagaggcaagtgaatacatcattgtataagatgtagtcagatataagtggctgtga

SEQ ID NO: 15294 - DNA, 74 bp, Homo sapiens
tagcttcttaaggaatctggcagtgtcttagctagttgagtttggcttagggtctcttaaaaggttacagttga

SEQ ID NO: 15295 - DNA, 74 bp, Homo sapiens
cctatatggagagaagtactcatggtgctatactgaggcctcctgccaacagtcatgtgagtaagccaccttgg

SEQ ID NO: 15296 - DNA, 72 bp, Homo sapiens
tcctgcctggacgatgtgaatatctggggaattttcaagctccttgccttcacagtaccacctgcagggaaa

SEQ ID NO: 15297 - DNA, 70 bp, Homo sapiens
cttatggagtggtggcaactgttcttccaccttctggaatctcagttgacagtgttcccttcttcacttt

SEQ ID NO: 15298 - DNA, 74 bp, Homo sapiens
tttttctggtgatgaatattatatctgaccagcatatatagggaagaatagttgggccaggcatggtggctcat

SEQ ID NO: 15299 - DNA, 74 bp, Homo sapiens
agtgtcacagcataagaataagaggggctgggtgcggtggctcatgcctgtaatcccagcactttgggaggctg

SEQ ID NO: 15300 - DNA, 74 bp, Homo sapiens
tacatgaaagagagtttcctagttcagtgtgtttggataccatgtttaaacaggtttcatgagtgcagaggctt

SEQ ID NO: 15301 - DNA, 73 bp, Homo sapiens
caagggctagatatagagggcaaagcctgaaggctttccttagccacataatacccatttgagcctcacttca

SEQ ID NO: 15302 - DNA, 71 bp, Homo sapiens
agtcctgaccaagctgtaccgtaagaggtaataaaatacctctatgaagatgttttgggccttaccatcaa

SEQ ID NO: 15303 - DNA, 74 bp, Homo sapiens
cgactttgtgatgggtttatcaggacataagcatcggaagtcaaagagactctgaacccaacaacaaggagggt

SEQ ID NO: 15304 - DNA, 73 bp, Homo sapiens
atgcacaccatcagttctggggcccggttccttgactccttgcggcagtagcagggccttgggttagctagaa

SEQ ID NO: 15305 - DNA, 71 bp, Homo sapiens
tcatcaccatcatcgtggcaactaacaatcatttcccgccaagtgtgtgtcgggccccacattgagcccat

SEQ ID NO: 15306 - DNA, 70 bp, Homo sapiens
tactccctgtgaaaggctgctgtgtccctcatgagttcacagtggctaaagtgttgtggcagtggaggag

SEQ ID NO: 15307 - DNA, 70 bp, Homo sapiens
gtatccctctcctcgcagcgccacaactgcgcgcaccgacctccccacgccagacgcggcgtgagccagg

SEQ ID NO: 15308 - DNA, 72 bp, Homo sapiens
catttgccatggactcctggcctctcccacccctccttgctggctcgctcgcctgtcacatggttcctgctc

SEQ ID NO: 15309 - DNA, 74 bp, Homo sapiens
cttggttgagagccagggactgctggccattcacagatggcgcctgggcgaggcccctggttctagtcctggtc

SEQ ID NO: 15310 - DNA, 72 bp, Homo sapiens
accacccccacccgacccttgaggataaggcttaaggatatttacaggtaagggaagtgggatgatctaaat

SEQ ID NO: 15311 - DNA, 73 bp, Homo sapiens
cttaaacttagaaagtaacagaattggaagatccttagcttgccaaggactatccaatcactctccatttttc

SEQ ID NO: 15312 - DNA, 70 bp, Homo sapiens
ggcctctgctccggcctcacgtggctcctgaagctagcaggagagaggcaagatgctggcattcagctgc

SEQ ID NO: 15313 - DNA, 72 bp, Homo sapiens
cttaacttaccgtgctgttgcctggctgaccctgactatcacagatagggagctgactggccaacaacacga

SEQ ID NO: 15314 - DNA, 70 bp, Homo sapiens
cctcttagatatacaagaggccctgctccctacagggaaactctgttctcactctggattttctctcttg

SEQ ID NO: 15315 - DNA, 73 bp, Homo sapiens
tgtgttctttccagacagcaccactcagagctgaccggggcggggtgagaacacggagggtggagagaagaga

SEQ ID NO: 15316 - DNA, 71 bp, Homo sapiens
atttcttggccgacacttgggcctatcacagctcaaagtgtttgtgggttaactgaggcctatgatggctg

SEQ ID NO: 15317 - DNA, 72 bp, Homo sapiens
agagtgggaccctgtctaaaaaaaattaaaatgaatttagcaattttaaaaagggctcagtcccacaagtct

SEQ ID NO: 15318 - DNA, 74 bp, Homo sapiens
catgaatgatccagctatgctggtaaataagtgagggcaacattgtatcccaacacaggaaggggtcaaattca

SEQ ID NO: 15319 - DNA, 70 bp, Homo sapiens
gggaaattagggatagggagatttgagtgtatgcccattttctcttctccttatgccccacgttttactt

SEQ ID NO: 15320 - DNA, 72 bp, Homo sapiens
tccccaagctgccagccaggaggtgataaccaccctcccagagtttctctcggctctttttttaaaagtccc

SEQ ID NO: 15321 - DNA, 72 bp, Homo sapiens
gactatgtgagttcttgcttgttgaaaaaggactcggaagtcttgtgaggagaatgaaaatattttgatttg

SEQ ID NO: 15322 - DNA, 70 bp, Homo sapiens
attagcagtctgaggactttagaccaaagaaggaattcttgtataacattgtattactctatgactgtat

SEQ ID NO: 15323 - DNA, 70 bp, Homo sapiens
tctgtcttgtatttttgctttatttaagctaggctagcctccaagctggaagctgaattgacagttgaaa

SEQ ID NO: 15324 - DNA, 73 bp, Homo sapiens
aggttttagtcactgtgagtcaagcagtttatgccaccacagcttgctggcgccccttcacccattctcatcc

SEQ ID NO: 15325 - DNA, 71 bp, Homo sapiens
aaggctagaacagtgaagggtaactatggtcctgcttcacagtggagcctgcaatatcctttcctgatgaa

SEQ ID NO: 15326 - DNA, 73 bp, Homo sapiens
tggattcccttagttttgctagtctgtgaaatattttatttgtcctttatttctgaaggttagctttgctggg

SEQ ID NO: 15327 - DNA, 71 bp, Homo sapiens
tagggcatgtattgccatatcagttcaacagattaaaaaaataggctatatggccgggtgtggtggctccc

SEQ ID NO: 15328 - DNA, 72 bp, Homo sapiens
ctctgtcgatgaaggctgccgccgggtagaagaagacactgaggtcgaaggtgggcaggtcgtcggcctcca

SEQ ID NO: 15329 - DNA, 70 bp, Homo sapiens
attaaacatttattgggtacctattctatgccaggcactgtttaagtgctagtggttcagtggtaaacaa

SEQ ID NO: 15330 - DNA, 73 bp, Homo sapiens
acaagtgtaaacatccttgacagatatatggacctttttgctgtaagggatccctgtttgaaaccagggggtg

SEQ ID NO: 15331 - DNA, 73 bp, Homo sapiens
atgcgctcggaccctcggagtggagttttgagaaaagcgaacgcacgctgaccacgacccgcacccacgcagc

SEQ ID NO: 15332 - DNA, 70 bp, Homo sapiens
ggattttgcagtcctagaatatactatacactccacctagaaaagcttctagtgtaggtctgagatcttt

SEQ ID NO: 15333 - DNA, 72 bp, Homo sapiens
gagaacttgagaatttgggtcctggaagaactcacagagatgattcagtccagtagttcgcaaggttctaga

SEQ ID NO: 15334 - DNA, 72 bp, Homo sapiens
tcctcactgcagttctatgcaataggtagcattactaacccatctcacaggtgaggaaactgaaacacagag

SEQ ID NO: 15335 - DNA, 73 bp, Homo sapiens
atcttaactcattacatctgcaatgtctttatttccaaataagctgacattctgaggtactggggtttaggac

SEQ ID NO: 15336 - DNA, 74 bp, Homo sapiens
atagtttgcaaaatcattctttcctggattattttccatgatgtgagtttatcaatggacactgagcaggaaag

SEQ ID NO: 15337 - DNA, 72 bp, Homo sapiens
aagaagacccgaattagaaataccaccaaatcagcagtgaatttaccattgttctcttctggtatcctctag

SEQ ID NO: 15338 - DNA, 72 bp, Homo sapiens
ctgggggttggctcctaactgctgttcctcagggcagctacattttcaaataaaaacactaaatcccaaatg

SEQ ID NO: 15339 - DNA, 70 bp, Homo sapiens
acacctggagtcagttgataattcccctcatctctgaaaacagaggcagaggagctgaaaaataatttgc

SEQ ID NO: 15340 - DNA, 70 bp, Homo sapiens
ggatgccaggacgcggggctggtcgcccagcagctctgagatgctcccagccctgctccctgtggcagcc

SEQ ID NO: 15341 - DNA, 73 bp, Homo sapiens
gcaagatgccacctgaagcccctggggaagagggtgacatggtgtgtcagcaaacagtggcgtgttgggggct

SEQ ID NO: 15342 - DNA, 72 bp, Homo sapiens
agggtctcccactgtcacccaggctaaagtgcagtggtacaatcatggctcagtgcagacttgaactcctag

SEQ ID NO: 15343 - DNA, 72 bp, Homo sapiens
cttttcctttctctgttggctggccatggggaacctccataataccatatgtgagctgaggaagacattgac

SEQ ID NO: 15344 - DNA, 74 bp, Homo sapiens
ggccggctggaggtcgggcggcctctgcccttcggaaaccagggcatcgatcctgcccgccccgcgcccccgcg

SEQ ID NO: 15345 - DNA, 72 bp, Homo sapiens
aggtggggaggcaggaacacatgtgcagggcgggaacacaccagcgcagaggaagccaaggtgcagtgggag

SEQ ID NO: 15346 - DNA, 74 bp, Homo sapiens
ttgggccctgcccagctctgagccctgtgcctctaagaggtgagtggttgggtcaagcagggaagatctatgtc

SEQ ID NO: 15347 - DNA, 72 bp, Homo sapiens
tctgatgttaggctgtgacctacccagctgcccttgtgggcttggagttctctctgctacaggacagaccgt

SEQ ID NO: 15348 - DNA, 73 bp, Homo sapiens
gcctaggtcacacagcagtttagaggacagccaagtctgggctgcctggctgcctccagctgctgcctgatgc

SEQ ID NO: 15349 - DNA, 72 bp, Homo sapiens
cctccgcctctcgtgttcaagtaattctcctatctccgcctcccaagtagctggaattacaagcacacgcca

SEQ ID NO: 15350 - DNA, 70 bp, Homo sapiens
tcaccttaagagtaggatagaggtgtccagagctcagctcatcagactgatggggcctctcacatatccc

SEQ ID NO: 15351 - DNA, 71 bp, Homo sapiens
aggattggagggcagagacagaaatgccccgggctgactgtttccagcttgggctagcactggctggctta

SEQ ID NO: 15352 - DNA, 72 bp, Homo sapiens
tgctctttgaacctcagcttcctcatttgtaaaatgcaaatatctagtagctccactttgggccacagggca

SEQ ID NO: 15353 - DNA, 71 bp, Homo sapiens
agggcacagccttctactttccaggctcctctgggaaccacgaggaagagaggaggcgggattgtcttgtc

SEQ ID NO: 15354 - DNA, 72 bp, Homo sapiens
ttgcctgtgtgtatgtgtcagtttgtgtttatgtgtgtgtgtatacacacatgatgtacatataatctaaca

SEQ ID NO: 15355 - DNA, 73 bp, Homo sapiens
tatgctcagaaaaaaaaagcaagcttctttttctatgagacaatagtgtgtggcttgcatgggtgagtaagaa

SEQ ID NO: 15356 - DNA, 72 bp, Homo sapiens
ccctctgagtcaggcagggtatattttaagtcacagttacttgagaagtccctccccaaagcagatcacaga

SEQ ID NO: 15357 - DNA, 73 bp, Homo sapiens
ggaatctggaggtaagtagcaccagagtcggcttattcgactgctcaaacccattggtaagaaccctggttct

SEQ ID NO: 15358 - DNA, 73 bp, Homo sapiens
tgctctgggcaaatccatgacaaactgaagaaagcaagtatgttcagcaactgcagagagctgtgatatggtt

SEQ ID NO: 15359 - DNA, 72 bp, Homo sapiens
gagcagtaagtggctgaggctatacaagggaagcataaggtatccttgcagtaacagaaatattttgcatct

SEQ ID NO: 15360 - DNA, 70 bp, Homo sapiens
catagtctcactgaggacttctacaccatgtgttctcatgttgactcagtgaatagtaggcaaacattga

SEQ ID NO: 15361 - DNA, 72 bp, Homo sapiens
catcttgtcgagttcagaaatacaaactccctgggggagcctctattattttgagaatggcccagctgtgcg

SEQ ID NO: 15362 - DNA, 73 bp, Homo sapiens
atggggcagtgcaatgaatgggaaatggggaaaggacactttcccaggtattcccgcagactttctctcatgt

SEQ ID NO: 15363 - DNA, 74 bp, Homo sapiens
cctggcttgtccaggtagctggtccagtatcctgccacttctttgatcataggctttgtcctaagctgtagccg

SEQ ID NO: 15364 - DNA, 74 bp, Homo sapiens
gcacttagctgggggaaaaaatctgtggcacatgtttgtagtcatgttcaggcatctccctctgatactggggc

SEQ ID NO: 15365 - DNA, 73 bp, Homo sapiens
taggaaagttgtttgcagtctccgataataagagaattcctctaaagattcctttattgctttttcaactttt

SEQ ID NO: 15366 - DNA, 73 bp, Homo sapiens
tgggggccatgtgcctgtgggtggtgtgcctgcatgcgtgccaggcagggcatttggaggggccgagccccca

SEQ ID NO: 15367 - DNA, 72 bp, Homo sapiens
ttgggtgggactgttccttgggctgtgggagtctttgctgcaccacagggcgtttggcatccctcaccctgg

SEQ ID NO: 15368 - DNA, 70 bp, Homo sapiens
ggagctgctggggccttctctcggggccacgggggagcccgagaaacaacgggaagagggcgaagtgaag

SEQ ID NO: 15369 - DNA, 73 bp, Homo sapiens
ctaccagcagctttggctcagatcttttgcttcaagtccagtgggaaactcttgcaatgttctgagtcccagt

SEQ ID NO: 15370 - DNA, 70 bp, Homo sapiens
aagccagagggcccctgtaaaactagtctgaatggacggagtggttaagagcacagtcttcatttgcatt

SEQ ID NO: 15371 - DNA, 70 bp, Homo sapiens
ttcattataacattaaacattctcaggttccatgtacacctgagacaagtcttgtggagtatgtggtcag

SEQ ID NO: 15372 - DNA, 73 bp, Homo sapiens
acacaatatcatggacctagtaggtgctcagtaaacacttgcttaaaaaatacatgcataaggccagttattc

SEQ ID NO: 15373 - DNA, 70 bp, Homo sapiens
gcactcagcatgctgcccgacctcagatcagatgggtagctcttgttgttattgctataaacgggcacca

SEQ ID NO: 15374 - DNA, 73 bp, Homo sapiens
caagaggttcatgtgtgatttccttcagacagacaaacattcacaatcaggttgtctgagttcacagcctctg

SEQ ID NO: 15375 - DNA, 72 bp, Homo sapiens
gaacaaggtcgtttccatatgactcaatactggccaaacagctagccagtaagttatggggaggagggaaaa

SEQ ID NO: 15376 - DNA, 73 bp, Homo sapiens
aagtacagtgggcactattgtggattgatgggtcatgtcaacccagatttatgtttaagccctgtaaacattg

SEQ ID NO: 15377 - DNA, 81 bp, Homo sapiens
ctctctgctttcagcttctttacagtgttgccttgtggcatggagttcaagcagcattgtacagggctatcaaagcacaga

SEQ ID NO: 15378 - DNA, 74 bp, Homo sapiens
attactgaggttcagagttgtatagcttgcccaggcaggtctgtgtaatgtggaagaagactctgactcccagt

SEQ ID NO: 15379 - DNA, 70 bp, Homo sapiens
ctttagtcttttacttcttttttctttacaagttttttaaatagaaaagtagaagtaagaaaataaagca

SEQ ID NO: 15380 - DNA, 74 bp, Homo sapiens
tggaagtgagctgttaaatctggcagcatccaggagggcatcttcttcaacgcttaccccagaaatggccatgg

SEQ ID NO: 15381 - DNA, 70 bp, Homo sapiens
gacaccacaagggccacgccctaagagtaaagccccatgccttagggtaaagcctgctttctcagtcttc

SEQ ID NO: 15382 - DNA, 72 bp, Homo sapiens
aatctccacttctaacaagttcttgggtgatgctgatgctggtggttcagtaaccataccactccatgtgga

SEQ ID NO: 15383 - DNA, 71 bp, Homo sapiens
atctggcagcagtgtgatacatgaagtaaaatgggaggaaactcagctgggcgtggtcatgtctgtaatcc

SEQ ID NO: 15384 - DNA, 72 bp, Homo sapiens
cactcaaagtacctggtaatgcagacagatgcttctggaaccagggatcattttggatacaaaagttgctca

SEQ ID NO: 15385 - DNA, 70 bp, Homo sapiens
gtaggctgtggctctttctggcagaggacatttcatgccaacacttagcacgtgggctttcactgctgca

SEQ ID NO: 15386 - DNA, 73 bp, Homo sapiens
acttgatatccttcagtcggaggagtagtctgaagtagtagtagtctgactactcctgtgatgaaaggacata

SEQ ID NO: 15387 - DNA, 72 bp, Homo sapiens
taggtgctggacatggaaaatggatgctctggatggtccttcctttcgaggagctcacagtcaaatcaggat

SEQ ID NO: 15388 - DNA, 72 bp, Homo sapiens
ctcccttcaagtaatccaggctcctaaatgaggaactactcttagttctctagaaaccatgactgggccagg

SEQ ID NO: 15389 - DNA, 71 bp, Homo sapiens
catcctgctggggttgcggctggacgaggcgcagtgcgccacgctggcccggaccttcgagcagctcgtgg

SEQ ID NO: 15390 - DNA, 73 bp, Homo sapiens
cgagggcgtcccgtctgggtctgggaggcccgcccgcgccgcggagcctcggaggaaggtctggagccggggc

SEQ ID NO: 15391 - DNA, 71 bp, Homo sapiens
ccctctcaacctgcctgagacctgctgggcgtttcagaaaggcattaaaaaggctgggcagagtggctgac

SEQ ID NO: 15392 - DNA, 70 bp, Homo sapiens
gcaacatggtgaaaccccgccctacaaaaaattacaaaaattagctgggcttggtggcacatgcctgtag

SEQ ID NO: 15393 - DNA, 73 bp, Homo sapiens
aattctagtttatcagcatgatgttaaatgtcagtgccataccatgatgcagcaccatgacactaacgccatg

SEQ ID NO: 15394 - DNA, 70 bp, Homo sapiens
aagccacctgtttgtgactttacaagctattttcacaaagtatgtattccatattgtgtatggtcacaag

SEQ ID NO: 15395 - DNA, 71 bp, Homo sapiens
cagcctctatcagtttgtcaattacagtttatgttttcctactgcagcactgccagaggtttcagcttctg

SEQ ID NO: 15396 - DNA, 72 bp, Homo sapiens
cacaaagcattacttctgatcaaggaactcacttcactacaaatgaagtgcaatgatgggtccatgcttata

SEQ ID NO: 15397 - DNA, 72 bp, Homo sapiens
atataggttccaggaatcactgattccttccaatggtgatcttgttcaaatcccactcctgacaccatatat

SEQ ID NO: 15398 - DNA, 74 bp, Homo sapiens
acacaggttacaggaatcactgattccttccaatggtgatcttgttcaaatcccactcctgacaccgtgtatat

SEQ ID NO: 15399 - DNA, 74 bp, Homo sapiens
ataatcctgtctctccaagccagcttacccctactagaaacagaggggcactgagcctctggcctggtactgat

SEQ ID NO: 15400 - DNA, 71 bp, Homo sapiens
cctgctgtaaacatcctacactgattggaatagaatacatagttcttttcttccaacatggtgtgttctat

SEQ ID NO: 15401 - DNA, 71 bp, Homo sapiens
ctgagatgcctccatcccgccgctcgctccctccgccttcctctggctgctgcagaggtgcccctcctcgg

SEQ ID NO: 15402 - DNA, 72 bp, Homo sapiens
tttgattttcataatagcttcattaggtcaatagatcttactctactgtgaaggtgaggaaacagcccatgc

SEQ ID NO: 15403 - DNA, 73 bp, Homo sapiens
ttcgttcactgctgagtacaaacaaaatagtactgtactcagcactaaaaacaaacaacatggatgaacctta

SEQ ID NO: 15404 - DNA, 74 bp, Homo sapiens
ggcaggttggtcagcatttctcagtgtgataagattcccttaggaggaactgcactatctgacttattgctatc

SEQ ID NO: 15405 - DNA, 74 bp, Homo sapiens
tgaagagttatggcagctacagaaacaagacccaaggaaaaagcttctcccttgggccaacttgacatagattc

SEQ ID NO: 15406 - DNA, 74 bp, Homo sapiens
cgaatgccccgtccgccccccgcctcccggaccttgggccgccctcgggtggctttttccctgcgggccggagg

SEQ ID NO: 15407 - DNA, 72 bp, Homo sapiens
attaaccaatataatagctcagatctttcaaatgttgggtttggggtggggtgggaaaagtatcaaaaggca

SEQ ID NO: 15408 - DNA, 70 bp, Homo sapiens
tttttgtatatttgtagaggcggagtttccccatgttacccaggctggtctggaactcctaacctcaggt

SEQ ID NO: 15409 - DNA, 73 bp, Homo sapiens
cagagtagacctggttagcttatcactttgaacttctgatttccagatgctggctatgagtttgacatctgct

SEQ ID NO: 15410 - DNA, 73 bp, Homo sapiens
ggcaatgcttaaggaggtggatctggaaggaagggagctaacggtgacagagctgcctctaggagttggccct

SEQ ID NO: 15411 - DNA, 71 bp, Homo sapiens
gaggctgcgcaggaagaggcccccaaggcagaaacccctgggccactcgctacaccactgcagccgcctca

SEQ ID NO: 15412 - DNA, 72 bp, Homo sapiens
ggctagggccatggctggtgagcaatggatccagatgagaaccaaaggtcgatgacaccagttgtctgagcc

SEQ ID NO: 15413 - DNA, 71 bp, Homo sapiens
ctgcctctttgcccatttggcaattcattactgagtgaaactatgagccgacatgatgctgagtgctggga

SEQ ID NO: 15414 - DNA, 73 bp, Homo sapiens
tctagcccccaggatagctggcgctgatgatttaaagggcctggcagtgcttaatctttctgcccagctccct

SEQ ID NO: 15415 - DNA, 71 bp, Homo sapiens
cgacccgactggcggccgggggcagccggggacccggagcccgggagagcccagcgccgagtcgtggcggg

SEQ ID NO: 15416 - DNA, 72 bp, Homo sapiens
ccattttcagcatctacatactagcaggctagaaatagcagaaactgtggcttctgaggctgtggaattttt

SEQ ID NO: 15417 - DNA, 74 bp, Homo sapiens
ctgcgcctcaagcccagacccttttccccatatatccagagttgtatgtggagaggcactgagtgtgggcagag

SEQ ID NO: 15418 - DNA, 70 bp, Homo sapiens
taaaagtggttaaggctttggaatcagctacctgggcttgaatcttggctccacaatatagttgtaagaa

SEQ ID NO: 15419 - DNA, 72 bp, Homo sapiens
tgcacaaatagcactcatttgcacataccacccaggcattgctggttcagtggtgtcatttgtgagtttacc

SEQ ID NO: 15420 - DNA, 73 bp, Homo sapiens
ctaaaagcaagtttctatttcagaagtatgaagcactggagaaatgcagtcagctctcagatgtctgtggtct

SEQ ID NO: 15421 - DNA, 70 bp, Homo sapiens
tgcttaaaaaataacatactgggccaggcgcggtggctcacgcctgtaatcccagcactttgggaggccg

SEQ ID NO: 15422 - DNA, 70 bp, Homo sapiens
cttaagtgaatgatgagtactgacactcttgtggattccagaagattatttctagctttcaaatcacttc

SEQ ID NO: 15423 - DNA, 73 bp, Homo sapiens
ttctttgaccaagtaacactaagctttcctgctcaaggaagcaaggtccagtgatgtgagatctgagattgca

SEQ ID NO: 15424 - DNA, 71 bp, Homo sapiens
ttatgctgggtaaacgatgcttcctaagaagaaatggaggaaaagaaactaacatttactgagcacttact

SEQ ID NO: 15425 - DNA, 72 bp, Homo sapiens
cggtgtccccagagtttcccaggttggacatagggtgcctcatttccccagggctgcctggggactatttgg

SEQ ID NO: 15426 - DNA, 70 bp, Homo sapiens
tttgcaccttgttatgtggttgattaactagtgtaggtcttccttactagactggactattccctgagga

SEQ ID NO: 15427 - DNA, 71 bp, Homo sapiens
tggcagttgtgttctcatggagtgactaggaatgtctgtgcgtgtgacagccccagtgcttgccttctgtt

SEQ ID NO: 15428 - DNA, 74 bp, Homo sapiens
tgcagtgctactgcatccgagagagaagcggggtgtcccatgcaggcccaccttgatcacaacagagctgtggc

SEQ ID NO: 15429 - DNA, 70 bp, Homo sapiens
atgggcctctcatcttgtaggcctgcttgtctcaggcaggttgttggactgggcttccccccaaaaagaa

SEQ ID NO: 15430 - DNA, 74 bp, Homo sapiens
gtggccggagagctcacagcctggtagaaataacagtgagtatgcctgagcgtgtgtacggggctgggcagcgg

SEQ ID NO: 15431 - DNA, 73 bp, Homo sapiens
ccagcctttttttttttaatagatgaggtcttgctctatcactcaggctgagtagcaagatcatagctctctg

SEQ ID NO: 15432 - DNA, 72 bp, Homo sapiens
gcaccagatttgaagttggcttgcattaagggtccctgttatgtaaaaaatgctcgaatcactaaactcaca

SEQ ID NO: 15433 - DNA, 71 bp, Homo sapiens
ttttccagacctatgaatggacaggtgggaatttaggcttggttcaggaacggattccagaaaacactgtc

SEQ ID NO: 15434 - DNA, 73 bp, Homo sapiens
accaccacttcgctcagaggcggctactggctcaagaggacgacagaagccagtctctgatgcccaccgcatt

SEQ ID NO: 15435 - DNA, 72 bp, Homo sapiens
atgcttcagtgcactacagaaaagacaggtccacaggatctggggtagttagggagggcatcttggaggagg

SEQ ID NO: 15436 - DNA, 70 bp, Homo sapiens
aggtcacttgagagccgcacccactccgggcattcattgatcctgccattagatccaggcaaggtggcct

SEQ ID NO: 15437 - DNA, 71 bp, Homo sapiens
aaaatgttctcagaggctcggtggatgctgtgtggcttcccctccgggttgacccagcctctgtgctggaa

SEQ ID NO: 15438 - DNA, 73 bp, Homo sapiens
tgctcagcagtgaggcctcatgatgacctaatggagactgaaactggccaaaacactgccagagaggtggctt

SEQ ID NO: 15439 - DNA, 70 bp, Homo sapiens
gccgctcctggaggcagaaaggacttacacgacgtgctgcacggacgattccgagagaaaggccttgtgc

SEQ ID NO: 15440 - DNA, 72 bp, Homo sapiens
tgtattagcttatcagacacgaatttggaatcctttgtctaagctgcagcttagactcttgtgaatgcccat

SEQ ID NO: 15441 - DNA, 73 bp, Homo sapiens
ggcagtccatcagatgccagggaaatgagtcagagatgagtattgtccctgccctccaggagctcaaagcctc

SEQ ID NO: 15442 - DNA, 70 bp, Homo sapiens
gacagcatattgttgctggaggaatgtagggggcatgccctacgcctgcaccccagcaattgccacatgg

SEQ ID NO: 15443 - DNA, 72 bp, Homo sapiens
ggatgacttaaggtgcctgtgcttctctgagatggtctagagctggagcagccacaggcacacagaatcatg

SEQ ID NO: 15444 - DNA, 72 bp, Homo sapiens
ccatcattctcagcaaactatcacaaggacaaaaaaagcgaacgccgcatgttgtcactcataggtgggaat

SEQ ID NO: 15445 - DNA, 74 bp, Homo sapiens
tattttcatctactccaaagagcaatagagatgtgtagcaatgcagactgatgttctgtctaagcagaatgtga

SEQ ID NO: 15446 - DNA, 73 bp, Homo sapiens
aggacaggctgaggcattttcacagagagagtcactgatctatcagagcagcatctctcagggggcttcttct

SEQ ID NO: 15447 - DNA, 71 bp, Homo sapiens
acattagagacatttcgtcaagtgccgtgtttcctccagaacaaaatgtggagaaatgtcatcaacaaaat

SEQ ID NO: 15448 - DNA, 72 bp, Homo sapiens
ccaaaatcagtagaaactcaattgactgttttgggggaccttgtctgtcgacagtgtatttgatttaaatgg

SEQ ID NO: 15449 - DNA, 72 bp, Homo sapiens
gaaggtgtgaagttcactttggtcaactggattaatccagtcctgggattaggtgtcctcaatacagatggt

SEQ ID NO: 15450 - DNA, 74 bp, Homo sapiens
attcccactatcaagctgtcacatacccaccacctcacataagttacctttgtgtgtgtgtgtgtgtgtgtgtg

SEQ ID NO: 15451 - DNA, 72 bp, Homo sapiens
ttatttccagggaaacaatgcactatatcttaaaaataaacaaaaattaagaggcttcaatgttttcttggg

SEQ ID NO: 15452 - DNA, 70 bp, Homo sapiens
aagaagcttcaattccaagtgcagttttatctgaatgatatacaggactgcacgtagctggctgttgtcc

SEQ ID NO: 15453 - DNA, 73 bp, Homo sapiens
cctatttcaggaacttagcacatcaagttgatgtttgtcattatacactggcttggtagctacaccttgatct

SEQ ID NO: 15454 - DNA, 74 bp, Homo sapiens
aaaaatatattatctctcactaccactggctaaggtaagactgcttaacattagttggaattagagggttgaga

SEQ ID NO: 15455 - DNA, 71 bp, Homo sapiens
gcaggtgacatggcagcacccttcctgtcagggagaaaagagaaatgaatgttgagtagttcaccttcaaa

SEQ ID NO: 15456 - DNA, 72 bp, Homo sapiens
agagcctgcttgttgctctaccctgttctggatgtgctagaaccaaaggtgcaagacaaagtcccctttact

SEQ ID NO: 15457 - DNA, 71 bp, Homo sapiens
cttacctggagatgaagctttggtggaacatgaagactgggttttaatacctgaaaaagctgcccttcagg

SEQ ID NO: 15458 - DNA, 72 bp, Homo sapiens
ctctgtcacacctgaaacagacttcagggctgaagcttcctaatgcttcataggataacccaagtcaggatg

SEQ ID NO: 15459 - DNA, 71 bp, Homo sapiens
cagataagggactaaaggcaggccaccagcgccaccagcagcaacctgctggggtacccttccatgctgtg

SEQ ID NO: 15460 - DNA, 72 bp, Homo sapiens
catcattggtgttatggattctcaatttttattaataacagcattatctaatgctgtcatatactaaacacc

SEQ ID NO: 15461 - DNA, 74 bp, Homo sapiens
cgctcacctcacaggggctaagttccgcaggaaagagaatgtaagtacttgtgttttaaggacagaggaagtgc

SEQ ID NO: 15462 - DNA, 70 bp, Homo sapiens
gaatctgctctgattcagcaggaaggccgggagatgcttggtagttccagttcattgcaggtttacaaaa

SEQ ID NO: 15463 - DNA, 70 bp, Homo sapiens
aatcagtgctgaggggcattggtggtccagtccagttaaagtggaaagagctcattaacactccagcatc

SEQ ID NO: 15464 - DNA, 73 bp, Homo sapiens
agttggataatctggcctaggtttctcagctcgagatccaaagaactcgatgctagagggaaagaccatattc

SEQ ID NO: 15465 - DNA, 73 bp, Homo sapiens
gttctgggaagacatgaatttgtgggggcggggaatccctattcaacctactataagatttttggcaggggat

SEQ ID NO: 15466 - DNA, 74 bp, Homo sapiens
atggctgccttgagccttgtcattgtctagccatctctgtagatgctggcatagctcgcatgcagttgggtgac

SEQ ID NO: 15467 - DNA, 72 bp, Homo sapiens
aattagaaaaaggtatctcttctagacagaagactgcagcagagtgcagggcttggaaagagtacttctagc

SEQ ID NO: 15468 - DNA, 70 bp, Homo sapiens
gaaagtgttcagaaccatcttggttagcacaagggcgtggacgtgtgtctactttctacctgatgggata

SEQ ID NO: 15469 - DNA, 72 bp, Homo sapiens
gaatccagtcagccaatggatgcccagagctttgcaccatgggaaacacccaatggtaatggctattcaatt

SEQ ID NO: 15470 - DNA, 73 bp, Homo sapiens
gtttcggatggggagacaaagcacagagaagatacatcgcttgctcagggctatggctagtaccagacagagc

SEQ ID NO: 15471 - DNA, 75 bp, Homo sapiens
caggggtttggggaaacggccgctgagtgaggcgtcggctgtgtttctcaccgcggtcttttcctcccactcttg

SEQ ID NO: 15472 - DNA, 72 bp, Homo sapiens
attaatacaccttaaaaatagctgcagcttctcaaatctgtgagaatcgtatgtgctgcttgctacactttc

SEQ ID NO: 15473 - DNA, 70 bp, Homo sapiens
agcaattggaatagtctgacttgcttacatctatggcattggtgagttgagcatgaagttgctcctagga

SEQ ID NO: 15474 - DNA, 71 bp, Homo sapiens
caaattgaggtagtagtttgacttagaacccgtgttcttaatacctactgcttactgacaatgagaaagca

SEQ ID NO: 15475 - DNA, 74 bp, Homo sapiens
tttgctattgtgaacagtgctgcaataaacatatgtgagcatgtatctttatagtagaatgatttaaactcctt

SEQ ID NO: 15476 - DNA, 72 bp, Homo sapiens
taatgtttgaacttggaactcagttctagaccagacactagaatactcgtgccatactttcggaccaagcca

SEQ ID NO: 15477 - DNA, 70 bp, Homo sapiens
tgggcggagaaacagatggacggatatacttcctatgtactaaattgtgtccctctgagttctcctctgt

SEQ ID NO: 15478 - DNA, 70 bp, Homo sapiens
cccttgtccagggtcacctggcttgactagaatcctaaatgctagctcagtgccctttttcattgcttcc

SEQ ID NO: 15479 - DNA, 70 bp, Homo sapiens
agaggggttttctccacactcgccagatagagctgaatgagggttgggcggcgggggggtgtggggggag

SEQ ID NO: 15480 - DNA, 73 bp, Homo sapiens
gtcctcataattctgtgggtggcctccagttctggtctaggtagcttgactagaaccagatggtctagaacag

SEQ ID NO: 15481 - DNA, 72 bp, Homo sapiens
agggacaaggtggttttgtggctccattggcaaatatatcaactgctgacctatgagccagcagctgttctt

SEQ ID NO: 15482 - DNA, 73 bp, Homo sapiens
gggttcagtgcaagctgcggtgacctcctgaggcctagggtggggaggcactaaaagagaagtggttgagccc

SEQ ID NO: 15483 - DNA, 71 bp, Homo sapiens
tttcttaaatcttcaaaggatgccagttattttactggcaagggacagataatgaaaacatacatatttta

SEQ ID NO: 15484 - DNA, 72 bp, Homo sapiens
taaatcagcttattaggtcagcaggctaacatgacctctgttcaccatgctgttattgaaaaggtggattct

SEQ ID NO: 15485 - DNA, 72 bp, Homo sapiens
ctgcttccctgtctgactacttcacaggcccttccttgagggggagggactctatcgtgtttgtctttttat

SEQ ID NO: 15486 - DNA, 73 bp, Homo sapiens
ttcttttggtgagtgtaagcttttctatgggcaaagttgaaagtgattacatatctcttaacaagaggatcta

SEQ ID NO: 15487 - DNA, 72 bp, Homo sapiens
tttgatgaagcacagtttacttattttttcttttgtagcttgtgcttttgatgtcaaactcaagaaatcatt

SEQ ID NO: 15488 - DNA, 76 bp, Homo sapiens
tacaaataattgaaggctaattagcagtataactataaatagtaatgctgccagtctccttcagacaaaaattcta

SEQ ID NO: 15489 - DNA, 72 bp, Homo sapiens
atctaatgtacactatgagaatatgagaactatagttaataatatcgtactgtacactggaaatctgctaag

SEQ ID NO: 15490 - DNA, 72 bp, Homo sapiens
gccgaaactagctgcttccggtggagttcgagctgacatggtttgagtttatgtggtggttaaaactggtct

SEQ ID NO: 15491 - DNA, 74 bp, Homo sapiens
ttttgatgccagggtcttggcaaccctgtctcttaaatgaatgaatggaatggtggtaatgacctggatttgaa

SEQ ID NO: 15492 - DNA, 73 bp, Homo sapiens
ttctttccttctacaaaaaagccaataatgaagtggcacagctgagaggaagatgtgctattttttttttatt

SEQ ID NO: 15493 - DNA, 72 bp, Homo sapiens
aagggaacatttcactgagggctgctgggtgcagtaccttgaatgtctgagctcttaacaatgggatctgtc

SEQ ID NO: 15494 - DNA, 71 bp, Homo sapiens
gtcaaggaagacagtctgtggcaaaggcccagttcaagtttagaactgaacagcctctggcaatctatctt

SEQ ID NO: 15495 - DNA, 70 bp, Homo sapiens
caacatgagagctgaaggggccccaaacgctattggtccaacccctttgacagctggctaaggcaaggac

SEQ ID NO: 15496 - DNA, 74 bp, Homo sapiens
cagcctcaggtgccagaggagcatctgcccagccatccttcataggtggcctggaaaggcagtctggtctgggg

SEQ ID NO: 15497 - DNA, 70 bp, Homo sapiens
ggagaaggacctgctgagcgctggagtctaggtggagtcatgcagcgttcctgggtcctttcttctgctt

SEQ ID NO: 15498 - DNA, 73 bp, Homo sapiens
tactgcggtggtacccgagatccttcttttgcctggcctctctccagctacatctgatcccacccacttctga

SEQ ID NO: 15499 - DNA, 71 bp, Homo sapiens
gaacagcgtgtgctaggctggagtggagaaataaggagccactgaaggaatggcccatgcagtctgattgc

SEQ ID NO: 15500 - DNA, 74 bp, Homo sapiens
ggtcatccagtttctctggccttactttcctcctctgtaggtgggaagcataatacttgcctctgggattaatg

SEQ ID NO: 15501 - DNA, 74 bp, Homo sapiens
ccatcaggctatgatcctcagttgtgtgtaaaattagggctttcaatctacacacaactgagcatcacagcctg

SEQ ID NO: 15502 - DNA, 70 bp, Homo sapiens
gactgccagtttcagttgtagaaatagcgagggtgctaaacacctgtgtgtaactgtgccatcactctcc

SEQ ID NO: 15503 - DNA, 71 bp, Homo sapiens
gagtgatggcacagttacacacaggtgtttagcaccctcgctatttctacaactgaaactggcagtcaaag

SEQ ID NO: 15504 - DNA, 74 bp, Homo sapiens
acatgccttgatcacatatttgtaactcgggagtctgagatgatcgtgacattctcgtatggggctgtgtgtgg

SEQ ID NO: 15505 - DNA, 73 bp, Homo sapiens
ctctgaagctcagcctgacaggagtgagatgggagcactactgcacaggcctctaagcaagaaaacaacaaac

SEQ ID NO: 15506 - DNA, 72 bp, Homo sapiens
ataatctctccggacacttggcagcccagccagcgtttgctttgatagcttatctctgcccgtccagcttga

SEQ ID NO: 15507 - DNA, 72 bp, Homo sapiens
catcagggtgaggacaaacataatttgaatgcagacctgtctctgctggttaatctcactttacagctcccc

SEQ ID NO: 15508 - DNA, 72 bp, Homo sapiens
ttagaaagttgagcatagaggtttttccacgttgacacaatcttttgagtgtgagcaattatgactgtgtgc

SEQ ID NO: 15509 - DNA, 72 bp, Homo sapiens
agctgctctacccagtgctgagccgtgctgtgctgtagcttatcagatcagggggtggaagtcagcagggac

SEQ ID NO: 15510 - DNA, 74 bp, Homo sapiens
taactaagtcaggaaggtgaagatcaggcctggtgctgactggcactggggcaaacattttctacctttaaaga

SEQ ID NO: 15511 - DNA, 72 bp, Homo sapiens
ttctggcttgtagggtttcactgttagcctaaggggatccctttgtaagtgacctgccctttctctctagct

SEQ ID NO: 15512 - DNA, 72 bp, Homo sapiens
tctgggtgagcctgatggaatcaaaagggtccttataagaggaaggcaggagagtcagtgtcagagaaaggg

SEQ ID NO: 15513 - DNA, 72 bp, Homo sapiens
gttttccaaagtggctgtatcgccttagcttcacactagcaatgtatgggcgttgcggtttttctacatcct

SEQ ID NO: 15514 - DNA, 71 bp, Homo sapiens
tggaatccaggcctcttccctgccaggcgaaggtgttttcacgtgttacatggagggaactaatttcatga

SEQ ID NO: 15515 - DNA, 74 bp, Homo sapiens
cagggtcctctgggccctcttcttgactaggcctcacccttggcctgttttaagcccagttttaggattagtga

SEQ ID NO: 15516 - DNA, 71 bp, Homo sapiens
agatgagtggataagaggccactggatgtttgtgcttcactgtctaaagcatcatccaatgtatcactgat

SEQ ID NO: 15517 - DNA, 74 bp, Homo sapiens
gctgctgagacttgtggattaaagggtggccaggtgacgtcattctcagctgccctgatgacttgtcagaagca

SEQ ID NO: 15518 - DNA, 74 bp, Homo sapiens
cctgccctccctcttcaatgaggcgtaaaaccccgtggctgactctaatccgcaaagttgatgccagtggcagg

SEQ ID NO: 15519 - DNA, 74 bp, Homo sapiens
gagagagctcagggagatcggatacttgcctcagaagcagcagtgtgtgaggctatgagtattagactctggag

SEQ ID NO: 15520 - DNA, 73 bp, Homo sapiens
accacatatatatataactaatatatatataactaatatatatgtaaaactaatatatatatgtatatacata

SEQ ID NO: 15521 - DNA, 73 bp, Homo sapiens
tgcacctggccctaggtccagttttaacaggaattttccctaaggcctaaagcaacttgttagacagtctgta

SEQ ID NO: 15522 - DNA, 74 bp, Homo sapiens
attgggcaagcctgttcaagtctcaaggccaggttgaagaacaagccagcaagggtttcagagaccactcaggc

SEQ ID NO: 15523 - DNA, 71 bp, Homo sapiens
acttaccagtgtcagcttcctgatgtggctaagtttagacacacacgcgggctcgcacgaaagatcctaat

SEQ ID NO: 15524 - DNA, 72 bp, Homo sapiens
ccaaaatacacgttccaggagccctttcattttgcagcaccgcccgcagcacctgcccggtggtgtcctcca

SEQ ID NO: 15525 - DNA, 74 bp, Homo sapiens
tgggttggttcttatcagaaaagtgtaggttctgttaataatcacgggattgtgatgaatccatagaagaccta

SEQ ID NO: 15526 - DNA, 71 bp, Homo sapiens
atgtcactttcagcctgtgttttcacttagtatttttaatggctgagtaatattgcactgtctggacagag

SEQ ID NO: 15527 - DNA, 72 bp, Homo sapiens
tgaaagaaaagcagttcagctcatttgtgactatttagtctccgataaaatcgcagagaactgtttgggtgg

SEQ ID NO: 15528 - DNA, 74 bp, Homo sapiens
caggtcgggtacagagacaggcctgggacctggaggacctgcacgcggggtcgggcacctgccacactctccca

SEQ ID NO: 15529 - DNA, 73 bp, Homo sapiens
tgagagccacctgtggtgggtgggggcaggtgctgtggcccctgcctctggtttccatgtaggtgctggcctc

SEQ ID NO: 15530 - DNA, 73 bp, Homo sapiens
gggtggctgggcggcaccccgatggctccctgtgctccctgagaccctacaggccgccctctgcagccacacc

SEQ ID NO: 15531 - DNA, 72 bp, Homo sapiens
cctcctttgtatcatgggaataatttagcagtgttgtgctataaattcagataatccaggatgggcacggtg

SEQ ID NO: 15532 - DNA, 70 bp, Homo sapiens
gtctggcaaattgttggactgttgaacatgccttgtggcaacactttccaatgaaaatgcttagcagcct

SEQ ID NO: 15533 - DNA, 74 bp, Homo sapiens
gcatgtctcttcccagctccacctttgctgacgttaccctggtaacttgataatggccatggtgggagtatgtc

SEQ ID NO: 15534 - DNA, 73 bp, Homo sapiens
ccagagaatctgaggcagcagggcactgcacatgagcactgccctgagtgtgcacacacctggctggactgca

SEQ ID NO: 15535 - DNA, 73 bp, Homo sapiens
ctccttgcattttcttatatattttaggattaacttgtcagtttctattttaaaagtttgataggaattgcct

SEQ ID NO: 15536 - DNA, 71 bp, Homo sapiens
gggattacgagtgagccagcggaggtgtgaccaaagagatgtcacagttcgcttttctttgtgatcaatac

SEQ ID NO: 15537 - DNA, 74 bp, Homo sapiens
ggctgggtgaaatgagccggtcacagaaggacaaatgccgcatgatttcacgtatatattcaggatctacagtc

SEQ ID NO: 15538 - DNA, 72 bp, Homo sapiens
gtggagccgaatctgtcctttgcaaagatgcacagtgggtgctgtctgacctgagtgtgtcagatctcccag

SEQ ID NO: 15539 - DNA, 73 bp, Homo sapiens
gtgccctttcttcagggtctcaggctgatgaccacatcgcccgacgcacagcacagaagatcatggcaccacc

SEQ ID NO: 15540 - DNA, 73 bp, Homo sapiens
ctgatttttcttgtttagcttactgatgtgatgaattgcattggctgatttttgaacgttgaattagggtgtg

SEQ ID NO: 15541 - DNA, 71 bp, Homo sapiens
tattccagcagcacactgtggactgcagttaatttcatgcagttataatttaatgctgcattttttttttt

SEQ ID NO: 15542 - DNA, 70 bp, Homo sapiens
gggagtgcacgggcaggatggagggacactcggggggtgagaatcgccacctgggagctgccatcccctc

SEQ ID NO: 15543 - DNA, 74 bp, Homo sapiens
ctgccaagagacaaggtccagccctcccaggaggacacccgggggtgctgggtgcagacaggccaagcttgagc

SEQ ID NO: 15544 - DNA, 73 bp, Homo sapiens
tggaccgtcagtaatccaggcgtggtaaaatctcccagcgttggggctggccaacggctgcaccccgcggttt

SEQ ID NO: 15545 - DNA, 74 bp, Homo sapiens
ggaacctggggaggcccaggcagagggggacagcgtggagcaggggagcacactctgggtgggggagcagcagg

SEQ ID NO: 15546 - DNA, 72 bp, Homo sapiens
aggtgcaggcggcaggggtacaggcggcaggggtgaaggtggcaggtgcaggcggcaggggtgaaggtggca

SEQ ID NO: 15547 - DNA, 70 bp, Homo sapiens
tgggaccgggtggccccgggccgaggaggtggtagcaggaagctccaccaggagccaggagctgagagga

SEQ ID NO: 15548 - DNA, 71 bp, Homo sapiens
ctcctctgacatcccggagcaaggagaacagacgggctcctctgaggtcccggagcgaggagaccagactg

SEQ ID NO: 15549 - DNA, 70 bp, Homo sapiens
gatgccccccggtgtgggaaccagcacctcccaccaaccagccacacccagtgggggcacagcacagacc

SEQ ID NO: 15550 - DNA, 70 bp, Homo sapiens
aactagccgcctgtggtcatgcgcacctgcaatctcagctacttgggaggctgaggcacaagaatcactt

SEQ ID NO: 15551 - DNA, 72 bp, Homo sapiens
tttcatggtccatcctaatccctgccggtccatctgtggcctgccaggtttcgcttgtggaccagagcaccc

SEQ ID NO: 15552 - DNA, 74 bp, Homo sapiens
cgtcctcccggggccgagcctcgctgcccggcgcgcccactttgcgggagggaaactgaggccgtgcaaggagg

SEQ ID NO: 15553 - DNA, 73 bp, Homo sapiens
ccctccagggcaggtcagcgtgtggcagccttgggttccttgctgctgacacaggtactgagggtgctgagga

SEQ ID NO: 15554 - DNA, 70 bp, Homo sapiens
cctggggcttgtgggtgtcggctcccatcccggggtcctcccccgccgtcctcccccctcccccgccctc

SEQ ID NO: 15555 - DNA, 74 bp, Homo sapiens
gcttgccaggaatgccttcttccatgtggtccactgtcctcacagcccttctgagccacatgtgctggcagggg

SEQ ID NO: 15556 - DNA, 70 bp, Homo sapiens
actgcaagtgggtggggtggcggcccccgccctggcggggagtccaggggtcatggaggtggcgggcaga

SEQ ID NO: 15557 - DNA, 70 bp, Homo sapiens
catatacaccatggaatactatgcagccataacaaagaatgagatcgtgttattggcaggaacatggatg

SEQ ID NO: 15558 - DNA, 71 bp, Homo sapiens
ctctgatccccggctggaggtgggagcgattctggccctagagcccccccaccttgcctggtgacagagac

SEQ ID NO: 15559 - DNA, 73 bp, Homo sapiens
gggaggccccgacggggagccaagaagcgggttctcaccagcaaccgcatctgctggccccttgatctgggcc

SEQ ID NO: 15560 - DNA, 73 bp, Homo sapiens
gatgcttcctggggaggggcgcccgcaccctggggcagtggggcagccgcgggtgtctccctcccaggtgtcc

SEQ ID NO: 15561 - DNA, 72 bp, Homo sapiens
taccccatgcgcttgacagtatgcccagcctgtccagctacaggactcagcagacaaacaacacccaggtca

SEQ ID NO: 15562 - DNA, 74 bp, Homo sapiens
tggacaccgtgggcatttctgtgtggatgttgtgtgtgtgtagctgcactgtgtgtgcggacagcaggtgtgcc

SEQ ID NO: 15563 - DNA, 73 bp, Homo sapiens
gacccaggcctcctgggggcctcagctcagctggagccagggtctctggaggggcctgggttagtttcctgtg

SEQ ID NO: 15564 - DNA, 71 bp, Homo sapiens
gactgttcacagtggcttccaaggcctttgggatgggccttgcgtgctgcccttctgctggaaaccctccc

SEQ ID NO: 15565 - DNA, 73 bp, Homo sapiens
tgccttatttgccagatgtcccagaagtacacaggagcagacgcaccacttcgatggctattttaggaggctg

SEQ ID NO: 15566 - DNA, 72 bp, Homo sapiens
caggcaaaggccggcgtgtgcagccccagtggtcccctcctgctgggacccagccatgcagactccaccttt

SEQ ID NO: 15567 - DNA, 71 bp, Homo sapiens
tcctactgtacctcctttgaggtgcatttgttgttgtgtcctggtctggtttgggtatattagagtaatgc

SEQ ID NO: 15568 - DNA, 72 bp, Homo sapiens
tgccaatcccagtgttacatttgaaggactcagtgaccctgggatttagtcattaggttttatgggagaaac

SEQ ID NO: 15569 - DNA, 71 bp, Homo sapiens
tggcattcaatacagtaccgttattcccacaaatagccacaaaggggcaatgttgacttgccaactatgaa

SEQ ID NO: 15570 - DNA, 72 bp, Homo sapiens
gccacacattttcatttgagatagtagttgcgtttgagaggtaactagaaaacaaatgaaaattaaggactc

SEQ ID NO: 15571 - DNA, 74 bp, Homo sapiens
tgatgtcatcacaagccaggctgataacccccaagttagagcagaggcagtgctcgatttcattcctggaacag

SEQ ID NO: 15572 - DNA, 74 bp, Homo sapiens
ggtgggggtgcatgcctcagagggaagcctgagtcttgtctctgttttcctcctcccctctttccacagcaact

SEQ ID NO: 15573 - DNA, 74 bp, Homo sapiens
gctgcactccatcatccaacagattattggttgacagattcagaaatatcaggctctggcttctgatgagagca

SEQ ID NO: 15574 - DNA, 74 bp, Homo sapiens
gccgccgccgcgcagggtcggcccaccccccaagagggccgcgccgtcgggcccggctcgcagcagcggcggtg

SEQ ID NO: 15575 - DNA, 73 bp, Homo sapiens
aaaaaagaggtagtaggttgaaagtgagatgtatatttgagcattttcatgtaacattataatttttcttttt

SEQ ID NO: 15576 - DNA, 74 bp, Homo sapiens
acagacccgagcctctcccaggtttcggcaccagatgaaaagttcttgtattggttcaaaccctgagagcgctc

SEQ ID NO: 15577 - DNA, 70 bp, Homo sapiens
ccaggtagcaaacccccactaagagtatgcagattatgggggacaagtgggtggagttcaccaggggtga

SEQ ID NO: 15578 - DNA, 72 bp, Homo sapiens
cttaatgacagtaatccaggccaggcgtggtggctcacacctgtaatcacagcgctttgggaggccgaggtg

SEQ ID NO: 15579 - DNA, 72 bp, Homo sapiens
gccatatcatgctcaatttttagccaagagagtggtcacctccacttgcaatgagcattattaccccttggc

SEQ ID NO: 15580 - DNA, 70 bp, Homo sapiens
gaacgatttccacactggtgcagcacacagcaggggacgggaaatcctggtcctcgctctttcagagtca

SEQ ID NO: 15581 - DNA, 74 bp, Homo sapiens
gcaaggaggtcatttcttgaagggaagattggtcaaaagccaaatggctcaaaattttcaaataagatgaagac

SEQ ID NO: 15582 - DNA, 73 bp, Homo sapiens
ccagcaaggcagcagagatctgattcagcaggaatgactcttgctcttgttatccacagaaaatcctttgagt

SEQ ID NO: 15583 - DNA, 74 bp, Homo sapiens
agaggcctccactggggagacatctgtgatggcatgtataacactgcattgcaccagactgtttcctctccctt

SEQ ID NO: 15584 - DNA, 71 bp, Homo sapiens
gtgttggagagaaagcgtttgagcacccacgagttcatcagctgatgtgttcttgaatgctatactgagct

SEQ ID NO: 15585 - DNA, 70 bp, Homo sapiens
aaggtccctctgctgcaggcagcagaaattctccctgcaaattggattacctgatctattgctgcttgca

SEQ ID NO: 15586 - DNA, 70 bp, Homo sapiens
tcaactactcacaggttgctaagtgtttaaaccttgttttaaaaaggcagacacagagctgtaaccagtc

SEQ ID NO: 15587 - DNA, 70 bp, Homo sapiens
gttgccccgatatcatcttgatacttctgtctccagaactggtaagctagaagtaaccccagggtctcct

SEQ ID NO: 15588 - DNA, 72 bp, Homo sapiens
ctccatgcagctcagccagcaccatccaggatcagctgtccagctgccagcataggcaggagcaaacctcaa

SEQ ID NO: 15589 - DNA, 73 bp, Homo sapiens
ataacacctagaatttgatttacactgccggctttaaagtacttccagatcctgttgtgtaaacagtacggtg

SEQ ID NO: 15590 - DNA, 72 bp, Homo sapiens
aaatttgactgtgtagtttatggttggccacattagtggctaacacagcgtaaccaaacttagtcaacttat

SEQ ID NO: 15591 - DNA, 74 bp, Homo sapiens
tgagctgtaaccaccaagtcaccagtgcgtggggacagcattgtctgaccacattgctctaaaaaggcagcatc

SEQ ID NO: 15592 - DNA, 72 bp, Homo sapiens
aattctaggaggctattgcagtaatccaggctagggagaatggtggttagattaaagtgatagaaatgtaga

SEQ ID NO: 15593 - DNA, 74 bp, Homo sapiens
ctaagacactgtgctggctttgtaacatgtcagtttggcttgctgacatgcaatgattccctttacatgtgttt

SEQ ID NO: 15594 - DNA, 73 bp, Homo sapiens
ggtgtgtgtttccctctgtgtctctacacatagatgttcatttggtgtccagtgggaccaggaatagactctc

SEQ ID NO: 15595 - DNA, 70 bp, Homo sapiens
atcagagctcttttattcttaccatttctaattacaagcaagagatgtaagggggttctgaggcaagaca

SEQ ID NO: 15596 - DNA, 72 bp, Homo sapiens
ttctcctgcgttttttttaccttgtcctccaggggcttagtgttgagctgttgggccaggtagagacctagg

SEQ ID NO: 15597 - DNA, 71 bp, Homo sapiens
gcaggtgctctagaagaatatacgggtactgggttggcggcgggagaagaaaactcagcccagagaaggag

SEQ ID NO: 15598 - DNA, 73 bp, Homo sapiens
atttggaatccaaactgctgcaagttgaaatccctgcttctggggaaacttccctcatggctctgagcattgg

SEQ ID NO: 15599 - DNA, 72 bp, Homo sapiens
agctgcaagtgcgttatcctggctggagcacggtgtcaatcacggcagactaaggccagcggtgatggcttg

SEQ ID NO: 15600 - DNA, 71 bp, Homo sapiens
cttctgggcctggggcagggccctcctgaactgcaaggaaagccccattccccggcatctcctgctctgtc

SEQ ID NO: 15601 - DNA, 70 bp, Homo sapiens
ctttgtatcctatagcccctatctgaggggccaagctgggggccccagcaggggatggaacatcaggcaa

SEQ ID NO: 15602 - DNA, 73 bp, Homo sapiens
tgtaggatggcaggcacagaagtgagggtccctttggtagggtccaagaaccttggaagcaacatctcccttg

SEQ ID NO: 15603 - DNA, 71 bp, Homo sapiens
atttcgtatcgtggagtcctagctggtcctgatattcagtaatcagagtgggttaatccagctattactca

SEQ ID NO: 15604 - DNA, 74 bp, Homo sapiens
gtaaatgtcagtggactgctatgtttggaaaacttttctatagaaatgtaatatatactgagcggcagaatgac

SEQ ID NO: 15605 - DNA, 72 bp, Homo sapiens
aacagtttcagtgatatcctgagtgcaggatgctgaaaacaaacgtctctgaagaactgtaagattgtgtgt

SEQ ID NO: 15606 - DNA, 72 bp, Homo sapiens
acatgttaggtatgcaatatgcaacttgacttctctcaaggagctcacagtctatgacctgaacagagtatt

SEQ ID NO: 15607 - DNA, 70 bp, Homo sapiens
cccaggaccctctcaccctgtgctgcctcctcagggggcaccatcgccccagcttcccctggcttctggt

SEQ ID NO: 15608 - DNA, 73 bp, Homo sapiens
tactatgttgcccaggctggctgtgaactcctgggttcaagtaatcctctcgcttcagcctcctgagtagctt

SEQ ID NO: 15609 - DNA, 71 bp, Homo sapiens
gaaaaaagccagggagaaaagaaaaaaaggaaggaaggaaagatgtcaatatagctcttttttcctctcca

SEQ ID NO: 15610 - DNA, 73 bp, Homo sapiens
ggccctggtcagaggtcaggattccattcctggatctatcacttactagccaagcaactttagccaattactt

SEQ ID NO: 15611 - DNA, 71 bp, Homo sapiens
cgctcacgacttgtcccgccgccacccgcgccgcggccgcccaacagggacgcgagccgggaccacgccga

SEQ ID NO: 15612 - DNA, 71 bp, Homo sapiens
ccttgacctcccaaagtgctaggattacaggcatgagccactgcacctggcctcatctttcgtgagttaag

SEQ ID NO: 15613 - DNA, 72 bp, Homo sapiens
cccgcttgctggctctcagtcttggtcctgtgccaggcaggcagcctccaggcagcgccattcaggtgagac

SEQ ID NO: 15614 - DNA, 74 bp, Homo sapiens
gtcagatgtacacattggctcataagagtgaaaacagttacctggagctaaattcatgttccttggctttctga

SEQ ID NO: 15615 - DNA, 72 bp, Homo sapiens
caacatggcaggtcaattcttggggagcctcggatgagggaggaaggaactggggaaactgaattgctcagt

SEQ ID NO: 15616 - DNA, 72 bp, Homo sapiens
atccacagacacccactgggctgggcagcaaagggagaccagggctcagggaaaaggaggtgagttgtctgg

SEQ ID NO: 15617 - DNA, 70 bp, Homo sapiens
gtaatgagatcatgaggatagaggtcccaggaatgggattagtgcccttataaaaaaggccctagagaac

SEQ ID NO: 15618 - DNA, 72 bp, Homo sapiens
ccacatcctgctgcccccaaactgggctgtcagcccaggagtcattagcaggtagcagggctgagcgtgggg

SEQ ID NO: 15619 - DNA, 72 bp, Homo sapiens
tcctgctggtatgtggacaggctgagagtgaacccacatttgaccaaagcctgagctgccctagggctgaaa

SEQ ID NO: 15620 - DNA, 73 bp, Homo sapiens
actgatagttgtcccaaatttgtttggcgatatgtcatcctacaaagcagtattgcacagggatatgtagagt

SEQ ID NO: 15621 - DNA, 71 bp, Homo sapiens
atatttagcaccatctgacatatatatgagatatatatgtaaatatatatatatatttacgcatggtggct

SEQ ID NO: 15622 - DNA, 72 bp, Homo sapiens
ggaggtgaattagagtctaggtagtctgactccaaagtccacacacttggataccgtctctttacacatgct

SEQ ID NO: 15623 - DNA, 71 bp, Homo sapiens
tcgccatctgcactggggaccaggctctgcagtgggccggtgaggccccgacaatcctcccgggctggacg

SEQ ID NO: 15624 - DNA, 72 bp, Homo sapiens
cctggggcagggctaagaatacaaactttggcaataaataattttttgttcaaatccaggatctacctgaaa

SEQ ID NO: 15625 - DNA, 73 bp, Homo sapiens
ctctaacagttctctcaaactagctcccactaaggtcatactgcctggtaatagctaggtgtggctccctgca

SEQ ID NO: 15626 - DNA, 74 bp, Homo sapiens
tctctaataacctttttagcttattgagtcaatggttcagtgaccctacctaggggattagcggagaagtacaa

SEQ ID NO: 15627 - DNA, 70 bp, Homo sapiens
gtagagacagggttttaccatgttggccaggctgatctccaactgcaactcctgacctcaccacctgcct

SEQ ID NO: 15628 - DNA, 72 bp, Homo sapiens
gattacaggtgtgatccactgcacccagcctgggctagctctttttaatcagtaattttaatgcgcttgtaa

SEQ ID NO: 15629 - DNA, 73 bp, Homo sapiens
acagtgtttgtatcttactgtcctaaggtgagtggcccagtgtttagcagcatggtctctggggttagatagt

SEQ ID NO: 15630 - DNA, 73 bp, Homo sapiens
tatctaagctcatcatcatgatcccagtgcctcatgctgcggctggctggcacacagtaggtactcaacaaag

SEQ ID NO: 15631 - DNA, 73 bp, Homo sapiens
agtagtagctttatctcatgagtggtcagtttcctttgtgatagatcacattatctagaaatgcactgctgct

SEQ ID NO: 15632 - DNA, 72 bp, Homo sapiens
ttgcaagcagcattgtacaaggaaagggactgtgtacgtgcactcactgccacctcttcagatgctcaatga

SEQ ID NO: 15633 - DNA, 74 bp, Homo sapiens
ccctgtccctgtctaggacctatttgagggtccagcctcttggtttccagcaactgtccaaagatgggaggggg

SEQ ID NO: 15634 - DNA, 70 bp, Homo sapiens
tgctcatgaattccttctatagcttactgaggactcatctttcagcctctgcttgaatatttcttggaca

SEQ ID NO: 15635 - DNA, 73 bp, Homo sapiens
ccttccctgcatgcttttagctctagtccccagactcactgcccctactctgccactaggcctgggaaggaac

SEQ ID NO: 15636 - DNA, 71 bp, Homo sapiens
atctgcccacgggatagaacctgtctatagaatactgtttttctgaacaggacctacgcctcagaattaag

SEQ ID NO: 15637 - DNA, 70 bp, Homo sapiens
ttttctgactcagttcagcagaggactcaggttgccttagaactccgccaatggtttgagaggggaataa

SEQ ID NO: 15638 - DNA, 74 bp, Homo sapiens
gctccgtagggattatctagttcagggtggctgccaaatatgttactcgttagtagtaactcgttagtaacttc

SEQ ID NO: 15639 - DNA, 72 bp, Homo sapiens
ttgaagtttactgacctattaaccagatctgttcaatggcctagcaaaggcaatggtagactgtcagaggca

SEQ ID NO: 15640 - DNA, 70 bp, Homo sapiens
tccatgcacacatgttttgggcttcagtttctaggtgcaatagcacttccctggggagatccttccacac

SEQ ID NO: 15641 - DNA, 70 bp, Homo sapiens
agagcaggaggacaggggattgatctcccaagggaggtcccccgatccgagtcacggcaccaagtttcat

SEQ ID NO: 15642 - DNA, 74 bp, Homo sapiens
gataggggtctagtttcattcttctgcatctgctggtccagttttcccagcatcgtttattgaagagactgtcc

SEQ ID NO: 15643 - DNA, 73 bp, Homo sapiens
gcactggagcccagcgatctgcctttctagatgtttagctatatctcatctacaacatgggctgcccttgttc

SEQ ID NO: 15644 - DNA, 70 bp, Homo sapiens
gagctgaacattagggtattgacccgttggctcaagggatctatccatgggcagtatttttcacctcggc

SEQ ID NO: 15645 - DNA, 72 bp, Homo sapiens
ggagaagggaagaaagcttcagttgggtatgcgtacaacttcctaaacgcactgcgcgtgctcacttcccaa

SEQ ID NO: 15646 - DNA, 73 bp, Homo sapiens
tcaagttcccacttttcctgcagcactagttctgaatgacatttttagctgcatctctgtagcagtgtgggag

SEQ ID NO: 15647 - DNA, 74 bp, Homo sapiens
acaaattcctaaaatttagagctaaacaatggcagtagctgtagtttccatactgttttgtgatgggacttggg

SEQ ID NO: 15648 - DNA, 72 bp, Homo sapiens
acaattagcaccatctctggcatttattcactagatgccagtagcacacacccctcctctaagttatggcaa

SEQ ID NO: 15649 - DNA, 73 bp, Homo sapiens
tgaggtttggggtacaaatgatcccattacccaggtagtgatcatagtaccaaattagtttttgtttagcctt

SEQ ID NO: 15650 - DNA, 70 bp, Homo sapiens
atagacaaatctgctatcatagctggaaatgtcaattctttctaacagtaattgacagatctagcaggca

SEQ ID NO: 15651 - DNA, 74 bp, Homo sapiens
acgcttatgatatcaatgtgatgatgacaaaagtctgggtgtaaataaaaactaagatttcattgtcgaagtgg

SEQ ID NO: 15652 - DNA, 72 bp, Homo sapiens
gaatgtagcaccatctagtaaatgttagtcttgaagatgatgatgaggaggaggaggatggtgatgactgaa

SEQ ID NO: 15653 - DNA, 74 bp, Homo sapiens
ttaagttccttatagatggtagatattaggcctttgtcagacacagtttgcaaacattttctcccattctgtaa

SEQ ID NO: 15654 - DNA, 72 bp, Homo sapiens
tagccagtgtcaagtctgaagtgaattttatatcttttacttttgtgagtcatcacttttatgtttcactga

SEQ ID NO: 15655 - DNA, 73 bp, Homo sapiens
ttttttttttttctgccacagggatggtagctgtgcaaggtatctgtagtgcaggagatcagtaactgggata

SEQ ID NO: 15656 - DNA, 72 bp, Homo sapiens
cctctcttgggcctaattgcaatcacccagaagagagactgccattggcctaacttgactaaggatacatat

SEQ ID NO: 15657 - DNA, 71 bp, Homo sapiens
acaactcagagttctgtgtactatctatggcttagatacacgacggctttcaactctgcattttgagatct

SEQ ID NO: 15658 - DNA, 74 bp, Homo sapiens
tggtagagacgaaagtgagtagtctgcactagtgaatgtagcttggtagtaggcgatggttgctgattttcctc

SEQ ID NO: 15659 - DNA, 72 bp, Homo sapiens
gttttcctgagaaagactgaggaatctgccttgtaatacatactacaggtggccttggatctcactctgaaa

SEQ ID NO: 15660 - DNA, 73 bp, Homo sapiens
caaagccaattcttaaaagaatagtctgtgatgaagcatacactatgattttctattggtttttcaatacaat

SEQ ID NO: 15661 - DNA, 73 bp, Homo sapiens
gattgagagccaccagtctggtggttaaaattcgagaccttgggattatatagatgtggcttcaaatctgact

SEQ ID NO: 15662 - DNA, 71 bp, Homo sapiens
taaaaatagttcacaagctaaggctctccaatcataccttgatatggttctgggagatccttttctattca

SEQ ID NO: 15663 - DNA, 71 bp, Homo sapiens
ttaaaaggatagaatggcatgccaggagaaaaagtctattgattgatttagttttagcatccaatcttgcg

SEQ ID NO: 15664 - DNA, 70 bp, Homo sapiens
atagcagcagggtctactctacttgtaaaccgtatggaatttgagatagactgcttaaagctatgaattt

SEQ ID NO: 15665 - DNA, 72 bp, Homo sapiens
aacctcataaatggctccctgagacaagctggctactaacactaacatggactctgggaggcactttgctct

SEQ ID NO: 15666 - DNA, 74 bp, Homo sapiens
agctggacctctattcacgatagaccattttcaaggatagcaggaaaactggctatcagagagaaagagaagtt

SEQ ID NO: 15667 - DNA, 74 bp, Homo sapiens
attatttgtttctttgggagaacaggctgctgagaagatgcaatggtggcagtctgggggagtgggagggaggt

SEQ ID NO: 15668 - DNA, 73 bp, Homo sapiens
gatcttgtgctgggctcagcgcccctgagtgcttttggctctctagctgctgttcactccgtatgtggggtgc

SEQ ID NO: 15669 - DNA, 74 bp, Homo sapiens
caacctggagcaggggagcaaggccactggcatcagtgtggatgtttgcactggtggtggttggtgtggggttg

SEQ ID NO: 15670 - DNA, 70 bp, Homo sapiens
ggaggccacattctgaaaaaacagtagccgctcagctctaactggtggtttccatcaactcatgtagact

SEQ ID NO: 15671 - DNA, 74 bp, Homo sapiens
cctgactttttaataatcaaacatatcttgctaacagcagattttagtaaggttgatctgataagggtagagga

SEQ ID NO: 15672 - DNA, 74 bp, Homo sapiens
atagctgtcaaggggccactttgaccgacggggctgcggtcgacggcgctccccggctgtctttttgtcccagg

SEQ ID NO: 15673 - DNA, 73 bp, Homo sapiens
ttataatgcaatgtggtaaaggcagcgtggtgctgtgggcatggaggaaggtccatagaatgttgggaacaca

SEQ ID NO: 15674 - DNA, 74 bp, Homo sapiens
ctcccctcattccagtcagtcaaagtcatcgctaaaccgaattgacaagcaattgatacggtggcggcacggag

SEQ ID NO: 15675 - DNA, 72 bp, Homo sapiens
tagtgattactacatagatgaccatgttgggtaataattgaatttatcggtgtctgtgttgtaaaactgaat

SEQ ID NO: 15676 - DNA, 72 bp, Homo sapiens
ctcagttgttcctggctcaccaaagaattctaaatccttgttgtctaggaatatgagacagtaatgaaaggc

SEQ ID NO: 15677 - DNA, 70 bp, Homo sapiens
aaagtgctgggattacaggtgtgagccaccgtgttcagcctaaaaatactcttatatcacctagtcacat

SEQ ID NO: 15678 - DNA, 73 bp, Homo sapiens
tgttctggtggcagggctactacatgcaattaacagcacacaactctagggggagccacatacatgggccacc

SEQ ID NO: 15679 - DNA, 74 bp, Homo sapiens
ctaaaagtttagtatgttattattgtctctgttttactgatgagtgaactgaggttcagagaggttatttagca

SEQ ID NO: 15680 - DNA, 72 bp, Homo sapiens
gtctgggtgcctggtaatgatgcctgcactggcatgatgctgtggctttccaggcttgttttacctggttgt

SEQ ID NO: 15681 - DNA, 74 bp, Homo sapiens
caggaatgggcagtcctaagctacttcgtgtcaatgggatctgaggagaagtttgcttggggcttctgggaaat

SEQ ID NO: 15682 - DNA, 73 bp, Homo sapiens
tttctggagtgactgggagcaatgctgcaattgagcctggacaatccaggataggcaaagttttggctcagtc

SEQ ID NO: 15683 - DNA, 72 bp, Homo sapiens
cagataaggaagaagataccctagtttaaatgaactagaggtaactcagttacaaaccaagcttaagtcctg

SEQ ID NO: 15684 - DNA, 72 bp, Homo sapiens
ttcaaatgacattggtctttatttccagtagatgggcagtaaacagggtcagggtggtcaagggatatgatt

SEQ ID NO: 15685 - DNA, 73 bp, Homo sapiens
gcagacccacacattatgtagccagtcctacagggcagccacacatgtgcaggcttgcatgaaatcctcttac

SEQ ID NO: 15686 - DNA, 73 bp, Homo sapiens
gggcaggcacttgcatgtgcacatacatgcaaacagtgcacaaatacatactcctctgctaagagaaattcgc

SEQ ID NO: 15687 - DNA, 73 bp, Homo sapiens
atttctcccctttagcagatgctttaagtacacattgctgacttgagcccacccccaggagttaggagaacat

SEQ ID NO: 15688 - DNA, 70 bp, Homo sapiens
gtcaaattcccaggagatgccgctgctgctgatccaagcaccatttgaatagcgaggctctagtctacca

SEQ ID NO: 15689 - DNA, 72 bp, Homo sapiens
gctcacctttccaatgtcttcattaggtttatggggaatcaatctggaaaggttcaagtcataatgggttcc

SEQ ID NO: 15690 - DNA, 71 bp, Homo sapiens
ctgtaatttctgagaccacctcctgcctctaggctctgacagccaggccagtgatgatgaggtccatcttc

SEQ ID NO: 15691 - DNA, 70 bp, Homo sapiens
ctggcagggcatcatcctgcgcatgaggagcaaatgactgtacagcatcctgaaatcagaacccctgcta

SEQ ID NO: 15692 - DNA, 73 bp, Homo sapiens
attaaatgaagtagctggactgggtgatttattaggttaataaaaactttaaaatcattttgttctctatttt

SEQ ID NO: 15693 - DNA, 73 bp, Homo sapiens
tgtcattcattgctttcagcgcaatgatgctgcaattgggaccaatcatatcttccctggaggcttggggtga

SEQ ID NO: 15694 - DNA, 73 bp, Homo sapiens
ttcctcagtgtggatttacacaacagaataatacatttgtaacaatctatgaatctacagtgacacatcactg

SEQ ID NO: 15695 - DNA, 72 bp, Homo sapiens
gaaatccctgtctcccactagattgtgagctcctagaagtatggggagcacattgtagatgcataatagttt

SEQ ID NO: 15696 - DNA, 70 bp, Homo sapiens
catggacccttcaagccccccactgctggcggctggccatcatagctccctgggagaagggcctacagta

SEQ ID NO: 15697 - DNA, 70 bp, Homo sapiens
tgggttacactctctttctctcggaattgtatctattcttttatcttctgcactccagagaagaagaaca

SEQ ID NO: 15698 - DNA, 71 bp, Homo sapiens
caggggagcatgctgagagcttacacatggtgtcttgcatggccggcagcatacagatttcctgcaaagta

SEQ ID NO: 15699 - DNA, 70 bp, Homo sapiens
aggagaagtgtacagtggatatagggaaaagccccttataaaaccatcagatcttgtgagaactcactca

SEQ ID NO: 15700 - DNA, 73 bp, Homo sapiens
ttacagaatatgagaatcagcctgtcagatattctgctagataactccagggatgttctcttgtttaaacctc

SEQ ID NO: 15701 - DNA, 72 bp, Homo sapiens
gaggtaggctttattatcacattattgaagattagatcattgtggctcagagtggtttaaagacttacccaa

SEQ ID NO: 15702 - DNA, 74 bp, Homo sapiens
aatagaaccaactgctttgcagtggctactggaataaacagggcgacattgtcagaagcaggaagcactttcta

SEQ ID NO: 15703 - DNA, 72 bp, Homo sapiens
tttttttttctgtgacacagcctcaggaggtcctgagaacatgtgccccctctgctttattttgtcaagaaa

SEQ ID NO: 15704 - DNA, 71 bp, Homo sapiens
atggagcttttatcagctagtattccagagtgaaaaccacatggagtagaggctcataacaagacagacgt

SEQ ID NO: 15705 - DNA, 72 bp, Homo sapiens
caaaatgacactgaatcggacctgagacaaattcctcatagaataggtcttagttaaattctgatttcagtt

SEQ ID NO: 15706 - DNA, 73 bp, Homo sapiens
aaatatactatattgttgccacatggactgtcagtttctggtttgagaaatacaaacatagtggatacacttc

SEQ ID NO: 15707 - DNA, 72 bp, Homo sapiens
ctttggtgttacagcctcagtgatgcagctcttgcagcctcaatcactgactgcttcattttctctccactt

SEQ ID NO: 15708 - DNA, 73 bp, Homo sapiens
cgggctttaggccagcccctgtggactcaggttcaaagcctatccccatacattcaggttccaggcccacctc

SEQ ID NO: 15709 - DNA, 72 bp, Homo sapiens
gtataatcagcattgttccataggtccttgtggtggctatggggtcactggctttagtgagcatagctgcct

SEQ ID NO: 15710 - DNA, 73 bp, Homo sapiens
tcaaaatcctcatttttaaaatggataatggtggtctaggtggtttccacgttctatgtatctatattgaaga

SEQ ID NO: 15711 - DNA, 70 bp, Homo sapiens
ggtcgtgtaaagacaatgccatgttggactgccagaatgagccaacagtgcttgatgtgcttccccctga

SEQ ID NO: 15712 - DNA, 72 bp, Homo sapiens
cagcagtgtgtgctattgacctgcattgacgtcagtgcgtcattaggtctcccttagaaacactgactttca

SEQ ID NO: 15713 - DNA, 71 bp, Homo sapiens
cctgcaggcctcatcacttgctccctgtgtccagctcggggccagacacaggtggtgtccatctcccactc

SEQ ID NO: 15714 - DNA, 72 bp, Homo sapiens
ctagagttggcaaatccagcagctcaatggaggtaaaactctcagttggcggtaaaactctcagttggcttc

SEQ ID NO: 15715 - DNA, 70 bp, Homo sapiens
gagtcaattttatacgcaggaacagtgcttgttattcgaagcatttcaatggaaagtccatgtataaagt

SEQ ID NO: 15716 - DNA, 71 bp, Homo sapiens
tactgtgctaggaagtgaggatacagtggtaactaccctcttcccaatgacacagtgacccatcttcagct

SEQ ID NO: 15717 - DNA, 73 bp, Homo sapiens
ctatttggggggtctgctaaatttaggggttccatgaatatgcctaaggagtgactataatatccagagtgga

SEQ ID NO: 15718 - DNA, 71 bp, Homo sapiens
atcacaatgctggtgagctgggccatggggaacgttttggctatggttgcagtctgcccattgacgacacg

SEQ ID NO: 15719 - DNA, 71 bp, Homo sapiens
gtggggtctgtagtgtagcaccagggtcccgtggtgctgctgtcggggttgcggcagaaattctcctgtag

SEQ ID NO: 15720 - DNA, 74 bp, Homo sapiens
ctggcccccagggagatgccaggcccctctgctcccagtctcaaggggccatgatggtggctgagcctgggggg

SEQ ID NO: 15721 - DNA, 71 bp, Homo sapiens
tctacatcgccttggtgaacgtgctccctgacctcttggaagaagaggacccgtggtgagtgacctgttgg

SEQ ID NO: 15722 - DNA, 72 bp, Homo sapiens
gggttagggtgggtcatatgttgctcaggtaattttatgtttctacagattttttgggtgaagagtggccta

SEQ ID NO: 15723 - DNA, 74 bp, Homo sapiens
gtccttcatgtctcaaaggatgttcagtctttatgaatatctcattaaatgtcaagagactggacattaacctt

SEQ ID NO: 15724 - DNA, 70 bp, Homo sapiens
ccaccgctactacatggactgttatctcattcacaaatatgtttccacaagcaagcttgagtattggcgg

SEQ ID NO: 15725 - DNA, 71 bp, Homo sapiens
gagcaactggattagaaaccgtagatctagtgaatggtttattttttaggtaagcatattgagtccggaat

SEQ ID NO: 15726 - DNA, 72 bp, Homo sapiens
tggctctatgcaatgtctgcctcccaggttcaacggattctcctgcctctgcctcccaagtagctggggcta

SEQ ID NO: 15727 - DNA, 74 bp, Homo sapiens
tccttgcagccatcctttaagagggggcattttcacctcattttgctcataaggaagctgagactcagagaggt

SEQ ID NO: 15728 - DNA, 72 bp, Homo sapiens
gtgcaacatggcaagaccctgtttatctgtacaaaatttttttttaaaaaattagccaggtatggtagccat

SEQ ID NO: 15729 - DNA, 73 bp, Homo sapiens
cagggacaatttgcctagcttatctcttcaatgggtccatgagctgggttcacacatctctagcaaactgata

SEQ ID NO: 15730 - DNA, 70 bp, Homo sapiens
ttggaaaatgtagaataagtggatcaattcctggacacacacaatctgccaagattgaaccaccaagaaa

SEQ ID NO: 15731 - DNA, 71 bp, Homo sapiens
cttaaaaatggcagagtaataatgtaaggcatacaccaacaatgcctacagaacaggctatgcttgtgttc

SEQ ID NO: 15732 - DNA, 72 bp, Homo sapiens
gggggaggggtgataacagcactcctttggctgacccagctggtgtctcagtatgtcaaatatccccctagt

SEQ ID NO: 15733 - DNA, 72 bp, Homo sapiens
aggagcagacgaatgttggggcaaaggcacaggtctctatcttggcagggcactgcccagaagctaggcaga

SEQ ID NO: 15734 - DNA, 70 bp, Homo sapiens
gtctgctcgcccctccctgctgtctcttagtgttgagggaaacaaagatcacaccctgggaggcaggagg

SEQ ID NO: 15735 - DNA, 70 bp, Homo sapiens
aagtgctgggattacaggtgtgaggcaccatgcctggcctcattcccttttagtaatactgactgtaatt

SEQ ID NO: 15736 - DNA, 74 bp, Homo sapiens
ggcctttgtggtttttcccatatttcaaagtatgacttattatggatatagggaaatcattacaaaggccaaag

SEQ ID NO: 15737 - DNA, 74 bp, Homo sapiens
aatcctagcaccactcaggtgattggcagtatgaacttctctatgccttagtttcctcatctgtaaaacagagg

SEQ ID NO: 15738 - DNA, 74 bp, Homo sapiens
ggatagctcagtcggtagagcattagatcatacgctttttgttcaattctgtatctacacggctgtccacactt

SEQ ID NO: 15739 - DNA, 73 bp, Homo sapiens
tttttgtagagggaaagatttgttgcaagtcaactgggaaggagacatgctcaaatctgtctccccaagccag

SEQ ID NO: 15740 - DNA, 71 bp, Homo sapiens
aggtaggccttaatttgccttataatgcagatgaagaaaaagaggcgcagagaggtctgtaaaaggtcatg

SEQ ID NO: 15741 - DNA, 74 bp, Homo sapiens
gtgggcacagcagaataagccctaggtttggggtctaggagaactaggctgagaccctagtccagctgctaacc

SEQ ID NO: 15742 - DNA, 74 bp, Homo sapiens
agccaactcattctccagctgggggtcatcagctccggactgggcctcccgcccccacgtgacccctcccagct

SEQ ID NO: 15743 - DNA, 74 bp, Homo sapiens
cctgagctcagtccctccccatgtggcccaggtggggactcatttccagggtaggtagttgggggctggctcag

SEQ ID NO: 15744 - DNA, 71 bp, Homo sapiens
gtctctggctctcaggttccctctgtgccgtgaggggcgaccagctggaacagcaactccagtgtgaagac

SEQ ID NO: 15745 - DNA, 74 bp, Homo sapiens
ctaggaggcagcagggtgtggacacaggcttcaaagtgacacccactgggcgtggtggctcacgcctgtaatcc

SEQ ID NO: 15746 - DNA, 70 bp, Homo sapiens
gcgcccagccacccggctggtcacattggctgcgacattgtgactcaggtcaaaagggtcctggagattc

SEQ ID NO: 15747 - DNA, 72 bp, Homo sapiens
gaagggacagtggttggtggcttccagacatgctgtgtcctcaagaatccaacaagcatcttcttcatcctg

SEQ ID NO: 15748 - DNA, 74 bp, Homo sapiens
cggcagctcacaggaccccggagagtcctggcatggtatctcggtccggactctccgctgggcccacgaaggag

SEQ ID NO: 15749 - DNA, 71 bp, Homo sapiens
cctcccaaagtgctgcaagtacaggtgtgagccaccgcacctggcctaataaatgttaagactccattctt

SEQ ID NO: 15750 - DNA, 70 bp, Homo sapiens
aagcggccggcggagaggggcgggacttccccgggagccggaagtcccgtctcacggttgccctggcagc

SEQ ID NO: 15751 - DNA, 74 bp, Homo sapiens
agtggcggcggcggcaggcggcagaggggaggtaagattcgctttaagaggggatctggccgccgtgtcagctc

SEQ ID NO: 15752 - DNA, 74 bp, Homo sapiens
atgccttgccgcgttgctggtcggcctgaaagtaactctaaagagtgcgtgggtcggaggacatcggggctgag

SEQ ID NO: 15753 - DNA, 74 bp, Homo sapiens
aatctctgctctttcgttgagtgtgtggaagttgctacggggatgattttacgaactgaactctctctttctga

SEQ ID NO: 15754 - DNA, 72 bp, Homo sapiens
ctttgtgaaggacaaaatggcgatggcgggccgtgtaggtcccccttcctatgatgaggaccttttcacaga

SEQ ID NO: 15755 - DNA, 70 bp, Homo sapiens
ctggacatgaggccagtgacctatgagttgacgcagcatgaggactctgcccaaaagtggtgctccatat

SEQ ID NO: 15756 - DNA, 73 bp, Homo sapiens
gaggacttctcatcttgttaagactcagtcttgttaggactgagccaggggatatcaggggacctcaggggaa

SEQ ID NO: 15757 - DNA, 74 bp, Homo sapiens
ccttctctgtgaaatattttaaagactatctggatgttctggcatgcacctgtagtgctacccactcaggaggc

SEQ ID NO: 15758 - DNA, 70 bp, Homo sapiens
gaagcgggaggtggtcagccaagctgccactgaggggaaaggcgatctgaccagtggaaatcttctagaa

SEQ ID NO: 15759 - DNA, 74 bp, Homo sapiens
cctcctcgtaggcctccaggatagtctggcgctcctcaggcgtgaagtccatggagaaggggtgcacctgcagg

SEQ ID NO: 15760 - DNA, 74 bp, Homo sapiens
ggccggcggcccgggcgggggccccggcgtgggggaagggagggctgcggctcggggcccctctccgccgccga

SEQ ID NO: 15761 - DNA, 70 bp, Homo sapiens
cccagccctgttttttcgtaaatacgaagaacaatgagaaaatttgtgtctgaggaagcctactctggaa

SEQ ID NO: 15762 - DNA, 72 bp, Homo sapiens
acccatgggtgaggtggggaggctgcagcaggacctagtccccgctgagaccctagctcccctcaggcatcc

SEQ ID NO: 15763 - DNA, 74 bp, Homo sapiens
cactgtccccctcacccctctcgcccaggagcagcagtatgcccgctggatggctggctgccgcctggcctcca

SEQ ID NO: 15764 - DNA, 74 bp, Homo sapiens
ggctggggtgcaggtgggtgggggcaggtgggaccccagctgaccctgctgatcctctcccaccccagaccaga

SEQ ID NO: 15765 - DNA, 73 bp, Homo sapiens
taggcccgaggttgggcaacccgtgtggcagggtgtctcccatcccccataccagtgctttcctgcgaaccta

SEQ ID NO: 15766 - DNA, 72 bp, Homo sapiens
gtgagccccggggagcggccgcccggtgcctgggcgcgggggtgagggcctggggcgcttcgtgggggtcgg

SEQ ID NO: 15767 - DNA, 74 bp, Homo sapiens
gggtgaggagtggctatcagtgaggggagaggccagcaaggtgctgaggccactcctcatgcccccagtttcag

SEQ ID NO: 15768 - DNA, 74 bp, Homo sapiens
tgggaatacagagatgagtaagacacggttcctgccctcgaggagctcacagtctactgagggagacagacaca

SEQ ID NO: 15769 - DNA, 74 bp, Homo sapiens
accctcagagctctggggggagaaatggagacctgagcatccctgctgccccctagaacttctccagccctctg

SEQ ID NO: 15770 - DNA, 74 bp, Homo sapiens
tggaaagcactttcacatccactgtctccttcttgcctcccaacaagccggcgggagggggtgggaaggccatc

SEQ ID NO: 15771 - DNA, 73 bp, Homo sapiens
agtgtgaggataaccaggagcattgatgtcttagaagcttaagtgaggggccgggcatggggttctcacccgt

SEQ ID NO: 15772 - DNA, 73 bp, Homo sapiens
ggattcaagcttccttcttgaggtagcccctaagtgtcatgggctcaaacacccactaccaaaagagtctgct

SEQ ID NO: 15773 - DNA, 73 bp, Homo sapiens
aaggcagggtacaggatagcactgagacctgagtgtgctcagtgttaggaaatgtctggtcgtccagtgtggc

SEQ ID NO: 15774 - DNA, 72 bp, Homo sapiens
gggccgctcgcctgagccccggcggcgacccgcgccccgggcgccgcgcgcactccccacaccagtgagccc

SEQ ID NO: 15775 - DNA, 72 bp, Homo sapiens
atgctagccttgcaaatgggtttggagacgtctttttcttcaggcttgaatactttataggccaggcatttg

SEQ ID NO: 15776 - DNA, 72 bp, Homo sapiens
tctgcccgcccacccccggcccaggcccggatgaatgggctgaaaggggatccaagccgggagagcagcagg

SEQ ID NO: 15777 - DNA, 72 bp, Homo sapiens
ttttgcggccgagggcacccctcggggctggcgggccctgggaactgcgccccgggcgggtcctcgcaccgc

SEQ ID NO: 15778 - DNA, 74 bp, Homo sapiens
ctgtgatccacagaaaggaaaggcccagggggcactctccactgcctttgcaactggacctaaatttcttttct

SEQ ID NO: 15779 - DNA, 74 bp, Homo sapiens
tgcgcgccagggtcgccatgcacctcgtgtgcccctcgcgttacgaggcagccgtgcccgacccccgggagccg

SEQ ID NO: 15780 - DNA, 72 bp, Homo sapiens
caatttccagggtggttttatgtggattctctgattctactacatgaggcatgttaatggaaaaaccaaact

SEQ ID NO: 15781 - DNA, 72 bp, Homo sapiens
catcgaggcccacaagaggggctcccgcttctggatccaggacaaaggccccatcgtggagaggtgaggcgc

SEQ ID NO: 15782 - DNA, 72 bp, Homo sapiens
atgaaactcaatgtgccccgaaagacccggctttacgtggatcagacactgcgagagcgggaggctggcacc

SEQ ID NO: 15783 - DNA, 74 bp, Homo sapiens
aggcttcagaaagatgtaaatcacttctcggccagtttacatgctagactggtgtttctttaaatatgctaaaa

SEQ ID NO: 15784 - DNA, 70 bp, Homo sapiens
ccgaggcgggtggatcactcggatcaggagttcgagaccagcctggccaacatggtgaaaccccgtctct

SEQ ID NO: 15785 - DNA, 71 bp, Homo sapiens
aggctgaggcgggagaatcacttgagcacggggagttggaggtaatcgtaccgtgagtacagtgagccgtt

SEQ ID NO: 15786 - DNA, 74 bp, Homo sapiens
agaagggtcctgagagatgaataggagttcataagcccaaagggcagaggcggtggacacctgcaaagtcctgg

SEQ ID NO: 15787 - DNA, 73 bp, Homo sapiens
tataaagtctgtcttgcttagtgactctctgccttgctggctttgaagaagcaagctgccctgtcacgagcgg

SEQ ID NO: 15788 - DNA, 73 bp, Homo sapiens
gactggacaactgttcacctaacactgttactgtaaatgttggcaaccgatagggtttggctgtgtccccacc

SEQ ID NO: 15789 - DNA, 73 bp, Homo sapiens
ggggctgctgtgcccaccagggcggatgtgcctaccgaatcccactcctctgtgtgtgtccctttcaggccct

SEQ ID NO: 15790 - DNA, 72 bp, Homo sapiens
gaccctgtctcaaacaaaagcgaaaacaaaacttagtaaagctactgagatggtgtggctttggcaaagaat

SEQ ID NO: 15791 - DNA, 73 bp, Homo sapiens
gtccggggggaataccggggttcctctcggcgccccggttccggcggcgtcccccacccggtccggttcccgg

SEQ ID NO: 15792 - DNA, 73 bp, Homo sapiens
cttggcagagcgctggcgccgtcgggcccggcactccacgtgcaggatgagggccaggcagggcagcaccatg

SEQ ID NO: 15793 - DNA, 72 bp, Homo sapiens
tgttcctgacagcgtccttgactagctgtttgatcaccccgagcaaagttacataccagctttcaaccgttg

SEQ ID NO: 15794 - DNA, 73 bp, Homo sapiens
caggaggatcaagaggggcaaaggaggtttgcaagatccaggttggtcaatcagtgtttcttattcccctggc

SEQ ID NO: 15795 - DNA, 73 bp, Homo sapiens
cacagtggcccctgctgggttaggtgtgaggcatgggggcggctgcgcccgttgggtgctctgtgttacaaag

SEQ ID NO: 15796 - DNA, 73 bp, Homo sapiens
gtagccagtgcaagggccctgaggcaggagtgtgcctgatgcatcagaggctcagcagagaagctggccgggc

SEQ ID NO: 15797 - DNA, 70 bp, Homo sapiens
aagtggcacctgtgcggcacgtggtggggctgtggcccagccctgctccttgtggaaggtctgtttcctg

SEQ ID NO: 15798 - DNA, 70 bp, Homo sapiens
caagaggtggatggggagggggcatctccaccaggtgaccttgatccctaggatcccaccctgtgcagat

SEQ ID NO: 15799 - DNA, 72 bp, Homo sapiens
aggacagtgagccactggtatggatgggcaccgctggtgggtgccctggggtgaccaagggggcggggttag

SEQ ID NO: 15800 - DNA, 72 bp, Homo sapiens
tctatagcaggaggatatgcgtacagcacagtgtggctggtgaggggcatgacgtcttggctgttgtttacg

SEQ ID NO: 15801 - DNA, 72 bp, Homo sapiens
gacaggatctgattcaatgctggaagaagaacacacttcttgtccagctacatcagaaggcggtgcgaggca

SEQ ID NO: 15802 - DNA, 72 bp, Homo sapiens
ctgaggaaggtgagttagcagatgccgtagaggtggaggtccctgaatccatctgtgtaatccaagcctcat

SEQ ID NO: 15803 - DNA, 73 bp, Homo sapiens
gcttgaacccagggtgcagaggttgcagtgagctgagatcgtaccactgcagcagctccaccctgggtgaaag

SEQ ID NO: 15804 - DNA, 71 bp, Homo sapiens
agtgcctgtgtgtctcctgagagcctaaggataggacttcctagcctgccatcaccgctgccaccagtgcc

SEQ ID NO: 15805 - DNA, 70 bp, Homo sapiens
aagactaccaaatagaacgagaactttgaagtcggatggctagtgatatcgctagttaatagcagcaggg

SEQ ID NO: 15806 - DNA, 70 bp, Homo sapiens
cgaagaggtacgattccggagaatcgcgaggcagagcgggagcgcgcagccaggtaaccggcgcgggccc

SEQ ID NO: 15807 - DNA, 72 bp, Homo sapiens
gccagctgatttctcatcacatcattctgtgcccttgcgtggatttttgtctactgtgtttgttgtcagcct

SEQ ID NO: 15808 - DNA, 71 bp, Homo sapiens
gcccttttttgtgtctttcctgggagtcacatctggggacttaggagaggtgtagagtaagtgatctgggc

SEQ ID NO: 15809 - DNA, 70 bp, Homo sapiens
aagagacagggcaagacctgtccctactgtctccagccagccctgctccttacagcctcacatagccctt

SEQ ID NO: 15810 - DNA, 73 bp, Homo sapiens
taaatggagatgggcactatacattagaaacagagtaatgtaggtggcatttatccatgcaatcagtggatct

SEQ ID NO: 15811 - DNA, 73 bp, Homo sapiens
aggtctgtagacccagaggtttaacagtagtggaacattaagtgtgggcagccaggtcatggaatacaaggcc

SEQ ID NO: 15812 - DNA, 74 bp, Homo sapiens
ctcctcgtttctgaaattaggcattatatggttccaggacccagccttcaaaattcctggcaggccagcttcaa

SEQ ID NO: 15813 - DNA, 72 bp, Homo sapiens
aggcttggtagtttatgcctgtaatctgaatactttgggaggtggccagaggattgcttgagcccaggagtt

SEQ ID NO: 15814 - DNA, 72 bp, Homo sapiens
caggttctctagcttttgcgctgagctctgtctggctgtgcattccggagaggctcggcaaatttgctgtga

SEQ ID NO: 15815 - DNA, 74 bp, Homo sapiens
ttgtagggaagtgaaagggaaagggtggcatcagaaagtgataatccaggatccttaccagatctcttgatcag

SEQ ID NO: 15816 - DNA, 73 bp, Homo sapiens
tagaaacgaggtcttgctatgttgcccaggctggcttcaagtaatcctcctgctttagcctggcctcaagtaa

SEQ ID NO: 15817 - DNA, 73 bp, Homo sapiens
catgaggattagaaaacagttgttgctgggcgtggtggctcacacctgtaaacccagcactttgggaagctga

SEQ ID NO: 15818 - DNA, 70 bp, Homo sapiens
ctgacacatctgtgccctgtaccgtggctcctttcctggaaaatggggtttggaaacagggctctgtcat

SEQ ID NO: 15819 - DNA, 73 bp, Homo sapiens
ctgcatcatgcatttttatggtttattcaatcagttccctgtatagtgatgaatacgtaacctaatgaatgat

SEQ ID NO: 15820 - DNA, 74 bp, Homo sapiens
gcaagaggagatgccatcatgccgccagggagttcttgaactgctgatggttccgagacaggcaaagggtcctc

SEQ ID NO: 15821 - DNA, 73 bp, Homo sapiens
gggtggtgagctgggttagacccaacatggggtgcccctccaagtcaggggtcccagggcatctggtcactcc

SEQ ID NO: 15822 - DNA, 74 bp, Homo sapiens
atgcccagtgctctcacctctttttggatctgcctttccagtgggaaactgaatcaagaatccagttggtggtg

SEQ ID NO: 15823 - DNA, 74 bp, Homo sapiens
gggggagcgccgagcaatctgggggtgcgcgagggagtaagaggggcgaggggaccctgcgaagcgttgggtgc

SEQ ID NO: 15824 - DNA, 74 bp, Homo sapiens
gaggccaagatttagatttaggggtaatgtaggaggttcccttgggcctaaatccccctattttaacccagtcc

SEQ ID NO: 15825 - DNA, 72 bp, Homo sapiens
tgcgggaggcggggcgggcacggctccaccggagccgcagccgccgccgccgcgccggggagggggagtggg

SEQ ID NO: 15826 - DNA, 74 bp, Homo sapiens
ccggcggggactaggcggcgcggcgcggcgcgagcccggcagcctcgcgcgcgcccgctcccccgccccgagcg

SEQ ID NO: 15827 - DNA, 71 bp, Homo sapiens
tcaccacccgcataatatcatctgctttgaaagactaggctttctgtgagcatagcttagatggatggtga

SEQ ID NO: 15828 - DNA, 73 bp, Homo sapiens
ttagtcagaaaatgagagttagagctttgaagatagacaagaccttcaaagtgaacggctacaaccactttct

SEQ ID NO: 15829 - DNA, 73 bp, Homo sapiens
cctgaaggcttatgtcaccccttgttcaagctcctcaagagcttcctcttgctgcttgtgctagttggctttt

SEQ ID NO: 15830 - DNA, 71 bp, Homo sapiens
ccctggatcgtgctcatagcacatcaaggtaaacagagacattcccagggtgtgtactgtaggcaattcta

SEQ ID NO: 15831 - DNA, 72 bp, Homo sapiens
aaccttctctcaactgtgactgggtcaaattcccccaagatttcacagctctgagtagattcacttaaagca

SEQ ID NO: 15832 - DNA, 72 bp, Homo sapiens
caccacagcttatcagactggagtagagatgggggctgctggccgcctcatctcaagccgttgtggtggcag

SEQ ID NO: 15833 - DNA, 72 bp, Homo sapiens
tattttcagtctctgtctttatgggtgaagtatgtttcccataggcaacagatcattgggtttgttttctta

SEQ ID NO: 15834 - DNA, 71 bp, Homo sapiens
atgggttgtaatcagtggcaagctttgctatagacctgggctgagtatagcttgtcagcagatagctctct

SEQ ID NO: 15835 - DNA, 71 bp, Homo sapiens
cctctgcttcaccctgaagcagggtaaagtgaagcagaggatgcatcacctatgaattgacaccaacaagc

SEQ ID NO: 15836 - DNA, 71 bp, Homo sapiens
tttttgtagatactctgccctcatggaggtggtatagaactccccatttcttaaatgtaggctacacatag

SEQ ID NO: 15837 - DNA, 72 bp, Homo sapiens
ataaggtaatgcgtaagaaagccctgtgtatgcggaaacacagcatgtgtatggaagggcttattaactgta

SEQ ID NO: 15838 - DNA, 72 bp, Homo sapiens
cctttaaggctatatcattagcatcaaaaagaaggccttacctttgatgccttttctgataaatggctatta

SEQ ID NO: 15839 - DNA, 72 bp, Homo sapiens
ttggaactgctatacagagtacccactggggcaatgcatagtggagctgtgagaagagggccatcatcctcc

SEQ ID NO: 15840 - DNA, 72 bp, Homo sapiens
accgtggaaagagtttctgagtaatctgagaacttagttctcagcatttaattttatacttgaggaaactga

SEQ ID NO: 15841 - DNA, 73 bp, Homo sapiens
gaccggggctccggcgggtgcgctgctgtcgggagccgaaggaggggacgtgcgcgaggccacccgcgatcta

SEQ ID NO: 15842 - DNA, 74 bp, Homo sapiens
aaagaccttcttagccttctcagctcagcaggacactgggcttcaccttctgcagtagggaaattgtcttcatg

SEQ ID NO: 15843 - DNA, 73 bp, Homo sapiens
gccaggttccctgccctgattttcatactggagccttttcctctgggattcttgtgactcataaagtcagcct

SEQ ID NO: 15844 - DNA, 72 bp, Homo sapiens
aggcatgagtgctgccagggatgaggcatgagtgatgtaaacattcccgccttgccagcagtccaaccttcc

SEQ ID NO: 15845 - DNA, 73 bp, Homo sapiens
gtgttgttttaaatctagcttgctgctttgatgttgaatatgatagtaaaagatatgttggagaagctgcaaa

SEQ ID NO: 15846 - DNA, 73 bp, Homo sapiens
tgtatgtctagcagctgtggatgctgaataatgcaactaatacagctgtcagtaagtcaaatattttgtttag

SEQ ID NO: 15847 - DNA, 70 bp, Homo sapiens
tgcttagattaaatggagtgacagctgtatcatgtgtcaggatgaccgagcagtctaaggcactgcattc

SEQ ID NO: 15848 - DNA, 71 bp, Homo sapiens
gcccaagaaaaagcacctggactgtgagtgaagccgaccgcggcccccgctccccggcgcccgcgcgaccc

SEQ ID NO: 15849 - DNA, 72 bp, Homo sapiens
ttgtcttgtttggggttcactgacattcttgaagaatctgtagtagattgatgttttgtcccaggtttggaa

SEQ ID NO: 15850 - DNA, 72 bp, Homo sapiens
ttgggtgcagactggagaatcaactgccctttcctttcttggtaaacttgctgccacctgcacagccctaga

SEQ ID NO: 15851 - DNA, 71 bp, Homo sapiens
gggggtacacctgctatgacattaggagtatcatcccactaggatattacaaaaaatatcacagggtgtac

SEQ ID NO: 15852 - DNA, 72 bp, Homo sapiens
gggatgatactcctaatgtcatagcaggtgtaccccctgtgaaattttttgtaatagttttgggggatgtta

SEQ ID NO: 15853 - DNA, 70 bp, Homo sapiens
tgttggccagactggtcttgaacttctggtctcaagtgatccacccgccttggcctatgataaattgttt

SEQ ID NO: 15854 - DNA, 73 bp, Homo sapiens
tccttttgagtagctgggactacaggcgtgtgcaactgcacccagctgtatagctttagtattttaagaagtg

SEQ ID NO: 15855 - DNA, 70 bp, Homo sapiens
atgatgttgcctcagtttcctacttgatcaactgggtaaatggttgtcctatttactgaggtatgggaga

SEQ ID NO: 15856 - DNA, 70 bp, Homo sapiens
ctcttaggcaagaaggtgcccagtagaaccatttacaggatctatgcagggagatctgcaaaaaggacaa

SEQ ID NO: 15857 - DNA, 70 bp, Homo sapiens
ttgaagtccttagccagcaggctgggagctgcagcaccactgcaagactgctccccagctttgtttgact

SEQ ID NO: 15858 - DNA, 73 bp, Homo sapiens
actgttctgagttgatatacaacctcagtaagccaatagaggtccacaggggtctggttgaaatggaagagca

SEQ ID NO: 15859 - DNA, 72 bp, Homo sapiens
ttttctctagagcagtccctgagacaaatacttgtgtgcaaatagaatatttgggaagtggtcccaggaagt

SEQ ID NO: 15860 - DNA, 72 bp, Homo sapiens
gaaggagggtgtgggacttgaaggctggctgaagtgaatcagatgcctatgaaatgaggatgactgccagtg

SEQ ID NO: 15861 - DNA, 70 bp, Homo sapiens
cttctgcatatggatgtccagttttcccagtaaaatgtattgaagagactgtcctttcctcaacgtatat

SEQ ID NO: 15862 - DNA, 72 bp, Homo sapiens
ataactgattttgatggacaattgattttcaacataagtgcaatggtaattcagtgggaaaaggattgtctt

SEQ ID NO: 15863 - DNA, 73 bp, Homo sapiens
ttctgcaatgagtaaaagcttcctgagacctccccagcagcaggtgccagcgctatgcttcctgcacagcctg

SEQ ID NO: 15864 - DNA, 70 bp, Homo sapiens
tactgctaaagggttcaaggactgagcatggtggttcatgcttgtaatcccgactgtttgggaggccaac

SEQ ID NO: 15865 - DNA, 74 bp, Homo sapiens
agtttatagttttttagaaattttatttactttgtgtctctttgtcaaaataaaattaatgctgaaaagctata

SEQ ID NO: 15866 - DNA, 70 bp, Homo sapiens
tctatcaatatggagtcacagagctatcacctagttgttcctagctcctgtagatcttcagtaaatgaag

SEQ ID NO: 15867 - DNA, 70 bp, Homo sapiens
aattattaatggtgtcgcagttttacttaggcccttatgaggtgctgtgcggaatcattacattttttgt

SEQ ID NO: 15868 - DNA, 73 bp, Homo sapiens
agcccaattgcttcagtcatggtagccagactcacttttgaagtttagtccgtcagagactacagctgcattg

SEQ ID NO: 15869 - DNA, 74 bp, Homo sapiens
acagatttgaaagttgaggatttagctctgggcaccatagactggcactctgttcagaagcacttccctccttt

SEQ ID NO: 15870 - DNA, 70 bp, Homo sapiens
accacattttttctggaaaattacaagaagttgcccatatcaggtatatttcctgtgactttctcctcta

SEQ ID NO: 15871 - DNA, 72 bp, Homo sapiens
ccttacccctgcaccccctcccctaacacacatactccagtctgtaagccaggtgtttagggggtgggaaga

SEQ ID NO: 15872 - DNA, 71 bp, Homo sapiens
aaatacatatatcctaagactcaatgttccattcctaggaatattctgtagcaaaacaggtgcacatgtat

SEQ ID NO: 15873 - DNA, 74 bp, Homo sapiens
tttacattcttacagacaagaattgtttgcactgctgtcagtgtgctgcaatttaacttctgtctctacagaat

SEQ ID NO: 15874 - DNA, 74 bp, Homo sapiens
taacgatgttatgatgatgggcgaaatgttcaactgctctgaaggggctgaatgaaaatggcctttctgaacat

SEQ ID NO: 15875 - DNA, 72 bp, Homo sapiens
cagcattcccagaccccttggtgcccatgacagaggccaggagtcagagggttgggacagcaactcagcttg

SEQ ID NO: 15876 - DNA, 72 bp, Homo sapiens
ggccagatcaaaaaaacgacatcatcaaaaatgtcacaacaggaatgtgacatgtgagagctgggaagtgaa

SEQ ID NO: 15877 - DNA, 72 bp, Homo sapiens
aggaggcacggggcgagctgtgggtgtgggcgtgggtatggctagtttcctgcaccaaatctgtgcagagag

SEQ ID NO: 15878 - DNA, 72 bp, Homo sapiens
ataagttgggacatctaggctactcacccatgcccaggctgagatgcctttgccagtgctggatgacacaag

SEQ ID NO: 15879 - DNA, 70 bp, Homo sapiens
taaactctggtctccctgtggagtgctgtagatgtttgtcgtatagaataacataggcatggatttttat

SEQ ID NO: 15880 - DNA, 72 bp, Homo sapiens
atggatccagataattcaggatagcaaagggctgatgttctttatttccagattgactttccaatatccaac

SEQ ID NO: 15881 - DNA, 73 bp, Homo sapiens
gaaagacagactcaatccctgtcctccaggagatcacagtctctgtagtcaaagaacaggatttgaaggtctt

SEQ ID NO: 15882 - DNA, 72 bp, Homo sapiens
tcttcatttcctggacggtttcggctgggaagaacctctttaagcattgatatgccagtctaattacaatta

SEQ ID NO: 15883 - DNA, 73 bp, Homo sapiens
ggcctgacttaacatgcccagttttctgtccttaggggccacatctgaggtctggtgggagtcaaactttcag

SEQ ID NO: 15884 - DNA, 71 bp, Homo sapiens
aatatgatttcaaagtacttacttgtgatggctactgctgtgacgatggtgatggtgatgatggtggtgat

SEQ ID NO: 15885 - DNA, 72 bp, Homo sapiens
catattggagacttctgcagaaggtgaggggaaccactggaaggttctcagcagagaagtggtagggttgca

SEQ ID NO: 15886 - DNA, 72 bp, Homo sapiens
aagtactaatcaggcctgaccctgcttagcttccaggatcagatgggatcaggtgtattcagggtggtacag

SEQ ID NO: 15887 - DNA, 72 bp, Homo sapiens
aagtctgaaatgggcctcacagggctaaaattaagtcatccactggctgcattcccttttgaagcccctaga

SEQ ID NO: 15888 - DNA, 73 bp, Homo sapiens
tgaggagatggatttatgtgtgtgtgtgtgtgtgtgtgtgtgtgcataaaacaatacatataaaatacatagc

SEQ ID NO: 15889 - DNA, 70 bp, Homo sapiens
ctcaggatgatgccatatgatccatatgcccaaaggctgtatcaaaggataaaataggattatttctaat

SEQ ID NO: 15890 - DNA, 73 bp, Homo sapiens
catttagaataaattctctgtagcaaattcttctgcagcagggcagccagggaaatgcggtagaggaaagaat

SEQ ID NO: 15891 - DNA, 74 bp, Homo sapiens
gaaaatatctatgatgatggattttactctcataagaaaatgtccagtttcctgtaattcctatcatcactaga

SEQ ID NO: 15892 - DNA, 73 bp, Homo sapiens
tgaaggcgggagctgagggctggagagtctctgttgacatagtaactcttcagctccgtctcccttgctctcc

SEQ ID NO: 15893 - DNA, 71 bp, Homo sapiens
cccctatgacctatgaatagacccacgtaggaggaggggagatgccccccccgatttccttagttcttagg

SEQ ID NO: 15894 - DNA, 73 bp, Homo sapiens
ctgacaactgaggtggctactaagtgaccaatggggtggtggcatgggaggtagcatagacagtatggatgca

SEQ ID NO: 15895 - DNA, 72 bp, Homo sapiens
caatctgtctcaaacagtgaataaaaccaagtcattaaatggcttttcaagtgttttgatatcagaagaact

SEQ ID NO: 15896 - DNA, 73 bp, Homo sapiens
ggtatttcctgagaaattcctgatcaaagccatgtgtcagcttctctgggaagtctttccctacagccagaaa

SEQ ID NO: 15897 - DNA, 73 bp, Homo sapiens
ggttggaacatgttcttttagcttggtggagtctgttattacccaccatctgaagactacttctgtcaattca

SEQ ID NO: 15898 - DNA, 73 bp, Homo sapiens
aagaagcatgctgtgtaacccaggaagcacattcatcttcaatgtagtaataatgcctttcctatgtgccagt

SEQ ID NO: 15899 - DNA, 72 bp, Homo sapiens
ctcccttcaagtattcccagatagcgaccacttggtcaatctttgggataagctggcccttacagggaacat

SEQ ID NO: 15900 - DNA, 72 bp, Homo sapiens
ggcctcttagagtgctgggattacaggcgcaagccatcatgcccaactgctaaaggtatatatttttaaact

SEQ ID NO: 15901 - DNA, 72 bp, Homo sapiens
gacttcaaatataattgagtgttgttaccatagctgtagctactacagccattttagcattaccaggtgccc

SEQ ID NO: 15902 - DNA, 72 bp, Homo sapiens
aaattagaaaaaaactaacgtatattgatagaaattcaatcactacttatctgaggggggagtttttttctt

SEQ ID NO: 15903 - DNA, 72 bp, Homo sapiens
tcaagagccgagtccagccatgcgttcgtacactcaaatacctatgagttgggtaaattcctctcctctcaa

SEQ ID NO: 15904 - DNA, 70 bp, Homo sapiens
caatttgcagaaatggggctcagttcagcagacaaaacattaaaatttgaaagctagtcagggtcctatc

SEQ ID NO: 15905 - DNA, 73 bp, Homo sapiens
atacttagcttatcattgcaaccatgtatcttccgaactgcaaaccaagtcggttataataaacaggttggaa

SEQ ID NO: 15906 - DNA, 74 bp, Homo sapiens
ctgaaaacaaagagtaattattactccctttattttttatgtgggtttagtgtgctcgatttagttgttcgcag

SEQ ID NO: 15907 - DNA, 73 bp, Homo sapiens
aacattttttgggaaaaatgatttgatgctgtggcatcatgaattcagggatttccaaatatttgtttggagt

SEQ ID NO: 15908 - DNA, 72 bp, Homo sapiens
tctggattctgcaagtaggaatatgagtgtcacttatgataatattagtatttttattgctataattgtcag

SEQ ID NO: 15909 - DNA, 72 bp, Homo sapiens
cactgttcacattttattacatatttactcttgagtgagagattagtgagatagatgtgatttcagagatgg

SEQ ID NO: 15910 - DNA, 72 bp, Homo sapiens
ataacataggtcaaggtgaagttcttctgactggagctgatggaaggaccacatcatctctggctttgttca

SEQ ID NO: 15911 - DNA, 71 bp, Homo sapiens
attgcccaggccaagatcatggagcttttcttgtatgttttcttctagtagtttcataatttcaggtctta

SEQ ID NO: 15912 - DNA, 71 bp, Homo sapiens
gaacagggcagagcagcaatatagccagagtctagcaatatagacagctgctctattagtcctggcaggct

SEQ ID NO: 15913 - DNA, 71 bp, Homo sapiens
ggaagcatcatcaaccatcaacttagcaagctcgcctccctgcgttgttattgaaaggatgtggtttctgg

SEQ ID NO: 15914 - DNA, 72 bp, Homo sapiens
ttatttatctatgggctaggcacccgcaaacaaatgttcgaaaggtgtctcaaactcattatgcctccaaat

SEQ ID NO: 15915 - DNA, 73 bp, Homo sapiens
cactggcccgcatcctccacctggccctggcttgacattaggccatgcttccagatggttgatcgaaacacag

SEQ ID NO: 15916 - DNA, 74 bp, Homo sapiens
ggaccgatttatatgtcgtgtctcttttcttctgctaggttgtaaacttgctgagcacaggaaacatgcatatg

SEQ ID NO: 15917 - DNA, 72 bp, Homo sapiens
aagtgatggaactttgacatgaacctaggtcctttgcctttaaattataggatctttgcactgttactcact

SEQ ID NO: 15918 - DNA, 70 bp, Homo sapiens
ctgaccactcgccaggaagtacatcaccagttcaaaggagcacagaccactgcttccccctggctttgcc

SEQ ID NO: 15919 - DNA, 71 bp, Homo sapiens
ctcagccagggagtggttggagtctcaccgttcctgtccccgggtggaggtgggaaattcttctccatgag

SEQ ID NO: 15920 - DNA, 73 bp, Homo sapiens
atgttttacagtttgagcttttgcatgtaggtctataatccattgagtttatgtttgtaaattgtgagacaac

SEQ ID NO: 15921 - DNA, 72 bp, Homo sapiens
atacatgtgatcaggagatagtgagttcaggagtaaaggagaacaaaaccaaatgataatgactcacatgta

SEQ ID NO: 15922 - DNA, 72 bp, Homo sapiens
tgggtttctcagagtttccacttctgacaacttacatctgtattttgctgctctgagcaacccttctctagg

SEQ ID NO: 15923 - DNA, 74 bp, Homo sapiens
ctattccagtgctagtttggcaatggtaaagacccaactctttggatggttcttcaaaatacccccaaatactg

SEQ ID NO: 15924 - DNA, 71 bp, Homo sapiens
ttagctcaacttccttgtcgtaaaggtttatagtgcttcctacttctcttatgaggaagccttaccactat

SEQ ID NO: 15925 - DNA, 72 bp, Homo sapiens
agcccccacattgatcctgcaacttcctcgtgtagcctcagctatctagcagcacataatgtggtgactgaa

SEQ ID NO: 15926 - DNA, 70 bp, Homo sapiens
atctgctccatggatatcatcggctattgttccagacagtagttctgcagctctgaaagcagttttccct

SEQ ID NO: 15927 - DNA, 73 bp, Homo sapiens
aatccctaagcacagtgtgctgactcatagtgcagcgatccaatgcatctccaccactatgggtaaaacacgc

SEQ ID NO: 15928 - DNA, 73 bp, Homo sapiens
attttgtgccctgggattctcccttgctttaccttagccttgattctacagcaggtctcttccaggaactccc

SEQ ID NO: 15929 - DNA, 71 bp, Homo sapiens
ttaaaggtagcgtggccagatgacttgcttcagtaaatggaatatgaacagaagtagcatgtgtcacctcc

SEQ ID NO: 15930 - DNA, 72 bp, Homo sapiens
caatgtgggctctccacaggctgagtatcattgcaacatggtagtcagcttccctagaacaagtgatgagag

SEQ ID NO: 15931 - DNA, 70 bp, Homo sapiens
tgccctgaggtagtagtttgaatgggatttggacgggaggcatagttgtctctccttccctccctccctc

SEQ ID NO: 15932 - DNA, 71 bp, Homo sapiens
cagcaactgcaagaaggggcctggcaggcagatgggcaggtgggcaagacccctaccccaggcccagcaga

SEQ ID NO: 15933 - DNA, 71 bp, Homo sapiens
ggaagtttctcaccccggacggggcccaggagggctcaccttactgatccctgcggcggagaaccccacgt

SEQ ID NO: 15934 - DNA, 70 bp, Homo sapiens
tgggcatggtagtgcacaccttgcagtcccagctactcgggaggctgacataggaggatcgcttgagcct

SEQ ID NO: 15935 - DNA, 74 bp, Homo sapiens
cctttctgggcctcagtttcctcaacagtaaaatgaagagggatataagtgatccttaaagggtttttctccac

SEQ ID NO: 15936 - DNA, 73 bp, Homo sapiens
agtcacagaggcggtgaccatacaaagtagagggtgtttgggccaacagacctgcgatattatggccagccgt

SEQ ID NO: 15937 - DNA, 72 bp, Homo sapiens
tgaatttagccctgggcttacagctgagtcagccatcttgcttccacctaagccctgcctgagaaagaagct

SEQ ID NO: 15938 - DNA, 70 bp, Homo sapiens
caggaaggaaaagccaaaggaattgacggaacctctgtatgaggtgcaggcacttctatggctagtttct

SEQ ID NO: 15939 - DNA, 71 bp, Homo sapiens
tgccagccagaggtgcatggctgtctctcatattaggctccccagactcccggcatctccattgggaagct

SEQ ID NO: 15940 - DNA, 73 bp, Homo sapiens
ggcagtgaataaaaaggagatgtgggacaggtcctgggacctgtagaataatagcataataataaatactacc

SEQ ID NO: 15941 - DNA, 70 bp, Homo sapiens
gctctggcagggcggactgtccatcaaatgtggcccaagatgtcagagcagccctgcagccaaagagacg

SEQ ID NO: 15942 - DNA, 73 bp, Homo sapiens
cgggtctgagttgtgttcacagtggagcctggatgtgctctgctcagcgagtgcctctgtttgggtggatggg

SEQ ID NO: 15943 - DNA, 71 bp, Homo sapiens
gtttttaattttaattggtttagatttgaatagccacatgtggctagctactagactagcaccaccctagg

SEQ ID NO: 15944 - DNA, 70 bp, Homo sapiens
ctgcttgccgagtgagggggtgtggttggcccggcaccctttgcccaccccaggcaactcccacctcctt

SEQ ID NO: 15945 - DNA, 73 bp, Homo sapiens
gatgcctccaggaggagttatgctgcttagtgaacaatcacagtggcctctgacaatagcctcagctgacccc

SEQ ID NO: 15946 - DNA, 73 bp, Homo sapiens
gtggcctcatgctgagtctccaggccctcattaaactgggaaacagattacaacaggatcccgaggcagacac

SEQ ID NO: 15947 - DNA, 72 bp, Homo sapiens
aatggcctctgccaatcttttcatatctatgtaaccttttgtagttactgtgtgatttagcgttgtgctatt

SEQ ID NO: 15948 - DNA, 72 bp, Homo sapiens
gaacttttatctctacctgagggcaagaggtaatccaggtctccagaacaggtaccaccggctctttaggga

SEQ ID NO: 15949 - DNA, 72 bp, Homo sapiens
aggctggagtgcagtggcgtgagcttttggctcaatgcaacctctgcctcccaggttcaagtaattctcgtg

SEQ ID NO: 15950 - DNA, 70 bp, Homo sapiens
tttttagatgccagtaagacttttctctcagttgcctagtatgcaaaggctgggccttaaatgttttgct

SEQ ID NO: 15951 - DNA, 73 bp, Homo sapiens
ggctgagcagcaggatacagctagcgtggagcagtcctcccagaaggagtgtgggcaacctgcagggtaagct

SEQ ID NO: 15952 - DNA, 72 bp, Homo sapiens
ctcctctataatggaaagaaccccagcctagggctggggtctcactccagtctcaaagccaggccactttag

SEQ ID NO: 15953 - DNA, 74 bp, Homo sapiens
gctgtttgctcagttcagctcagcactcctcccactgccccatcccctgctgctctgctctcaccaggcaaaca

SEQ ID NO: 15954 - DNA, 73 bp, Homo sapiens
gcccggcctctacaaagctttagagttagatcatagaggtcaccttgtccatgatctcgatttggcagtgagg

SEQ ID NO: 15955 - DNA, 71 bp, Homo sapiens
tgacctgggagatgagctctcagttggggaccccagccctatggcaaacgtaagcatctgcagatcacaga

SEQ ID NO: 15956 - DNA, 74 bp, Homo sapiens
ggccacctggccttcactggttcctgcactgaatgtttccttctcacctgctgagtaccaggtgttaccccagg

SEQ ID NO: 15957 - DNA, 74 bp, Homo sapiens
aactaatgagtagtaagcattctgaggataaatgtgcaaagcacatcatggtttacaaagtgctttcacagcca

SEQ ID NO: 15958 - DNA, 73 bp, Homo sapiens
gggaaaagaatgcctaggtccaggtgtgtgcatggagaaaaagccggcctgccccagggacatggggcacagc

SEQ ID NO: 15959 - DNA, 72 bp, Homo sapiens
tggcctcgggaacgccgtacacgccatccccaaccaggcggatcttgtagttgaatcggaggatctctgcca

SEQ ID NO: 15960 - DNA, 72 bp, Homo sapiens
tcctcccaagcccctaccctaggacactttgagactgtctctgaacagtctggtagtgataccccctgtttt

SEQ ID NO: 15961 - DNA, 72 bp, Homo sapiens
cttggtccatttcggagttgttcagaacggataactgtgtgcacactccagaaaaggacttccaaagccaca

SEQ ID NO: 15962 - DNA, 72 bp, Homo sapiens
tgcaaagccacagggcagagctgtccaagaccttcggagcccacccttgtaccagtgtgccctggatgtagg

SEQ ID NO: 15963 - DNA, 70 bp, Homo sapiens
gcgggtggatcacttgaggtcaggagttcgaaaccagcctggtccacatggggaaaccccgtctctacta

SEQ ID NO: 15964 - DNA, 72 bp, Homo sapiens
gtgctattgtgcccctcagcaccacagttggaatgtgaagtatcaaagcacagttgaggcaagagagcacat

SEQ ID NO: 15965 - DNA, 74 bp, Homo sapiens
ataacatccatcatattcacattgccagagattacacagggcatgtataataaagggcatggggaatcttgggc

SEQ ID NO: 15966 - DNA, 70 bp, Homo sapiens
cttcttcttctaagtggaataatagaataggaatgtttcacagctattccttacctctctaggggatctt

SEQ ID NO: 15967 - DNA, 73 bp, Homo sapiens
gtccaggttcagcgctagaccatggactgtagctccagggaatctgctgtgtgtggggtattgtgttggaatt

SEQ ID NO: 15968 - DNA, 73 bp, Homo sapiens
gctctgtaattgctcttctctgtatgtcacatctaatggtgagaaatgcagccactcaactacaaaatttaaa

SEQ ID NO: 15969 - DNA, 74 bp, Homo sapiens
gagggcataccgtgctgcctaatgggagaaaaccgagtcctttgtgctggggtgagtccagggagtgatggatg

SEQ ID NO: 15970 - DNA, 70 bp, Homo sapiens
ccaaagtgctgggattataggcaggagccaccgctcccggcccacctgacagcacttaatcactatgtag

SEQ ID NO: 15971 - DNA, 74 bp, Homo sapiens
gcgtcagggagaaagaagggttattaacattaaaagaacttgcagtaattcctttttctcttcctcagactgct

SEQ ID NO: 15972 - DNA, 73 bp, Homo sapiens
tgtgtgtgatatcaagagactaaatttgatttttttttctttgagacagtgtctcgctctgtcgcccaggctg

SEQ ID NO: 15973 - DNA, 72 bp, Homo sapiens
gctgcaccctcatctaggctgtggtgctaggcttggagaatacagtattaagtaagctaaacacggcccttt

SEQ ID NO: 15974 - DNA, 73 bp, Homo sapiens
cgctggtcctctgaatgacatggcacataggaaatgccatcctttggcactcaataagtagagcagggccttc

SEQ ID NO: 15975 - DNA, 71 bp, Homo sapiens
gcatccattgttctaggtcctgtttggggtcagaagtgttccaagaagcccagcatgacagccagatgaga

SEQ ID NO: 15976 - DNA, 70 bp, Homo sapiens
tgagagaaaatctaacagagccgagtctcagaggatgagaaagattctgctagatgagatctaaacaagt

SEQ ID NO: 15977 - DNA, 72 bp, Homo sapiens
aaatatgtgttggctgcatgccctagtgcatctccctatgggaatgcacagccattgacttaatccacgcag

SEQ ID NO: 15978 - DNA, 70 bp, Homo sapiens
ggtagtaagttttcagtagctggaggattagagtaagcattgttctgggaatgctgtggggaactcaggt

SEQ ID NO: 15979 - DNA, 74 bp, Homo sapiens
ttccaacttgttggcaacagattcacagagctggacggcaatgtctgcagccacgttcttagctgaggagaggg

SEQ ID NO: 15980 - DNA, 74 bp, Homo sapiens
ctcttgaaaggatctttgtggttacattaaactcacctgggtaatccaggaatccctccccatcacaaggttct

SEQ ID NO: 15981 - DNA, 74 bp, Homo sapiens
acacagccagtaggtggcgggaaagctaaggtttttcagtagactggggtcttgctcaccatactcattctgtg

SEQ ID NO: 15982 - DNA, 73 bp, Homo sapiens
gaagggcagaaatgggtccagcaagcccaggggctttcccagaacgggcacagaggcagagtctgcagcctcc

SEQ ID NO: 15983 - DNA, 72 bp, Homo sapiens
ctacgattgagaccatccaaagttatcacatcaatggtggaaacacctatgtgctcaggtagccaatacagc

SEQ ID NO: 15984 - DNA, 73 bp, Homo sapiens
ttcagttttctcaaaattaaaataggaattacacaactacctatttttagggtttttgagaagaataactgag

SEQ ID NO: 15985 - DNA, 74 bp, Homo sapiens
ggctagatagatttatgagtcatactcaggcgtcctatctacagggcccctactattaacgaagctactttgcc

SEQ ID NO: 15986 - DNA, 70 bp, Homo sapiens
tacatttgtaaactggcatttgtggttcagtttcaggtaccaactgaatccccaggttctaagctacagc

SEQ ID NO: 15987 - DNA, 74 bp, Homo sapiens
atgcatgtaggtctgggggttgtttctcttacttatagatggctcagactatgacaagggcttcattcacccag

SEQ ID NO: 15988 - DNA, 72 bp, Homo sapiens
atggaatgcatataatgcactactaatatggcaagaaattgctatattaaaaagtaaaatgtatcaagtcaa

SEQ ID NO: 15989 - DNA, 70 bp, Homo sapiens
ttggggagtattgccatatcaatagtgtcgagtcttacaatccatgtggttacatttctttcaacaacgt

SEQ ID NO: 15990 - DNA, 71 bp, Homo sapiens
cctggaaacatatgagcttttagtgtatgatgattccttaggtataggagtctatgtgcacatcttgtgtg

SEQ ID NO: 15991 - DNA, 73 bp, Homo sapiens
cttcctgctttgcttttctgttgttcttggtgagttgcatcattcttgagatagctctctttgcattggagga

SEQ ID NO: 15992 - DNA, 73 bp, Homo sapiens
gtggccaccctggaaaacccttaagcttagcatgtgtcctggtgctcctcccagaggactcctgggtctgact

SEQ ID NO: 15993 - DNA, 74 bp, Homo sapiens
atggcggctctcctttccttctgccactgagagaagtccagttttcccaggatctgatttactacgcagatgga

SEQ ID NO: 15994 - DNA, 72 bp, Homo sapiens
aattcaccaataatggtaatctttccctaaagggttgtacttcagtgatgaggttactattgtaagataatt

SEQ ID NO: 15995 - DNA, 74 bp, Homo sapiens
gagggatggtagcgaggggccttagctcagctgagattgtcacagcacataaagtttaaggagcccgggttact

SEQ ID NO: 15996 - DNA, 74 bp, Homo sapiens
tggttcagttgagttgggtttatgctggacgttggtagaaagagtttctaccaagagttttcccttttctccat

SEQ ID NO: 15997 - DNA, 74 bp, Homo sapiens
attcttgtgacagacaaaaacatgactactatatatgtcaattccctcccccatttatagtagcattgttacag

SEQ ID NO: 15998 - DNA, 74 bp, Homo sapiens
tcgcgggagggggcgggctccggcgggaccccagcgctgcaggcggtgcggctgagccagggagccccccgcgc

SEQ ID NO: 15999 - DNA, 74 bp, Homo sapiens
ccctttgagcaaatccacatggccagtttctgtgctcaggggtgagaatagctgggctgtgattggggcagggg

SEQ ID NO: 16000 - DNA, 70 bp, Homo sapiens
gccccacaggctgcagggtagtgttcaagccaaagtagcttatcaaggtgccccaagtcttctgggtaca

SEQ ID NO: 16001 - DNA, 71 bp, Homo sapiens
tggggaggagaggatagtgggagtgacaggaagatagactctgatttccccatgaacgaggatgagatgag

SEQ ID NO: 16002 - DNA, 73 bp, Homo sapiens
gaaactagcagcacagaaatgccagtgggcacagagaaaagaaatcctgagaaaagctggctcttctagctaa

SEQ ID NO: 16003 - DNA, 73 bp, Homo sapiens
acgtccttccttgaatttgatttacaagatcagtgagctaaggttcagcggtaatgattcacaagcctggggc

SEQ ID NO: 16004 - DNA, 73 bp, Homo sapiens
gcaggcctggcatctggatttgcaaggatgggccttgttctgattctatgaaggtgacttggtactggggtcc

SEQ ID NO: 16005 - DNA, 74 bp, Homo sapiens
cggctccccagctccctcagagccagccacctagtgagcacagtgagtgggccaagggcagagtccttttttag

SEQ ID NO: 16006 - DNA, 72 bp, Homo sapiens
attcctggcctgctcaccagcaacaacgtactagacactttgttgtctcccagtagccccaatgaaccttga

SEQ ID NO: 16007 - DNA, 70 bp, Homo sapiens
aactaaacatttagaaacaatagtgatactttttaaaaaagagtgttttttgtttttgttttgttagtac

SEQ ID NO: 16008 - DNA, 72 bp, Homo sapiens
cggtggcacagctgggccctgaaggtgggttctcttctcccaaccctcagcccagtgcccttcctactgcac

SEQ ID NO: 16009 - DNA, 72 bp, Homo sapiens
agagttagcttggagaacatttggtaacactgccctgctgaccgcagattatgtttgccctccaataatcta

SEQ ID NO: 16010 - DNA, 73 bp, Homo sapiens
gaggtctgactgggactgggccaaagttgtgatataatagttcaggactggtgaactcaggtgaggattttgg

SEQ ID NO: 16011 - DNA, 72 bp, Homo sapiens
ctctttgacttatcagaacaggaccagtcacgggcaagccatgtaactgcccagtgcctcagtttctcgtct

SEQ ID NO: 16012 - DNA, 70 bp, Homo sapiens
agggctttcctaatgttcgataaaaatactgtgaacatttaaggacacaggctctgaaaacagttctgaa

SEQ ID NO: 16013 - DNA, 73 bp, Homo sapiens
tactgtggcgtggactgtgcatggaatgaactgtgtctctcattgagtcagctccatgagacatacttcaggt

SEQ ID NO: 16014 - DNA, 74 bp, Homo sapiens
tgtgggggtctgggcagcagcaccacgtgaatgaggagtctcgtctgctcggcttgttgggcgggcctggagcc

SEQ ID NO: 16015 - DNA, 72 bp, Homo sapiens
acttcattctttagcatgaggttatctggttgtcctagcaccatttgaatcatgttagtgccattgttgaaa

SEQ ID NO: 16016 - DNA, 73 bp, Homo sapiens
gttctcgccccagttctggttgtttaagagagcgtagcgctgccctctactctctctgtctccctctcttgca

SEQ ID NO: 16017 - DNA, 71 bp, Homo sapiens
gtggggcattggtggtgactgcacctgaggttttggaggagaacactcacggagaatgcagaatggaacaa

SEQ ID NO: 16018 - DNA, 70 bp, Homo sapiens
aatcattatctaaatcaggttcaggagcaggtgaggctcctggatgtacttcctcatatgatgttgctct

SEQ ID NO: 16019 - DNA, 73 bp, Homo sapiens
agcatcatcatggcactggggcacgtggggaccatggaataaatggaattgtggcccacgtccaactcacagc

SEQ ID NO: 16020 - DNA, 74 bp, Homo sapiens
ccatccagacttgcgggcgaggctcccgtcctgggcctcggaggggtccaggtttcccattaatcccgtcctgc

SEQ ID NO: 16021 - DNA, 72 bp, Homo sapiens
tttaaaacctggtctgcaggaataggtgagacttagcatgacctcagtttatgtttgaagaggccatttttc

SEQ ID NO: 16022 - DNA, 71 bp, Homo sapiens
tactgtattgtttagataataatgacagggaaaagcctgtatgtgttcagtactgtgatacagttttctct

SEQ ID NO: 16023 - DNA, 73 bp, Homo sapiens
aatagccaatgtctattttactatcctgttcttatttaacctcttagcagctgtgctagtttctattggctat

SEQ ID NO: 16024 - DNA, 74 bp, Homo sapiens
ctctatgaaaacaaagtacagttgacccttgtaccacacaggtttgaactttgagggtctgctgacacatggat

SEQ ID NO: 16025 - DNA, 74 bp, Homo sapiens
cagttttatcatcttttaaaatagggagataatgttagctactttacagtgctaaatgttttaagtgagatagg

SEQ ID NO: 16026 - DNA, 74 bp, Homo sapiens
ggcccagggacaaacagctagtgagaaagctgctgccataattcacatcagctccccaacggcctgccctcggc

SEQ ID NO: 16027 - DNA, 72 bp, Homo sapiens
aactacaaatgccaggattttattccaggcctgctgaatcagaatctttgggtcctgggtatattttttttg

SEQ ID NO: 16028 - DNA, 72 bp, Homo sapiens
aacaagtaatgctattgaagtcattataaaaagtctctcagcaaagaaaaggctgggacctgacggcttcag

SEQ ID NO: 16029 - DNA, 73 bp, Homo sapiens
cattgtaattaggaaggagacagaagaggcaagaagagcccagcgggaggctcccattttggcttgaaggcag

SEQ ID NO: 16030 - DNA, 70 bp, Homo sapiens
ccggttctccagagagccaatatcataggctgtgaagctgggcttggtttggatggaagggcatggaaag

SEQ ID NO: 16031 - DNA, 72 bp, Homo sapiens
actcttggcaatttatttccctcctaaattagatagaaatgtcatggtttggggtttccattgtgtgttcaa

SEQ ID NO: 16032 - DNA, 73 bp, Homo sapiens
ctcttgaagtatccaggttggtagtgttacgtatattcacaatgctgcgcagcaggtctccagaacttcttca

SEQ ID NO: 16033 - DNA, 74 bp, Homo sapiens
aggctcaaagtgaggcaggtggcaggattgagaggaccacagggttcttgtgtaagtctttgttatatagggct

SEQ ID NO: 16034 - DNA, 72 bp, Homo sapiens
gtcagtccctgagcaaagctgtagtgaagtcccatcagggcactcagcttagtcatcagaatcataaaagca

SEQ ID NO: 16035 - DNA, 70 bp, Homo sapiens
cgcgactttgcggagctgccgccggccctgggctgccccggcgcgcggcggacagtgccgagggatccgc

SEQ ID NO: 16036 - DNA, 74 bp, Homo sapiens
aaaggcaccgcaggcagttataccaactccggccagcaggtggcagggtgggggtggggaggagtgagcgcagc

SEQ ID NO: 16037 - DNA, 72 bp, Homo sapiens
tagaagccagcgcagtgctgggctcagggcagatgtgtgcaaggtacctgctgagtaactaactggctggag

SEQ ID NO: 16038 - DNA, 72 bp, Homo sapiens
cctcctccctgggtcttggttttctggccgtcactaccattccagggttttatggacgaatatttgaggagg

SEQ ID NO: 16039 - DNA, 73 bp, Homo sapiens
gcccagagaaagccggcgccgggcgaggctcttgcaggttctcagacccggtgcgcgtgctcccacctagggc

SEQ ID NO: 16040 - DNA, 71 bp, Homo sapiens
cagcactctgtacataggagctcagggtctcctgccattgctcttagtcaagcgcttatctatgccttcct

SEQ ID NO: 16041 - DNA, 71 bp, Homo sapiens
acttttagcagcacgtaatggagaccttggctcaactggcttaaacaagaaggacaggagtcctgaggttg

SEQ ID NO: 16042 - DNA, 72 bp, Homo sapiens
gagataataaagaggccagcctaagggcagcccgtctactctttctagaggcccccttgatggtcacctctt

SEQ ID NO: 16043 - DNA, 72 bp, Homo sapiens
cccttgccctcttgcaaccttcctcttcttacacaactatagtattctgagcaattagggaaggaagatgcc

SEQ ID NO: 16044 - DNA, 71 bp, Homo sapiens
tagcactttaatacggggttgcatatttgtcacatgacaccgacacctcggttatggtgaatctgttaggc

SEQ ID NO: 16045 - DNA, 74 bp, Homo sapiens
gaagcacctgggtgcccaaatgaggggatttgttcctggatctgacttggaggattggctcagccaggggcact

SEQ ID NO: 16046 - DNA, 71 bp, Homo sapiens
ggttccatatctagcaaacacctctttacaggaggttgattggttgagaggatcaaaatggagccttattt

SEQ ID NO: 16047 - DNA, 70 bp, Homo sapiens
gcagaaccaaggtgatcttctggggtgagacaagcacatccaagaccaccagctagaatttgattcttta

SEQ ID NO: 16048 - DNA, 71 bp, Homo sapiens
tcactcactcaataaatgatagcagctaacattcagatgccacctgctgtgtgccactgtgttgaggactt

SEQ ID NO: 16049 - DNA, 72 bp, Homo sapiens
acacacagtaggccaggtctcgctgctgccgctcagttctgcagataggaagggctttgtgaggaactggga

SEQ ID NO: 16050 - DNA, 73 bp, Homo sapiens
ggacggccgcagccctgcgggtctccgctccagacccacccccgccccaccccgcgcgcctctgccgcctctt

SEQ ID NO: 16051 - DNA, 72 bp, Homo sapiens
agacacaaataacacccagtctgtgcccctgtgcctcgaggagctcacagagacaggtgaccgggggagaca

SEQ ID NO: 16052 - DNA, 72 bp, Homo sapiens
acacagttattaagttctaaaatgtttgctggctagactcagagccagcaaaggctcatgttttgacaataa

SEQ ID NO: 16053 - DNA, 73 bp, Homo sapiens
aagacctgctacgctggaaaaaaagggtttcacagaccccaacggtagcaggtattgaaatcaacaaaacaat

SEQ ID NO: 16054 - DNA, 73 bp, Homo sapiens
gcagtaagccaagattgtgccattgtactccagcctgggagacaagagctccttgtcaaaaaacactccgtct

SEQ ID NO: 16055 - DNA, 70 bp, Homo sapiens
ggtaggtagagggagtgagaaggacttcatgcaatgaagtttcccggcgttacactgccattgtaattgt

SEQ ID NO: 16056 - DNA, 72 bp, Homo sapiens
ccttagaatgttgcttgaggctacaatgagtttataaatgttgagggctttaaataaagagcattttacaaa

SEQ ID NO: 16057 - DNA, 72 bp, Homo sapiens
tcttcttttaattgctcagtgtccgttgaattgggagactttcaactgaggatacttaactgtattctaaaa

SEQ ID NO: 16058 - DNA, 72 bp, Homo sapiens
agttccaatatgcttctaaagattagttggggctttgctgtaacatctagacatgtatatctgatttggaac

SEQ ID NO: 16059 - DNA, 72 bp, Homo sapiens
atcccagctacatcactaataaaattcttgcattggatgcactatattatgatgtatatatgttgaaggatt

SEQ ID NO: 16060 - DNA, 73 bp, Homo sapiens
atcttgcggtttctatagctcagaagtccaggcacagttggttttctgtttagggtcctataaggccaaattc

SEQ ID NO: 16061 - DNA, 72 bp, Homo sapiens
tgatgattaattttctgtgtcaacttggctaggccaccatacctaggcagtttgtcaaataccagtctagat

SEQ ID NO: 16062 - DNA, 73 bp, Homo sapiens
ctataggtttgcctaagagaggtagggaatgcctagtttctctaaataacaatatataggttggtgctaaagt

SEQ ID NO: 16063 - DNA, 74 bp, Homo sapiens
atctgggcagtgagtcagagcaggatggcacggtctggcctttcttccctgggctctcctcttgcactctgccc

SEQ ID NO: 16064 - DNA, 72 bp, Homo sapiens
ggcaatcacagaaaggaaatccttggtgtgcccaagccacggggaagagcagctgggattgccacagaaaag

SEQ ID NO: 16065 - DNA, 73 bp, Homo sapiens
gacagaagcagctggctttgagctatccatatgggtgtgcaaatctatgtggcactaccagttaatagcaagc

SEQ ID NO: 16066 - DNA, 72 bp, Homo sapiens
cttctcccaagatcgaaaagttgcatctagaactagatatatagatggaagttacctaatatggaggaaaaa

SEQ ID NO: 16067 - DNA, 74 bp, Homo sapiens
gcagaatggggaactttcttgagtagatgtgtatcaagacagttgttttggaccaacactgtttcctatggatg

SEQ ID NO: 16068 - DNA, 73 bp, Homo sapiens
agatgtggggtgggtgaaacaagatggagctgtagaggaaaagagagcagtggcacccaggaatcccttagga

SEQ ID NO: 16069 - DNA, 73 bp, Homo sapiens
atgggaagctggggaggccttaagggaaaatcttaatagtacagtgctattaggaagttgatactaggccagc

SEQ ID NO: 16070 - DNA, 73 bp, Homo sapiens
tgggaacctctttgcccactttaaacaccagtatagcagtgggtgaactgaaggggcactaccatatctctac

SEQ ID NO: 16071 - DNA, 70 bp, Homo sapiens
acacaggatggggagggaccaaggaaccacaggaggggacttggtaagggcctgcgatttttgtctgata

SEQ ID NO: 16072 - DNA, 73 bp, Homo sapiens
ccacagatgggtcgctaatatttcctcctttggtgtttagacacctgatgtcacactttctgctgtggtttcc

SEQ ID NO: 16073 - DNA, 72 bp, Homo sapiens
cttgtgggcaaggtgaagattcgggagagttgaggggtcttgattttctcaaatttccttcttctggaacat

SEQ ID NO: 16074 - DNA, 72 bp, Homo sapiens
gattctgcatcagaggctatgaagtaggctgggcacagtggttcacacctgtaatcccagcactttgggagg

SEQ ID NO: 16075 - DNA, 72 bp, Homo sapiens
gactctcctttgaccctcactgcagtgcactttcattacttatcaatctgggggcgggaaaaaggggtgcag

SEQ ID NO: 16076 - DNA, 70 bp, Homo sapiens
aaccttaatgttgctcagagctaacttccctaggggacaaactcatgctctccaaagcaaggaaggacca

SEQ ID NO: 16077 - DNA, 72 bp, Homo sapiens
taaatgtgactctgagtagttgaatctggatacaaacaactcagattgcagggttctactttagtcagaatg

SEQ ID NO: 16078 - DNA, 74 bp, Homo sapiens
ttgcagagttttctattcctatatcatgacaggtcagagcagcgctgtgacaagcagcctctgtattagtaaag

SEQ ID NO: 16079 - DNA, 74 bp, Homo sapiens
tcgcttaaacctgggaggtggaggttgcagtgagccaaggtcacgccattgcatcaatacaccccagcctgggc

SEQ ID NO: 16080 - DNA, 71 bp, Homo sapiens
attgttaggggtttgtgcctagggggaccaacctgtggaatgtacctcctgctgcatggtgctgctgattg

SEQ ID NO: 16081 - DNA, 70 bp, Homo sapiens
aattagtgtaacattaacatggaggaaattttgtaattgccagttgttctgtagccatggttacatcaaa

SEQ ID NO: 16082 - DNA, 72 bp, Homo sapiens
agccaactcatcagaatgttaacctttgatatgctggatgggcatgtttcaagataattgacatgttctgat

SEQ ID NO: 16083 - DNA, 71 bp, Homo sapiens
atcctcagagggatccagggtttatggggctgcataaacaggtagtgaactttttcccaggaatcaaatca

SEQ ID NO: 16084 - DNA, 70 bp, Homo sapiens
tgtgtggtcctgggccctgtaaactccactccgaatttaggtggtgcagatgtacttaatctttgattat

SEQ ID NO: 16085 - DNA, 70 bp, Homo sapiens
ggtatttggaaaatgttgcaaagctgaaactcatctctaaagcattagtgacatattctattattctaaa

SEQ ID NO: 16086 - DNA, 72 bp, Homo sapiens
gagtatatgagagattttagactgggctacttcacaggtaccctcagacaattctcaactgtgcttccacag

SEQ ID NO: 16087 - DNA, 72 bp, Homo sapiens
tctccttcactgccgaagaagcaagagtctctgccacctgtctaggtttccagagtttctttttcactctgt

SEQ ID NO: 16088 - DNA, 70 bp, Homo sapiens
ataacacaggtaaaatgcttatcaaggttaccaacctaactagtagctatgtcatcattgttgtgtgtta

SEQ ID NO: 16089 - DNA, 72 bp, Homo sapiens
ctgaactgtgatttgacagtgtccttattatcagactctgctcaatgacagtttaaacttctttttgataca

SEQ ID NO: 16090 - DNA, 72 bp, Homo sapiens
attatatgaaaaagacagttgcacacacatgtttatagcagcacaagttgcaactgcaaaaatatggaacca

SEQ ID NO: 16091 - DNA, 74 bp, Homo sapiens
tgaatgtgtttgctaggctctgctaataagaaggagacacaaaaatctgtggggcattttgggcttgggggaca

SEQ ID NO: 16092 - DNA, 72 bp, Homo sapiens
atggtgcgatcacgggctcactgcagccttgaactcctgggctcaagcaatccttccccctccacctcccaa

SEQ ID NO: 16093 - DNA, 72 bp, Homo sapiens
ttggctagaatgtggggaaaccagcgcctgcatatatattgctgctgggtatgtcaaatcacgcagccacat

SEQ ID NO: 16094 - DNA, 71 bp, Homo sapiens
caatgtgtagcccaccattatgcagaaaccagtatgtatggtggcagctacacaggtgtgtttctttataa

SEQ ID NO: 16095 - DNA, 72 bp, Homo sapiens
aaataaaccccacacttggcgcttgagtatttcaagccattgaaacaatttggaaaactctacttgcctagt

SEQ ID NO: 16096 - DNA, 72 bp, Homo sapiens
gttaggtgtccaacagccagggaattgttaacctaataactcattcagtgcaatgtttgggaggcattaaaa

SEQ ID NO: 16097 - DNA, 74 bp, Homo sapiens
tctgtattctggtctattgtgagttaatgaattaactcttctgagggagagaaaggcatattaggccttataat

SEQ ID NO: 16098 - DNA, 70 bp, Homo sapiens
acacttaatagaccacagtatagcataaacaaaacatttatatgtactggggaaacatctgtgtgacctg

SEQ ID NO: 16099 - DNA, 74 bp, Homo sapiens
agatttagaatgggtgtgataggtgggtgtgagccataagatgggttgactcttaccattcttccttaagaagt

SEQ ID NO: 16100 - DNA, 70 bp, Homo sapiens
tgaccctgctctcaaactaaataaatattattctgattcaggaaagagaggagttcaaggttgagggctt

SEQ ID NO: 16101 - DNA, 73 bp, Homo sapiens
tgaatcaggtgttcaagtaaaccttctgagtaatccatacatcagctgacatgaacactgctcatatattaag

SEQ ID NO: 16102 - DNA, 70 bp, Homo sapiens
taaataaaaccacatcattgcactcactctgtcagaagagtctagagtggagggtacaaaattcagtcaa

SEQ ID NO: 16103 - DNA, 73 bp, Homo sapiens
aaaagggattcaatttacctgatctctctgagatgtctgtttttatgtatcagctcatcaggaactcacccct

SEQ ID NO: 16104 - DNA, 72 bp, Homo sapiens
ggactcagcccagcgccgagctcgccgccgagaacgacacggacaccgacagcggctacggcggcgaagccg

SEQ ID NO: 16105 - DNA, 70 bp, Homo sapiens
gcgcattacagagacaaacccatgtatgcctcacaatgaccctatgagatgggtgctcttattacccccg

SEQ ID NO: 16106 - DNA, 73 bp, Homo sapiens
gtctcttgactgttggctcttagtgcctgagtcatatgtggatagaattgacaaagcagccagtggtgacagc

SEQ ID NO: 16107 - DNA, 72 bp, Homo sapiens
agtcccttttgtctcctttctttgactcctgtaacaagtgggtcaacacctgtgacaagcactcaggaaact

SEQ ID NO: 16108 - DNA, 74 bp, Homo sapiens
atggcacatccttcactccttcatactcctggaactagaaaccaggaacatacagtgccatggaagtcaaagga

SEQ ID NO: 16109 - DNA, 73 bp, Homo sapiens
cagatgtaactggtttgagagacagtagtaccgtgcaaaacggagatactactgtggcaaaggatgcttgagt

SEQ ID NO: 16110 - DNA, 72 bp, Homo sapiens
gcagggcaaaggtgaaaaccacaacaccagttaggagcatattgctgcggtctagctgagaggtggagggga

SEQ ID NO: 16111 - DNA, 74 bp, Homo sapiens
gttgtaggaatggtggtagcagtagttcagtgcctaacatttattgtgctctgactgtgggccaagcactgtgc

SEQ ID NO: 16112 - DNA, 70 bp, Homo sapiens
gcatatccctaggcccctcaatgatataacgggtctggggaagggatctggggatcagcattcgtaagcc

SEQ ID NO: 16113 - DNA, 71 bp, Homo sapiens
actctaacaggtgctctcgaatgcaggtttctgataactttggagaatgtgccattagggtaaaggaaaaa

SEQ ID NO: 16114 - DNA, 70 bp, Homo sapiens
tttttttgtagagactgagccttgctatattgcccaggctggtctcgaacctctgaccacaagcaatcct

SEQ ID NO: 16115 - DNA, 74 bp, Homo sapiens
cacctgtaatctcagcacttcgggaggccatggcaggaggattgcttgtggtcagaggttcgagaccagcctgg

SEQ ID NO: 16116 - DNA, 70 bp, Homo sapiens
ctgtggctttttcactggggttttaagctcctctgggaaaacgaggggcaatgttgggcaggaagaactc

SEQ ID NO: 16117 - DNA, 72 bp, Homo sapiens
ctgcataagggaggcagtgcctcacagtgtggccgcaaggcaatactgttcattgtgtcaattatgcatgta

SEQ ID NO: 16118 - DNA, 72 bp, Homo sapiens
aaagcaaatgagaaattgttcaaatcctcctatctgggaaaggagatgagattttaagtcatttggcttttt

SEQ ID NO: 16119 - DNA, 71 bp, Homo sapiens
gcaggagaatcacttgaacccaggaggcagaggttgcagtgagccgagcacgcaccactgcactccagcct

SEQ ID NO: 16120 - DNA, 70 bp, Homo sapiens
atcctctgtcaagatggtactagtaacagattcaaagtagtaccatatcgtatcagactgatgtgggggt

SEQ ID NO: 16121 - DNA, 72 bp, Homo sapiens
attatgtacataatacatattctttcagtaggatatgtttaatacatgtgtacattgaaatattggcttttc

SEQ ID NO: 16122 - DNA, 71 bp, Homo sapiens
atgcatcatggcactcattgccatattaatatactttaggtatattaatatttgtgacagatgtgataact

SEQ ID NO: 16123 - DNA, 72 bp, Homo sapiens
ataggctgtaccatatagtctaggtctgtgataggctataccacctaggtttgtgtgagtacattctatgaa

SEQ ID NO: 16124 - DNA, 70 bp, Homo sapiens
ccttgggcccaaggcggcagggaggcttcaaaggggatgtcgaggcacctgtggtgtggcaggaaaacag

SEQ ID NO: 16125 - DNA, 74 bp, Homo sapiens
tttactgtcagtttgtaccattgttaccctgggttgctctgagcacacacaatcttaccacaaggctgactgtg

SEQ ID NO: 16126 - DNA, 72 bp, Homo sapiens
tatttttattaataactgaagtccaggcaaagtaaaccaatagcctgagatgaaggtgaccacagaatgaga

SEQ ID NO: 16127 - DNA, 72 bp, Homo sapiens
taggctggttatgaaattgctagacgcttcaatggaaggagtgtgactcatcaatgtgccatctactaagag

SEQ ID NO: 16128 - DNA, 73 bp, Homo sapiens
tatggctatttaactggacctgggctccatgtagccagagcaggatgctgtagcccctgggatagagaagcta

SEQ ID NO: 16129 - DNA, 72 bp, Homo sapiens
tagatgctatatttactcatgcttttaataattattctttctttaatttgcatgtgtacattttggcgaggt

SEQ ID NO: 16130 - DNA, 72 bp, Homo sapiens
attcccagaaggaggtcaaagggcaacaaatgctctgtcagtttgccaaatcccctctgtaagagttgtacc

SEQ ID NO: 16131 - DNA, 73 bp, Homo sapiens
tggcagagaaggaagggagaaggagcctggtctgatgagttctgttagcaccatctctaatgcatcatctttg

SEQ ID NO: 16132 - DNA, 74 bp, Homo sapiens
cagcaatgttgtgttgttcttttttttaacactagtgaagtgtttcagcaatattttgcagctcaaatatgttg

SEQ ID NO: 16133 - DNA, 70 bp, Homo sapiens
gacgagcattatgctgaggatgaagatgttaggggacaggtactgccatttattatcattggcaagctgc

SEQ ID NO: 16134 - DNA, 72 bp, Homo sapiens
gactgaatatttgcataccttgtaatgtgtcactaattgttgtggacactttctttcttggctcagtcacct

SEQ ID NO: 16135 - DNA, 73 bp, Homo sapiens
agaagacttggggatagggtgggtgcacctgcaaggtaaaccaaaagtgtgcatattatttcattgatacatg

SEQ ID NO: 16136 - DNA, 74 bp, Homo sapiens
gtgtcactacattcaaatttctcatggtgccataattcttatgctggttccttttaatctgaaatttctggcac

SEQ ID NO: 16137 - DNA, 73 bp, Homo sapiens
ttcccaatttgctactgtgcagatctatgcaacactgaaatgctgaacactgcatcagtgagcttcttgaaaa

SEQ ID NO: 16138 - DNA, 72 bp, Homo sapiens
ccagtagccctctcccacttgtgacagtcaaaaatatctgcacatactaccaaatgtctgtggaggggaggt

SEQ ID NO: 16139 - DNA, 73 bp, Homo sapiens
ccatgtccctgagagtttgacttgtgaccaaatggaagcactctctcttggtctctgccatccagggcacatg

SEQ ID NO: 16140 - DNA, 70 bp, Homo sapiens
ccaagcactgaggctcaaaagtcctggtacttaatgtcttttgtgcctactccagcatggaaagagaaaa

SEQ ID NO: 16141 - DNA, 73 bp, Homo sapiens
gaaaagttactctatctaatagcataataattgtagattgtcacaattgcttgctagtttgatactgagttac

SEQ ID NO: 16142 - DNA, 70 bp, Homo sapiens
aaatctccctaatgtggcagtttgtctagagactgggccctaatcgagtcaacctagagtgaggtaggta

SEQ ID NO: 16143 - DNA, 72 bp, Homo sapiens
tggagttagtcaggcttaaatacaaacatctccacccatggacttcgcaattatatgagccgataaatttcc

SEQ ID NO: 16144 - DNA, 72 bp, Homo sapiens
gagacagttgttggcatatggtttcatttagaaacacattatgcattttatgcatattgtgaactcatagaa

SEQ ID NO: 16145 - DNA, 73 bp, Homo sapiens
gtaaattaacaatgtatagcattgcttgtaaaatgaataataattttataacagcagaagctgtttttcatat

SEQ ID NO: 16146 - DNA, 71 bp, Homo sapiens
gaatggtgtgaacccgggaggcgaagcttgcagtaagccaagattgtgccactacactccagcaccccagc

SEQ ID NO: 16147 - DNA, 72 bp, Homo sapiens
ctgctgctgagcctctgttcttgagggccctcttgccaagaatactctcccagtttcccgcaactgtaactt

SEQ ID NO: 16148 - DNA, 72 bp, Homo sapiens
taccattgtatatgtattctgccattgacctaaaggtcattatgtggcatatgactgtatatagtacagcac

SEQ ID NO: 16149 - DNA, 71 bp, Homo sapiens
ggcgtggaaggggacctgagcaggttgctgctactcgctcaggtggcctgcttttattcccttatctggcc

SEQ ID NO: 16150 - DNA, 70 bp, Homo sapiens
cttctgggtcatagtttgtcaaccactgagtcaattcccggggccactacaagctattttgactaaagaa

SEQ ID NO: 16151 - DNA, 74 bp, Homo sapiens
tttccttagctatgcctggccacctggagaatataatcacatgattgaagtccaggttgggattctagaagaaa

SEQ ID NO: 16152 - DNA, 70 bp, Homo sapiens
tactccacaggcttctggcgcttccttcgagaaaatgaaaaactaaaaacgcgtagaggtggtagaagtc

SEQ ID NO: 16153 - DNA, 72 bp, Homo sapiens
ttttcttcactgccactgaatactttgaaagtaacatccaccaactggggatgagtcattcccagtgcagca

SEQ ID NO: 16154 - DNA, 72 bp, Homo sapiens
atagactgcttttatttctatttttccttctaggaagagagggaagaggctgttcctgtcatttagttatgg

SEQ ID NO: 16155 - DNA, 73 bp, Homo sapiens
gcaagtgttttgtgttgaagaccctccctccttagggagaaaaatggaaccacggtagtcaaggcagaacatc

SEQ ID NO: 16156 - DNA, 74 bp, Homo sapiens
ataacccccagggctcttccctaggtatggaaatggcaatgaaggtgaaggcatttagcagaagagggcagggc

SEQ ID NO: 16157 - DNA, 72 bp, Homo sapiens
tggcctctctgggtcagggccaggagcacaagcagactagcaatcagacggcggagggagagacacatagca

SEQ ID NO: 16158 - DNA, 72 bp, Homo sapiens
agtgtgcagagccctgggttcaggtggagcagttatggaacctaatcttaggcaagagcagggcacgtcatc

SEQ ID NO: 16159 - DNA, 71 bp, Homo sapiens
ccatagtatacatctgctattctcatagtcctagctttataggaacaactgcccagtggattgcctggtca

SEQ ID NO: 16160 - DNA, 72 bp, Homo sapiens
agattgtcagttagctgggcgtggtggcgggtgcctgtaatcccagctactcaggaggctgaggcaggagaa

SEQ ID NO: 16161 - DNA, 73 bp, Homo sapiens
agaaaacatctcatagtgtttgaagagaagctggtccaagtaggatcatctgacctggcaggccactctggaa

SEQ ID NO: 16162 - DNA, 72 bp, Homo sapiens
gcctggacaggcagaggaatgggaattgaggaggaggggtgtgttcttgccaatcctgggggcaggtagagg

SEQ ID NO: 16163 - DNA, 74 bp, Homo sapiens
cttggaagaacagacagcaaccacgttggactcaggcagtcctgggtttgaatcctgtctctgtcaccacctag

SEQ ID NO: 16164 - DNA, 71 bp, Homo sapiens
caggggctcctccacagccatgatgcaacactgaaagctgagctctgatgagggccaccttctttttttaa

SEQ ID NO: 16165 - DNA, 73 bp, Homo sapiens
atgggcattaccaggcactgtacttgctgcccgggcagaggtatagataagatgactgcagtgccatttcatt

SEQ ID NO: 16166 - DNA, 70 bp, Homo sapiens
cacaccatgcggcagcgacccagcatctcgtagtgcgctggcccgcgggagctgtgcaccagcagcggga

SEQ ID NO: 16167 - DNA, 71 bp, Homo sapiens
agcaggggcaccaacaaacagacaaagcctcctcacgacctagagaggagataacttcctgtttccctgat

SEQ ID NO: 16168 - DNA, 74 bp, Homo sapiens
gaccctccctcgagggagagaaaccacagcccccagaattcagcgggcctctccgagagcacggcgcgtctgag

SEQ ID NO: 16169 - DNA, 72 bp, Homo sapiens
gtaagatcttatatggaaagtttttctcctctccaagcagccttagggagataggcttgttctgacccatat

SEQ ID NO: 16170 - DNA, 71 bp, Homo sapiens
cttttgcctggatcgagattgttaagtccctctcagtgaagggtaagattatgagatctgagggctgtata

SEQ ID NO: 16171 - DNA, 70 bp, Homo sapiens
ctgagtgacagagcaagaccctgtctcagaaaaaaagaaaagaaaaagtactgtcgattcagaattctaa

SEQ ID NO: 16172 - DNA, 72 bp, Homo sapiens
agggaccatggcaatgggattttgtaatgggtagagggactgggctaaaatccaaacagagcagagccaagg

SEQ ID NO: 16173 - DNA, 73 bp, Homo sapiens
caagaatgttcagctctaaaattctggaactctcttggaaaggagacaaaatcagaattttgtggagaaaata

SEQ ID NO: 16174 - DNA, 72 bp, Homo sapiens
tgggagacagtagggtggtgaagctcatgcactgtggaatcatttcatctgagctcacagtctagtgtctcc

SEQ ID NO: 16175 - DNA, 72 bp, Homo sapiens
tccccgggcccgcctccactacgcccccgccgagccgccgggaggggccgcgggctgaggaccgggacccgc

SEQ ID NO: 16176 - DNA, 72 bp, Homo sapiens
ggaaaatggcactgctcagggctaacctcatataatggtgatctaatgggtggtatggacatgattcttctt

SEQ ID NO: 16177 - DNA, 73 bp, Homo sapiens
tccattttacttttgttgcttgtgctttggtgtcatatctgacagaccattgccaaatccaagttcatgaagt

SEQ ID NO: 16178 - DNA, 72 bp, Homo sapiens
cctggctgtccgtcatgatgcagtcactgacaccattgacattgccccgaatcagagggtggggaccaaacg

SEQ ID NO: 16179 - DNA, 73 bp, Homo sapiens
cccacccccgagcctgatgatgggaacctgcccttgctaggcgcactggctgcttctgcagggctctgtgggg

SEQ ID NO: 16180 - DNA, 73 bp, Homo sapiens
gtggtggagaagatggggctcagggactcaggaccagaggctccaacaatcttgtctagccccttgagctggt

SEQ ID NO: 16181 - DNA, 71 bp, Homo sapiens
ttaggcattgtttaaaggagctgggagaaggcctggtgtaaataggtgctaactgaatttcccttgctcca

SEQ ID NO: 16182 - DNA, 73 bp, Homo sapiens
ggactcctgcagtggggaaggcagcagaggggagattccttactgcagcgttgcttgaaatcagtcttacctc

SEQ ID NO: 16183 - DNA, 71 bp, Homo sapiens
ctgagtgtatggtgggtgtcctgaattcgttcatgtgaatacaggactcaggcttcccaccccactccaat

SEQ ID NO: 16184 - DNA, 70 bp, Homo sapiens
agtagaagggatttggggctgggggtggggtagaactcattccaaccagtccagtcctgttgggaacatg

SEQ ID NO: 16185 - DNA, 70 bp, Homo sapiens
tagaggggggagctcgagaagtttccgctggcagacatgctgtcttagcggatcttttcacatgggcaag

SEQ ID NO: 16186 - DNA, 72 bp, Homo sapiens
aaagccaaagtgctcacagtggtctgcagtatcctgaatggtctgccccccactgcttcttccactgcattt

SEQ ID NO: 16187 - DNA, 74 bp, Homo sapiens
ctaagggcttctgtgagataagactaagaatggcttccctgggcttgaactggggaccaggaatttctacaggg

SEQ ID NO: 16188 - DNA, 71 bp, Homo sapiens
gaacttgttgggaacccggagtaaagggcactcttgctttgcaaacagactggcggcattttgctgtggaa

SEQ ID NO: 16189 - DNA, 70 bp, Homo sapiens
gattgggggcatgttttgtccacttctttcccacttaataatgtggtctatagcaaataccatgtctcct

SEQ ID NO: 16190 - DNA, 72 bp, Homo sapiens
ccctcttaaactttaagagtgccattctgggccaggcgcagtggctcacacctgtaatcccagcactttggg

SEQ ID NO: 16191 - DNA, 70 bp, Homo sapiens
gaccgagatgctgagatagtggtgaaggacaatggcagaagctgtaagtggccgtgatcaagattgctcc

SEQ ID NO: 16192 - DNA, 70 bp, Homo sapiens
ctaaaaataactctgaaagagtggcctcttgctctgctagatgtcctagggcttctgggtctggctctta

SEQ ID NO: 16193 - DNA, 71 bp, Homo sapiens
cctcttttttttttccttctttcttcatcctctttagatgtatggtggcatgagaggcatgaagggattgg

SEQ ID NO: 16194 - DNA, 70 bp, Homo sapiens
cagcatttcccactgcgccatttgggctctgcgtcagaaggatgagggttcccaattggatattttgctg

SEQ ID NO: 16195 - DNA, 72 bp, Homo sapiens
tggctgaccctttatacaagttggctaacacattaaaactacaaacagggccgagtgcggtggctcacgcct

SEQ ID NO: 16196 - DNA, 70 bp, Homo sapiens
caggggatgagagatttccaataggagtatcagggccagcagaacccttcttggttggaggtcttttagt

SEQ ID NO: 16197 - DNA, 74 bp, Homo sapiens
tcctgttccagttttcccagaggttagcaggcctttcagaaaattacaaaaatgagttcttctttggggaatag

SEQ ID NO: 16198 - DNA, 72 bp, Homo sapiens
ggcccccagccctcccgccggcccagcccgccgggccgcaagcccggaccacccgcgagaagcgcaaacttt

SEQ ID NO: 16199 - DNA, 70 bp, Homo sapiens
ctgctccttgcacgcaggaggcactcaatcaatccttgataaaagcataaatgaggccgggcgcagtggc

SEQ ID NO: 16200 - DNA, 73 bp, Homo sapiens
ccacacccttcttcatggcttccctattcatggtttggcttatcagatcaatgagctcagccaggtgcctccc

SEQ ID NO: 16201 - DNA, 72 bp, Homo sapiens
aacactgactgtgggggtgggaaggtcggggggctgcgctgctccggattcatccgccccaggcgcttcctg

SEQ ID NO: 16202 - DNA, 72 bp, Homo sapiens
ggtgtggctaggcttgtggtggtgggggctacaatataatggagatgacagtaatctgagtatccaagccca

SEQ ID NO: 16203 - DNA, 73 bp, Homo sapiens
attcactatgtaaaccttgtcctagtgcagtgcctgctagatagtagtacctggcatgtttgtggagtaaagg

SEQ ID NO: 16204 - DNA, 73 bp, Homo sapiens
aaggtaggcagaagctgtcctgtagtacagtgcagatatagagacagagttgatctttatcttaagaataatg

SEQ ID NO: 16205 - DNA, 70 bp, Homo sapiens
ctttagtcagaggttagtgaaaagtaagataatttctttttattactgacctatgaattctatccacgga

SEQ ID NO: 16206 - DNA, 70 bp, Homo sapiens
taaacttccatatgctaggtggtatgattcaagactatattcctgaggagtctgagcatttggttgtttt

SEQ ID NO: 16207 - DNA, 72 bp, Homo sapiens
aaagtattagaatgagttcaggggtcagtagcactgtatcaggattttattcctaactttgtcatttctctg

SEQ ID NO: 16208 - DNA, 70 bp, Homo sapiens
tgagcatgatattcttaagtataatattagattttgtaatatttaagagtttatacatgttttcattaca

SEQ ID NO: 16209 - DNA, 70 bp, Homo sapiens
atcccagtaaggtcagctaggtttaaatgcacttgaggatgaaactcagcttgctgataaggggaatgat

SEQ ID NO: 16210 - DNA, 70 bp, Homo sapiens
tgatgtgatttttttccatttgagtataaatccagtaatagaattgctggatcaaataatagtagaatct

SEQ ID NO: 16211 - DNA, 72 bp, Homo sapiens
caggaaggaggagaggctctgagctcagccgatgtcccccctccagacgcccgcgttcctccgtccaggtgc

SEQ ID NO: 16212 - DNA, 71 bp, Homo sapiens
gcaaggcagggagggggcagcaatggtagcagctcaccatgtttactttgttttttaatttcaaattcaca

SEQ ID NO: 16213 - DNA, 73 bp, Homo sapiens
atgattttgtcatgcaatggaaacagaggtgatttctcaccatattgtggaaatctatgcaaaacaggcacca

SEQ ID NO: 16214 - DNA, 73 bp, Homo sapiens
ttgtagtagattttgtgctccttgctctgacatcgtagcttcttgagtcagcaaaagagaaaggttaataaag

SEQ ID NO: 16215 - DNA, 72 bp, Homo sapiens
gagcaaaagcaaatgttgggtgaacggctgtttcctcttattcaagccatgcaccttactcttgctggtaaa

SEQ ID NO: 16216 - DNA, 73 bp, Homo sapiens
tgccactgtggtatcagctgctgagtatcactgcaatctccatcaacaatgacctcagctgacagagctgcag

SEQ ID NO: 16217 - DNA, 73 bp, Homo sapiens
tgatgacgatgatgagctatggtttacagagcactctctttttgccaggcaatgttgaaagtcacttcacgtg

SEQ ID NO: 16218 - DNA, 73 bp, Homo sapiens
tacatgagatactttgttacaggcatgcaatgtgaaagaatcactttatggagatggagtatctattccctca

SEQ ID NO: 16219 - DNA, 73 bp, Homo sapiens
tactgactatgccacccagaggcaacacatgatggactaaaatacatcagaggctatgtggatgacatggaca

SEQ ID NO: 16220 - DNA, 72 bp, Homo sapiens
tgtgttgacagtaatccaaaaatttagcacagtatctggtgacagtaacagaggccgagttgtcaagaaacg

SEQ ID NO: 16221 - DNA, 70 bp, Homo sapiens
ggaggcgtggaattaatcagctgctccataaggggaaaccactgacctctagccactgcctcaaaaccaa

SEQ ID NO: 16222 - DNA, 72 bp, Homo sapiens
aaggcatgactaagtatgtacctcttcccagaggagctgcatagaggttcaggatcatcaacacattaattc

SEQ ID NO: 16223 - DNA, 72 bp, Homo sapiens
tatacaatgtctaagagtttattagacagatgagttcactacacatctgttgttcctcttgttactattatc

SEQ ID NO: 16224 - DNA, 73 bp, Homo sapiens
aggcaatttatggcagtcctcatttcccaggaatttctgatttgagtcagattttttaagaaagagaagctct

SEQ ID NO: 16225 - DNA, 70 bp, Homo sapiens
attctctactttctccattgtggttttactagttcactctagtttgacattgagaaatggaatcagtcca

SEQ ID NO: 16226 - DNA, 72 bp, Homo sapiens
tttcatggttgtgtgggtggttctactttatcttagactggtgaagtgagagttgtctttatttttgaagag

SEQ ID NO: 16227 - DNA, 74 bp, Homo sapiens
taagctactcactgtttctgtcatgcaccagggtcaggctgcaatgtctttcccttatatgactattatctcag

SEQ ID NO: 16228 - DNA, 73 bp, Homo sapiens
tgagcggggcgtgggacgtgctgcggcgtcctagctggcttacagggcggcggcggggtgtgtgtcctctgtt

SEQ ID NO: 16229 - DNA, 70 bp, Homo sapiens
agctcttcacatcaagtatgccgtcttcttctggggagaaactttcctggttagctttacctaaagagtt

SEQ ID NO: 16230 - DNA, 70 bp, Homo sapiens
aatgcagttgttaatctgggttggttttcctcatactgggatatacagaccccaaggaatactctgcagt

SEQ ID NO: 16231 - DNA, 70 bp, Homo sapiens
aaaactgtttgccttccattcctagatgccagtttgctggaatccccctgggaataaaagataatattag

SEQ ID NO: 16232 - DNA, 70 bp, Homo sapiens
gaaatgctgcattctacgttcccctctgggggattcagagtgcttattagcaaattataggatcttgaag

SEQ ID NO: 16233 - DNA, 72 bp, Homo sapiens
caagatggctgactagaagcctcgagtcctactgcatgcatcagaggagtaacagaaccctggtgagcacaa

SEQ ID NO: 16234 - DNA, 72 bp, Homo sapiens
gctctgattagggatattgggccgctaggctgaggtggctcagtggtggcttaggctcagggatgaagtggc

SEQ ID NO: 16235 - DNA, 74 bp, Homo sapiens
ttgtatccttaacatggttccatagtgtagtggttagcatttttgttttacacacattgtatccttaagtggca

SEQ ID NO: 16236 - DNA, 73 bp, Homo sapiens
tttgaatctaaccatctgaaatattttcctgtaatacagggtttaactcagagtttctgggatacaaatgtga

SEQ ID NO: 16237 - DNA, 70 bp, Homo sapiens
gtgccctggttccctcggaagatctctgagttagacaaatgctctcacagagttctcatgtatggttctg

SEQ ID NO: 16238 - DNA, 70 bp, Homo sapiens
gccaggggctgggtactttttactggtaactgtcatatatggcaccagtatagtatgtggcactcaagtg

SEQ ID NO: 16239 - DNA, 71 bp, Homo sapiens
attttaaaaatggttaatgagcactggcttcaatttaaagccatcagctacattagcttataacaagaaag

SEQ ID NO: 16240 - DNA, 70 bp, Homo sapiens
gtcgacttcatatcatgatttaagtattgctaactttatgtaataccatttggatcggggattggtgcac

SEQ ID NO: 16241 - DNA, 72 bp, Homo sapiens
tgtgtgagaggtgattttcaggttctctattatgctccactgatatgtcagtctactctataccaaccattt

SEQ ID NO: 16242 - DNA, 72 bp, Homo sapiens
tgaaaataccattgttaatattttaaaaagctgtgaaagccagcaggctttcaatgcaatactggtgaagaa

SEQ ID NO: 16243 - DNA, 74 bp, Homo sapiens
ttctaaaactgccattgacctagcttgtctactaatttagttcttttaatatggagaaaagctgggatgcttcc

SEQ ID NO: 16244 - DNA, 72 bp, Homo sapiens
caactgggcctgcctctgctagggatggtcagtggtcccaacaggagggtctaaagtggagtggaggctggg

SEQ ID NO: 16245 - DNA, 74 bp, Homo sapiens
ctcactgtaggtgcttccagtcacatctttctggtgcctaaccctaaccagttcctgctgttaccaagtgtgag

SEQ ID NO: 16246 - DNA, 70 bp, Homo sapiens
gacatattagagagcaaatcaaaaagtaggtattttagtacctgctggatcagaggctatcactaagttt

SEQ ID NO: 16247 - DNA, 73 bp, Homo sapiens
caggaaacaagggggcctggctctgggatacaggactggggagataatgaatctgagagagcaaaggagcatt

SEQ ID NO: 16248 - DNA, 72 bp, Homo sapiens
aagtcacagcctgagtatgtaacaggagttaatacctcatatgaaatctattttcctgactagctcagtcct

SEQ ID NO: 16249 - DNA, 72 bp, Homo sapiens
ggctgaggcgggcggatcacttgcggtcaggagttcgagaccagcctgacctacaggttgaaaccctgtctc

SEQ ID NO: 16250 - DNA, 73 bp, Homo sapiens
aaatctagctgtgactctcagcacactttcttgtctttgagctttgattgcaggtgtgcttggccttctaagc

SEQ ID NO: 16251 - DNA, 73 bp, Homo sapiens
ttaatatgatggatgggaaaggccatacacaaagttaatctgctgagttgatgggttgcatcaaaattatggg

SEQ ID NO: 16252 - DNA, 73 bp, Homo sapiens
aaacacaggctcagtaatatgtggaaaagcttcccaattaactttgtctataaactttgtgtgagtctggatt

SEQ ID NO: 16253 - DNA, 72 bp, Homo sapiens
atttttatagttctgagctgactagcggctcatctttaggtgctttgctatattctgagtttagttcagtac

SEQ ID NO: 16254 - DNA, 72 bp, Homo sapiens
atcctatacaggactctttccatctcctatcatataaaatttgcacagagctcctcagggtaggattgtgtt

SEQ ID NO: 16255 - DNA, 74 bp, Homo sapiens
gcctcccaaagtgctgggattacaggcgtgagccaccacgcccggccgtgtttttctaattatattccagctct

SEQ ID NO: 16256 - DNA, 71 bp, Homo sapiens
cgaatttacaactccatttagtatgtttttattgtgtaaatgtgggagtgtaggttttgaaagcccctatg

SEQ ID NO: 16257 - DNA, 71 bp, Homo sapiens
attaatagataatgaatatcattcctatttggaaaccaaatgctcgaatcgagtagggtactaagttggaa

SEQ ID NO: 16258 - DNA, 73 bp, Homo sapiens
ctaattcagtctaacagtttatggtattttggtctaaccctagttttactcagatagtctagaactccatgaa

SEQ ID NO: 16259 - DNA, 73 bp, Homo sapiens
tttggcccccactctcttgtggcctgtagggtttctgcagagaaatctgtcattagtctgataggcttccctt

SEQ ID NO: 16260 - DNA, 72 bp, Homo sapiens
taataagaatacaaagcccctgttcaggcgtaatgggttgggttgttcatgcggcctgagataggttaataa

SEQ ID NO: 16261 - DNA, 72 bp, Homo sapiens
aaaaataatagcacatcatggttttgtaaacactggattgagaactctttccagggcattgagcatttattg

SEQ ID NO: 16262 - DNA, 72 bp, Homo sapiens
aaggtttatcatagttctacatcacagacactcaaaactgtttgttaaatgactggataaataaaatatatg

SEQ ID NO: 16263 - DNA, 73 bp, Homo sapiens
tatatagtattctgctgtaacagcacagaacagactcagaaaagtatatgcctaacagtggaattgctaggta

SEQ ID NO: 16264 - DNA, 71 bp, Homo sapiens
gcagtttgacctacaggccagtgtatggcgtttgctggtgagagccagctgtcacacaagcaggtgggttt

SEQ ID NO: 16265 - DNA, 71 bp, Homo sapiens
gatggcagcaccagctgaatagcaccctttcttcagagaggtgtggcatgtcagatcctatcttgccaagg

SEQ ID NO: 16266 - DNA, 73 bp, Homo sapiens
cattttagaaacaagaaagaagagtctgaggggcctaagtaacatctcagtctcaaagcccttgtgtgcctga

SEQ ID NO: 16267 - DNA, 70 bp, Homo sapiens
atttggtgtgagctgccgctgagacttagtcacaagatggatgtgggtttctgcagccagggctagggtg

SEQ ID NO: 16268 - DNA, 71 bp, Homo sapiens
actgccttcctgtcagcctcagaagagaaaacagctacactcatcgtgagctgagtacaattgtggttaaa

SEQ ID NO: 16269 - DNA, 72 bp, Homo sapiens
ctggaggagcagggatgcagggtgccatgcctcaaggttgcacagagcagtggtgacccacaaaaccatttt

SEQ ID NO: 16270 - DNA, 72 bp, Homo sapiens
cttgatttttagtcctcattcagcttatgtgaaattgagactcattttacaggctgattatgaaacattata

SEQ ID NO: 16271 - DNA, 72 bp, Homo sapiens
aatatgctagccactagctacatctggctactgaatactcaaaatgcagctagtatgaattgtgatgtgctc

SEQ ID NO: 16272 - DNA, 73 bp, Homo sapiens
ttcagaagaaagaccactggacttggagtcatggaatgcaaattcaagttctttgtccaatcctgataataac

SEQ ID NO: 16273 - DNA, 71 bp, Homo sapiens
ctactcctttctgcagtgatgaatggttttcagaaatatgttgctcagcagatgttgaaagaatgagtaca

SEQ ID NO: 16274 - DNA, 73 bp, Homo sapiens
ttttgaattgatttttgtatgtggtttgagatcagggtctattttcggtcctctgcacgtggctattcaattt

SEQ ID NO: 16275 - DNA, 71 bp, Homo sapiens
aaaaccaacaaactacaaagtaaccataatcatggtctaatggaacaatggtgatctttggatctgtttaa

SEQ ID NO: 16276 - DNA, 70 bp, Homo sapiens
tgatgtgtaatatgaagtggctcccaggaaagatggagtagaatttaccaccatctgagcgattgctgga

SEQ ID NO: 16277 - DNA, 72 bp, Homo sapiens
atttgtatgcaatgttcaaagcccacagaactgaacactccagatctgtgtgttttatcttatgtgaattat

SEQ ID NO: 16278 - DNA, 70 bp, Homo sapiens
gggatgatattcaataggcaagatgctggcaagagagtatgcatcagtgatcaggtttcagtatcgtttt

SEQ ID NO: 16279 - DNA, 71 bp, Homo sapiens
caaagtgctgagattacaggcgtgagccaccatgcctggccaatacatgtttagtatgtttttatttttgc

SEQ ID NO: 16280 - DNA, 72 bp, Homo sapiens
acccatcagcttcaagttctgataattgctcatcacagattggcactaatttagtagtaatggtgctgacag

SEQ ID NO: 16281 - DNA, 72 bp, Homo sapiens
tggagagttcccattctcagattacctgtaaggtgatcacatcattgaatgcaaggtgaaaacaggaggttg

SEQ ID NO: 16282 - DNA, 72 bp, Homo sapiens
ttctgccacagggcatgttccatagcacgacagtttgtttcttcagggccaatgaacagcatctttgttgca

SEQ ID NO: 16283 - DNA, 72 bp, Homo sapiens
tcggcctcccaaagtgctgggattacaggcgtgagccaccgcgccttgcggcacactgtatatattttaaat

SEQ ID NO: 16284 - DNA, 74 bp, Homo sapiens
gctcacattgaaaaaaatggcccaggcgcagcggcacatgcttgtaatatcagcacgttgggaagctgaggcgg

SEQ ID NO: 16285 - DNA, 70 bp, Homo sapiens
cgcgcaccggcctggcgggtcccgggcacctggggggcggcgggagccccgggaccatagccggcctggc

SEQ ID NO: 16286 - DNA, 70 bp, Homo sapiens
tttaaagtataatattcaatgctggtatgggtgaggtgaaataggcaccataccttagtgatagttgtac

SEQ ID NO: 16287 - DNA, 72 bp, Homo sapiens
ctgggtcagaacatgcccaggaaaatcagctcccagcaggaaataaattaaataagggtgtcattggaccca

SEQ ID NO: 16288 - DNA, 71 bp, Homo sapiens
tgacttagtagttttcccaggaaccctaagtcttccttcagtatcctgctaggactgagcttgtcttaaaa

SEQ ID NO: 16289 - DNA, 72 bp, Homo sapiens
aatgaaattccattgtcagagttcgccaaagagtctattggtttttggagactttcaggtcctgtgaaggct

SEQ ID NO: 16290 - DNA, 100 bp, Homo sapiens
agataaattcactctagtgctttatggctttttattcctatgtgatagtaataaagtctcatgtagggatggaagccatgaaatacattgtgaaaaatca

SEQ ID NO: 16291 - DNA, 71 bp, Homo sapiens
agcagtaacaacacgtgtgtgagcactggcatagctttacgagagcttcagtggaaaggatgtctcttcta

SEQ ID NO: 16292 - DNA, 74 bp, Homo sapiens
atttgttactatcaggactcgactcgtgtgcggacatttctgttaataatgacagtctctgatagatgagtgta

SEQ ID NO: 16293 - DNA, 73 bp, Homo sapiens
ttctaaagtgcagtagtagctggctaggctaagtaaaatctgtggatgcatttttaaaactttagtttagcta

SEQ ID NO: 16294 - DNA, 72 bp, Homo sapiens
gtcttttagaatgtaagtcagtttgtcgggcgcagtggctcacgcctgtagtcccagcactttgggaggctg

SEQ ID NO: 16295 - DNA, 72 bp, Homo sapiens
ggaagcagcataatggaatggttgggaacatggtcagactatccgagtttgaatcttggctccattctttgc

SEQ ID NO: 16296 - DNA, 73 bp, Homo sapiens
tttaagagctgtgcccaagagttccagcctgcccttgcagatagcctgacctatgaattcagacttgcctagc

SEQ ID NO: 16297 - DNA, 72 bp, Homo sapiens
ggtgcttaggaaaacaagctattttggtccttggcaaatgtgggcattggtatctgtgttccttgctatcat

SEQ ID NO: 16298 - DNA, 71 bp, Homo sapiens
caaaggtatattcttaaatttgggtattattgaaaatattttccatgccttggtgctagcatataagtttg

SEQ ID NO: 16299 - DNA, 70 bp, Homo sapiens
accctacctatatccctccctggcaagacctttactggtatatttgcctaggggtctcttgggccaccac

SEQ ID NO: 16300 - DNA, 70 bp, Homo sapiens
agccagcggctatctttaaagataataagatcatttccttatttcaagaccctgttgagcttatccaggc

SEQ ID NO: 16301 - DNA, 70 bp, Homo sapiens
ttcttatattttcctttgaaattcttggacccatccaaggaattccttaaagtgaattattgcacagtag

SEQ ID NO: 16302 - DNA, 72 bp, Homo sapiens
gacaacttggtaaaacctgagacatgaacattgagtcctggactcggattgtctggctctcaggacaggata

SEQ ID NO: 16303 - DNA, 71 bp, Homo sapiens
cgtctctaataatgaaaaaatacatactgtatcggggcatcgcggggcacggcgagggcagtgcagggtcg

SEQ ID NO: 16304 - DNA, 70 bp, Homo sapiens
tcatttccccggcatagaacataggaggtcaggatcgcacaacattcccttgttgttctcaggatgcctc

SEQ ID NO: 16305 - DNA, 74 bp, Homo sapiens
gggaaagtttggaaactcttagagacttggagggctaagaaggcaggaagaagtgggaaagtttggaacttcct

SEQ ID NO: 16306 - DNA, 73 bp, Homo sapiens
ggcttctgtgctgggtagtcctgattaatgacagtcgtggaatcgtgggagtcaatgcacttctgtcccaccc

SEQ ID NO: 16307 - DNA, 70 bp, Homo sapiens
tcctggccttcacctgtaatggtgtccaatgttggaacaagaacttagcaccaagactccagccagtatc

SEQ ID NO: 16308 - DNA, 72 bp, Homo sapiens
tcagatcgcagctttgcccagttttcccaggtaaggaatggattttttagccttctagttataggtctgtga

SEQ ID NO: 16309 - DNA, 73 bp, Homo sapiens
ctacccttaccctgagataattggcaatgtcaagggaactttgtggttgtcatgactggtatggggtgggaag

SEQ ID NO: 16310 - DNA, 74 bp, Homo sapiens
aatggcaattgtaacagaactgacttctggatagcaatgatgaaagtcagaagacagtggaagtttgttaatgt

SEQ ID NO: 16311 - DNA, 73 bp, Homo sapiens
ggtccaccagagtaggggcttatggaggtcaggtgctcaatgaagttttaactcacagtgggcccagtgggtc

SEQ ID NO: 16312 - DNA, 70 bp, Homo sapiens
ccctctggttacacaccacattgcacgcaggtgtgtggaacaaaaaggggtagttgctgaaaatatacca

SEQ ID NO: 16313 - DNA, 70 bp, Homo sapiens
gcccaggatggctctccactacattcttatcccttgcagggaaagggggaacagtgacaaagggtgtctt

SEQ ID NO: 16314 - DNA, 72 bp, Homo sapiens
ttcttatcaattcactcttctcgtcaggggagggctatttttagccactccactgggtcgtgtttcgagcgc

SEQ ID NO: 16315 - DNA, 70 bp, Homo sapiens
agacacaaaagatatcatgtacagttcctgccttgagggcatttacaacccatcaaggagaactgccaca

SEQ ID NO: 16316 - DNA, 73 bp, Homo sapiens
agaattacaggtgggagaggggagagctgattggccatgccatcagtgacctgtcctcctatactcttttgct

SEQ ID NO: 16317 - DNA, 71 bp, Homo sapiens
gttatagtcaggactctgacctacctgccagtgaaagagctcgacagaggtcaccaaggctgctacttcaa

SEQ ID NO: 16318 - DNA, 71 bp, Homo sapiens
tggcagagaaacattctgtgttaagtcatttgagccaaataatgatttttgcatactcgttcttgtttttc

SEQ ID NO: 16319 - DNA, 70 bp, Homo sapiens
gctcctgagatgaagcactgaccaggctgcctggggagggcactgtcaagtgaggtgtcagtgagtggcc

SEQ ID NO: 16320 - DNA, 70 bp, Homo sapiens
gttagccttatagtaacttcctatcctttttatgcccccaacagtataaataacataggacttctgtgtt

SEQ ID NO: 16321 - DNA, 72 bp, Homo sapiens
caagtttgcttttccactgagtaatccaggaggctgaactctgtttccttccctctcaaggcaaaggataac

SEQ ID NO: 16322 - DNA, 72 bp, Homo sapiens
agctcgagattccgaatgggctacttgttataaacagtagcaagacacgtcctcctctgtctgtgcctctgc

SEQ ID NO: 16323 - DNA, 72 bp, Homo sapiens
atgaattattgagagacagcaccctgacatatgggagtcttgtcttaaggatgcagtctatgttttgaatca

SEQ ID NO: 16324 - DNA, 72 bp, Homo sapiens
agacagagctgggttccaataaatcctgaccccactacttactgagggtccctgggcaagtcactctgtctt

SEQ ID NO: 16325 - DNA, 73 bp, Homo sapiens
tcattgtgagtcaggtgacatatggggtttgcattcatccacaggtgaggcatctgaagggtcagaagaggtg

SEQ ID NO: 16326 - DNA, 74 bp, Homo sapiens
caccttaaggcatcctgtaccagctgacctatgggcaatgaccgaagccaacaatcagccgctaccaattgtgt

SEQ ID NO: 16327 - DNA, 70 bp, Homo sapiens
agagagaaaaggtgtgctctcacccacggtgtgctgcatcccagcagccacaccagctctggggcgcaga

SEQ ID NO: 16328 - DNA, 71 bp, Homo sapiens
agatctccaagcatttcacttggtctccattcctgtgagatgggatgagtccatgttagatatgactggag

SEQ ID NO: 16329 - DNA, 73 bp, Homo sapiens
gttagtgttctgggacatttatgggaacaatgggacagagggttgggatcagaattatcctaagaatactaaa

SEQ ID NO: 16330 - DNA, 70 bp, Homo sapiens
ttctcaaaagccacctgctgcaacctacagctgaatgcggggaagcacagggatcatcgagtccagtgtg

SEQ ID NO: 16331 - DNA, 72 bp, Homo sapiens
ttaaaatgcatcagaggctgtgtgctgttcccaatattagcaacctcagcaccatcccctaagccttcctgc

SEQ ID NO: 16332 - DNA, 74 bp, Homo sapiens
ctcaagcgatcttttcacctcagtctcgagtagctgggactacaggtgcgcacatcaatcctgggctttttttt

SEQ ID NO: 16333 - DNA, 71 bp, Homo sapiens
gcaggcctggtgaggtggccgagcttcctggtggggaggccttccccctctcctccctggtcaatctattt

SEQ ID NO: 16334 - DNA, 72 bp, Homo sapiens
ggtaggcataaattttacaaaaaagagtttcgaaaccgtttgaggaggcgagattctgagaaggtggtggag

SEQ ID NO: 16335 - DNA, 73 bp, Homo sapiens
aagtttcttgtttctgatatgctctccttggcaaatgtttgaaagtctagtatcagagcagctgtgatcctgc

SEQ ID NO: 16336 - DNA, 74 bp, Homo sapiens
atcacaggggagtgttttttgttttgttggggttttttttgaggcaggtcttgctgtgtcacccaggctcatgt

SEQ ID NO: 16337 - DNA, 73 bp, Homo sapiens
ttgcccaagtcggcagcttctaagtcccaggaaagggatttgaactcagtgttgtctagccgacatgagaggc

SEQ ID NO: 16338 - DNA, 74 bp, Homo sapiens
tggtggaaagaaggggcaagagccaacggaaaagatgaggatcatctatgtataggactcatcagtggcttctt

SEQ ID NO: 16339 - DNA, 71 bp, Homo sapiens
ctctaacaaccctaggagcttttattacttccacttcacagatgagacgatggaggtacagagagatcacc

SEQ ID NO: 16340 - DNA, 71 bp, Homo sapiens
tcccttctctctctctcccgctcatctctgctggatgaagaagcctgaattgctctgtccacaacatgagc

SEQ ID NO: 16341 - DNA, 70 bp, Homo sapiens
ctccacggcgggtgttggtattatgcccatcttacaggtgaagaaaccaaggctcagagaggggaagtga

SEQ ID NO: 16342 - DNA, 72 bp, Homo sapiens
gctatgtatgattaaaaggtttgaactctgctcaatcctctgaaagattcaaggacccagaacatactgagt

SEQ ID NO: 16343 - DNA, 72 bp, Homo sapiens
ttgtctttgtgcagccgacttcccagtgggggagacagatgctgctcctttgcaaaggtgctcagtgggacc

SEQ ID NO: 16344 - DNA, 71 bp, Homo sapiens
gtcaacaccagagtctcttggggcagcacctggctgggtcacaagtgactaccaatgacaacacgtaaaca

SEQ ID NO: 16345 - DNA, 74 bp, Homo sapiens
tggtaatctgaaatttcatgatggtgtgggcattttgcattaactatgtcagacaccttttaatccagatacca

SEQ ID NO: 16346 - DNA, 72 bp, Homo sapiens
cagtcaaaatacggaatactatagtattctggtctgggaataatggtagctcagaccagattgagaagagta

SEQ ID NO: 16347 - DNA, 73 bp, Homo sapiens
ccatacgcgacgatgagctgagaggggcagaaaattgagcttgttctgagactggaggcttttggtttatctc

SEQ ID NO: 16348 - DNA, 73 bp, Homo sapiens
gggtggggcacctcaggcgtcattcctgggcgtgatggctcagaagtccagggacagaattgctccatggggc

SEQ ID NO: 16349 - DNA, 70 bp, Homo sapiens
cagagaagataccacaaaggcgtttttgtgtcccctctccttcaggggacatgtggccatgcctggagac

SEQ ID NO: 16350 - DNA, 72 bp, Homo sapiens
tcaatccctctgagcctctgtcttcttttggggtctcctgagaaactgactccaaggccagtggtttacggg

SEQ ID NO: 16351 - DNA, 72 bp, Homo sapiens
gggttgcattggtggttgtcaaactgtgcttcatggtaccccgagggtttcatagagccagttcaggggcca

SEQ ID NO: 16352 - DNA, 72 bp, Homo sapiens
ggtgagttggcattgggcttaaaagacatggtctgtgcccccgcctgtccctcatccaacatattcacacct

SEQ ID NO: 16353 - DNA, 72 bp, Homo sapiens
cctggtctcaccggtctgggcgttggctcccgcactcagtctgcaggggcactcccattggtgcctggcctt

SEQ ID NO: 16354 - DNA, 72 bp, Homo sapiens
ctgctttcctttaatgctccaacaacctgacaagagggtcgggtgaggagacaggccccaagcggcagccgg

SEQ ID NO: 16355 - DNA, 72 bp, Homo sapiens
gtgtgttttctggttggtgcctaaatagacacaggtgtcatctctccttcaccgccagagtcattctgtaaa

SEQ ID NO: 16356 - DNA, 73 bp, Homo sapiens
aagggaagctggcctcttcatccatcagcgccgctgctgctgcccaggggtgaggaccatggtggagcccctt

SEQ ID NO: 16357 - DNA, 73 bp, Homo sapiens
tgagcccggcactacgctaggcgtctcacatacttgactcatcttttatcacccagctgtcaggcagggcttt

SEQ ID NO: 16358 - DNA, 74 bp, Homo sapiens
attgactccactacgcctccatcagaatattcaggtgatggattcaaggagtgtgcgtggggtgcgggaccaac

SEQ ID NO: 16359 - DNA, 73 bp, Homo sapiens
gttgtatatgaatcgtgaaggtatgcacactatcccttcccagttccagggatggttagtcattctagcttga

SEQ ID NO: 16360 - DNA, 72 bp, Homo sapiens
cccactgatgccatttgattagctggctgggaaaatgcctgaagaaggtcctggcttgtcactgagagacag

SEQ ID NO: 16361 - DNA, 73 bp, Homo sapiens
ttccttggctcagaagtctgaacacagcttagctgggtctcctactcagggtctcacaagactgcagtcaatg

SEQ ID NO: 16362 - DNA, 74 bp, Homo sapiens
gccctccatggcggcggccgcggggcccctggacggcaaagtcgccgccctggccgccagcccggcctcggtgg

SEQ ID NO: 16363 - DNA, 73 bp, Homo sapiens
cgtccagttccataatgacagcgaggaggcagaaaccctaaatcctgaaacattttgagtggaacccagcacg

SEQ ID NO: 16364 - DNA, 72 bp, Homo sapiens
gagtccatggtctagacaggatggaaacagagaaacctattctcccagtgtttgtcaaataaaactggaaaa

SEQ ID NO: 16365 - DNA, 72 bp, Homo sapiens
aacctctgaagctctttctctcccttggtgtcctctcaatggcacaggggtatcattctgtttctctgaaca

SEQ ID NO: 16366 - DNA, 71 bp, Homo sapiens
ctgcatgctgctaagtttgggcttggtcatatgacttgctttggtcagtgcaatgttagagggcatgatgt

SEQ ID NO: 16367 - DNA, 70 bp, Homo sapiens
cggtctcgaatgacctcaagtaatccagctacctcggcctcctaaagtgctgagattacaggcctgagcc

SEQ ID NO: 16368 - DNA, 74 bp, Homo sapiens
gtttctgtttccttgataggacccgaactgatatcgagagctgactctgtttcagggactgtggaaatacagag

SEQ ID NO: 16369 - DNA, 72 bp, Homo sapiens
tgatgaattctggggtctagaggggcaagaggcaatataggcgactcagtcacccttttaacatagccaggg

SEQ ID NO: 16370 - DNA, 74 bp, Homo sapiens
tatcccagggggctgcctccagaagggctgtgtgtggcgtcccggcgaggaggaggagggggcagagccgcggg

SEQ ID NO: 16371 - DNA, 73 bp, Homo sapiens
aatgtttccacctctgtgctactgtgagtaataatgcagtgaacatgggtgtgaaaatatttctttgagatcc

SEQ ID NO: 16372 - DNA, 71 bp, Homo sapiens
attgtatcccactgctgccaccaataaaagaggtgattgtcaaattttcaagtgggataatgctattgtgg

SEQ ID NO: 16373 - DNA, 72 bp, Homo sapiens
aatcttacagctgagagacaccattagagctcatcgactcacagcagttgattcggtgttgtgtgtgttagc

SEQ ID NO: 16374 - DNA, 73 bp, Homo sapiens
ctggagtgcagtggtgggatctcggtgtgagccaccatgcctggcctgttcatttctattatttttatctttg

SEQ ID NO: 16375 - DNA, 73 bp, Homo sapiens
ctccaactctcctgtgcggtaggaacagggcattcactttggagcaatccttctcctttcaagtggtgaggtt

SEQ ID NO: 16376 - DNA, 71 bp, Homo sapiens
tatcttggctcatggttctgcagactgtagggggagcatggcacctgcatatgctcggcctctggtgaagc

SEQ ID NO: 16377 - DNA, 73 bp, Homo sapiens
agtctatagcaccagctgagtagccttagatggtactttagtttttgttgttgttgttgttgacttgaaaaaa

SEQ ID NO: 16378 - DNA, 74 bp, Homo sapiens
cgcccggctcaaggcgctaggcgacgagctgcaccagcgcaccatgtggcggcgccgcgcgcggagccggaggg

SEQ ID NO: 16379 - DNA, 70 bp, Homo sapiens
ggggactctgctaatactcgggcccagctccgcaagctgcgggtccatcacaaaggacagccgcactagg

SEQ ID NO: 16380 - DNA, 72 bp, Homo sapiens
catagcggctgcagctaccagcgtaggtaccaagcacctggcgcagagcagatgctcatgaactttttaaga

SEQ ID NO: 16381 - DNA, 71 bp, Homo sapiens
cggagccgcgggttccgcgtggggccggagcggggcctcatataacggcggagggcggcgcgccgcggtcc

SEQ ID NO: 16382 - DNA, 73 bp, Homo sapiens
accatgatgttcaaggtcactggggaacaggatctttacaggatgctacagagtgaccacgtggatttcttaa

SEQ ID NO: 16383 - DNA, 72 bp, Homo sapiens
tcagggaagtgttgtcaccctctgcctgcagaaaggtcatcagaggctatgtggacaagaacttggtaatga

SEQ ID NO: 16384 - DNA, 70 bp, Homo sapiens
gctacaaaatgaggctatctatactaccctggtgcatatattcatatgtatcagtagaaagcaagcttgg

SEQ ID NO: 16385 - DNA, 72 bp, Homo sapiens
acatgacagcaggcaagagtgaatgagaaccaagtgaaaggggaaatcccttataaaattatcagatcttgt

SEQ ID NO: 16386 - DNA, 72 bp, Homo sapiens
caagcagtgagttttcaccattaaagagctgaaatatcacatctttctcctaatggtttagcatctcaaagt

SEQ ID NO: 16387 - DNA, 71 bp, Homo sapiens
tgtgctagcaaagctcaggatcggtcctcgaatgatgtctattcctcggtcatctgaagcattcagctaaa

SEQ ID NO: 16388 - DNA, 71 bp, Homo sapiens
tctgtcagtcacccaggctggaataccgtgacacgatcgtggctcgctacagcctccatgtcccaggctcg

SEQ ID NO: 16389 - DNA, 71 bp, Homo sapiens
gggggctgtattcatttctaatccatggaaaagaaagcatctctctccctgagactctaacttctgcaaat

SEQ ID NO: 16390 - DNA, 72 bp, Homo sapiens
aaacccagactgccagacttatttcagagctccagagtcccttctagctcccggattctctgggtgagtttc

SEQ ID NO: 16391 - DNA, 71 bp, Homo sapiens
gggttagggctggatagtcacattgccagggaaacaaccagggatgttgcaaaagtctcaccaaacccaaa

SEQ ID NO: 16392 - DNA, 72 bp, Homo sapiens
tcaaagacccaaaacacagcctactaagctggtttagattaagatgggactgttttgggagatctctgaaga

SEQ ID NO: 16393 - DNA, 72 bp, Homo sapiens
agactcagattaggcaacatgcccaggttgttctgctaatggctgagtttaaacaaaaaccataaacacctc

SEQ ID NO: 16394 - DNA, 71 bp, Homo sapiens
ggtgacctgcccacctcagcctcccaaagtgctgggattataggcgtgaaccaccaagccaccacatccgg

SEQ ID NO: 16395 - DNA, 70 bp, Homo sapiens
gagccggtgcaccacactctgggaactgctgattcaagtccattaggtcagccttgaggtaacagaatga

SEQ ID NO: 16396 - DNA, 73 bp, Homo sapiens
catgaggatgagctcaaggtctgatctagctgtgtcctctcctaaagcagctagtacagtgccttgctgagaa

SEQ ID NO: 16397 - DNA, 71 bp, Homo sapiens
tggttcagagtgatgtgcagctgatcaagactggagacaaagtgggagccagcgaagccacgctgctgaac

SEQ ID NO: 16398 - DNA, 70 bp, Homo sapiens
gatgtctaccttcttgaatctaaaggtgcacgcaaaagagcaaagtggttagcatgaaggatgagtagcc

SEQ ID NO: 16399 - DNA, 72 bp, Homo sapiens
cgggcctggtccaagactgggaggccgcgggccgtgccaatgtgcttcctcccggggctgtgcctgtggggg

SEQ ID NO: 16400 - DNA, 73 bp, Homo sapiens
gcttttaaagttagtaagtagctcgttaagggccgagaagcgagaagctactgtgtagtttatggggtgacaa

SEQ ID NO: 16401 - DNA, 73 bp, Homo sapiens
ttcagtcatcatcctcctgatgttgtaaagtttggactggagataatatactagactgatgcaaaaaacagtg

SEQ ID NO: 16402 - DNA, 73 bp, Homo sapiens
gtcttgcctgaggctcagtgaggcagtgatgaaagaagagctgccaactctcctatccccagtccagcatgat

SEQ ID NO: 16403 - DNA, 73 bp, Homo sapiens
tggcttcccttgggcatcagacattggagaaggacacccagacgcctcggaggcctcaaccaaaaagccttac

SEQ ID NO: 16404 - DNA, 70 bp, Homo sapiens
tgagatcttgtggaggttacattcccgtggagggaaacaaccacatagtggatacttaattgttgagtaa

SEQ ID NO: 16405 - DNA, 73 bp, Homo sapiens
cttcagcaattctcagctcccgtttggtccagacccactgacctgctcccgccccatgggttattctgaagca

SEQ ID NO: 16406 - DNA, 73 bp, Homo sapiens
gtggacttgttttcacaggttccctacttcagcaaagcgtggcagcgtgtgatacagataccactgctttcag

SEQ ID NO: 16407 - DNA, 74 bp, Homo sapiens
gagacgagttgcatgtgttggttcagctggcgatagcggcgggagcggagccggcggggcctgtgcgaccgcct

SEQ ID NO: 16408 - DNA, 70 bp, Homo sapiens
agatacactcaggatagctggcatcgccaagtgtgtaagaacatactctatgccataaggccagcagaca

SEQ ID NO: 16409 - DNA, 74 bp, Homo sapiens
accgtggagtggaagcccagggttgcagccctctagtttccttgctgaccccaggaatcccctcccaggtgctg

SEQ ID NO: 16410 - DNA, 74 bp, Homo sapiens
gtgtgtagcttatcactgctgagttgaatagatgggagctggtcccacaagctgtctactgctgagcaggtggg

SEQ ID NO: 16411 - DNA, 72 bp, Homo sapiens
acttctcccccagaacaagcttgactgatttgttttcatatcatctgagcttctctcttggacagtgggaag

SEQ ID NO: 16412 - DNA, 72 bp, Homo sapiens
gccggttcccgcccccgagtgcgctcggctgctgcggacggtgggcgaggagcccggggcggggatccgcgc

SEQ ID NO: 16413 - DNA, 72 bp, Homo sapiens
agtctgcatggcttcccagggtttggacgggacactgtgctgtccaagcttatcactctgtatggtcgcccc

SEQ ID NO: 16414 - DNA, 74 bp, Homo sapiens
aatcctgcattattccacctgcacgtaatcggagccccagcccttagaaagggggatttccacatgctgagggg

SEQ ID NO: 16415 - DNA, 72 bp, Homo sapiens
cgtgggtccacacacttgcacacgtgcatgcatgttctaacagtggagcttcgggcaacaagatggtccaca

SEQ ID NO: 16416 - DNA, 74 bp, Homo sapiens
cttcctcctcccctccttttttttttgtttccatttaattttaaaaggaagagagggagataaaccacagcagg

SEQ ID NO: 16417 - DNA, 73 bp, Homo sapiens
gagggatccatctgtcagcagtttgctgaaatgggaccatactatgcacgctttgctgcaccgtgggtttctc

SEQ ID NO: 16418 - DNA, 72 bp, Homo sapiens
cttctccatctccaggtgaagaataggccttgcagatccatctcttctggcccgaggcatctgtctcatttg

SEQ ID NO: 16419 - DNA, 71 bp, Homo sapiens
aagtgggaggctgaggtgggagggttgtctgaactcaggcggcagaggttgcaataaactgagatcctgct

SEQ ID NO: 16420 - DNA, 70 bp, Homo sapiens
ggctgtggttcgctctacatcttctcattgggacacagctgatgaagtgtcacctgtctagaaccttgcc

SEQ ID NO: 16421 - DNA, 70 bp, Homo sapiens
ggaacagggagagaccctgagacagcctgagagtcacctacaggaagagacagggcttctcctgaagagg

SEQ ID NO: 16422 - DNA, 70 bp, Homo sapiens
gcccttctaagaggcgagacacaaagcatgatgtctcagtcgtgatgtctcagtcctgctttccatcaca

SEQ ID NO: 16423 - DNA, 70 bp, Homo sapiens
gtgttcaaacgattctcctgtctcagcctcccgggtagctgggattataggcatctgccgctacgcccag

SEQ ID NO: 16424 - DNA, 72 bp, Homo sapiens
atagtacacaggtgataaagaataaaccttggagtcagattgctctaatactgcctgggccactacaaacct

SEQ ID NO: 16425 - DNA, 74 bp, Homo sapiens
ctccctgtgtctcctccccatccttcacctggactacacactttgctccttcatgacgttctggggtcaggctc

SEQ ID NO: 16426 - DNA, 73 bp, Homo sapiens
aatcacacagcaggcctggccagatggggaaagctatagagctcttactgacccactgggcacagagggcccc

SEQ ID NO: 16427 - DNA, 73 bp, Homo sapiens
ccttcctgaggaccccgatcgtatgttgtggcaatgcaaatgtggacccaaaaaacctgagacaggtctcagt

SEQ ID NO: 16428 - DNA, 73 bp, Homo sapiens
gctggacttcccaccaaggcccactttcataatccaagcaccatacagtgctgacgcggaaggaggctcgagc

SEQ ID NO: 16429 - DNA, 72 bp, Homo sapiens
cagcctggcagcacctagcagctgtgccacaagaagatggcctgacagcacagtgtgcagccctggcctcgc

SEQ ID NO: 16430 - DNA, 72 bp, Homo sapiens
ctgaaattcacggtaagaagatttaagcgaggccagtgggcatgagcgggtgtttccccggttactttcagc

SEQ ID NO: 16431 - DNA, 71 bp, Homo sapiens
gataattgtttgtggtgggggtgtcctgtgcattatagaatgtttagcagcatcactgtccttactaacca

SEQ ID NO: 16432 - DNA, 74 bp, Homo sapiens
gggagacgtttagatcatggaggtggatccctcatgaatggcttggcttgttaatgagttaccatgagatctga

SEQ ID NO: 16433 - DNA, 74 bp, Homo sapiens
ttccctgtggattgggatgtgctttctaaaaactttccctgagacccttacacagtgtgattcccccagtggat

SEQ ID NO: 16434 - DNA, 72 bp, Homo sapiens
gcttttgacgaatcagcttaaattcctattgtttgtttttatagtaatgtaggcgacggcagtctggttctc

SEQ ID NO: 16435 - DNA, 74 bp, Homo sapiens
gtttgcacatgggcttgcatgaacatgtgtatgagtgtgtgtatgcatgtgtgtatgcatttgcaccagtgtgt

SEQ ID NO: 16436 - DNA, 74 bp, Homo sapiens
gtttctcaccacgaccctatagatgttattgtctccattttatggcaacggaatcccaaaagggcagagaggtg

SEQ ID NO: 16437 - DNA, 73 bp, Homo sapiens
aggagaaaactgattatatatgatactcattatgcatatatgattatatattatatgtaatcagttttctcct

SEQ ID NO: 16438 - DNA, 73 bp, Homo sapiens
attaaaatgatacaggcatggagggaagcccagcaaatggtgctgacgctcacactgtacttcgtgatgccag

SEQ ID NO: 16439 - DNA, 71 bp, Homo sapiens
gtcctgccccgtaagggccacgcgggagatcatgtcggatgacttgtggataattaggctctaaaacgcag

SEQ ID NO: 16440 - DNA, 72 bp, Homo sapiens
atgaaatgggtggggtagaggcctgagtgtcctggtgaggggtacgtctgcactagggtccaaccaaggaaa

SEQ ID NO: 16441 - DNA, 73 bp, Homo sapiens
ggaatgagggggtcacaatctgagtcagcaggaggtcagccaacctggccagcggtatggatgccccaggcag

SEQ ID NO: 16442 - DNA, 72 bp, Homo sapiens
tgcccattgagctgctctgagatccacagacttccatactagagctgggagagaccagcacttgttaaactt

SEQ ID NO: 16443 - DNA, 72 bp, Homo sapiens
tggtccccagccctcccgaggacagttctgcacactccctgagaccctttacaggagctcatgttgacctaa

SEQ ID NO: 16444 - DNA, 72 bp, Homo sapiens
tttatcttttctcttcaagccttgggggttagcagctttatagataagggcagtcctgaccataaacccaac

SEQ ID NO: 16445 - DNA, 70 bp, Homo sapiens
aagaagaaggaatgtgttctatttgtgcaatccatcagcaattgatcatggactgtttttgtcttctact

SEQ ID NO: 16446 - DNA, 72 bp, Homo sapiens
ttctgtcatagtacccgaagtccatagttcacatcatggggtcactcgatgtacactgggctttgcagaagt

SEQ ID NO: 16447 - DNA, 72 bp, Homo sapiens
caagcttgtacattcatcactttgtaaatgttcagttatctctgcaggacataagggggtgtttagttaaat

SEQ ID NO: 16448 - DNA, 73 bp, Homo sapiens
gcccctggagagcagtcgtggggcagggcctgcccttgttcagtaagaggatgaacctggccgtctgcctgac

SEQ ID NO: 16449 - DNA, 73 bp, Homo sapiens
ggcctgtccagttttcccagcgcgagctgtcctcccaaccctggaatcaaacgcagctatctccagactggcc

SEQ ID NO: 16450 - DNA, 73 bp, Homo sapiens
ctcctgcccacccaggggcgccacaactgcggtgctgtcccggccacacctgggcgggtgggaaggtcaaggt

SEQ ID NO: 16451 - DNA, 72 bp, Homo sapiens
actcagatgaacatccactgcacacagtggcgtcccaggccgggcgtgactcagtggacacagggcctccac

SEQ ID NO: 16452 - DNA, 73 bp, Homo sapiens
ggcgggccatcagccagcgctcatcatgctgtttgtagctcatcagactgcggtttgtagcaggacctaccca

SEQ ID NO: 16453 - DNA, 74 bp, Homo sapiens
gcattagtgggcgctgagagatgccgctcctggcagaaatgcagggtgaggttcctgcaggcctctgctcacag

SEQ ID NO: 16454 - DNA, 72 bp, Homo sapiens
gaagctggaaggtggtcaagtccctgtgtagggtgtaatgaggggtgcgccaagggatcaggaccaagtggg

SEQ ID NO: 16455 - DNA, 73 bp, Homo sapiens
aactaatgagggatgtggctcagaagtgcaggcacagtgcgcttctgaacacttcatcccagattaggcaccc

SEQ ID NO: 16456 - DNA, 71 bp, Homo sapiens
gagttgggcgttgggtcgtgtagatgtcacctctgtacatttcacaggggcatctaggctcaggagagagg

SEQ ID NO: 16457 - DNA, 72 bp, Homo sapiens
gctatcactactgcatcagtataaacagcacctggaagtcatttccaggagcccttggctgtcagctggcta

SEQ ID NO: 16458 - DNA, 70 bp, Homo sapiens
cctgactcctgcaattgcggctttcccgcttttcagactggccgcccgtgttcacattcctcagctgcag

SEQ ID NO: 16459 - DNA, 70 bp, Homo sapiens
aagttccctgtgcaaagctggcagcaaggttcttgtgagtgtccctgcctctgtggctaatgctaactga

SEQ ID NO: 16460 - DNA, 72 bp, Homo sapiens
gctggtgtactgggtgacggccttggtgccctccgacacggcgtgcttggccagctccccgggcagcagcag

SEQ ID NO: 16461 - DNA, 73 bp, Homo sapiens
gtgggtgtcatactcatcagcaccaaagttttgatgcactgtggtaatgtttagtgatatgtggccaaatcac

SEQ ID NO: 16462 - DNA, 71 bp, Homo sapiens
gcatccgccctcaggtagcctagtgggggttcttccacgctgtctatgtcacgggctgtcctagtacattt

SEQ ID NO: 16463 - DNA, 74 bp, Homo sapiens
tcagtatcacattgccaggtttggaaggacaagttggctagttggactggataacctgtgttttccccagcttg

SEQ ID NO: 16464 - DNA, 72 bp, Homo sapiens
ctccaaattcagtcccattgtgacgtactgagggttaggactttggcatacgaatttgtggggctgggggga

SEQ ID NO: 16465 - DNA, 70 bp, Homo sapiens
acattttgagtgtggttctttgtcttatgagttcagggatggtttctttcactcagatcaaacgttggga

SEQ ID NO: 16466 - DNA, 72 bp, Homo sapiens
tggacctaatacctaatttggactcaatttcaattaggttaatacctaattcagacttggtttgaagagggg

SEQ ID NO: 16467 - DNA, 74 bp, Homo sapiens
aagaattatgcattctgcaagtggcttctgatagatagcgtttctctctggcttttgtgttaaatgagtggtgg

SEQ ID NO: 16468 - DNA, 70 bp, Homo sapiens
ctgggacggggtctaaactgatgctggacagcctgcccacgggagctccctcacacccctgcccaaggac

SEQ ID NO: 16469 - DNA, 73 bp, Homo sapiens
taaagaccaatggcaagttactcagtggtatggtcgtataaattaaccacctgtgaatgagaacgtgggctgt

SEQ ID NO: 16470 - DNA, 72 bp, Homo sapiens
aggtttgtttgcaaaaggtgtgagccatggctttataaggtgttttagcagctgtgcaaatattttgtttta

SEQ ID NO: 16471 - DNA, 72 bp, Homo sapiens
cttttcagtgcaattggccaagttatgacagatttggcatccctccaaaatgactgtaatagactgaaacac

SEQ ID NO: 16472 - DNA, 70 bp, Homo sapiens
tgaaagccactgccttggactacagatgtaactgggctgatcagcgatgctctgaggcagcagctgtgat

SEQ ID NO: 16473 - DNA, 71 bp, Homo sapiens
tactacagagggctgagtcagaccagaggtcacatctctgcgtgctggttttccctagttccaccagacag

SEQ ID NO: 16474 - DNA, 72 bp, Homo sapiens
taggtcaaagccctaatccccagtacctccacatgtgactgtatttggagacagggcctttacagagctgat

SEQ ID NO: 16475 - DNA, 72 bp, Homo sapiens
accacacgccctctgcagtttaatgttctaatggaggaattagggggccagaggagctgggggttacatttg

SEQ ID NO: 16476 - DNA, 72 bp, Homo sapiens
tgttaatcacatgtaactaagccagtacttaaaatagatgggccaccagtgaattagcatgtgatttgcaca

SEQ ID NO: 16477 - DNA, 73 bp, Homo sapiens
agggcagcagcaagtgctgatttcgcacataccatttgatcatcagtaactgggctaagtgctttccacgcat

SEQ ID NO: 16478 - DNA, 71 bp, Homo sapiens
gaggactagcctggcctctgagagaggctgagagcttgggctctagggccttgttggatgctggctctgcc

SEQ ID NO: 16479 - DNA, 74 bp, Homo sapiens
agctctagcaccaaaactttacatgaagtgattagaggtaactttggtaaataatctctgatcttttatatgct

SEQ ID NO: 16480 - DNA, 70 bp, Homo sapiens
tctcagaaccttggctaaagtctcaaagctgagtgacaagaactctttagtctaaaagaaggttctggac

SEQ ID NO: 16481 - DNA, 72 bp, Homo sapiens
aaggcagcctgccctgggttatagagctcaggggcacatgacccactgggctaaaaccttgaggggcattct

SEQ ID NO: 16482 - DNA, 71 bp, Homo sapiens
gttcaatagtactcaccgcttggcgataggcagtggtctcactgcttggtgatagtcttactgcttggtga

SEQ ID NO: 16483 - DNA, 73 bp, Homo sapiens
ctggcagcagcattgtttgaaactccctgtgtgatttcaatgggtaatcaatgttgagaaacactgctttatt

SEQ ID NO: 16484 - DNA, 74 bp, Homo sapiens
actgctagcccactgagtcagcatcattctctaaagagatgtttcagcaactgaccacagtaattggttttcct

SEQ ID NO: 16485 - DNA, 72 bp, Homo sapiens
atattttctgctgtatggtttcaaagcaagtgatagatgtcatgacactatcctaaatacttcagcatttgt

SEQ ID NO: 16486 - DNA, 73 bp, Homo sapiens
tttggacagttgatgtcaaatacgggttctctgaaatttagagtctaaaatgctatcggcaggtccttttcca

SEQ ID NO: 16487 - DNA, 73 bp, Homo sapiens
tgttccctggcttcttaaaccacctgatcccagaaatcctgatctataggaaaagacacagggaggattctat

SEQ ID NO: 16488 - DNA, 73 bp, Homo sapiens
gtggcatcctatttttcataatttaccgaaggcccttggtaatataaatacagagaataacaggtgctgcact

SEQ ID NO: 16489 - DNA, 71 bp, Homo sapiens
agcccctctgaggacggtggctggaccccatgcgggagccgaactctgcggcatctgccgccgtagagggg

SEQ ID NO: 16490 - DNA, 74 bp, Homo sapiens
gtggcatttgtgtgtggatgtgtgtatatgctcgtgagaatgtgtgtcagagagagagagaggtttatgttgct

SEQ ID NO: 16491 - DNA, 70 bp, Homo sapiens
tgtggatttgccagactgcttcactattgatagagacaggagatagtcaacgtctccagcaaaactccac

SEQ ID NO: 16492 - DNA, 72 bp, Homo sapiens
caccggagtctctgctctgaaccatgctgcctgctggcatcaggtgagcatggcactcattgacttactgtt

SEQ ID NO: 16493 - DNA, 72 bp, Homo sapiens
gtgtgctaaaactctaataggccttctcaagaaccaagggcaatggtatactgtgtttctgtatacatatag

SEQ ID NO: 16494 - DNA, 73 bp, Homo sapiens
tgcaacagcgcgagtggcggcggcggcggtcccgcccccctgccttccgcccgcgctccgccgtcctgcgcgc

SEQ ID NO: 16495 - DNA, 73 bp, Homo sapiens
acaggatctctggggtgtcaatttttctggccggaaacctctgtggctgtggtgtctttgcctgagttctcgt

SEQ ID NO: 16496 - DNA, 72 bp, Homo sapiens
catctatttcatagcatggaaaaattccaggctcatagcagcacgcgttatacaaagcttttagtttccagc

SEQ ID NO: 16497 - DNA, 74 bp, Homo sapiens
catgatattcatagtacagtgtcttgcacatgtcgtgcgcttagtaagtgtcagtgataatagagcaagctgct

SEQ ID NO: 16498 - DNA, 71 bp, Homo sapiens
caactcctaagcaaaagcagcatgacactattttgagagcctagtccatgccatactgcatgctgctatca

SEQ ID NO: 16499 - DNA, 72 bp, Homo sapiens
aaagttcagcggaggacttggcctctgatccggcccggtgaacctgaatcagagtaagccaggtagagaagt

SEQ ID NO: 16500 - DNA, 72 bp, Homo sapiens
catggaagatcagagaatttggctgagccattcatgggctgaggctctcacaatgtcacatacaaacatact

SEQ ID NO: 16501 - DNA, 74 bp, Homo sapiens
agacattggggccctattcggtctctcactgctaattccccttccaaaatgtctgaaataccactacgaaaaat

SEQ ID NO: 16502 - DNA, 70 bp, Homo sapiens
cacccacattaaagacatcacaataaaatgcaccagcattggtggtccagtgggaaattaaatgccatgt

SEQ ID NO: 16503 - DNA, 73 bp, Homo sapiens
cttagatatactagtgacactaaaaaaatcactctcagatagaaaaatcttttgagggttgataaagtgttac

SEQ ID NO: 16504 - DNA, 73 bp, Homo sapiens
atttgtagcttatcagacagggtcttagtcaccttgcgccattgctagggactgcagttgaactcaatccaaa

SEQ ID NO: 16505 - DNA, 71 bp, Homo sapiens
gtagagtaagcatgtagcagtttgtgttgctttccattagtctgtgcctggggttacatgtataaagcagc

SEQ ID NO: 16506 - DNA, 72 bp, Homo sapiens
gctttaaagtggaaaaagggaagagtcaggcatggcctaatcagaggctactgtcatgaggaagctataggc

SEQ ID NO: 16507 - DNA, 74 bp, Homo sapiens
taatcaccgtttgttttgtgctttctagttaacctgatgccagtacagtgcaattggaaaagcaggactttggt

SEQ ID NO: 16508 - DNA, 73 bp, Homo sapiens
tgcattgtcaatgccaatctattttccaaaatgtttgtatcagttcatacttccattggcattgtatgtaagt

SEQ ID NO: 16509 - DNA, 73 bp, Homo sapiens
cctaccattctgccatcaggctcagtaaacgaaatgggcaagtaacatttatccagcatagactactggccat

SEQ ID NO: 16510 - DNA, 72 bp, Homo sapiens
aaaatatgacctatgaatgtccagtgtcctccattcacagccatttctctctctggtattaatggttcatgt

SEQ ID NO: 16511 - DNA, 73 bp, Homo sapiens
agcccagtgtttttaaaactgtggattcagcaataaataagattgaatccctgcctggtgagcttgaaaactt

SEQ ID NO: 16512 - DNA, 72 bp, Homo sapiens
tccatggggctaagcagtgggtggactgtggggctcttctacacagcccgttgccagactggcctgggatcc

SEQ ID NO: 16513 - DNA, 74 bp, Homo sapiens
gttatttttaggaaatattctctgatgtatatagggatactatgacactatgtcagaaaatgactttctatgaa

SEQ ID NO: 16514 - DNA, 70 bp, Homo sapiens
tcccaaaggggcaccgacctgatgctgctggagctctcctgtatgaggtgtctggcaacctctgttggga

SEQ ID NO: 16515 - DNA, 72 bp, Homo sapiens
atcttcgaccacaggtagcttatcagacctagtggtctgggcagtagtgctggtggtaaagacagaccccag

SEQ ID NO: 16516 - DNA, 74 bp, Homo sapiens
gtcttcgccgggtaaccctgcttgggctctcagaagcgtgaggggcggagaagatgtggggggcgggacaagac

SEQ ID NO: 16517 - DNA, 73 bp, Homo sapiens
ccccagcccttctaatctgggaggaagaggaatcccgataatatctcacaatccctcatcttcccaggagtgc

SEQ ID NO: 16518 - DNA, 71 bp, Homo sapiens
tatttagttgagtaagacagtgcttctgtattcaagaagtctacctgtgacctattttaactgtatgtttc

SEQ ID NO: 16519 - DNA, 70 bp, Homo sapiens
gggtggtccccggcacctcaacctgacgatgggcttcatggacaagtccttagtcaatgtgcattttcca

SEQ ID NO: 16520 - DNA, 72 bp, Homo sapiens
actgctcactgggatacatgtgctcatttagactttgtcagtttgtcaaagcagaactttccaagtaataca

SEQ ID NO: 16521 - DNA, 72 bp, Homo sapiens
atgcagatatggaaggaaagtctcaaagtcaggtgactggaggtggtctccttttagtcatggcaaataagg

SEQ ID NO: 16522 - DNA, 73 bp, Homo sapiens
gatagattagcctggattgtccatgtggtcctaatatcgtcaaaaggggccttaaaagttgaggatgccagca

SEQ ID NO: 16523 - DNA, 73 bp, Homo sapiens
aacttgaaactgtggccaaaggggtaagtaaggcagtatatgaggaggcaagatgctggctatggaagtcaag

SEQ ID NO: 16524 - DNA, 74 bp, Homo sapiens
aaggactcaggataaggccagtgaaaagaggtggtttagctgaaggctggcctcagcctcttcacagggagttc

SEQ ID NO: 16525 - DNA, 74 bp, Homo sapiens
aaactatgtccacagacctggatgacagtaggaaaaattataagttgattcattaggtttatagggctatgggc

SEQ ID NO: 16526 - DNA, 73 bp, Homo sapiens
gcctcctcagtctcttggagacccctcttgccaacacactcaaacttgtttccctctagaggcacaggatact

SEQ ID NO: 16527 - DNA, 71 bp, Homo sapiens
cttttctgtctgaactttgtctccttttggaagtttccccagtacctccactagggtatgtgaaagaaaag

SEQ ID NO: 16528 - DNA, 73 bp, Homo sapiens
acataccctagtggaggtactggggaaacttccaaaaggagacaaagttcagacagaaaagagggtgagtaag

SEQ ID NO: 16529 - DNA, 72 bp, Homo sapiens
taccttagcaccatttgactatctacaggtcacttttttggagggaacaggagtcaggggtggaggggtgga

SEQ ID NO: 16530 - DNA, 73 bp, Homo sapiens
gctagagaccttgctccaggtagaggggcagcccagatccttctgggtctcacagtggaacatggtcagcacc

SEQ ID NO: 16531 - DNA, 70 bp, Homo sapiens
tgcactatccaatatggcagtccacaagtggccactgtgcatttgcaacatggccggtgcaaatcaagat

SEQ ID NO: 16532 - DNA, 73 bp, Homo sapiens
ctcatgcccggctagctcagctttgaccttgaggttcctgggaagctgtcagagtcatgtctggatggtctga

SEQ ID NO: 16533 - DNA, 73 bp, Homo sapiens
ccaactggcagtttgagtaataccaacccacctcatggaggaacatctattgccacaaatgtcacaaaagaag

SEQ ID NO: 16534 - DNA, 72 bp, Homo sapiens
ccaccaccaccaccatcagcaccacggaggaaccggcgcccccggcggggcgggtggtggcggcggtggcag

SEQ ID NO: 16535 - DNA, 70 bp, Homo sapiens
ctcttgagttaaacagtgcactgtatctttttagccttctgacgaagacactgttagcctcaatgtgcca

SEQ ID NO: 16536 - DNA, 72 bp, Homo sapiens
tgtgtatgtggtttttctgactctgggatcattgtcttagactggagctccagagaggaattattggatcaa

SEQ ID NO: 16537 - DNA, 74 bp, Homo sapiens
gatcgcaatctgctttgagtcctcaatcatttttaagagtgcaaagaggtcttaagaccaaaatgatcgcaatc

SEQ ID NO: 16538 - DNA, 73 bp, Homo sapiens
gggatacagtctatgttgcttatcactacatctccagtgttttggaatagtgattgcaaatattaggttaaga

SEQ ID NO: 16539 - DNA, 72 bp, Homo sapiens
tttgctcatgttgcccagggttgagtgcaatggcgtgatctcagctcactgcaacctttgcctctgggttca

SEQ ID NO: 16540 - DNA, 73 bp, Homo sapiens
ttcagaggcaagatgctggcccctctggctgtcaccatggatgactgctgatttaaggtctttcttggtcatc

SEQ ID NO: 16541 - DNA, 74 bp, Homo sapiens
gtagatgaaaagaggattgagggcagataattgacttacctgggcttgatctgataggatcagccctgggacct

SEQ ID NO: 16542 - DNA, 72 bp, Homo sapiens
aaggtgtccaggggtctggccttgctggaggacttcgggggatggtagcagcagcataaataacatagaagc

SEQ ID NO: 16543 - DNA, 73 bp, Homo sapiens
aaacaggaagaatagtagcttataggatcagagagttgataggggccatatcttgtagctgtttaagctacaa

SEQ ID NO: 16544 - DNA, 72 bp, Homo sapiens
aaatgaagaccagattagtgattgccagggattactcagggagtgggggcaggaagggagtgggagtggcta

SEQ ID NO: 16545 - DNA, 73 bp, Homo sapiens
tgctgaaagttttctcctacacccagttttttcagtccctatacactgtggcaggctggaaatgtaggggagt

SEQ ID NO: 16546 - DNA, 70 bp, Homo sapiens
cccagagcaaatacatcagaatttatgtctggtggagccagagcatcaatggatttgaaagctcctcagg

SEQ ID NO: 16547 - DNA, 72 bp, Homo sapiens
cagggtaggtagatctgctagggagacgaggaacatgctcttctgatggcttccattgtccctgtgcaatca

SEQ ID NO: 16548 - DNA, 71 bp, Homo sapiens
gcatagtactcaaaagggtccttagtagtagggaagagtcagccctaactatttgctggactggtcctacc

SEQ ID NO: 16549 - DNA, 71 bp, Homo sapiens
ttttgtcatctcaagacactatcttcccgaggtggtctggaagggggcatgtgtgagaatccagttactat

SEQ ID NO: 16550 - DNA, 73 bp, Homo sapiens
gcactgcttggtgatgtctaacctgaaagcacatctcatagtcacacaattttgcattgctacccacagtgtg

SEQ ID NO: 16551 - DNA, 72 bp, Homo sapiens
aaatactcttcaaatactcagtttgtcaatattttgtggatagggttagtgaatgggtaaatgtggacttga

SEQ ID NO: 16552 - DNA, 72 bp, Homo sapiens
aactggtggacttcctaactgagacaagccaagtgtcttaggttttgtgtggtcagaagtaacaagaaccca

SEQ ID NO: 16553 - DNA, 70 bp, Homo sapiens
cctcatgaagtgtggacatcaacaataaatctgtaattcatacagtagccatttgtccatggcttggggc

SEQ ID NO: 16554 - DNA, 70 bp, Homo sapiens
tttgaatgttcacattctcaatgtgaagaggccaagcagaagcgcatacggtgtgagccaggggaagaga

SEQ ID NO: 16555 - DNA, 74 bp, Homo sapiens
cctgcttgggtcgaccgcgccgctgcgagggagggcttgccccttgcctccctgctctctgggtgtttcctttg

SEQ ID NO: 16556 - DNA, 73 bp, Homo sapiens
ctccttgctgcaaatacgttcccctgaggctggtgggtaacctaatgccagtcaagctactctgtgagcagcc

SEQ ID NO: 16557 - DNA, 72 bp, Homo sapiens
tcagctgtctgggctggtttatggggtcatggcaaacctgcttctccatgagtctcacacactcactgggtg

SEQ ID NO: 16558 - DNA, 71 bp, Homo sapiens
gttagccattcatcctgtctctgtcctgagtctaaggaaccaaaagggtccttggaggacaaatagactcc

SEQ ID NO: 16559 - DNA, 73 bp, Homo sapiens
gagaggcacttaagtgagaaacctcacccagactgaggaggagggaatctggaagttttctcagaagatagga

SEQ ID NO: 16560 - DNA, 72 bp, Homo sapiens
atgggtggtgatgggtgtgtccattaacttgattgtggtaattacaacatacatgtttatcagatcatcaca

SEQ ID NO: 16561 - DNA, 74 bp, Homo sapiens
atgcagaaatgcttgtataaagacccagagtcaggcaaaggtgccgtgtgattatggaagcccgaggaagcatt

SEQ ID NO: 16562 - DNA, 74 bp, Homo sapiens
gtcatagataggtacaagtaaagtgctataggaatttatctgagatggatatgaaaaggtgccttagctcagac

SEQ ID NO: 16563 - DNA, 74 bp, Homo sapiens
ggaaatactgatggtgctttatggggaagggggaaagaaactaggttaaccctttctctctctttgtcttgggt

SEQ ID NO: 16564 - DNA, 71 bp, Homo sapiens
caaataatgggaacaaaaagagtgattggtttggctgtcaaaagtgaaaaagtcatggaaatgttgctgtc

SEQ ID NO: 16565 - DNA, 70 bp, Homo sapiens
acagttactgcagttgaacatgatcaggttgaatagaggcatgttggcgcatttcaattgcagagaagtt

SEQ ID NO: 16566 - DNA, 72 bp, Homo sapiens
agcagctagaagatctgttcctcaggagagtcacgtgtgtgctgggtgtgaggcagtctggacaatggttgc

SEQ ID NO: 16567 - DNA, 72 bp, Homo sapiens
aactctgctgttgaccttaaagaaacaagctgctatgaccattctgtctctttaggagtacaataagaaatt

SEQ ID NO: 16568 - DNA, 72 bp, Homo sapiens
aagattggtggtaggattttctaaaatgtagtgtttgctacattgtcaaataatttacattaattgctaatg

SEQ ID NO: 16569 - DNA, 74 bp, Homo sapiens
aatagggctttcctgtgtgggaattaaatgtccaatcacagaatccaaagttcttacctgttgagtaaccctgt

SEQ ID NO: 16570 - DNA, 72 bp, Homo sapiens
gcctcagaatactgatccattgctggaactctagtattgcatgtaactagatttcgtttagaattttgatta

SEQ ID NO: 16571 - DNA, 72 bp, Homo sapiens
tttttccattttttctgaagtgtgggaatgtttgggaaaatctacactttcgaagagatatgttgcaaaaac

SEQ ID NO: 16572 - DNA, 71 bp, Homo sapiens
ttgtaaagttctcaggcacaagatctaagattctagactcttagattgtagatgtcaggagctcaggatga

SEQ ID NO: 16573 - DNA, 74 bp, Homo sapiens
gaatattaaacttagagctacattgtcaatatggtagccactagccaccagtggcatggaacacttgaaatgtg

SEQ ID NO: 16574 - DNA, 71 bp, Homo sapiens
gtgctgagattacaggcgtgagacaccgtgctcggccgactttctgatggcatagtttgggcatactattt

SEQ ID NO: 16575 - DNA, 73 bp, Homo sapiens
cctccaagttcaaaattgctatctgtttaacaccattacctgggcttagctaagggtgcaagattgaaataga

SEQ ID NO: 16576 - DNA, 73 bp, Homo sapiens
gaacagatacaggtgataaaattgaaggtaacatgttgttggttacattctgttttttttcctctgggtgggc

SEQ ID NO: 16577 - DNA, 72 bp, Homo sapiens
atggaagctgacaagtctttataaaacactgtcttattagatgagtggactttgtgatgtcttctgttatgt

SEQ ID NO: 16578 - DNA, 73 bp, Homo sapiens
attaataatataatactaatggctgagatttaatgaggactttcagtattttgagtattttgcatttattaat

SEQ ID NO: 16579 - DNA, 72 bp, Homo sapiens
aaagggaataactgatgctgaaagggatgtggagaagggggaacccttgtacactgtccgtgccaatgtaaa

SEQ ID NO: 16580 - DNA, 74 bp, Homo sapiens
caggtggaccacctaaggtcaggagttcgagaccagcctgaccaacacgtgaaaccctgtctctgctaaaaaaa

SEQ ID NO: 16581 - DNA, 72 bp, Homo sapiens
agcattctattttctcctgacctgccaggcttttgctgagaaattgctgaaagccatattggagtttcattg

SEQ ID NO: 16582 - DNA, 70 bp, Homo sapiens
aagacaaagcagcaataggaatagtctgacttgtgtagagctctggcattggctaattaatatgctgttc

SEQ ID NO: 16583 - DNA, 70 bp, Homo sapiens
aatgaatctgggcaatgtaccaaaatatgctactggtggcattatatcacattgccaggaaatggaatta

SEQ ID NO: 16584 - DNA, 72 bp, Homo sapiens
ttatttctttctcttgtctgacggctcaggataggacttccagtactatgctgaataaaagtggtgaaagtg

SEQ ID NO: 16585 - DNA, 70 bp, Homo sapiens
gatgggggtcccgagtgtcgggggggaagagaggctggatctcagtcctcggcgcgcggcggctgcctcc

SEQ ID NO: 16586 - DNA, 71 bp, Homo sapiens
cagtgccagaattgaattggaggacacccagcctgtgtccgctgcttggtgtctgggaaaaaccactacat

SEQ ID NO: 16587 - DNA, 72 bp, Homo sapiens
gggatgacctgcctgcagagaggagtttccttctctatggtctcctccctgctaggagctgaacactcatca

SEQ ID NO: 16588 - DNA, 73 bp, Homo sapiens
cttagcatggactgacattatttagaagttgcatattcttgactcttctgtgaaatgatatatttccaggctg

SEQ ID NO: 16589 - DNA, 72 bp, Homo sapiens
ctttgacatgcacctgaactctgagcctgaatttctgcaggtataaagcggtcatcaaagcactacttcaca

SEQ ID NO: 16590 - DNA, 71 bp, Homo sapiens
cttagaacaatctcctttagaacactgagctgacagatgagtattggaaataaagtggatttgaaggatgc

SEQ ID NO: 16591 - DNA, 72 bp, Homo sapiens
aatttatgttttgtcctgatatttaggggctgtcaacctaattgaaaggaacgtagctaggaatttaacaca

SEQ ID NO: 16592 - DNA, 72 bp, Homo sapiens
agtccaaactgacaaccgttagaaatatgaacaaataaatggtggttgtttgaaggtagaaagttttggagt

SEQ ID NO: 16593 - DNA, 72 bp, Homo sapiens
gcaagcacagccatggatgaatttgagttatctgcagcagcaatgcataggactcaatgtttagttcttacc

SEQ ID NO: 16594 - DNA, 72 bp, Homo sapiens
aggtgggttctcaggccttgtcacccactctccttaccctttcagagtcctcagaggctattgtttccattt

SEQ ID NO: 16595 - DNA, 74 bp, Homo sapiens
ctcaataatttaacaaaagaaacatttatttatgcctcccatagaatatgattggtattggggtgggagtggtg

SEQ ID NO: 16596 - DNA, 73 bp, Homo sapiens
tccactggctcagggactgcttcgaggatatttctcatatcttgttgaaacaaaatctcaatgtgtcagtata

SEQ ID NO: 16597 - DNA, 74 bp, Homo sapiens
gatgacataagcttcagctgctgtctgactgcaactgcatgaggaaatctgagcgagaactggctacttgagtc

SEQ ID NO: 16598 - DNA, 71 bp, Homo sapiens
tagcataactttcataagagaatttaaagtctgttgtgtaacagcagtcttaaaagttgaatttgctgtag

SEQ ID NO: 16599 - DNA, 71 bp, Homo sapiens
ctgctctcaagtctgagagttcaggtgatgctgggggggccatgctcagttctcaggccagtgggtcttat

SEQ ID NO: 16600 - DNA, 70 bp, Homo sapiens
cccacggttctctgcaaggaagcgcagaggcaaaagttcagagtgagattccgggagaaagaaaataggg

SEQ ID NO: 16601 - DNA, 72 bp, Homo sapiens
agaaataactgatgtttagcaattgagtttatttttattactgaactcaagtcaaagtctcagcttgggtca

SEQ ID NO: 16602 - DNA, 71 bp, Homo sapiens
ttcaaggatgaacatcaaataccacacatagtgccaggcacataatgaggtattggataaaatttcatttc

SEQ ID NO: 16603 - DNA, 71 bp, Homo sapiens
tcaaatgagtaatgttttgtgacacatcaaaattataatgatgtgctgcataacttttggtcaacaatggc

SEQ ID NO: 16604 - DNA, 73 bp, Homo sapiens
ttcaagtcatatgactaggaaagaccacagcaatttagaaccatttgaattcagtgggtacctctagtataga

SEQ ID NO: 16605 - DNA, 74 bp, Homo sapiens
attattatttttttaattttacttatttttttattcttcctccaggaaatgtaagattttagtcaagttaaaga

SEQ ID NO: 16606 - DNA, 73 bp, Homo sapiens
cagcaatcccactcctgacaactgaaaaaccgtctatacataaacttatgtttgaaggtttatagcagtttgt

SEQ ID NO: 16607 - DNA, 72 bp, Homo sapiens
gataaaaagaaattgataaaacctgcctgtagttccctggacggcttgatatgactggggatgcagagctag

SEQ ID NO: 16608 - DNA, 72 bp, Homo sapiens
tgaatttaaagttgttatatcttactgctgtttgttgtagacagcatatactggatattgctttttaattca

SEQ ID NO: 16609 - DNA, 73 bp, Homo sapiens
actatctctttggacagtttatggggtttttatagtatatgaaaaacaagctgtacccttttaataaaaggga

SEQ ID NO: 16610 - DNA, 74 bp, Homo sapiens
tttggtttcagtttgtaccattgtttgaagtactcagttggttgaatactccaaataatggttcaaattcaaac

SEQ ID NO: 16611 - DNA, 71 bp, Homo sapiens
atattaaatttacacctactacatgcccagaactataaccaggctctgtaagggatgtggcatttttaagt

SEQ ID NO: 16612 - DNA, 71 bp, Homo sapiens
atttggggagattcaatgatttggtttgtaaagcaagggtctgctgcttggttttcccaggaaaaatgaac

SEQ ID NO: 16613 - DNA, 72 bp, Homo sapiens
gcatcaaaatcagacagcagcaacagccaggaatccaagaaacaaattcctggatgcagaagttgttactga

SEQ ID NO: 16614 - DNA, 73 bp, Homo sapiens
gaaaacacaaaactatcagtcattgtcaaatactccataaatggagacagagaaggggttcagttctctgtgt

SEQ ID NO: 16615 - DNA, 72 bp, Homo sapiens
gataaagggatagtctgcagatgactgatagtcagctaggcaaaatacctgagtcctaacttagaattggct

SEQ ID NO: 16616 - DNA, 72 bp, Homo sapiens
taggtttggaaggtttgcagttgctgctcttcagtccaaagtagaacagtatgagcgtgaaaccaatcgcct

SEQ ID NO: 16617 - DNA, 70 bp, Homo sapiens
gaataacaagcagtgagattgaagcggtaatttgtatggtaattttacaaattaccaacagcaacaaaaa

SEQ ID NO: 16618 - DNA, 70 bp, Homo sapiens
ggactttttgttgctgttggtaatttgtaaaattaccatacaaattaccgcttcaatctcactgcttgtt

SEQ ID NO: 16619 - DNA, 72 bp, Homo sapiens
ggcgatgactcaggctttcaggctgtctctactccttgttcccctatgcgagatggctgctgagcacagggg

SEQ ID NO: 16620 - DNA, 72 bp, Homo sapiens
tggtgggaggtgattgaatcatggaggtggtttctcatgaatggtttagcaccatctctctagcgcttttct

SEQ ID NO: 16621 - DNA, 72 bp, Homo sapiens
attgcagagatgcctaacatggcctcaattgaccattctttggtttcctgcaactttttccccctcaattca

SEQ ID NO: 16622 - DNA, 73 bp, Homo sapiens
gcgttagttttcagagttaatggccatgtgtgagaacatgctgagtacaggtggccaatggttatgctgagaa

SEQ ID NO: 16623 - DNA, 73 bp, Homo sapiens
tttctgacatcatattaattggatctaatgtgcaaatgttgcaattacctgagaccctttagtgtgttagaga

SEQ ID NO: 16624 - DNA, 72 bp, Homo sapiens
agcagtcaatagatagtttctctacttacataaaatttgttgtaaagatgtcataggaatagctgattgctt

SEQ ID NO: 16625 - DNA, 72 bp, Homo sapiens
atagatttaaatagcctcacattgccagaagctaccaaattggagactggtgggctaggatttctggtcagg

SEQ ID NO: 16626 - DNA, 73 bp, Homo sapiens
ctcacagcaatgctcaggctagagtacaatggcacaatcttggctcactgcaacctctgcctcctgggttcaa

SEQ ID NO: 16627 - DNA, 72 bp, Homo sapiens
taaacatgggccaagcttcacattgagaagtagactccctctctgtgatgaaacactacagtccatgctgca

SEQ ID NO: 16628 - DNA, 70 bp, Homo sapiens
gtaacgaggcctttccgttgagagtcccaaggttctaggaacatagctttgttatcatacaacatatgtt

SEQ ID NO: 16629 - DNA, 71 bp, Homo sapiens
ctatatattttggtgtgtgactgaactaggaggtaaactgaacgcaactagttttattgcacaagtcctgt

SEQ ID NO: 16630 - DNA, 72 bp, Homo sapiens
agttcactgaaaacatctaattagaagaagaataaagctttttctttgactattaggtttataggctgcttt

SEQ ID NO: 16631 - DNA, 73 bp, Homo sapiens
gaaagcggtctagttttcttattctgcatatggatatccagttttcccagattagtgaagagattgttatttc

SEQ ID NO: 16632 - DNA, 74 bp, Homo sapiens
gttacactctagtctgcaagccaaaatacattgctgcccttagcccattcttgggtttaagttaaggccagcaa

SEQ ID NO: 16633 - DNA, 72 bp, Homo sapiens
gaagacatcacttgctaaaggaaaacttgggtggtgatcagaaattcggtttccatcctattcaatcttgag

SEQ ID NO: 16634 - DNA, 73 bp, Homo sapiens
gcggggtacactgtcaacctagcaaagtacttcaaggaggtggagttatcacttttgcttatagatccagtaa

SEQ ID NO: 16635 - DNA, 71 bp, Homo sapiens
agtggagggaggagatggagaatagtcattgttcttgagatgactacagtggcaggagcttattttgtccc

SEQ ID NO: 16636 - DNA, 73 bp, Homo sapiens
gtctgtatgtgtccatcaatacctcactgatttgaagtttaaactttatggtgatgagatacacaaaattggg

SEQ ID NO: 16637 - DNA, 72 bp, Homo sapiens
aatctcttctggcttacagggtttccactgagaggttcactgttagtctgataggcttctttgtaggttacc

SEQ ID NO: 16638 - DNA, 72 bp, Homo sapiens
ataaggaggaatatgagtcagcagagattccagattttgtcctgtgatcgccaactgacaatccaacttcag

SEQ ID NO: 16639 - DNA, 74 bp, Homo sapiens
taagtgcacagtcttgtaagagagaattgcaaattattgcaatgctctaataattgcaatatgatccttacaag

SEQ ID NO: 16640 - DNA, 72 bp, Homo sapiens
ggactagcagaattctagcagcatgtaaaatattggatgctggaaataaacatctgggctttgcttcttatc

SEQ ID NO: 16641 - DNA, 71 bp, Homo sapiens
ctatgtgctgttctgttggttgtgtagtgaactaccatgcacagtgggctagctttcctctgatttctgtt

SEQ ID NO: 16642 - DNA, 73 bp, Homo sapiens
gctagcagtactttaagtgctcataatgcagtagataactaaacactacctgcactataagcactttagtgct

SEQ ID NO: 16643 - DNA, 70 bp, Homo sapiens
ccagaattgtggggatgtttctgaattctcacccagaagcagcagtagtggttaatacgtcttcctttcc

SEQ ID NO: 16644 - DNA, 73 bp, Homo sapiens
atttcaccagaaatgtcttttttttttaaccactgtaaagaacaggcaatgcatcagactgatatttcaggta

SEQ ID NO: 16645 - DNA, 73 bp, Homo sapiens
cctgaataaacagaagtcacaacagaggcgatgtgcgtatacccaaggatccttttagtgatcgttgtgtcag

SEQ ID NO: 16646 - DNA, 73 bp, Homo sapiens
ttcatcagttgatagacatttagactgtttccagtttttgactattaggaatatgctgtgatgatcatctatg

SEQ ID NO: 16647 - DNA, 72 bp, Homo sapiens
tattttgtaccacgtgatgtatcaggagacctttctggcactgttggcctcaagggcatgggaagcaatgaa

SEQ ID NO: 16648 - DNA, 70 bp, Homo sapiens
tgggctactggatagaattgtcagaaggttatcatcttaagaatttggccctagaccagaggtccccaac

SEQ ID NO: 16649 - DNA, 74 bp, Homo sapiens
tgcatctacacactggggatacaaatggctacaacaatccctcaagtttctcaaagccagtgggggaaatatgc

SEQ ID NO: 16650 - DNA, 70 bp, Homo sapiens
tggatcctccctgccactccaccgctgccaccattttactcactgcactgaggccagggatatttatcaa

SEQ ID NO: 16651 - DNA, 72 bp, Homo sapiens
atattattcatcacctatagtagactgctgagtgcattgagagtttacaggggttcacttacattgactgac

SEQ ID NO: 16652 - DNA, 73 bp, Homo sapiens
ttttcttttctgtgatggcaataacatggtatgcccactctttctgtgtcaaaatgccatctctgtgaaaggt

SEQ ID NO: 16653 - DNA, 72 bp, Homo sapiens
ttactgttaaacgattatagaatttcaggctgggaagatgaaaaagttctagagatggataatggtgaagat

SEQ ID NO: 16654 - DNA, 70 bp, Homo sapiens
aatttctgacctataggaactgtggcataaggaatcttgttctaagctactgtcttttggtgtcatttgt

SEQ ID NO: 16655 - DNA, 70 bp, Homo sapiens
gccctcaccagacactgaacctgctggtattttgaacttggactacccagcccttagaactgtgagaaat

SEQ ID NO: 16656 - DNA, 72 bp, Homo sapiens
gattaaaagccctttgtacagtaatccaggagctgctgtatgctaatgactgtgctcttaaagcccgtgagt

SEQ ID NO: 16657 - DNA, 74 bp, Homo sapiens
ctttcagggactctgagatccttgtgaaatgaggttcaaactcttgaatgtgagcgagagggcattcccagtgt

SEQ ID NO: 16658 - DNA, 73 bp, Homo sapiens
ccactgcgggggcctctgtggtgacaaactcaaactccgtgggacacacgtcatccatgcacccactgccact

SEQ ID NO: 16659 - DNA, 71 bp, Homo sapiens
gtggtacagtttgcatttaataggttgagcatccctttttaactgctaaagcactagaactgcaacatgcc

SEQ ID NO: 16660 - DNA, 73 bp, Homo sapiens
atctcagtagacctggagaaaccattccacgtgggtgaatggtgtggttagactggttttcgtggagtctaca

SEQ ID NO: 16661 - DNA, 72 bp, Homo sapiens
ctctgttgcccaggctggatggagtacagtggagcgatcagagctcactcagatccgatcagagctcagcag

SEQ ID NO: 16662 - DNA, 74 bp, Homo sapiens
agaataaatggctagtcctttgcaaagacagtcagtgggatatggcatgtagattgatgaagttctttggctgt

SEQ ID NO: 16663 - DNA, 74 bp, Homo sapiens
gcacattgattttgtatccagagactttgctgaagttgcttatcagctaaaggatattttgggttcagacgatg

SEQ ID NO: 16664 - DNA, 73 bp, Homo sapiens
attgtccttgtgggtaattttgcaagccagtgtcccgcacattgccagggatttctggagggggctgttacct

SEQ ID NO: 16665 - DNA, 72 bp, Homo sapiens
attctcccagtcaagtctgatgagatgttttttctgacctccgcaacccctggactggggttaagcccacaa

SEQ ID NO: 16666 - DNA, 72 bp, Homo sapiens
ttttgtggctcagttcagtaggacagaacggtcatgcgttctgctgcgtgcagggagagagagttagtagct

SEQ ID NO: 16667 - DNA, 71 bp, Homo sapiens
cttgcaaagagagtgactgggaaaatgtcacttttctaattttctgcgctttctatgattttttgctttta

SEQ ID NO: 16668 - DNA, 71 bp, Homo sapiens
aagctctcaggtgttacttgctggtccaaggactacacgtagtagcaaagtgctatgtcatacctcccaac

SEQ ID NO: 16669 - DNA, 73 bp, Homo sapiens
actgaggatatctgttctgcacaaagccatgccaactcacctggcagcagccggtgcactggaagaacccctc

SEQ ID NO: 16670 - DNA, 72 bp, Homo sapiens
ggaggagctgacaccacatgaagagaagaacgtggagtctacggccaggtgcatgtggcttcaaatccacct

SEQ ID NO: 16671 - DNA, 70 bp, Homo sapiens
aatcactaccaggtggtaagtgtgtgaagacctacagctgactctttgctatttgtgatactggaggcca

SEQ ID NO: 16672 - DNA, 73 bp, Homo sapiens
tccagtgtgagacccactgctatggggtcaccgattcctagattcctaatggaggtggagcatgttcagggag

SEQ ID NO: 16673 - DNA, 73 bp, Homo sapiens
gggtgggagggcaaggctctgcagtttggggttccagaggccaaggcgcaacagcagaagagaggacaaaaaa

SEQ ID NO: 16674 - DNA, 73 bp, Homo sapiens
acacaggtgtaaaaaagatagcccccagtcctttttcttatggagcttaggtcctgtctctcttgcagaatta

SEQ ID NO: 16675 - DNA, 72 bp, Homo sapiens
gtctgccctgacctcatttaggtcaactatgggctgggagcagctcgtgactctgagctgagtgaccaggga

SEQ ID NO: 16676 - DNA, 73 bp, Homo sapiens
gcgaccgttctcactgagcatgtgcagacggcggtgcgcatgctctgttgcggtccgcttcggtttctgttgc

SEQ ID NO: 16677 - DNA, 74 bp, Homo sapiens
atatgatcatttgccaaggaatatgctgtgatgaaaacggagcagtgtaaactcagcacttctcttagctcgta

SEQ ID NO: 16678 - DNA, 73 bp, Homo sapiens
cctgcctcggcctcccaaagtgctggtattgcagacgtgaactactgcgcctggccatctcaggtattttcag

SEQ ID NO: 16679 - DNA, 70 bp, Homo sapiens
ataagtctgctccctaatctcaagcaataactttgaggtgaagtgtagtggctgatttgttttcctttct

SEQ ID NO: 16680 - DNA, 71 bp, Homo sapiens
aggagactaattagaaggcagatgaagtaatccagactagatgatagtagctggaatctggggttggttag

SEQ ID NO: 16681 - DNA, 70 bp, Homo sapiens
atccaggtggtgtggggaggctgagggcacggtcctcctgcccagaacgcaggtgtcctgtctgctacag

SEQ ID NO: 16682 - DNA, 73 bp, Homo sapiens
gttcaaggcactagatggagacacctgatgaaacatcactaatgaatctgtctcaggccaacattgagctgtt

SEQ ID NO: 16683 - DNA, 72 bp, Homo sapiens
gtgagcagagccatcagataagatagggccttactgcggtaaggtgcatacgtaactcagtggatggtgaag

SEQ ID NO: 16684 - DNA, 73 bp, Homo sapiens
aaaagagaggagagcctggcaccgagttatattaggatgcaatgtctattcagcaagaaagctcactggctct

SEQ ID NO: 16685 - DNA, 73 bp, Homo sapiens
tggaatgagccaattcctcaggtccaggacatagatgcatggctccttgcctatcctggggatgtttttgtca

SEQ ID NO: 16686 - DNA, 72 bp, Homo sapiens
tctatattcttttaggagttatttcattatgaaagttctgataatgacttatgaaaagccagactggaaata

SEQ ID NO: 16687 - DNA, 70 bp, Homo sapiens
gtggaaactaagcctaactctaattctgaaacaaagaaaaagggggaggggggaccaaaaaaccctctaa

SEQ ID NO: 16688 - DNA, 72 bp, Homo sapiens
tccacctccctcttataaaggacccctgtgattgcatcaggctcacctgagtaatccaggataatctcccca

SEQ ID NO: 16689 - DNA, 74 bp, Homo sapiens
ggaagctgtaggtacatccagtgttctatagaattttgctgttctctcctgtagtggggtacttgtggtctgcc

SEQ ID NO: 16690 - DNA, 74 bp, Homo sapiens
aagcactaagtctcagctactccacagactgaggcaggagaatcacttaagcccaggagttcaagagcagcctg

SEQ ID NO: 16691 - DNA, 71 bp, Homo sapiens
tttcatgtttggctacctagttttcatgtattttgccatcgccaggcagtacttgcataatgtggagagct

SEQ ID NO: 16692 - DNA, 74 bp, Homo sapiens
cctgtctcggggtctggccctagaatttatgtccaggttacttattggaaagttttcccaggaagaaaggaaga

SEQ ID NO: 16693 - DNA, 71 bp, Homo sapiens
cttgtgccaggctcagccagcagactgctagagatttcagcagatggttcagtttgcttcaccaatgaaat

SEQ ID NO: 16694 - DNA, 70 bp, Homo sapiens
acagtgaatggagcatcacgaagctcaatgtgtatcatgttgagtaaaacggagatgaggagaattaggc

SEQ ID NO: 16695 - DNA, 72 bp, Homo sapiens
aaggctactctagttcactgcaatgtcattatggcattgatgagtgtgggaaaagcctaagaaatgctgcta

SEQ ID NO: 16696 - DNA, 74 bp, Homo sapiens
aaaggaaactaagaaaacagagtatagagtgtgcttgtttcactaatcaaatagtctgtggcaggagttttctt

SEQ ID NO: 16697 - DNA, 72 bp, Homo sapiens
agaaaggggaacaagacaaacaaaagccccaaacagtcatgggcttggtatgtgtttctgtcccagtgaggg

SEQ ID NO: 16698 - DNA, 72 bp, Homo sapiens
ttcacaagacatttgttctttccactgttctctactttaagtggatgaggttcatctggtttgttgatgtta

SEQ ID NO: 16699 - DNA, 71 bp, Homo sapiens
aaccagctgaacagagcctttcatgtgacaacaaaaaacgacctggctcaaacatcacgacaggcatctgt

SEQ ID NO: 16700 - DNA, 73 bp, Homo sapiens
gaggggaagggacaggttgggttttagtctcacagggcctgtatcatattcgacaggttttgggggaaagcta

SEQ ID NO: 16701 - DNA, 71 bp, Homo sapiens
ctggaaagcaagctgttcttccctgacaagcacttggtggtcaccagaggctggactgaagacttctttgc

SEQ ID NO: 16702 - DNA, 74 bp, Homo sapiens
aattcagttcttcagtgatagatccctgggactcctgattaccaggtaaagttatagaaaatagttattgaaga

SEQ ID NO: 16703 - DNA, 72 bp, Homo sapiens
cagtggtgctgaggatgaggcaggcctgactatagttgatattaggactgtgttttcaccaccgtgtctaca

SEQ ID NO: 16704 - DNA, 72 bp, Homo sapiens
gcaacctaggcagaagtgagaggctccagcagtgacagcagcacattgcaaaagcactttctttttcttgtc

SEQ ID NO: 16705 - DNA, 72 bp, Homo sapiens
agcccagcatgctgagagctacccctagaccctgacaagctcagtgcttgcacctgcctcagagagcctggt

SEQ ID NO: 16706 - DNA, 73 bp, Homo sapiens
catgaatgagaaaatgaatacaaaagtgggacttgcatactaaatgcaaatgttttgcctgtttaattttcaa

SEQ ID NO: 16707 - DNA, 74 bp, Homo sapiens
gagaaaatagattagtgccatgaaatgggatccctttcccatttaaaataaattttaatgctcttgttgaaagt

SEQ ID NO: 16708 - DNA, 74 bp, Homo sapiens
ttttttttttctgtctctttttctcttgctgtctgagcagcattgcataggtagctaggggaagagactctaga

SEQ ID NO: 16709 - DNA, 74 bp, Homo sapiens
tggaaagggaagccagctcccacacacccaaggcagcacgaagcctgttcttcagaaggaaccctgccctctct

SEQ ID NO: 16710 - DNA, 73 bp, Homo sapiens
cagtctggcagctgctatagcgtgggcatcccagcatgactgatttggttgaggtttgcagctttccacactg

SEQ ID NO: 16711 - DNA, 74 bp, Homo sapiens
agccagtccagtgaagggtccttggatgaaagtgactcagcagagtcttacatctttataggaactacctgtca

SEQ ID NO: 16712 - DNA, 73 bp, Homo sapiens
gcaccaaagccccattgaggttcatggttgttaagttaacgtgagacccgtatagtgctcggcttttctccag

SEQ ID NO: 16713 - DNA, 70 bp, Homo sapiens
gcaaagatgccaagaagcaacctccagggaggcaggagatgcatcccaagagagcagcttgggatgtgcc

SEQ ID NO: 16714 - DNA, 74 bp, Homo sapiens
actgcctgacctataggccacattcaaacaatgtcatcaattattatgatgcttcctaatgtctgggattggcc

SEQ ID NO: 16715 - DNA, 73 bp, Homo sapiens
gtgtgtgtgagtgtgtgtatgtgcacacacaaaaaatagtcgggcacctgcacacactgtgctcaaggccata

SEQ ID NO: 16716 - DNA, 73 bp, Homo sapiens
tcggcctctcaaagtgctgggataacaggtgtgagccactgtgcccagcctagcattttaaattttgatagat

SEQ ID NO: 16717 - DNA, 72 bp, Homo sapiens
tgctgggctccagcccgaggtccctgggtcctccctgagtcaaacctgggcgggggtgtgctcgccttcatg

SEQ ID NO: 16718 - DNA, 74 bp, Homo sapiens
gccatgcttcccgctgcccatcagaaccggcgattttgaatctctctttccacggcagtagctcctgcaagagc

SEQ ID NO: 16719 - DNA, 72 bp, Homo sapiens
gtctttgcactgaaagatgaccttcaagtttgctcctttgagataccaaaatgtcattgtttctgtgattaa

SEQ ID NO: 16720 - DNA, 71 bp, Homo sapiens
gaatttgacatttcacagcaaatggggcttggcaagtaaaggtgccgtgtgatgaatcaacagcagactca

SEQ ID NO: 16721 - DNA, 70 bp, Homo sapiens
cccttcatgtacaggccagaggttgataggaggggcttccttaccaaatactgtggtcatatcgtcatcc

SEQ ID NO: 16722 - DNA, 74 bp, Homo sapiens
tcggctcctgactctgccaggtagggcgacctcgtgggtggcctgcgggggtctgcgccatttgggtaatggag

SEQ ID NO: 16723 - DNA, 73 bp, Homo sapiens
atgcatgtgcaaacccatgcacccactcacacacatgcatgcatgcacacatagacatatgcactcactcaca

SEQ ID NO: 16724 - DNA, 73 bp, Homo sapiens
tgcctcccgggccgcagcgatgaattccgccgagcaaaccgttacgtggctcatcactctgggggtgctggag

SEQ ID NO: 16725 - DNA, 73 bp, Homo sapiens
agtattcagtacgtcacatgagctattcaacgctgtgttataaaatatgctcttgtgtgagatgattttgccc

SEQ ID NO: 16726 - DNA, 70 bp, Homo sapiens
tgtgacaaggagagggaggcgggtgcctccgccctgccctctgtgcctggccatggcctctttttcccag

SEQ ID NO: 16727 - DNA, 71 bp, Homo sapiens
cagagagcggctgtaccaccagccacaggacacacagtgagcaacgcgtggctccgtggcaccactgcctt

SEQ ID NO: 16728 - DNA, 70 bp, Homo sapiens
aagtggccggggctgggatgcgggccgcggcttcaccgtgcaactgcggcccattgctacgtgcctcgtg

SEQ ID NO: 16729 - DNA, 73 bp, Homo sapiens
gccacagctccgcgccccctccccgcccctcgcggctcccccaccctcgcgttcggcagcgccaggctgcgct

SEQ ID NO: 16730 - DNA, 73 bp, Homo sapiens
gccccctcctcctccccgcgcccccgcccccgcccccctcctgcatagcgtacggattcaggaaacacggcag

SEQ ID NO: 16731 - DNA, 71 bp, Homo sapiens
gggcctggaagaaatgctgtgccattgaacttagcaagcatccagttcttggctcacaatcagtaacggtg

SEQ ID NO: 16732 - DNA, 72 bp, Homo sapiens
aatctttctggctcaagcatttggaatggagatggactgaacccactgggcgttttagttgcatgtaagccg

SEQ ID NO: 16733 - DNA, 72 bp, Homo sapiens
ctggggagcccctctttccttcgcatccatcccggaagctcctcgagtggagagagtcgagggtcggcagga

SEQ ID NO: 16734 - DNA, 73 bp, Homo sapiens
gcccgacctcgcactgccgcgcgggccggtcccccccggcccgggtaactgggacgtcctgggaaaataaatt

SEQ ID NO: 16735 - DNA, 72 bp, Homo sapiens
acttttcttttatgagatcagaatgatttgttgttctgacatcatatcaacggattgaaacttgaaccaggc

SEQ ID NO: 16736 - DNA, 74 bp, Homo sapiens
taaatagcagcaccctttgaaggatccttgaaccatgaccacaccgcaacaaagagtccttcatcaaactcgct

SEQ ID NO: 16737 - DNA, 73 bp, Homo sapiens
cctgtgaggactctgggatactcacagactgaagtctgactccttggtagtatccacaaagattcaaattcag

SEQ ID NO: 16738 - DNA, 70 bp, Homo sapiens
gtttatgaagctgttgacgctgaagcctcttgctaatgatggcatctcctgcatgggcacctttgtgctc

SEQ ID NO: 16739 - DNA, 70 bp, Homo sapiens
tagagactgccagagcacgtgacaccagtatagcagagaggctgggaggaagcaggtcagggaggcagcc

SEQ ID NO: 16740 - DNA, 73 bp, Homo sapiens
aacactccactgccagcctctcacaggtgccatctcagtcggtcctgcggtgaccctggaggagcaggtacca

SEQ ID NO: 16741 - DNA, 72 bp, Homo sapiens
gcccctccctctctccagccaggtgtcgatcaagtcctcaccttctctccagccaggcgtcgatcagggccc

SEQ ID NO: 16742 - DNA, 70 bp, Homo sapiens
aaacccagcagcagtgttctggaatcctatgtgagcgacaaactatcagaacttcgtagcattgttctgg

SEQ ID NO: 16743 - DNA, 72 bp, Homo sapiens
gctatagatgaatgttagtgacatgagtgttggcggcagcagcagaggcacactgacctgtcaccaagcagg

SEQ ID NO: 16744 - DNA, 71 bp, Homo sapiens
gcaagcatggcgaaggcccgctccacattgactgctcacatcactgtggtcactttattctttggaccatg

SEQ ID NO: 16745 - DNA, 73 bp, Homo sapiens
agatctgaactgggctttgaaggatttcaagaggcaggaaagaatagccattcaagaaagaagctaagtggga

SEQ ID NO: 16746 - DNA, 72 bp, Homo sapiens
cctgaagggcgcctggtgggatggtttggttagtcaggtggaccccactaaggcactgggcgtggctgcaca

SEQ ID NO: 16747 - DNA, 71 bp, Homo sapiens
ccctatgggaagaatcctgggaaagaggcaaacttacgaaagtcctaggatcatggttaaacggcatttga

SEQ ID NO: 16748 - DNA, 73 bp, Homo sapiens
ctcggggtgccctgcggggagccggcagagctcggaggtgcggtagggtcggtcgggctgggcaggggtgggg

SEQ ID NO: 16749 - DNA, 73 bp, Homo sapiens
atgttttgacctctggcactgtcaatttcctgggaatggcaagaacaggaacaaggccaggcttggaggagca

SEQ ID NO: 16750 - DNA, 72 bp, Homo sapiens
ccccacccaaatctcatttcaaattgtaatccccaatgttggaggtcagacctggtgggaggtgtttggatc

SEQ ID NO: 16751 - DNA, 70 bp, Homo sapiens
caaaaattttgatgtgtgatggattctattggtctatccattgaagccttgctatatcaagatacctttt

SEQ ID NO: 16752 - DNA, 73 bp, Homo sapiens
ccccggtgtgaccgccgggggcggcccggggccgctcggcggcacctccacacccgccccaacgcgttctctg

SEQ ID NO: 16753 - DNA, 72 bp, Homo sapiens
ggcctgcgcccaggcggcggaggggcccagcccccttccagtcctcggctccagggcgcagggccacgagct

SEQ ID NO: 16754 - DNA, 72 bp, Homo sapiens
tggttgtagagtagttgcagacgtcacagcggtagggtttgtagccacagttgtagctctctccacgagcaa

SEQ ID NO: 16755 - DNA, 72 bp, Homo sapiens
tgggacaatgtaggcttgcaggagagacactgagagtggagagattggctgcagagaggctggtggaaccgc

SEQ ID NO: 16756 - DNA, 73 bp, Homo sapiens
tatacacatatacatgaatatacacatacatgtatgtatacatgaatatatatgtgaaaatgttttggcaact

SEQ ID NO: 16757 - DNA, 72 bp, Homo sapiens
ggagccccggggccgagggagctggcctgccagcggggcggaggaaagctagtgccagccctaccaggttcc

SEQ ID NO: 16758 - DNA, 70 bp, Homo sapiens
tgccagcaaattgggcctcttgcccatggcatggggactcactgtaggggctggcacatcctttggcaaa

SEQ ID NO: 16759 - DNA, 72 bp, Homo sapiens
tcaattaggactctgggatcagctgtggcagtggagattttcaggagattgcaattggccattgacaccaat

SEQ ID NO: 16760 - DNA, 73 bp, Homo sapiens
gcctcacatggtcatattgcctctgaaggtgactggcagtgcaatcaaaaccttcaagaacaggccaagttta

SEQ ID NO: 16761 - DNA, 72 bp, Homo sapiens
ctcagtctcccaaagtgctgggattacaggcatgagctactatgcccagctatccactccttgattgatgga

SEQ ID NO: 16762 - DNA, 70 bp, Homo sapiens
tctggagaaaatgaaactggacttggagtcaagacatccagtgcagtcctgatattctctaatacatgta

SEQ ID NO: 16763 - DNA, 74 bp, Homo sapiens
cagtatgactcgtacttttctaggaggtatatatttgctcctaattaaaggacacttgctgcatacatttcagg

SEQ ID NO: 16764 - DNA, 71 bp, Homo sapiens
ggagacaggtttcaggtctggccctgctccctacagccagctggcctctgctagatcgcttgcttcttttg

SEQ ID NO: 16765 - DNA, 73 bp, Homo sapiens
tgtttgtccagtgacttgctccttgcaattactaatattgctcagtaaagagggctaagtttttcactctttc

SEQ ID NO: 16766 - DNA, 72 bp, Homo sapiens
acagaggcccttgtttgagtgtttactaaataaaggtcatgaaaataatggtttctgttaagcagtggtatg

SEQ ID NO: 16767 - DNA, 73 bp, Homo sapiens
acatgtctctcctatctagacaatggatttgtggatttgcaaatctgcatgcccagtgagtccatttggagat

SEQ ID NO: 16768 - DNA, 72 bp, Homo sapiens
taaaattagaaagcttagaattacaatataaggccccttgcatctaggcttctgaattctaattacttctca

SEQ ID NO: 16769 - DNA, 72 bp, Homo sapiens
ctaaatattgcctaaattagatatggattagactcaaagtatgattcatcctgaggcaaatttctctccatc

SEQ ID NO: 16770 - DNA, 71 bp, Homo sapiens
catgattttattacttttgcgcatatagtatataatgtagctctgaggtagtgttttcattaactaacttt

SEQ ID NO: 16771 - DNA, 71 bp, Homo sapiens
atccaacttccaggggtaacagtggtggattcaaaggaagggtccagtactttgcatgtgtggagtccagc

SEQ ID NO: 16772 - DNA, 72 bp, Homo sapiens
cttttgggcagaaattacggggttttctaggtagaaaatcatattgtctgcaaacagaaatattttgacatc

SEQ ID NO: 16773 - DNA, 74 bp, Homo sapiens
acagctagctgcgaccttgtgacacagttgtggccaaataaatttaagtacaagtcactaggcaaggcttctag

SEQ ID NO: 16774 - DNA, 74 bp, Homo sapiens
aagcagtaactcatatctttggatctgaatagccaattcttgtttgtgatcctataggataggatttcctagct

SEQ ID NO: 16775 - DNA, 73 bp, Homo sapiens
atttgaagctcatttccagagcgaggtcatccattttgagagagtcacctgtcatctcttaggccattgctta

SEQ ID NO: 16776 - DNA, 74 bp, Homo sapiens
aaaattcggttcctcagtcacaccggctacattcaagttctcaatagctacatgtgactagtggttactatatt

SEQ ID NO: 16777 - DNA, 74 bp, Homo sapiens
tttttttcctatttctttctcattaggtttatgaaacaggagtgtcacaattggggagtagctatgggaattaa

SEQ ID NO: 16778 - DNA, 72 bp, Homo sapiens
tattctttcactcaactggacactaactcagtagatacctacttgtcagtagactgaaaagccagataatta

SEQ ID NO: 16779 - DNA, 74 bp, Homo sapiens
gttcataaatggagaaagctgaacatagcagtccttttattcattagaacataacagggctgggtgcagtggct

SEQ ID NO: 16780 - DNA, 74 bp, Homo sapiens
cctttgacttacttcttgagtcaccgttcaaagacttccctgccggcaggataggggagtgaacaggggcccag

SEQ ID NO: 16781 - DNA, 72 bp, Homo sapiens
gacagatcatgagaagagtgagtacagtgcaataaggtcttgagagagactacatgcatatacatatatata

SEQ ID NO: 16782 - DNA, 71 bp, Homo sapiens
aaccgcgccctttcctgtccatcttggagcctttgggagaatttcatgcaacggaactcatcacaaggctc

SEQ ID NO: 16783 - DNA, 74 bp, Homo sapiens
ggactgccttggttgaggcaagataagaagcccagagcccagactgatgagccattctcaaccactgcctccaa

SEQ ID NO: 16784 - DNA, 72 bp, Homo sapiens
catgcagctattagatggtcaagctgggatctgaagctagatagtctgactctggttctccactctctacac

SEQ ID NO: 16785 - DNA, 73 bp, Homo sapiens
cagccttggcgagcgcgcggcggggcgcggggtgaagtctcgccagggcgcgccgcggcggacaccgagccac

SEQ ID NO: 16786 - DNA, 74 bp, Homo sapiens
actccatcatgtgtggtgttctaagtgggcaatgcactacttagaagagtctacaaggcaaagacactggctgt

SEQ ID NO: 16787 - DNA, 74 bp, Homo sapiens
ttctgctggttcgcaggccacattttgaatagtaaggtcctgagtactgccttcattcacatggttgaagcagt

SEQ ID NO: 16788 - DNA, 70 bp, Homo sapiens
tgtgactgcaaggtgtccaagttcttggcattttgaacaaagaattggacaaaacgcccaccaaagcaaa

SEQ ID NO: 16789 - DNA, 74 bp, Homo sapiens
taaagagtgcatatgggctggtccgagtgcagtggtttatgactaattaatcacaaccagttccagatttcttt

SEQ ID NO: 16790 - DNA, 71 bp, Homo sapiens
ctcgttctttatatagaccagtgctgtccaacagaaatttctgtgatgctggcaatgttctatatttgcaa

SEQ ID NO: 16791 - DNA, 73 bp, Homo sapiens
actcagtatggatttgaatcatggaagctataaggctgatgtgtgggagttagtcacttagtgagtaagaaca

SEQ ID NO: 16792 - DNA, 72 bp, Homo sapiens
gtaagcactagatacttacagggattgtaatcagtaagggagataacatacatagtgtttggtgcaggcctg

SEQ ID NO: 16793 - DNA, 74 bp, Homo sapiens
cagtctggatggccacttgtcatgaataccagcaatgggagatacacagcaaatccatgcatttgatggccctc

SEQ ID NO: 16794 - DNA, 71 bp, Homo sapiens
tccttagcttgggagcaatgatgtctcacttggctgcagtccacaggcatctcacacagctaggaaacacc

SEQ ID NO: 16795 - DNA, 73 bp, Homo sapiens
gtggaacaagctttgagatgggaagtgaaaccccagactccatctagagcagcgctggctcattgaaacaaaa

SEQ ID NO: 16796 - DNA, 72 bp, Homo sapiens
caagcatcagatggaactaagagtggtaaatacagaagcttatcagactggatgatattaccttagatgcca

SEQ ID NO: 16797 - DNA, 72 bp, Homo sapiens
tttacatgtgtacattcaaagcttccacgtgaagctactctggttgtatacagcactaccatgtgagtcata

SEQ ID NO: 16798 - DNA, 72 bp, Homo sapiens
taggagacaaagcctgagccgctgcggtgagccaacccaaacccatccgcgggtcttctttccagagacatt

SEQ ID NO: 16799 - DNA, 73 bp, Homo sapiens
ggtactgcgggactgcgccgggagcaggccccacgggtgtagcaagggcagcttccgggaagggcggagccgc

SEQ ID NO: 16800 - DNA, 73 bp, Homo sapiens
taaaatcaggcattgatgacagggtaagagccagacccaatgggtttggaagctcaaggttctcaggtgtctg

SEQ ID NO: 16801 - DNA, 72 bp, Homo sapiens
tctttcagcttgtggagacctgccgaactctttctgagtgacttggttctcctctacttgcaaaggaggcaa

SEQ ID NO: 16802 - DNA, 71 bp, Homo sapiens
tcaggcagtaaagatacacgccatgtatagtttgttaacttattgcattagtggtgtcaaaagtgctagcc

SEQ ID NO: 16803 - DNA, 70 bp, Homo sapiens
aaccaggattttaataaaaatgtaaattattttaacattagtactgaagttcaggttaataagtatggca

SEQ ID NO: 16804 - DNA, 72 bp, Homo sapiens
ggacaaattaatgggatttccagtgttgtaactggaatcatgagtgtcacgttacaatggaaagcatacatg

SEQ ID NO: 16805 - DNA, 70 bp, Homo sapiens
ttagaaatgcagtctcatgctgagagctatcaacaacttggatctagcctgaggctcagcttttactacc

SEQ ID NO: 16806 - DNA, 73 bp, Homo sapiens
tgaggaggcaaggattgaggttgctgcagacccatatggattcactgctgctaacagttttacccatacctga

SEQ ID NO: 16807 - DNA, 72 bp, Homo sapiens
gaatctagcagcacgtcaaatagcttaagccatgagcaagttggcttcatccccaagaggcaaggctgtttc

SEQ ID NO: 16808 - DNA, 74 bp, Homo sapiens
gctgatacggctgttggactgttgtttgattttataacaataagtttacatgagacacccgtgcaacacatgcc

SEQ ID NO: 16809 - DNA, 72 bp, Homo sapiens
tacttaggtgatgggatgatctgtgcagcaaaccagcatggcactcatttacctatgtaacagacctgcaca

SEQ ID NO: 16810 - DNA, 72 bp, Homo sapiens
ccattttgacatacgacttttctttggctgcttgcacaaacttagtggcttaagaaaaaaaccacaaaatta

SEQ ID NO: 16811 - DNA, 72 bp, Homo sapiens
taaacaaaaatacatcaataaaaatatagatgggctatctacccactgttatgggttgaattgtgttcatcc

SEQ ID NO: 16812 - DNA, 74 bp, Homo sapiens
tctgtttccaagatggtgtcttgaatgctatgtccttcagaagagcagaacaatatacccttataatagtggaa

SEQ ID NO: 16813 - DNA, 71 bp, Homo sapiens
cctgagtaaaagtgacccggcctgcagcagttcacctcttgctgcttggtactcaaacaaacaaacaaaca

SEQ ID NO: 16814 - DNA, 71 bp, Homo sapiens
gtgccatattgaagtatgtaatagtacactctattgttttaataagactattgcttctggatggtgatgac

SEQ ID NO: 16815 - DNA, 72 bp, Homo sapiens
acaaaaagactaaaagagactggtggtgtttcaggttttcaaagacttgggtaccttgcatctttctgtcta

SEQ ID NO: 16816 - DNA, 72 bp, Homo sapiens
cagataatcacatttttgacctattggagtgagctagtgataggcaattatgtgatcagtttctggagatac

SEQ ID NO: 16817 - DNA, 72 bp, Homo sapiens
ttcacagtcactcagggtctaaggtagacactaccatcttggagctacaccacggggtatttgtggtcttca

SEQ ID NO: 16818 - DNA, 72 bp, Homo sapiens
caaagccacagggacggagctgctcaaggtcttgggagcccaacccttgcaccagtgtcccctggatgtggg

SEQ ID NO: 16819 - DNA, 71 bp, Homo sapiens
tccagctgggaagatgctagcctcgagataacccctcttaggacccgaaagatgtctgccccagataacct

SEQ ID NO: 16820 - DNA, 70 bp, Homo sapiens
aggtagcccctactgctgtgttgttcccctactggctagggctggactgcacagtcttagctaattccga

SEQ ID NO: 16821 - DNA, 72 bp, Homo sapiens
aacaaagctgatgcatctgacacaggaatggagccaaatttttccttctttgcaaagagtaccagtgccctg

SEQ ID NO: 16822 - DNA, 73 bp, Homo sapiens
ttccacttagcatgcccgaggacaaaggcagtagattagcaatgtctgggtggcatatggaccttgccaagtg

SEQ ID NO: 16823 - DNA, 72 bp, Homo sapiens
gttccatattaaccccagttagctgccaagcctgaaacaataactcagtcaggtgcttgagtgggcaaagta

SEQ ID NO: 16824 - DNA, 72 bp, Homo sapiens
ccatctaggattttcattgctgaagagaaaaagtccatgcctgctttaaaaggatagactgactcttttgtt

SEQ ID NO: 16825 - DNA, 72 bp, Homo sapiens
tccctgaaagtctctggatccttgtgagattcctccttattttagacatctaaaagctccaagacattccct

SEQ ID NO: 16826 - DNA, 74 bp, Homo sapiens
tactatatttgtataattatactatatgtgtataatgtatgaaattatactacatatgtatagtatatgtaata

SEQ ID NO: 16827 - DNA, 70 bp, Homo sapiens
gtgttcactcagtgatcctgggggttgctagaagctccattttggatcccactcctgacatcatctgata

SEQ ID NO: 16828 - DNA, 72 bp, Homo sapiens
tgtcggtatatatgcatataagtatgtgatatatatgtatatacagacgtatgcatatatctatatgatggc

SEQ ID NO: 16829 - DNA, 72 bp, Homo sapiens
gggtgcagcatatcatcatggcccgtgtatacgtatgtaacaaacctgcatgttgtgcacatgtaccctaga

SEQ ID NO: 16830 - DNA, 72 bp, Homo sapiens
ccccatctttgtggttttatctacctttggtctttgatgatggtgacctatggatggggttttggtgtggat

SEQ ID NO: 16831 - DNA, 73 bp, Homo sapiens
ctattcatctttctggtcttctttctccaggaatccctctcttgtctggtgtcccaaagctgacttagatgct

SEQ ID NO: 16832 - DNA, 70 bp, Homo sapiens
agaggatcgcttgaggccaggagttcaaggccagtctgggcaacatcatatcaagactccgtctctacaa

SEQ ID NO: 16833 - DNA, 70 bp, Homo sapiens
gcaaagactgagacagctccgctgcccgctgaactccatcctcccggcggtcgggcggcggcagctgcgg

SEQ ID NO: 16834 - DNA, 70 bp, Homo sapiens
gcataaaaatgactgcttgttcctaatttatagataggacttctaaggcagtttatgccctattttgaag

SEQ ID NO: 16835 - DNA, 70 bp, Homo sapiens
gattccggaggcttgatgatctaacaaggaaaattccttttttctgtcagtttaattttaccttgagtct

SEQ ID NO: 16836 - DNA, 70 bp, Homo sapiens
cttgctgggactctgggattgcattggatctatttgggggacttgagataaatttgggggacttggtatc

SEQ ID NO: 16837 - DNA, 72 bp, Homo sapiens
tgatgcagctgaagccctgatctccagtcaagttgttcttggctgggagcatgctgagaatcaccgaggtct

SEQ ID NO: 16838 - DNA, 74 bp, Homo sapiens
acagtgtgagtactgtctcctgttttcacctgtatctataggttatttagtctcaaagccaggagtcaacttgt

SEQ ID NO: 16839 - DNA, 74 bp, Homo sapiens
tcaatctgatgatgtcatttttctgtcttccgaagtcttctgaaatcatcagtttgactttatgtttgcttcta

SEQ ID NO: 16840 - DNA, 70 bp, Homo sapiens
gaggctgagaggtcacttgttggttttctgactgttccccagtacagaacacacaagtacgggattctct

SEQ ID NO: 16841 - DNA, 71 bp, Homo sapiens
tttgggatgatgctgtacagggatggggggccatcttcaaggatgtggcatttatcccaaattaatgtctt

SEQ ID NO: 16842 - DNA, 74 bp, Homo sapiens
tcatcctgttccttctattaacttacgtgtcttcgtaatactgcctggaaatgtagaagacagggcaggggtgg

SEQ ID NO: 16843 - DNA, 74 bp, Homo sapiens
ctttaaaatgatgtatacgttgggcatttattttagatatatgaaaactatgttcatgctaaacctgtacatga

SEQ ID NO: 16844 - DNA, 74 bp, Homo sapiens
gtcactgattctccacagaaaaattgttccacatagaaaaaaactatactggacttggagtcagaagacttgag

SEQ ID NO: 16845 - DNA, 72 bp, Homo sapiens
tgtgattggcttccttgacttgacctgatgatgtgaccagtgcaggcacagggaggtgagctagctgaccca

SEQ ID NO: 16846 - DNA, 72 bp, Homo sapiens
ggcaggaatcagggatcagcgagtcaggtagaggctaaatggcacacaccgatttctggaacagcgagtgcc

SEQ ID NO: 16847 - DNA, 72 bp, Homo sapiens
agaaaattctgaaagccaaagtccacaaagtaggttgccatcacccagcgaacaggacgttgggctgggctt

SEQ ID NO: 16848 - DNA, 74 bp, Homo sapiens
gaagtatgactggtctgagtgcagtggtgtttacaactgattgatcacaaccagttacagatttctttattcct

SEQ ID NO: 16849 - DNA, 71 bp, Homo sapiens
tctgatagcttgtaatgcagatgagaagtctgatgccatcttagtacttcttcatgggtgacttgtttttc

SEQ ID NO: 16850 - DNA, 74 bp, Homo sapiens
atttttcctctcagagcttctgttcccttatttatgaaatgtaagtcatcattatgtaagttagggtgcatttg

SEQ ID NO: 16851 - DNA, 73 bp, Homo sapiens
aactgccctttccatggacgagaagaccaaatgaatggagactttcaggtccttgtcccacacagctagtagt

SEQ ID NO: 16852 - DNA, 73 bp, Homo sapiens
accagtagcagtttacgtttattgttatgatcaacaattatattgtgcatgctcagtaaatatgctgctctgc

SEQ ID NO: 16853 - DNA, 74 bp, Homo sapiens
ccttattccacctgtctggaagttggacattgtacagaacgaatgtctgcctaatgatgaaggaaacaaaggac

SEQ ID NO: 16854 - DNA, 72 bp, Homo sapiens
cggtggctacaaggagctagctacatacatagttgctcatgatataacatggtcttcagtcgctaacacttt

SEQ ID NO: 16855 - DNA, 70 bp, Homo sapiens
agtcatcattccctgaacctcgcttccctacctccaaatctggggtaggtctcccctgtgagctgtcata

SEQ ID NO: 16856 - DNA, 71 bp, Homo sapiens
ctcatttacagttaaggaagcctaagggtgtgccacaggtcaaaagggtttccaaattgcatggtctcaaa

SEQ ID NO: 16857 - DNA, 73 bp, Homo sapiens
gcgacagagcgagactccatctcaaaaaaataaaataaaataaaatcgtggaggtggtgcgcacctgtagtcc

SEQ ID NO: 16858 - DNA, 73 bp, Homo sapiens
aatgtttattatgattgaggtatgctgggtgcagtggctcatgcctgtaatcccagcactttgggaggcctag

SEQ ID NO: 16859 - DNA, 71 bp, Homo sapiens
tctgagggaagaggacaggcttggaaaccatgccagtgacatttgcggtggatctgagctagatgccgtca

SEQ ID NO: 16860 - DNA, 73 bp, Homo sapiens
cctccatcacatcattgaaagaatctatagagttctcagcacagaatgtcccaacaaatgatgcaatggaagg

SEQ ID NO: 16861 - DNA, 73 bp, Homo sapiens
ggttccccgcgttctgcctggtcaccttgtctccgttaaacgggaagcagaaaagagaaaggtgaattgaggg

SEQ ID NO: 16862 - DNA, 73 bp, Homo sapiens
cactgaaagcacgttgtgaccaagccaaaggcatcaccaaaaccttagcttgtcatcacagcaggtataaagt

SEQ ID NO: 16863 - DNA, 74 bp, Homo sapiens
actaatccagattgctcataggataaagaattaagttcacagtggctttcaaggctgctgttcattgtctgcag

SEQ ID NO: 16864 - DNA, 72 bp, Homo sapiens
gggttggacatccccatcaaatcagtgacctttaataagtcattaaacttatagggaggcccagtttcctca

SEQ ID NO: 16865 - DNA, 74 bp, Homo sapiens
tttgcttttatttctaaattatttatctggtcacttaatgactcagcaccaatggaatagatactttatgcaaa

SEQ ID NO: 16866 - DNA, 73 bp, Homo sapiens
tctatatttcaagtcatagaaatagtctgtgatgcagaaatatccaccctacttctagacttcagaactggac

SEQ ID NO: 16867 - DNA, 70 bp, Homo sapiens
aatttaggcagaaccgacatgtgatgatgattttagtgatgacagtctaaatagtctgactgcctttaag

SEQ ID NO: 16868 - DNA, 72 bp, Homo sapiens
tctagacagtactaaagaacaaaaccaatcatgattctagtatcagactgattatgattggtatcaaacagt

SEQ ID NO: 16869 - DNA, 71 bp, Homo sapiens
taggtgtggagttttcccagaggaggggatgtcattttctctctgggaatgggttctggacccattaagta

SEQ ID NO: 16870 - DNA, 73 bp, Homo sapiens
gagttgccgaagaccgggagagtgtgttttcatatggaaggtcacatctatgcatcagaggctatttatcttt

SEQ ID NO: 16871 - DNA, 70 bp, Homo sapiens
tgttgcccctccctcccaccctgccatataagcatcctttctattgtgggcaggtagtgctaccccagga

SEQ ID NO: 16872 - DNA, 73 bp, Homo sapiens
tggaaggaagtagacttcaagtgtaagctgagaggaagaaaccatggaagattacagactccaaagagtcaaa

SEQ ID NO: 16873 - DNA, 70 bp, Homo sapiens
atcaagtcgtgctgaataataccactgtcaaaacaagagaaattggtaattcacaaatgagcacttgata

SEQ ID NO: 16874 - DNA, 71 bp, Homo sapiens
ctacctcaggtgaactttgtctagtgcttccatcggaaggactaggtgtctgatcctgaatctggggcatg

SEQ ID NO: 16875 - DNA, 71 bp, Homo sapiens
agagatggggtcatggcttgttggggggcagtttctggaccaggagtagctgtgggctccaacactgtctc

SEQ ID NO: 16876 - DNA, 72 bp, Homo sapiens
agtttttcagtctttaccatagcaggatggtatatagtacctaactgatttattgaggtgtgattaacatac

SEQ ID NO: 16877 - DNA, 70 bp, Homo sapiens
cagagggagaattactcaagagacaactgaatagagaggtactttgcttctagtttatgttccccttata

SEQ ID NO: 16878 - DNA, 73 bp, Homo sapiens
ttttggattgattgaactttcctttaatctcttggattcctcctactggtttggaattttttctgttaatcga

SEQ ID NO: 16879 - DNA, 74 bp, Homo sapiens
caagcacctgtagtaccagctactgggaaggctgaggtgggacgattgcttgagtctggtatgttgaggctgca

SEQ ID NO: 16880 - DNA, 74 bp, Homo sapiens
cactagaattaagctctgatgacaaggatctttctgtgctgttcatagcttatcttctagtacctggcttagtt

SEQ ID NO: 16881 - DNA, 72 bp, Homo sapiens
atatctactgatttttctttatttttgagacagagtctcgctctatcacccaggctggagtgcagtggcgtg

SEQ ID NO: 16882 - DNA, 72 bp, Homo sapiens
gatcgacttgtacgagtgcatggtgaccctgcagtgtggtgggtgtctcagtttgtcaaatacttgatccgc

SEQ ID NO: 16883 - DNA, 72 bp, Homo sapiens
aacccagagatagttgacagtctcaaagccaggtgacatgggctggggagtcttacaaggtgagctgctcac

SEQ ID NO: 16884 - DNA, 72 bp, Homo sapiens
tgggggtagaagaacaaaggttatggtcaagtaacatagtgcttatgaaataacttgtggaaactcatcctg

SEQ ID NO: 16885 - DNA, 70 bp, Homo sapiens
caggaatttatgcatttcttctaggttttctagttagtgtacatagaggcgtttgtagtagttctctgag

SEQ ID NO: 16886 - DNA, 72 bp, Homo sapiens
atattgcacttcagtattaacatgcactgccacagttgccacagtaggggaagggaaaggtggatgggggag

SEQ ID NO: 16887 - DNA, 74 bp, Homo sapiens
taagactttgagtggtggggttagaaaccgatatttttaataagccccctaaatgatccttaaatttgaggtcc

SEQ ID NO: 16888 - DNA, 72 bp, Homo sapiens
aaagaatagcacgatgacctttcctatttccatcatccagatagaatggctactgaggtcttgccacacttt

SEQ ID NO: 16889 - DNA, 70 bp, Homo sapiens
tactctgattagcttgagcaacttcagaagttggcctgtggcctcccgagcccctcttccagctagtttg

SEQ ID NO: 16890 - DNA, 72 bp, Homo sapiens
tatcaggtgggtggggtccccagtgatgcttgaccatagcaaagccctttcaaaggtttcttagcacaccac

SEQ ID NO: 16891 - DNA, 71 bp, Homo sapiens
atctgggccttgtaatgacagccccctgccactctacagggagttgccctgctcagctgcccagaaccttt

SEQ ID NO: 16892 - DNA, 72 bp, Homo sapiens
cattctccccctgcaagaacaaaggcaaaatgaacagtgaggaaaacctggaaacaggaccgagtgtttgct

SEQ ID NO: 16893 - DNA, 72 bp, Homo sapiens
taggactgaggaaaaggtgagcctggggtactgattaatctgcgctagtggttatcacacccaaggcagctc

SEQ ID NO: 16894 - DNA, 71 bp, Homo sapiens
acccacccggccgcgcgctgcccgccgccgcgtggtccctgtaccaggccggctgctccctgcgtctcctc

SEQ ID NO: 16895 - DNA, 71 bp, Homo sapiens
catgccgcccacccccgcggggctgagcactgagcgcgccgccagcaagtgcccgggggccaggccgtcga

SEQ ID NO: 16896 - DNA, 72 bp, Homo sapiens
taggttgggggtgggaagggttttgaggacagggtgaatgtctaggactttccacctccataaagatgtttc

SEQ ID NO: 16897 - DNA, 72 bp, Homo sapiens
atgctaggcacaggggttcacagatgaacagatgggattctgccttcgaggagctcacagtagaataaggag

SEQ ID NO: 16898 - DNA, 73 bp, Homo sapiens
aggcagtaatgaggctcccagccccgggaactttttggggagctgcgattggatggtttagttataactgtgt

SEQ ID NO: 16899 - DNA, 71 bp, Homo sapiens
ggttagtgaatggcctatctggacagccatttaactgtccaccatgagtcaccactgggggttttgggcac

SEQ ID NO: 16900 - DNA, 73 bp, Homo sapiens
gcccactggaggatgaagctgcatgtcttgctgacacagagctctgcatggccaactttcaggaaaaatatcc

SEQ ID NO: 16901 - DNA, 74 bp, Homo sapiens
acacacattagccagcaggcacctgtaatcccagctactcggaaggctgaaggaggagaatcgcttgaacctgg

SEQ ID NO: 16902 - DNA, 73 bp, Homo sapiens
tgccaggcactgtgcgtagcaccagagtcacgatgttgaacatcgcattggccagacataaatgcacatggca

SEQ ID NO: 16903 - DNA, 70 bp, Homo sapiens
tgggtaattcagtgtaagctgtaaactggcctaggctgtgggtctattttaatgctcttcaacccagaaa

SEQ ID NO: 16904 - DNA, 73 bp, Homo sapiens
ggctgaggaaggaggatcgcttgagcccagaagttcaacgttagtctgggcaacatagcaagaccaggtcttt

SEQ ID NO: 16905 - DNA, 71 bp, Homo sapiens
gccctgcacaccctgaggatttgggcccagccacagtgtatttcagctccctcagatcagaagtgggtccc

SEQ ID NO: 16906 - DNA, 72 bp, Homo sapiens
ggggtcctccaccaccttgatggtcacctgcaggagacaggccaggccggccagtgaaggaggtcttagagc

SEQ ID NO: 16907 - DNA, 70 bp, Homo sapiens
agatgaggtgtcagaatagttagggcaggtgggaagagtagtggccagatcatgtatggccctttaacct

SEQ ID NO: 16908 - DNA, 74 bp, Homo sapiens
gggaggccaaggcaggtggatcacgaggtcaggagtttgagaccagcctagacaataaggtgacaccccgcctc

SEQ ID NO: 16909 - DNA, 73 bp, Homo sapiens
gaggaagcagcaatgtgcaggaagcactgtctccagcaggccctgctaaaatacaagtgtgtttttctgagag

SEQ ID NO: 16910 - DNA, 72 bp, Homo sapiens
tgagtgtctatgaagcacttgctagtccttgaaggggaatgcaaagcaaggatgggacatatcttttgtctt

SEQ ID NO: 16911 - DNA, 73 bp, Homo sapiens
catggaaagaggagaagtgtgatatctttcaaggacacaattttcctccagaaaatccaggaatcctcatttt

SEQ ID NO: 16912 - DNA, 70 bp, Homo sapiens
agattgactttgtaatgtacattaggagaatatctcctatgaagagcatcccaccaagtcaggtggaggc

SEQ ID NO: 16913 - DNA, 72 bp, Homo sapiens
aaaattcgatttgtaatatttgacaacactggttagtcagccctaacctcactgatatattatgaagatgaa

SEQ ID NO: 16914 - DNA, 72 bp, Homo sapiens
tacgggtggtgctgaggctggtccccaacattggtctaatggctgagtatattgtgtgagcaccatttattc

SEQ ID NO: 16915 - DNA, 71 bp, Homo sapiens
aaagatgccgcagtggtcagtttgtcaaatacctggcactactaagatgcaagatggggtctcgcaacggg

SEQ ID NO: 16916 - DNA, 70 bp, Homo sapiens
tttcctctagctccattccctgctgtaaataatttccattgagagcaaggattgggtctaagatctattt

SEQ ID NO: 16917 - DNA, 73 bp, Homo sapiens
tcaacagcagcaccacgtgcttgagcagaatgaccgagtcatagagagccaggaagaggcagttggagaaaaa

SEQ ID NO: 16918 - DNA, 72 bp, Homo sapiens
taatggtttttcctttccatatttagtgcttccttcaggagctcttgcaaggcaggccagtggtgacaaatt

SEQ ID NO: 16919 - DNA, 70 bp, Homo sapiens
aaccccaatagtggggagaagattgtggtgtaactgaaatttgggattacccattctcttctttccagat

SEQ ID NO: 16920 - DNA, 70 bp, Homo sapiens
ctcggggtctctggtcaactccacgagtgatagtgggtgaagagtgctccgaggtgaaaaaatgggaaca

SEQ ID NO: 16921 - DNA, 70 bp, Homo sapiens
agccctttgatgagttcctggaagtctctttctctcttatctgaggggggtcacaggaggcaagagagct

SEQ ID NO: 16922 - DNA, 73 bp, Homo sapiens
acgaagctatgtcattcccatggtttatactgaataccctaggtatatcatgaggtctttagttttgctggtt

SEQ ID NO: 16923 - DNA, 76 bp, Homo sapiens
aaattacagctgttttcctatagatggatttttccatgaagctaatgaagcttaaattttgggaatcttcatttac

SEQ ID NO: 16924 - DNA, 74 bp, Homo sapiens
tgtattggtgtcactgcatgtaagatgggtcttttgatgactgcatatcattgggtctttcgttttgttcagat

SEQ ID NO: 16925 - DNA, 73 bp, Homo sapiens
ccttacttgacacttggtgtaatagccaaatttgccttagactgtgtgcaccatgagctgcaagcaggccagc

SEQ ID NO: 16926 - DNA, 73 bp, Homo sapiens
ctaatgtaatggtgctaggaagcaggacctttgggaagtatttaggtcatgaagtcagagctctcatagatga

SEQ ID NO: 16927 - DNA, 73 bp, Homo sapiens
ttaaataaaagtgtgctgtttactccagagagtaaatagattgataatgatgttgtatgaaaagcacatgata

SEQ ID NO: 16928 - DNA, 74 bp, Homo sapiens
tgtggaacctggcattgtgcaaatctgcattgctcagtcctcctggaagtgtattttatataactgcctgtaga

SEQ ID NO: 16929 - DNA, 71 bp, Homo sapiens
cttgggagtctgaggcaggagaatcgccacctgggaggtggagggtgcagtgagccaaaatcacaccactg

SEQ ID NO: 16930 - DNA, 72 bp, Homo sapiens
aaagcaggattttcagttaatgggtgtatttggcataatgttgacatctacattgtagtagaaactgtcttt

SEQ ID NO: 16931 - DNA, 73 bp, Homo sapiens
caaatagaagaggtatgctctggacgacttatgggaccaaacattcccacactgacctaactggagtgccaca

SEQ ID NO: 16932 - DNA, 72 bp, Homo sapiens
attaagctgaatagaatattattatttgttgccttacatataggtatgatttcaagtgattgtctttgctta

SEQ ID NO: 16933 - DNA, 72 bp, Homo sapiens
ccctgagcaccgagaaaaatgagtggcaggcagccaacaagaactgctaactcaacatcttttgagagtgga

SEQ ID NO: 16934 - DNA, 70 bp, Homo sapiens
tcaatcaaagccactgactctcagatcctgcagcatcgttaggtgctgacctagtccggttgtgttccca

SEQ ID NO: 16935 - DNA, 72 bp, Homo sapiens
ggtactccaccagctggcacattgccgaaagctgaacaggcctcatgccatatgtacatggaaaatagacct

SEQ ID NO: 16936 - DNA, 70 bp, Homo sapiens
aaccccagaggatacttaactgtctataccaaacaaaaggtggaagggttgtctgtttcacccctggacc

SEQ ID NO: 16937 - DNA, 74 bp, Homo sapiens
gcttcttgggtcatggaccaccatcttctcattataacctcataaggcggaaggggccagggttcactctggga

SEQ ID NO: 16938 - DNA, 72 bp, Homo sapiens
agaaaaccaaataattgactggtcagaaatgccaaccccgttaaggcagtgttctgaataactactaattgt

SEQ ID NO: 16939 - DNA, 73 bp, Homo sapiens
cacagtagacccccagcagaccaccagatcaccaattatactgactgtggtctcagaagcttctgccaggggg

SEQ ID NO: 16940 - DNA, 74 bp, Homo sapiens
gaaagaccaagataagggtgcgggggtagccaggcccatggccactcaaatactatgttgaggaacttggactt

SEQ ID NO: 16941 - DNA, 71 bp, Homo sapiens
aattgtggctcaggcctgtaatctcagcacttgggaaggccgaagtgagaggattgctagagcctgggagt

SEQ ID NO: 16942 - DNA, 73 bp, Homo sapiens
tccttctgctgttttcattaaaatctcaagaattgttcacattgccaggagcagttctttgaaaacagtctga

SEQ ID NO: 16943 - DNA, 73 bp, Homo sapiens
ggaaatgctgcaagtctgcatgggagcttggtgaaagtgcaaatccatgcaaagggagttggctgatttttaa

SEQ ID NO: 16944 - DNA, 74 bp, Homo sapiens
ttctgtagataacacatagttgggtcttttatgtttgtttgtttttgagacagggtctcactctgttatccagg

SEQ ID NO: 16945 - DNA, 74 bp, Homo sapiens
tgccattctaccagcttcccttcactcagtgcctcccatgtatctatctgtcgcactgtcctgaaaagaagagg

SEQ ID NO: 16946 - DNA, 72 bp, Homo sapiens
tagatttcatgagggtgccgtgactctactgctggcagctgtaggatcacagggcctccctaatggtagtgg

SEQ ID NO: 16947 - DNA, 73 bp, Homo sapiens
ataattagagattgattccactgttagcctggcaagtggtccagcttttagcgtgaagacaggatcggttctc

SEQ ID NO: 16948 - DNA, 72 bp, Homo sapiens
gtttttctttctaattttatttccatttagttcaatgacactgttagtctggagtgcttgtctttgggggta

SEQ ID NO: 16949 - DNA, 73 bp, Homo sapiens
cccagagcagggtctggagtggcaggaccggcagccaatgaaggtgaaggccgagcattacatcatcaccgtg

SEQ ID NO: 16950 - DNA, 72 bp, Homo sapiens
tcctcagctgctcatgccccaggtagctccaggtgagtccccacagtggaggggcttccctggggctgagct

SEQ ID NO: 16951 - DNA, 72 bp, Homo sapiens
tatgtccctgtgtaggcatgtccaggcgcaggcgtgtccaggtgcaggcatgtctaggctcaggtgtctgtt

SEQ ID NO: 16952 - DNA, 70 bp, Homo sapiens
catgcagatggggtagcagccagccagagctatccctgtggtgatcagtggtccaaggctagcccctccc

SEQ ID NO: 16953 - DNA, 73 bp, Homo sapiens
ctacctgcctcatagggcttgtctggctgttttatagcagcaaacattgaagcaggtacttttaccccatgaa

SEQ ID NO: 16954 - DNA, 71 bp, Homo sapiens
gccttggttgagggtccaagtttggtatacctaaacttgctcaactgcataaccgacaacattagacagaa

SEQ ID NO: 16955 - DNA, 73 bp, Homo sapiens
gtttccataggttttcgaatgcttgaaataccactactgactgtgtttgttggaaaccctaatttgttggaag

SEQ ID NO: 16956 - DNA, 73 bp, Homo sapiens
tctccctgcaactcggctttaaataacaagattattatttttgacatgttattcaagctgggatttttttccc

SEQ ID NO: 16957 - DNA, 73 bp, Homo sapiens
agacccaggagctagcttcctctctttctgccttgtgaggatacagtaagaagttagcaatctgcaacctgga

SEQ ID NO: 16958 - DNA, 74 bp, Homo sapiens
gtttttagagcaaactcaacgcaaagtctggactggggttctagggccccagaggccctctctgctccgcatgc

SEQ ID NO: 16959 - DNA, 70 bp, Homo sapiens
atgtcagcaggatgctcaagcagcccatggagacacccataaagtaggggactgaagcctcctaccgaca

SEQ ID NO: 16960 - DNA, 72 bp, Homo sapiens
ggcttcccttatttctggggcccctgatgctccagctctttgggctccagctctgggggccgtgttggaagc

SEQ ID NO: 16961 - DNA, 72 bp, Homo sapiens
gtcacagagcctgtttctgtaggtgaccaggtgcactgcagtggcctggcgtttgacactggaatggctgat

SEQ ID NO: 16962 - DNA, 74 bp, Homo sapiens
caccacaactaaagtagaaagacagcaacgtgggcggcgctaggcaggccttaccactgtctgcttgcccccac

SEQ ID NO: 16963 - DNA, 73 bp, Homo sapiens
aaggctggagtgaacatccttatacagtaatacaactgaatattgtattaaaggatggtgtggtaaaaagtcc

SEQ ID NO: 16964 - DNA, 74 bp, Homo sapiens
ggctggtcattcttgagggagagtatggatttgttggaataggagggacatccagaggtggctgagccatttgg

SEQ ID NO: 16965 - DNA, 71 bp, Homo sapiens
gggacagcgtgaaagggcctgtggaatccaagagggcgctctccctccctgagaccctgacctccaaaatt

SEQ ID NO: 16966 - DNA, 70 bp, Homo sapiens
tgaatgtggaaagtgccctgttgcaatgatgagcatccattctgcacaggacatgcccactacctgcggc

SEQ ID NO: 16967 - DNA, 71 bp, Homo sapiens
cagtgagcaagcctgtggctcagttcagaaggacttctccaggagcctcacaggcagtaccgaggctgctg

SEQ ID NO: 16968 - DNA, 74 bp, Homo sapiens
atttcccctcctattccggtcactggtgacactgggggatgggaggccattccttggcaacacttctgagactg

SEQ ID NO: 16969 - DNA, 72 bp, Homo sapiens
gccctggcctggctctctctgggtgacccgcacttggcggccgctcctggtagccccttgctcttccataag

SEQ ID NO: 16970 - DNA, 72 bp, Homo sapiens
tggccaggctcatggagatgctcacaggggagaagaagatgctctggctgggggcagcggaagccaaggccc

SEQ ID NO: 16971 - DNA, 72 bp, Homo sapiens
tcccctgccctgcaggccacaccaacttaacctctctgaggatcatgggggcaagtgcatttagcaacctgc

SEQ ID NO: 16972 - DNA, 74 bp, Homo sapiens
ccaaagtgctgggattataggcttgagccagcaccctggcctcagcatcttcaatgtatttatcacaagcatgg

SEQ ID NO: 16973 - DNA, 74 bp, Homo sapiens
tcactcgatcactcaggctgagtgcagtggtgcaatgatggctcactgcagcctcaacctcacaagtagctggg

SEQ ID NO: 16974 - DNA, 74 bp, Homo sapiens
ccttaccatgatgccctgggtccgccccgcccactcttctttcttgggtggtggtgctttgtgactctgtcaca

SEQ ID NO: 16975 - DNA, 71 bp, Homo sapiens
tgcttgagacctttttttccaaatggagaacagtacgttccatttactgagcaggtattaggtgctagtca

SEQ ID NO: 16976 - DNA, 74 bp, Homo sapiens
cacccttggggagggctagaaaaccaggcttggaagctacacatccaggactgacaccccaaactatcctgaag

SEQ ID NO: 16977 - DNA, 74 bp, Homo sapiens
tgggctgagctgggattagacatgatgaatgtataagatcagaaagatgctatgaccttctccagcggcactca

SEQ ID NO: 16978 - DNA, 73 bp, Homo sapiens
gataaggtgctgtcactttccatccactgctgtgttcaagtatcaaagcacttggttgaaaatgccaggcagt

SEQ ID NO: 16979 - DNA, 73 bp, Homo sapiens
atgttagtaatggatttgagatggtgagtttatgggtgctcactgtaaaattccttcaaatttgctgtatgtt

SEQ ID NO: 16980 - DNA, 72 bp, Homo sapiens
tttttcctgtggggcctggagagagtgatgtccacaggccagaccttaacattcctttctgctgaccccaag

SEQ ID NO: 16981 - DNA, 70 bp, Homo sapiens
gatacggagtaatgctcttgttgcccaggctggagtgcaatggtgcgatcttggctcactgcaacctccg

SEQ ID NO: 16982 - DNA, 72 bp, Homo sapiens
tgaatctgcagtgggcagatgcagaggccgttgctcccgtggacggtgtgctgccccccaccagaaccttcc

SEQ ID NO: 16983 - DNA, 72 bp, Homo sapiens
ctggcatgaaatcttacggatctgcattttctgcagggctgtaacaacaggtttcaacttgatttgccatcc

SEQ ID NO: 16984 - DNA, 74 bp, Homo sapiens
ctttggtagtcattcagttatgttttgaaaagacagtttttacactgtttgtgggactgtaaactagttcaacc

SEQ ID NO: 16985 - DNA, 70 bp, Homo sapiens
ctgtgtgtccagagggattacttggcacaaggctggcagggaaccccactgtggactcatcaagatctct

SEQ ID NO: 16986 - DNA, 72 bp, Homo sapiens
tcaagggttgagaacacagcaggtcatcgtcagagccaagagaaggccaggcctctgtgggccaggccagga

SEQ ID NO: 16987 - DNA, 70 bp, Homo sapiens
agagggtggtgttggatgtatctgcctgtccattcccatttttggccatggtccatattgcccagggtga

SEQ ID NO: 16988 - DNA, 73 bp, Homo sapiens
taaatgtgactgtttagaccatacccaccgctgtgcttgagcacatcatctcgcattcctaagtcacaccctt

SEQ ID NO: 16989 - DNA, 72 bp, Homo sapiens
ctggccatggagcccttgaatgccagggtcagggatggctcagttcagccgggccccaaaagagtggaccag

SEQ ID NO: 16990 - DNA, 70 bp, Homo sapiens
catcatggagcaggggagcaaggggaagctaccgaggggtgacgcttgagccagcctggacgagcctgcc

SEQ ID NO: 16991 - DNA, 72 bp, Homo sapiens
agaggagacacaggctgcagctcttgctggggacatggtaaggctctgggatggggtgcagctgtttctgga

SEQ ID NO: 16992 - DNA, 73 bp, Homo sapiens
cgagccgcccctccgccccgctccccccgggcccgcggcgccaggggagcgctggggagcgctcgcggggact

SEQ ID NO: 16993 - DNA, 74 bp, Homo sapiens
tccaacgtgggctttgtaaacatttgttggatggctgaataaacagaatgaatgaatgaatgaagaagagccag

SEQ ID NO: 16994 - DNA, 73 bp, Homo sapiens
cctcccctgcccctgcagtttgtttgggtaactcaacagcctgctgatttatgggacattccgcagggtttta

SEQ ID NO: 16995 - DNA, 74 bp, Homo sapiens
ctccaagatgtaccgtgcgctccagactgtgtttggtgagaggtaaggaggtatggtggaaggcctgggtggga

SEQ ID NO: 16996 - DNA, 72 bp, Homo sapiens
acctggcccagcctcagtttccctcaggatagccataagagggaagcagcgaagccggcacagtgggcagga

SEQ ID NO: 16997 - DNA, 71 bp, Homo sapiens
gagggtctcacggagccgctgtctgagctggggtggtgacgtctgtggcaggaaggattgtggggttgatg

SEQ ID NO: 16998 - DNA, 74 bp, Homo sapiens
gtgagggcgatgggggaacatggagtgactgctagtaggtactagggtttcttctggagtaatgcaaaggttct

SEQ ID NO: 16999 - DNA, 72 bp, Homo sapiens
ccagaaaacatccaaggtggcaaatctatggagacatgatgtagactagcagttgccagggactgggaggag

SEQ ID NO: 17000 - DNA, 70 bp, Homo sapiens
agtttcagagaagtgaagcgcttatggagggtcccacaagcagtgggagccgggacgcagggctgactac

SEQ ID NO: 17001 - DNA, 72 bp, Homo sapiens
taggcaggcaagatgctggcctgagggttcaaggggagccccagggactggtgtgaagtctggcctctccct

SEQ ID NO: 17002 - DNA, 72 bp, Homo sapiens
ggccggtccctttaccagttcctgggccgccaccatgtggctgcagcataaacagttcagtccctgggcccc

SEQ ID NO: 17003 - DNA, 74 bp, Homo sapiens
ggcgagccaaggggcggaggcctggccaggcagaggctccgaggccagccaggcctcctaaccctccaccctgg

SEQ ID NO: 17004 - DNA, 72 bp, Homo sapiens
aaggagaagcggctgtgcagacagggtggcaggtctggggctaaggcagggttctgctctccctgtgacaca

SEQ ID NO: 17005 - DNA, 72 bp, Homo sapiens
ggggttgggcagcaacgtcagcacagaaggcttcggactagactctgaggtttgcttggtgcctggaagctg

SEQ ID NO: 17006 - DNA, 78 bp, Homo sapiens
tacttaatgagaagttgcccgtgtttttttcgctttatttgtgacgaaacattcgcggtgcacttctttttcagtatc

SEQ ID NO: 17007 - DNA, 71 bp, Homo sapiens
gagagctgacctatgggcacacagctggcaggtggtgtttgccacctggtctgctgatcccgcatctccca

SEQ ID NO: 17008 - DNA, 74 bp, Homo sapiens
cccaatgggctccatgtttgatgggtgcactgatggctgcacaagacatggttcccctctccagggctttctct

SEQ ID NO: 17009 - DNA, 70 bp, Homo sapiens
ggtctgtgtgtgcgcgcgcgggagcaagagagggcccccttgcctctcccgccgctttccaggatcccgc

SEQ ID NO: 17010 - DNA, 70 bp, Homo sapiens
tcgcccccagcccgtggacggcgccagctcggaggagtcagggagcaggacgcggggccagggtctgcat

SEQ ID NO: 17011 - DNA, 72 bp, Homo sapiens
cacctccatcagagctgttggttgactacaggcactgtcatgaacagtaatattttgagagaaatttgagca

SEQ ID NO: 17012 - DNA, 70 bp, Homo sapiens
agccggcggggggtgccgtcctcctcgccctccctggagcccggccctgggcccacgccgtgccccgagc

SEQ ID NO: 17013 - DNA, 72 bp, Homo sapiens
cttacttacttacttacagcctggcaacaggctgaagtgcagtggcgcgatcttacttacttacttacttac

SEQ ID NO: 17014 - DNA, 73 bp, Homo sapiens
gctggggatccatcttcttggtggtacagtctccagcatgggggttgctgggagatgggtacttacctgtgca

SEQ ID NO: 17015 - DNA, 73 bp, Homo sapiens
gagggtagctcatctctgcagctggtcatcctgtcttcagctctgctctggctgagtcctgggcttttatggg

SEQ ID NO: 17016 - DNA, 73 bp, Homo sapiens
cacctcaggcaggggggtaggcctgcgggtgccagggcgctgctcagatcagctacgtcgtctgtcaagagtg

SEQ ID NO: 17017 - DNA, 71 bp, Homo sapiens
gtgagggcaaggacaggggactggtctcccgaaggagtcctcctgtcccgggtttcggcaccaaatgtcac

SEQ ID NO: 17018 - DNA, 73 bp, Homo sapiens
ttctatacttttgggtttgttacttggcttctctatgcagctgctggaaaagcagctgatttggggtaacagg

SEQ ID NO: 17019 - DNA, 72 bp, Homo sapiens
tctaaatacaagtacatgcaattctcccttaatagggctgttatttatttgtattttatcttttattatttt

SEQ ID NO: 17020 - DNA, 71 bp, Homo sapiens
agggctggtgcaggaaggagctggcagcagcacggctgtcaccacccatgtaccacgtcttccaatgtccc

SEQ ID NO: 17021 - DNA, 73 bp, Homo sapiens
gggacacagagacccagacctcaccccagcaaagcccagggtgcaggctgagggaggcttcccagagaaggag

SEQ ID NO: 17022 - DNA, 72 bp, Homo sapiens
gaagctctggtaggaagctagtggaagcaggtggggtacacacctgatgtcggggtagctccggataagagt

SEQ ID NO: 17023 - DNA, 73 bp, Homo sapiens
gagggtccaaggcctacctcctgcctctggtcttcaggcccctgggcagtcaggtctgggctggggttgctcc

SEQ ID NO: 17024 - DNA, 70 bp, Homo sapiens
gacagtgaggacaaggtgccaatggttactgtagccactgttggctctgttaattacaccacaaattcaa

SEQ ID NO: 17025 - DNA, 73 bp, Homo sapiens
tttcgccgtgttgcccaggctggtctcacactcctgggctcaagcaatctacccacgtggcctcccaaagtgt

SEQ ID NO: 17026 - DNA, 74 bp, Homo sapiens
aaggagatctggtaagagaaagcaccttgtacactgtagaggctgtacaacgtgagggctatgaacattactct

SEQ ID NO: 17027 - DNA, 110 bp, Homo sapiens
gtgttggggactcgcgcgctgggtccagtggttcttaacagttcaacagttctgtagcgcaattgtgaaatgtttaggaccactagacccggcgggcgcggcgacagcga

SEQ ID NO: 17028 - DNA, 72 bp, Homo sapiens
ccaggtatggcattcgggatgtgtcacgtccacgccccacggaaatgtcagtgacagttcgcacccttgttc

SEQ ID NO: 17029 - DNA, 73 bp, Homo sapiens
ggtcccattagacaccaagacctgggcaccgggcctgcttgctgcttgggtgtggttgcttccaggccctctc

SEQ ID NO: 17030 - DNA, 74 bp, Homo sapiens
atagactgtcccccgtgaggaggcaccagtggacgtcagtccccagacccgtggggtgcgctaggcaggggccg

SEQ ID NO: 17031 - DNA, 72 bp, Homo sapiens
ctcacctggccccgtctagctccaccgcccctgcaacagtagcaaacactcaggctcacgtcagctgagttc

SEQ ID NO: 17032 - DNA, 70 bp, Homo sapiens
tgttctgcagacagggggaccgtgtcattgccgttttgaattgaaacaggcctcttggagagaaccatgc

SEQ ID NO: 17033 - DNA, 70 bp, Homo sapiens
tttgtaagttcctgagtggggaaggatcattaatctgtgcctcattggcatgacggaacatttactccag

SEQ ID NO: 17034 - DNA, 72 bp, Homo sapiens
agcctgggtctacctcccagtcaagtctgagttcacctcccagccgagcctgggtctaccttcccagctgag

SEQ ID NO: 17035 - DNA, 74 bp, Homo sapiens
cgcgctcggtcctgccgccgccgccggcccgccctctccccgccccgcgcccgccccgcgcccggagccgcccg

SEQ ID NO: 17036 - DNA, 72 bp, Homo sapiens
cggtggccacctccttggagcacttaacacccagaccgacgtggccattgtagtctccgatagcaaagaacg

SEQ ID NO: 17037 - DNA, 73 bp, Homo sapiens
ctgctgtgtggtcagggcaccatgagggtgtacagatgtgctgtgtcctcagagcctcgcaggtgccctcact

SEQ ID NO: 17038 - DNA, 71 bp, Homo sapiens
gcctgccagcgccccggcccggcgcgcgccccccagggcgcccgggcggcgggggcacggggcctcggggt

SEQ ID NO: 17039 - DNA, 72 bp, Homo sapiens
cacggtcctttccagagctaggggtcaccttggtggttaaagatccccatatggtccagaggggtcctcaac

SEQ ID NO: 17040 - DNA, 72 bp, Homo sapiens
agggtcagagcaggatgtcaggagcccagagcccctcagctccattcacccatggccacgctgcctgtctgt

SEQ ID NO: 17041 - DNA, 73 bp, Homo sapiens
catgggaaaggtcaaccctaagctatatgcaaatgtacctgcgtaggctggtgtgctgggttgatggcatctc

SEQ ID NO: 17042 - DNA, 72 bp, Homo sapiens
actgtaccacgttgagccacagggtggagcttcctaaggccttgggagcccaacccttgtatcagtgtgtcc

SEQ ID NO: 17043 - DNA, 74 bp, Homo sapiens
gtggatccttccttcagatgagcacatctgtccccacgtgcacccttccctgagacaaggacacctgtccccac

SEQ ID NO: 17044 - DNA, 74 bp, Homo sapiens
tccaatatccaaacaacccaaccagatgttgtgcttattccttaattacagcaggtagacagtgacaagggtat

SEQ ID NO: 17045 - DNA, 70 bp, Homo sapiens
agaggtaacataaatgtagttgaatcgggtacactgattcctgtggtactggattatatcatgtggtact

SEQ ID NO: 17046 - DNA, 73 bp, Homo sapiens
aaaaaatcgttacgtagttagcaccagatgctaaaactggtgactgaaaaatgcggaatatgatgaagaagat

SEQ ID NO: 17047 - DNA, 74 bp, Homo sapiens
gtacttaagtgtgtttctgtagtgactggtaatggccttgccatatttagcactcccatcgggtctcttgtaag

SEQ ID NO: 17048 - DNA, 73 bp, Homo sapiens
gggacaggggagcgggggcgccacgccctggccctggcaggggccggcggcggcacccgggtctaaatttact

SEQ ID NO: 17049 - DNA, 72 bp, Homo sapiens
taacttagctggattcaaactccaggctgcctcgtgtgctgtgggaagcagcctacgctctattcagttctt

SEQ ID NO: 17050 - DNA, 71 bp, Homo sapiens
tgttactcctttgtgggcatgaagactgtgcatggatcgatgatgactttcatacatgcattccttggaaa

SEQ ID NO: 17051 - DNA, 70 bp, Homo sapiens
agtgggtcaaaatggtggcagcacagtacgcgatgaagtattggttgtttaccttcataactgcatgact

SEQ ID NO: 17052 - DNA, 73 bp, Homo sapiens
cttgctttccctccatggacaggtgatgagatccacacaaaatactgactcatcactgacgcagggcaccctt

SEQ ID NO: 17053 - DNA, 72 bp, Homo sapiens
agtcccagtgcagcactggggtcatgcaggggagctgttttggacagtggaggtgctctcggggcctgcaat

SEQ ID NO: 17054 - DNA, 73 bp, Homo sapiens
attagtggctcgctgatggtgcaggtcaggaatttggacaggcagggcccagtggggatgactggtctttctt

SEQ ID NO: 17055 - DNA, 70 bp, Homo sapiens
tgagactatggagttttttagatatgtaatcatgtcatctgctaacaggaatagtctgacttcttctgtt

SEQ ID NO: 17056 - DNA, 74 bp, Homo sapiens
gtcgcgcaaggcccagagccaggagggcgaggcccgcgaggagggtctggcccccgtgcatggtgcgcaggccc

SEQ ID NO: 17057 - DNA, 74 bp, Homo sapiens
gagtcagtaaaccatggcccgttggtgaaatccagccattgcttagttttataaacaaggttttattggaagac

SEQ ID NO: 17058 - DNA, 74 bp, Homo sapiens
ggcagcccccccactgctgggcccccggggcgcgggctgggtagggcccggagaagggagcctggggctgccac

SEQ ID NO: 17059 - DNA, 73 bp, Homo sapiens
tgacctaacttacccagcatagagtatcagattcgagttttataaaacgaatctagggtggaggaagaggcca

SEQ ID NO: 17060 - DNA, 72 bp, Homo sapiens
gaagttccctgagacttcgagaatgtcaacagatgcatgctttcgtgagtccgtgccattcagtgaacttga

SEQ ID NO: 17061 - DNA, 70 bp, Homo sapiens
caatcctacttgttgctttgttttactttttgtttggaagaggcagaggcaaagctttaggattctggaa

SEQ ID NO: 17062 - DNA, 71 bp, Homo sapiens
ttcctagctccagatgagcttatcagactgagaggaaattgactggctcaaagagaacttcctattctaaa

SEQ ID NO: 17063 - DNA, 70 bp, Homo sapiens
caatactgagtattctaaggcgtccatgggagtgggctataaatccaccaatactgagtgttctaagata

SEQ ID NO: 17064 - DNA, 72 bp, Homo sapiens
gtgacaaggcggcaggggttgcatcgaggcattttttggacatgcaccctgtgccatcttctgtgccaaccc

SEQ ID NO: 17065 - DNA, 73 bp, Homo sapiens
ggtcctgcctgagcttgcatgaggagctgtgccttacctttgacacacggccccacgcaggcaacgtggcagc

SEQ ID NO: 17066 - DNA, 74 bp, Homo sapiens
aaagccgcatttctagattctcacacaacacatgatgtatgtgcttttgactggagttccagctttgtgttatg

SEQ ID NO: 17067 - DNA, 71 bp, Homo sapiens
ttcccggcctgcgggcaaaggtgtggaggggctcgccagagtgggatcccgagcggcgctgtcttttgcct

SEQ ID NO: 17068 - DNA, 73 bp, Homo sapiens
tgagttcccaaaaccctctttggaaagcacgggtcacagtagtttctgtggcttgtgttttttccgggggtgt

SEQ ID NO: 17069 - DNA, 72 bp, Homo sapiens
ctgggttgtgtaccttcctgagcttctagtaagagtcgcgtagtctccgatggaaggcctgggggttcccat

SEQ ID NO: 17070 - DNA, 71 bp, Homo sapiens
gtcagagaggtttgggttcaagtcctagctcattacttaaggtgtggaagccttggcctcgctttaaaaac

SEQ ID NO: 17071 - DNA, 72 bp, Homo sapiens
ggtgtgggtgtgttacagcagcaggagaggtgaacacatgtggttaccatctgaagctacacacctacacta

SEQ ID NO: 17072 - DNA, 72 bp, Homo sapiens
ttttgaagtgcttaatagtcacaagtctgatgcttatcgtattagtgtaggtgtgtagcttcagatggtaac

SEQ ID NO: 17073 - DNA, 71 bp, Homo sapiens
aatgtgactggataaggctgacaacaaggggaagcaagcctgacattctccccaccagcctggaagtctgg

SEQ ID NO: 17074 - DNA, 74 bp, Homo sapiens
gacgtgtattattattatttttgtgtgtgtgtgacagagtcttgctctgttgctcaggctggagtgcaatggca

SEQ ID NO: 17075 - DNA, 74 bp, Homo sapiens
cctcggctgggcgggcgccgagcccggccgggccattcactgcctccgaagcgagcggccagacccgccagctg

SEQ ID NO: 17076 - DNA, 73 bp, Homo sapiens
tctgagcacaagctgctgcctctgcactttgcagtggaccctggcaaggactgggagtgggggaaagacgaca

SEQ ID NO: 17077 - DNA, 73 bp, Homo sapiens
aaaggttcctgctcaggatcaggtgctgcattcagcggtggcgtctccttagtctccttcacctggaacattt

SEQ ID NO: 17078 - DNA, 73 bp, Homo sapiens
tatcctgggagtgttcagcaggtgtctgggaggtttactcgtgtccctgaagtgcatgctgctaacgggagct

SEQ ID NO: 17079 - DNA, 73 bp, Homo sapiens
taagtaattctaatgtgcagcaaactttgggaatccctggtgtatgcagtgcatggagaatcgtcagatttag

SEQ ID NO: 17080 - DNA, 70 bp, Homo sapiens
ggaagccggttatgtctcctgtatctcaggtgctgctgtgcataagaataacaggcatacaagggctcat

SEQ ID NO: 17081 - DNA, 70 bp, Homo sapiens
cacaccgcagggggcaagggtgctgtgttatttacatattaatcttttgcattcacctcttgtgggattc

SEQ ID NO: 17082 - DNA, 71 bp, Homo sapiens
tcagaggatgtatggaaacacctggatgtccaagcagaagtttgctaaacgggtggggtcctcatggagaa

SEQ ID NO: 17083 - DNA, 72 bp, Homo sapiens
aaacaatagcctggtagaaggtcatgcaatttcacatgacttccgaggatgattgggattcttgtttgacat

SEQ ID NO: 17084 - DNA, 72 bp, Homo sapiens
cttctcaagtccttctcaggacctgtcaaatcaaaactcctgagctggaaggtgggagccatccaacaatca

SEQ ID NO: 17085 - DNA, 71 bp, Homo sapiens
cagaaataaggatgggaaccacctcagctgcccttccaggccagtagaaaggtgatccacctcttagtcac

SEQ ID NO: 17086 - DNA, 74 bp, Homo sapiens
atgtctaagagccaactgattatttgtccctccaaatctgattgccagggataccctatctcagcggcttctga

SEQ ID NO: 17087 - DNA, 73 bp, Homo sapiens
aaaactggcctgcatctggaaatacttattctacacaggcaaaccaacaacaggaagactccagaaggaggtc

SEQ ID NO: 17088 - DNA, 73 bp, Homo sapiens
ttgtggaggatccctgtccagtccctttgaaggaaggtccctcctttgacagctgctagagatattagccaca

SEQ ID NO: 17089 - DNA, 72 bp, Homo sapiens
agatggggaaatctactgaggaaatgctgtttatgctgatacataaaagcaattgtctgctgggagcggtgg

SEQ ID NO: 17090 - DNA, 74 bp, Homo sapiens
gtggctacagtggcttgcatggagtgagtaagggtgggatgttggagatgggtcagagagtagcaagccgtcat

SEQ ID NO: 17091 - DNA, 74 bp, Homo sapiens
acactaccacctgcttcctgccttccaaggtgatgtgatgatgtgctgcaaccatctcgtgactatgagcagga

SEQ ID NO: 17092 - DNA, 73 bp, Homo sapiens
tgttccgtggcaatcagatgtgctggaactactgaaatgatgaattgaggtagtagttttgtagtcttttatt

SEQ ID NO: 17093 - DNA, 70 bp, Homo sapiens
gtctcacccaggctggagtatggtggcatgatctgggctcactgcaacctccacctcctgggttcaagtg

SEQ ID NO: 17094 - DNA, 74 bp, Homo sapiens
gattcatctcatgtaaagggatttccatttgcttatcagtggattcctcagcagaaactttgtagaatggaaga

SEQ ID NO: 17095 - DNA, 70 bp, Homo sapiens
agttatccttcttcaagccaagaagacacacatcagaaatgctgatagtgggttatcagaagaaaatata

SEQ ID NO: 17096 - DNA, 73 bp, Homo sapiens
gggcgatgtaaaggaacctgagagggagctccgtcatgtgatgagtggctcttaagtgcaggaacagatttga

SEQ ID NO: 17097 - DNA, 72 bp, Homo sapiens
gacactcccacatggagattatggcttcagcaaagcatgaagaaggtagtgtgtgcatgatgagtgtgagag

SEQ ID NO: 17098 - DNA, 72 bp, Homo sapiens
tgacattcatcatttccagagtcttagaattgtgatgatctttttccagtgggctctggaagcttaagaaat

SEQ ID NO: 17099 - DNA, 74 bp, Homo sapiens
gggtattctcttcccctgtcagtttgtcggcgcaacaggtcagacaaatgcacaaggccttacaatatttgtct

SEQ ID NO: 17100 - DNA, 74 bp, Homo sapiens
agacagggaaaaatgcttttctgtacagagcagaagtctgcatcttggcagcttccgcctttggttcagttcct

SEQ ID NO: 17101 - DNA, 74 bp, Homo sapiens
caaactcatcataaatacctactcagcctcacttcgcccaggtggtgaaatgggcattggaacagtgtgaaggg

SEQ ID NO: 17102 - DNA, 70 bp, Homo sapiens
ctcccttgaggccgagcggggccctgatgggcgtagctttgttattgccaccactcggcagcgcctcttc

SEQ ID NO: 17103 - DNA, 72 bp, Homo sapiens
gagagcagtgcaatgtcaaataccagggaaggctttgccaggcaaatgcggccaaggggcctttgaagagca

SEQ ID NO: 17104 - DNA, 73 bp, Homo sapiens
ccgggcgaggggcggtgacggtacctgatgaaggtggtcttgccggtgctgtactggcccaccagcaggatca

SEQ ID NO: 17105 - DNA, 74 bp, Homo sapiens
tccttgtcaaacccaggacgtgatctgaaggcatctcctgctcatgcccctcccaggcctgacactgccccttc

SEQ ID NO: 17106 - DNA, 71 bp, Homo sapiens
ggccttgatctgctggctcctgccagggtccttaggtgggaaggctggggtggtgcaggggccttgggctc

SEQ ID NO: 17107 - DNA, 72 bp, Homo sapiens
taaggtcctcttaattcaggatagtgcaggcaactgatggcaggttccttaagatggcatgaggggactgag

SEQ ID NO: 17108 - DNA, 73 bp, Homo sapiens
taccacagactgggtggttttacccaacagaaacttattttctcgaagttttggaggctggaagttccagatc

SEQ ID NO: 17109 - DNA, 70 bp, Homo sapiens
tcccctgggcccaggattacaactgaaaactcctgttttttgccttaatcctgtagaatgatattccaga

SEQ ID NO: 17110 - DNA, 72 bp, Homo sapiens
gccaggtgcggtggcttaccgctgtaatcccaacactttgggaggctgaggtgggtggatcacctgaggtca

SEQ ID NO: 17111 - DNA, 70 bp, Homo sapiens
tcttcctctttcttctctgagtttctgtttgtaccatccagttttcccagaagtcagacagagcctggac

SEQ ID NO: 17112 - DNA, 72 bp, Homo sapiens
tcccgctggacactgaagtgacggccctctcggaggatgagtatttcagtgcaggtaatgaaagaagcagag

SEQ ID NO: 17113 - DNA, 73 bp, Homo sapiens
tttattaatttcaattcacttaaatgcaaggtaccattttggctccatggtggtggtggagagagagcagtgt

SEQ ID NO: 17114 - DNA, 72 bp, Homo sapiens
gccgggaccagggcagatcccaacccggtgcttgggagtcctgcctgtgtctcaggagccatctagagtaaa

SEQ ID NO: 17115 - DNA, 70 bp, Homo sapiens
ctgagtaagcatcctaggagcaggaactctgtcttgttcatcactgtaaatctggcacctagaaaagtgc

SEQ ID NO: 17116 - DNA, 73 bp, Homo sapiens
tcacctaaaactaagctttactagtgagccaggtgtctcacttggaagttccctggaatagtagaactgaagt

SEQ ID NO: 17117 - DNA, 73 bp, Homo sapiens
gtggtgcagggggggcaatgctgtacaacaacaatagacatttattgcatgccctcaatgtacctggcactgt

SEQ ID NO: 17118 - DNA, 80 bp, Homo sapiens
tataaatctagtggaaacatttctgcacaaactagattctggacaccagtgtgcggaaatgcttctgctacatttttagg

SEQ ID NO: 17119 - DNA, 71 bp, Homo sapiens
gcaatatctgcattagggggtacccgaagcctagtaactctgtgacttttgcagtctcataaagctattgc

SEQ ID NO: 17120 - DNA, 72 bp, Homo sapiens
aaagcttattggtgctggcagtgtcttaaagttggtgagttctgatagatgaatgttagtagttgtgaagca

SEQ ID NO: 17121 - DNA, 74 bp, Homo sapiens
atatatgagacaggaatagtgctagagtagaaaaatacgatttcctgactatgtgttatctgccaggcactctg

SEQ ID NO: 17122 - DNA, 74 bp, Homo sapiens
aagttatttctaccaataagccatagatcctgccttcgaggagctcacagtctaaagaggaagacaggaggtag

SEQ ID NO: 17123 - DNA, 71 bp, Homo sapiens
gaaaggaaggaaagatcaatctattgagcagtcagatggaatggtaaagattaatcattctcttcccttca

SEQ ID NO: 17124 - DNA, 74 bp, Homo sapiens
ttaactcatctgatcaacaacatggcttctctgttcactctctgaaagttgaagccactaactttgaccaaggt

SEQ ID NO: 17125 - DNA, 73 bp, Homo sapiens
tgccgtgctttcattgcttgctgttgtttttccagagcagctaacatgtcccctaaatctagctgcacaggtg

SEQ ID NO: 17126 - DNA, 72 bp, Homo sapiens
accacactgggctaaattttgtattttggtaaagacagggttttgtaatgttgcccaggcggtctcaaactc

SEQ ID NO: 17127 - DNA, 72 bp, Homo sapiens
acagaagctgctggctcctcattcaaagccaggtgtctcctgtatttggggggagaatgacaaatggtagag

SEQ ID NO: 17128 - DNA, 70 bp, Homo sapiens
tctctccttgaagatagagggacaggccattctgagtccttggaaaagaatgcctttaaccaaggaataa

SEQ ID NO: 17129 - DNA, 74 bp, Homo sapiens
taaggtttaccacaagatgagttattttgggtttcagaagttttttggatttttggaattgaagataaggaacc

SEQ ID NO: 17130 - DNA, 71 bp, Homo sapiens
tattattacactgttagcctaagagatgagccagagctgaccctcaggcccatctcacagtggaaccatat

SEQ ID NO: 17131 - DNA, 72 bp, Homo sapiens
atgattttgggtctgcccaaaggaacatggtgtcacttttgttctttctgacccactaaataaaaagtagtg

SEQ ID NO: 17132 - DNA, 73 bp, Homo sapiens
tgatttgttctccttgccatccaaattggcctacttaaccagtgagttgccagttttcaagtttgtgttttca

SEQ ID NO: 17133 - DNA, 70 bp, Homo sapiens
tgcagggaatgcaggtagcggaagctaagcagatcagagtccaaatgccagctgttatttcctgtgtagc

SEQ ID NO: 17134 - DNA, 71 bp, Homo sapiens
ttagatgacctatgaatacttttcaccatgttggccaggctggtctcaaactgggagaaggatttctggga

SEQ ID NO: 17135 - DNA, 71 bp, Homo sapiens
tggctgtttttatggaaggtgtggggagcattggtcaattctgctccctacagcctccataaaaacaaact

SEQ ID NO: 17136 - DNA, 72 bp, Homo sapiens
atcttgttacagtactatacttctggctctacttaggggccatgttctacttaacagtttatggttttgtta

SEQ ID NO: 17137 - DNA, 73 bp, Homo sapiens
gtgtaccttatctcccgcgcgcccagctccttggccggctcacctgctaagcggagcgcggacatgcgctgga

SEQ ID NO: 17138 - DNA, 70 bp, Homo sapiens
caggatttggcacacaataaatgatcactaaagaaatggtgatggccatgacacctggcagctcatttaa

SEQ ID NO: 17139 - DNA, 70 bp, Homo sapiens
ccaaatgacattaaagtttatttgaaggtcaaatgaacaactatcaaagatcttcaagtgagagcaattt

SEQ ID NO: 17140 - DNA, 72 bp, Homo sapiens
tgagttgggaggttttagcagcacgtaaggcaacaggggagaagccacggtgacaataagatctccaaattc

SEQ ID NO: 17141 - DNA, 71 bp, Homo sapiens
cagaagtgttcatcacagctgcatctgaaatcggaagtgggttgaggggttgtgatgctggatatgtgagg

SEQ ID NO: 17142 - DNA, 70 bp, Homo sapiens
aatgttgactcatttgagggcttcccctcaaactgaatggagcagcagataacaataccgatcctgcagt

SEQ ID NO: 17143 - DNA, 73 bp, Homo sapiens
aatgagatactgtttatggagtgcccagcacaatggttggcatatactgggtacttaactgttggctcacttt

SEQ ID NO: 17144 - DNA, 72 bp, Homo sapiens
gaatccatttaggagcatggtgtgcctggaactgcaataatgtgcaggagctctgtagttaggtggacattg

SEQ ID NO: 17145 - DNA, 73 bp, Homo sapiens
tcacaggcaaattatgaggactgaatgataaaacatgtgaagcctttgtctgcctcatagtaattaataaata

SEQ ID NO: 17146 - DNA, 73 bp, Homo sapiens
cactgatgggcatctaggctgattgcatgtctttgctattgtgaatagtgctacaaagaacatatgtgtgcat

SEQ ID NO: 17147 - DNA, 72 bp, Homo sapiens
tcagaagtgccactgccagatctggtacctgtccttgagaaaggatgtctgctagagaagcaaacacatgaa

SEQ ID NO: 17148 - DNA, 72 bp, Homo sapiens
tcagattgaaaactgcaagaacacatccagatcttattgggtgggattggggagggtgcagggagatgggaa

SEQ ID NO: 17149 - DNA, 74 bp, Homo sapiens
gaatgaaatgaagattagtctgccactgactatccccgcagagtcttaggcatgttattgaggaagactgtctt

SEQ ID NO: 17150 - DNA, 72 bp, Homo sapiens
caacaggtctaggatgggaccagagagtctgcatttctacatgctctcagctgaggctcatgcttctgatcc

SEQ ID NO: 17151 - DNA, 72 bp, Homo sapiens
ttggtggaaaaccctcccaggaatcccatttggtaaaaacgcagtgtaaatatataaggaggattccatagc

SEQ ID NO: 17152 - DNA, 72 bp, Homo sapiens
acatctctgagtaattcaggctaggttttcttccagctggtctgaacatgtacggttttgtagggtggcatt

SEQ ID NO: 17153 - DNA, 74 bp, Homo sapiens
tccggcctgaaggaatcagggaagaccttccggacatgccaagtctccctgagaccctgctccatgagggctgg

SEQ ID NO: 17154 - DNA, 72 bp, Homo sapiens
aaatttgagagtcatcaccagatagtagatggtatttaaagccgtaagtctggatgaggtaactaagagagt

SEQ ID NO: 17155 - DNA, 72 bp, Homo sapiens
ccatgtgggccttctacttttcatgcctctgcagcaagcaataccaaggaaaccagcaaggtgagagggaat

SEQ ID NO: 17156 - DNA, 73 bp, Homo sapiens
gtattttatcattctatcacatttagtgagtgcctatcattgctagctaggcgctagtaggtgttgagtgcag

SEQ ID NO: 17157 - DNA, 70 bp, Homo sapiens
cgtgctgtttaatccaatagtcaatatgagcttctagtgtatagactcaattgacttaaaactcaagcta

SEQ ID NO: 17158 - DNA, 70 bp, Homo sapiens
agttgtatgacagagcactggatacttaacctgtgtgcattctgtgtccatatctgtaaattgggaatga

SEQ ID NO: 17159 - DNA, 71 bp, Homo sapiens
aagacaagtcacaattgaactggcctttgaagggtgggtaggtgtgtaccaggtcaactaagggggaaaag

SEQ ID NO: 17160 - DNA, 70 bp, Homo sapiens
gtaaataaaatgcaaagatgtttgagacagttgtgtgtgtcagctggtgggcagtagtgggtggttgtca

SEQ ID NO: 17161 - DNA, 70 bp, Homo sapiens
ttgtggtatagggagtctagtttgtatgctgttggcatggatccaggatacctgggtgataaagattcaa

SEQ ID NO: 17162 - DNA, 72 bp, Homo sapiens
tggagtgtgcagttggggcacgatggtcagaagaaagtcaagcaaggccagtgttgaggcccagggtgagct

SEQ ID NO: 17163 - DNA, 73 bp, Homo sapiens
ggttttctcttcctaaagcacttgtgatgcttcccatgggctgagccaggagtggttttcctgcaagggagcc

SEQ ID NO: 17164 - DNA, 72 bp, Homo sapiens
aaggcatgtttcttgctactgtatttatcattatttctggatacttacagtggacagaactaggatgtgtgt

SEQ ID NO: 17165 - DNA, 74 bp, Homo sapiens
accaaataagaaaaaaacaatgcagctaagaacgattaagcctgtcttaatcagaggctattgccttggttcgc

SEQ ID NO: 17166 - DNA, 73 bp, Homo sapiens
cccacatccttgctgagtcagcaggctcagggcctggaagtcagtgatggcttcatcaccactttgccttctg

SEQ ID NO: 17167 - DNA, 73 bp, Homo sapiens
ccacgctggagtctgtgggtgggaccacaaacaggaacattcacacgacagaacaaacatttctccgtgcaaa

SEQ ID NO: 17168 - DNA, 73 bp, Homo sapiens
ggacttagtgaacacctgcccgtcttgtgccaggcatcgtgccactgggcgtttgcaggtacatcatcaattc

SEQ ID NO: 17169 - DNA, 71 bp, Homo sapiens
agccagggcagtgcagtctctgagaggcaggaaaagctgaggccacattattagaaggttgcatgatgttc

SEQ ID NO: 17170 - DNA, 72 bp, Homo sapiens
tggtaatgatgaacagtataatcactaataaaactgtcacaaacagttttattttactacaagcagagttat

SEQ ID NO: 17171 - DNA, 74 bp, Homo sapiens
aactcctgacctcaggtgatcctgcctcagcctcccaaagtgctgcaagtgcaggcatgagccactgcacccgg

SEQ ID NO: 17172 - DNA, 72 bp, Homo sapiens
accagaagagtcactgaaaggagatggtgatggaagcaatgctagtctgacaccacccactccaacctccag

SEQ ID NO: 17173 - DNA, 71 bp, Homo sapiens
tgatccgccctctgccctaccccggactggagttgggccctgcgtctgtcgtcctcttcagcctctggtct

SEQ ID NO: 17174 - DNA, 73 bp, Homo sapiens
tcttgcctgttcccttgcctttagtttgattgatggattgttaagttagggatggaaggggaggtagggagga

SEQ ID NO: 17175 - DNA, 74 bp, Homo sapiens
ggcagatagcttaagtctgcagcaccacatcacctcacgagacatccctgcgcagtcaaacactggcttctgtt

SEQ ID NO: 17176 - DNA, 73 bp, Homo sapiens
atctaagcactaacggtcctcggaggtcttctggggataaggttccctgtccatttccctaggaatcacctct

SEQ ID NO: 17177 - DNA, 74 bp, Homo sapiens
acagaaccttagaaggcagattcaaattccactttacagatgaagcactgtagcctgaagagtttgggtagctt

SEQ ID NO: 17178 - DNA, 73 bp, Homo sapiens
aacctggagtccgaaacttggctctaatattaactagcgatctttcagcaggtcactcaatctatttgagcca

SEQ ID NO: 17179 - DNA, 74 bp, Homo sapiens
agttatccctgagcaaagtcaggtttctctagatggtacaaagctaagtgtggagagggagactgactggatca

SEQ ID NO: 17180 - DNA, 73 bp, Homo sapiens
atggggccgcaagagaggtggttactccggacaaagcggcttcattggagtcgcctcctcttcttactgggaa

SEQ ID NO: 17181 - DNA, 72 bp, Homo sapiens
ctcgagctaccgtgccggaagcggctcgctggaaccaggcgggaccgcctgtgagtggtgggtttgtggatg

SEQ ID NO: 17182 - DNA, 73 bp, Homo sapiens
atggtcctatcccagcatcaccatggtcccgactgtgggaccttgggccaagtaatatgaccttctttacctc

SEQ ID NO: 17183 - DNA, 72 bp, Homo sapiens
aactcggattggggatagcagagttggaaagaatcctcagaggctgtgatgtgtgagctgagtatgaaataa

SEQ ID NO: 17184 - DNA, 73 bp, Homo sapiens
tctgagttgtccattctaccccccacacctgcatggtgccaggcacagagcaggatgtcagagctggagggac

SEQ ID NO: 17185 - DNA, 70 bp, Homo sapiens
cctgttctccagcttgccacgtgttatgtgttaacagtgtttgctgaaaatgtatgtccaccgaggacct

SEQ ID NO: 17186 - DNA, 70 bp, Homo sapiens
catcccagcccctgctattcccaatcaggcttgtaccactacgcctcaattaagagcagatgtggggctg

SEQ ID NO: 17187 - DNA, 73 bp, Homo sapiens
gggaggtgtttagatgatgctggggaggtccttaggaggactgctgcagatgtggtcacaccagatgattact

SEQ ID NO: 17188 - DNA, 72 bp, Homo sapiens
tactttagcttgtcagagcaggttgtcaggtgttctttgtcaaaggctttgagaaaatccggataaattatc

SEQ ID NO: 17189 - DNA, 72 bp, Homo sapiens
tattagagggtcatttgtagagcatatagtctaactagcacgtagagacactactgctctttaagtctgttt

SEQ ID NO: 17190 - DNA, 74 bp, Homo sapiens
gcgcctcaaatccccctaccccgtgtgaactctagggcatcggacctcaaggggttaactggacagacgggggg

SEQ ID NO: 17191 - DNA, 74 bp, Homo sapiens
gtgctagggctgaagggttgctggggttagtgagaaggtcaaggatgtgactctgggagcaggtgtctcatagc

SEQ ID NO: 17192 - DNA, 71 bp, Homo sapiens
aagggtctagctatgattcgtatctggctactggcccagaaggaagaaaagcagggtctggcagtatttgg

SEQ ID NO: 17193 - DNA, 73 bp, Homo sapiens
gcatgagggacatgtggctgcatgactgtttcagtttgcatgttagaggcgggcttatgatctacccatctgt

SEQ ID NO: 17194 - DNA, 70 bp, Homo sapiens
ggtaaatcacagtgatcggacctgcctcacaggagagtggacaggagagagaaagtgctgtcttattgac

SEQ ID NO: 17195 - DNA, 74 bp, Homo sapiens
gtctggaaatgacctggtaataacgattatggtgatgagaatagttgtcttacactaggttctctggatccaga

SEQ ID NO: 17196 - DNA, 73 bp, Homo sapiens
attaggggactgggatgtgctgggtgtgggctggggttggttacacagccgaataagacaccattccctctgc

SEQ ID NO: 17197 - DNA, 71 bp, Homo sapiens
tggctggctggctgtgaaaggccttgagagcctgaaatgacaggacttgatgctgttatccctaaagcaca

SEQ ID NO: 17198 - DNA, 73 bp, Homo sapiens
agaacacaggcatctaggcaagaagagtggcagaactccccccagggcagatacccttctgcccctcccatgg

SEQ ID NO: 17199 - DNA, 74 bp, Homo sapiens
aggtcatttcatggtgtgttcagctctcagcagagaggaagccctggaggggttggctcctctctgcaggcagg

SEQ ID NO: 17200 - DNA, 72 bp, Homo sapiens
ttggtcatcattacaaactcatggatttaaggatttcagtgcactacagttgctattcttactgatgatcaa

SEQ ID NO: 17201 - DNA, 71 bp, Homo sapiens
cccattttagacaggtaagagcctgttttggtaatttagactggaaatggcaatggtaattcagaaaaaga

SEQ ID NO: 17202 - DNA, 72 bp, Homo sapiens
agttattcttcctctttctgggcctcattttcctcatctgtaagatgaggtagtaataacataatcacaggt

SEQ ID NO: 17203 - DNA, 71 bp, Homo sapiens
tttggtatagtgaggagctgactctttttttttttttttttttttttgagacggagtctcgctctgtcgcc

SEQ ID NO: 17204 - DNA, 70 bp, Homo sapiens
gcccagtccttggaataagatcagtgccaaggaagtagcctagggtggagcagggagatggagggtgcag

SEQ ID NO: 17205 - DNA, 72 bp, Homo sapiens
gatgctcctgcggctggggtcttggcggcccccggccccctcctcctcggcgtcctcttcctcgtccatgat

SEQ ID NO: 17206 - DNA, 72 bp, Homo sapiens
cttatctgcagtgcctgggactctggagccaggcactcccaggcaagtaggagacagatcagccaggaatgc

SEQ ID NO: 17207 - DNA, 72 bp, Homo sapiens
accagaaggtctcaaagcagcattagacttcgcttgagtagagtgtgtaatgctattagcctttacaaagaa

SEQ ID NO: 17208 - DNA, 70 bp, Homo sapiens
tttctttgctctgtgggcctggtagttcgacaactttctaacatcctggacttcctgatctattgaggaa

SEQ ID NO: 17209 - DNA, 72 bp, Homo sapiens
cttcgaagactccaccttctgagaccctagtacacaggctctgcggaggctgggccaggagaatggagcaac

SEQ ID NO: 17210 - DNA, 73 bp, Homo sapiens
cttgtcatagaaagttgtcctgttgctgggcgtggtggctcatgcctgtaatcccaacactttgggaggccga

SEQ ID NO: 17211 - DNA, 73 bp, Homo sapiens
gcgattctcctgcctccggctcccaagtggctgggattacaggcgcttgccaccatgcctggctaatttttgc

SEQ ID NO: 17212 - DNA, 74 bp, Homo sapiens
ggcgcccggcagggggcgccgccccgccggcccacgccccgccgcgcgccgggcaggccccctcgcgcaggcgc

SEQ ID NO: 17213 - DNA, 73 bp, Homo sapiens
cctctgcccagaggccgacagagctctgtccctagaggagcaggtgacagggctgcaggccagaggaggaagg

SEQ ID NO: 17214 - DNA, 74 bp, Homo sapiens
caggggactccctggagcagcattttacaggactacatgcgtccctgtgtgatgctatttctggctccgtcgcc

SEQ ID NO: 17215 - DNA, 74 bp, Homo sapiens
ggtaggctgagtggcagctcagtcctagaaggtctctgaagatctggactgaggaccctgctgctccccaagcc

SEQ ID NO: 17216 - DNA, 71 bp, Homo sapiens
tttgtcttaaagcctcaagactggccagatgtgcacctgagtaaaggtcagccatttcatctgggggctct

SEQ ID NO: 17217 - DNA, 74 bp, Homo sapiens
caggtctgtgcgtgtgacccgctgtctccctcactaactcactgggtcacatcaggcaatgcagtgcagagctg

SEQ ID NO: 17218 - DNA, 73 bp, Homo sapiens
taccctctctacttaacagtgcttagataggcactgccgatgtttgcctctgtgcctctcctttctgtgagtg

SEQ ID NO: 17219 - DNA, 72 bp, Homo sapiens
cctgattcactgggcctgggatggggtctgaggatttgcatttctaatgagctcccaggtgatgccagtgct

SEQ ID NO: 17220 - DNA, 74 bp, Homo sapiens
ggcgggaacgcgggctgggccaccgcgcgcaggggccggggccgggactggggatggcggcctgcccgcgcgcc

SEQ ID NO: 17221 - DNA, 71 bp, Homo sapiens
gcagaagagaagacaaatcctcattggaagaagacaccttcattctaggcctcagatagtttctgttaaac

SEQ ID NO: 17222 - DNA, 73 bp, Homo sapiens
catcctgtcattattattctagctggttgtcttgccggttagttgattcaatttcttcgtagtgttgatggtc

SEQ ID NO: 17223 - DNA, 74 bp, Homo sapiens
agtggaagggctaaagactaattgctatatgacagcgaggtaaaataactgtagcttagtcatagctcagcctc

SEQ ID NO: 17224 - DNA, 72 bp, Homo sapiens
acagcaaggagcaggaggacaagcatggtctctgaatcacaacatcagggcctgaatccaggctcacgcttt

SEQ ID NO: 17225 - DNA, 73 bp, Homo sapiens
gactacctgcctcttgggacaaatgttattctgaattccatttgttagctctgttcagcaggtacacatgtct

SEQ ID NO: 17226 - DNA, 73 bp, Homo sapiens
atttaactgagggtttggaatttttcaagatgactgggctttttcctgtgatttgtgagtttctcttgtttgg

SEQ ID NO: 17227 - DNA, 71 bp, Homo sapiens
ggtcagaagcggggggaggaaaatagttgggtgaggtcctgaatctccccagtgctatccccacttcagcc

SEQ ID NO: 17228 - DNA, 72 bp, Homo sapiens
ctggacggacacacaaggtgagctccatgatggggtggggcggctcccagcccttagagagcacctggtggt

SEQ ID NO: 17229 - DNA, 72 bp, Homo sapiens
ccagggagcctctgacgtggcaggcagcatgctaaaagctgccagttgaaggccagtggttttatgaacatc

SEQ ID NO: 17230 - DNA, 72 bp, Homo sapiens
ctgagagccaacaatgccatcttgggccaagtccctagcttatcctcagtctagtaggagtggcctctgcca

SEQ ID NO: 17231 - DNA, 71 bp, Homo sapiens
aggtggcagtccatgggcatagccaatgacctccccagagaaggagtcctgctatgggcctcaccatgttg

SEQ ID NO: 17232 - DNA, 74 bp, Homo sapiens
gaatcacatggcaaattcaatacaaggcctgcctggtctcttgagaccagcattgtgtgattagatgtgtgcca

SEQ ID NO: 17233 - DNA, 73 bp, Homo sapiens
cagtactgataacgccaaggtagcaggaaggtaacttgcattcttccatcaacctaggtgtttgatgatattg

SEQ ID NO: 17234 - DNA, 72 bp, Homo sapiens
tgcctttttccaccctttcagtttaagtttatgtttgtccttatgtgttaggtgtgtctcttgaaggcagaa

SEQ ID NO: 17235 - DNA, 72 bp, Homo sapiens
ctggagtcactggggaccaggagctagtcccagtgcatggtagctctgtgcagcagcttcctcccacttcag

SEQ ID NO: 17236 - DNA, 72 bp, Homo sapiens
gtctctggacttctgtttcctcagctgtcgaatgaagaggctacaccatatgtttcctagagacctttgcca

SEQ ID NO: 17237 - DNA, 74 bp, Homo sapiens
ttcactgttgctcccgctagcatcagagcagcaccagtcagggttgttctctagtttgggtccgtgggagccac

SEQ ID NO: 17238 - DNA, 74 bp, Homo sapiens
gtatgactcagcagtgaaacgatattggcctggtgctttctagcttggaaggttaattattgattgtgttttaa

SEQ ID NO: 17239 - DNA, 96 bp, Homo sapiens
agacatgcaactcaagaatatattgagagctcatccatagttgtcactgtctcaaatcagtgacaactatggatgagctcttaatatatcccaggc

SEQ ID NO: 17240 - DNA, 78 bp, Homo sapiens
ctgggatatattaagagctcatccatagttgtcactgatttgagacagtgacaactatggatgagctctcaatatatt

SEQ ID NO: 17241 - DNA, 78 bp, Homo sapiens; identical to SEQ ID NO: 17240

SEQ ID NO: 17242 - DNA, 71 bp, Homo sapiens
ccctggttagcctggttatagaaggtaattttgtccaagttaatatagcaccatctgctgctgaaaaggag

SEQ ID NO: 17243 - DNA, 71 bp, Homo sapiens
tgtccctgcccaggatagcagcatagcttatacagcatatgttgctttgttcaggcagaagtggtacatct

SEQ ID NO: 17244 - DNA, 73 bp, Homo sapiens
actagcagagtggagaagggtctggaggggagcaaggctagatacagggactgaccagttagagactgtcacc

SEQ ID NO: 17245 - DNA, 71 bp, Homo sapiens
aaaattattatttgtagatgcggggtctcactatgttgccaaggctgatcttgaactcctgggctcaagta

SEQ ID NO: 17246 - DNA, 71 bp, Homo sapiens
tgccggcgcgtctcccgggcccgggccgccccgcgtccgccccggctcggcgggcgccgccgcatccacgc

SEQ ID NO: 17247 - DNA, 73 bp, Homo sapiens
tacacatagactgaaaataaagggatggagttagatgttccatgccaacggaaccccaaaaacagcagtagtg

SEQ ID NO: 17248 - DNA, 72 bp, Homo sapiens
ctggctggatatttctgcatggtcttggcagcatttgctctggccatgacacagcatcaataccttcctatt

SEQ ID NO: 17249 - DNA, 74 bp, Homo sapiens
cagcagttctctcggggccattcttatcttggagctcagggagcaaatgggggccaaaacgcaagaggatggtg

SEQ ID NO: 17250 - DNA, 72 bp, Homo sapiens
tggttaatcatgggtctgttatggggtggcaatgggcatgctggctgtgggatccatgtgctgagaaaaaga

SEQ ID NO: 17251 - DNA, 74 bp, Homo sapiens
gtcatgaggggcatatttcataggatgtctatttagaccctgtagatccgatatgtggataaagcctagagaca

SEQ ID NO: 17252 - DNA, 70 bp, Homo sapiens
tagcactgagctcacctctaaagaggcagagggctagacgcgcccttgaaaattttaggaattttttcag

SEQ ID NO: 17253 - DNA, 70 bp, Homo sapiens
ttatagggtagttagaggctaatagtttcaaaccctgatgttgctcagggttattgatagccagtcatca

SEQ ID NO: 17254 - DNA, 72 bp, Homo sapiens
ggctaacaggctgtcatcaaggccgacaggagctatggccaccccaaggcttgatgcaggaggattcgcttc

SEQ ID NO: 17255 - DNA, 72 bp, Homo sapiens
gatctttattccaaactagcttttactcagtgggtcatagagtgagtaagcatggggattttgtggtcgtgt

SEQ ID NO: 17256 - DNA, 74 bp, Homo sapiens
caggtaaagtggctgtgcaccaccaaatccatttagtcaacattcaacaaatgcctatgtgccaggtactttgc

SEQ ID NO: 17257 - DNA, 73 bp, Homo sapiens
agcccggagcaagaccaactctcacccagtggcattaatttctcgctggggcctccattatgttgtacccggg

SEQ ID NO: 17258 - DNA, 73 bp, Homo sapiens
gtgtcacaggctgagctgggcacagagaagacacagtccctgtcctccaggagcacagtccaatagaaaacac

SEQ ID NO: 17259 - DNA, 71 bp, Homo sapiens
ttcgtccaccatctgtgacagcttcttgatctgtccccaggtaggtggctcagttcaacaggtgttgctcg

SEQ ID NO: 17260 - DNA, 72 bp, Homo sapiens
gagggtcaggtctcaaagccaggtggatgcaaggtgagagctgccacagccagggacctgtgataaggagga

SEQ ID NO: 17261 - DNA, 71 bp, Homo sapiens
agcagcccgggccgcgtttgaccactagtagggcagaaccactgaccggcaggcggcgctccccggggctc

SEQ ID NO: 17262 - DNA, 72 bp, Homo sapiens
tttaactgtccagctctcagagaagcaacttagttcttcggagctttgttagcagagacacaacagagcagt

SEQ ID NO: 17263 - DNA, 72 bp, Homo sapiens
tttggaatctggtaaaggaagaactgcagtattttaccagtactctctgctgtagcatggcccacagtttct

SEQ ID NO: 17264 - DNA, 73 bp, Homo sapiens
tagctgagatccttaataagcaaagaacaggaatccctgaggggtgacaggatctgacctccatgcagttacc

SEQ ID NO: 17265 - DNA, 73 bp, Homo sapiens
cttagtgttccagtattcagtgcccagaagagggtcgatggtgagctaataagtatagagccgctgtgggcac

SEQ ID NO: 17266 - DNA, 72 bp, Homo sapiens
gcctggaacatcctggccctatccactatagcttgaccgagtgggctctaaggctggtttatagggaaggaa

SEQ ID NO: 17267 - DNA, 73 bp, Homo sapiens
cacacctcgaaatctacaggggcgtgtgtatgtatgttgtctgcctgtcagtccactgggctttggggttttt

SEQ ID NO: 17268 - DNA, 74 bp, Homo sapiens
attatggcagcatggtgtaacctaattaatgagtggctgaaggttcaggctctagggttaagcagctgagccat

SEQ ID NO: 17269 - DNA, 72 bp, Homo sapiens
ttcaccatcctaattataagtaagccagggatttccttatggctcactggaagatcatgaaatactcttagt

SEQ ID NO: 17270 - DNA, 72 bp, Homo sapiens
ccaaaacgtggtgattagcacaagagtaggctacaatctgtttacacctccacttgttataggtcacaatgt

SEQ ID NO: 17271 - DNA, 73 bp, Homo sapiens
ccactcagcataagacatttcctacttttaaccaagtaaatttggtaaaaaagacacatattctttgtctggg

SEQ ID NO: 17272 - DNA, 70 bp, Homo sapiens
ctgctgtgtgagttctttttattagctcagttggcacctttgcctagagagatacctgctcaatgcaggt

SEQ ID NO: 17273 - DNA, 70 bp, Homo sapiens
ttgaaatatttttaaccacacttttggttccttctctgacctatgaattagttagaaatatgtcatttaa

SEQ ID NO: 17274 - DNA, 74 bp, Homo sapiens
gctgccagcacgctgtcacctctcacctgcacctgtggaggcaggaagcggagctagagaggaacagaacctgg

SEQ ID NO: 17275 - DNA, 71 bp, Homo sapiens
ctggcatcagctcccatgggatcctgtcattgctccaccacttcctggctcagtgactacatccaaaagtt

SEQ ID NO: 17276 - DNA, 70 bp, Homo sapiens
gtgtatgtgtgtggaggtattggtatgtggcagtagactatggtgctcttacctcctctttagccacaag

SEQ ID NO: 17277 - DNA, 74 bp, Homo sapiens
cagcttggatgctattggtgtacagaaatgctgctgttttttgtacattgattttgtaacctgaaaatttgttg

SEQ ID NO: 17278 - DNA, 73 bp, Homo sapiens
ataaaggagcagacagtaaatattttaagcttcgcaagtcatataggctctgttgtaactactcaactctgct

SEQ ID NO: 17279 - DNA, 72 bp, Homo sapiens
ccccaggaaacccacagcagcctttgggtacttcctcaggggagggggcaagcataagaataacagggagtt

SEQ ID NO: 17280 - DNA, 72 bp, Homo sapiens
cagagtagcacacgggagtgctagcgatgggcaagagaggagtttttacctgagctggcagccagtgtcgaa

SEQ ID NO: 17281 - DNA, 73 bp, Homo sapiens
gattacatttagagcctccaccaaataattcaggacaatcctctgatcagggtagggggggcagtcttaatct

SEQ ID NO: 17282 - DNA, 71 bp, Homo sapiens
gttatatgagatgcctcagcgatggcaggattccatgggaggaaacttatcagactgatgtatggtgtata

SEQ ID NO: 17283 - DNA, 70 bp, Homo sapiens
aattctaattaaagcagttagctatgactctcatttagcagcacgtaaaatgagtaattatgcttgttga

SEQ ID NO: 17284 - DNA, 73 bp, Homo sapiens
gatgaatcataaccatcctctgctattggagtattgtaccttcacatctagtaaatggtacatttcattttat

SEQ ID NO: 17285 - DNA, 74 bp, Homo sapiens
ggacagctgatggcccctgctgagtggcccctgctgagtggggggctgggcagaggagcaccccaggccatcct

SEQ ID NO: 17286 - DNA, 72 bp, Homo sapiens
tctctggacatggggacagaagactttggcgtgagttgctgctttgtccagttttcccagacctcagagtcc

SEQ ID NO: 17287 - DNA, 74 bp, Homo sapiens
ctcttccctcacccggggcggggtggggcgcgcgcgccagacaaaaggagcctcagcccctcggaggggagagc

SEQ ID NO: 17288 - DNA, 74 bp, Homo sapiens
tttttccactaggggataggaggccttactggagctgatcaactggttcatactgtggagttgactgtaaccag

SEQ ID NO: 17289 - DNA, 72 bp, Homo sapiens
gggagaggaggcaaaaatgagcctggaaatgtcagtggagtccaggtcgtggacggtactgtgggccatgtc

SEQ ID NO: 17290 - DNA, 73 bp, Homo sapiens
tggaaaagtatgcagtttggaatgacaggccttagtctgagtctctgttctgctgctgacgcaccatgtgacc

SEQ ID NO: 17291 - DNA, 72 bp, Homo sapiens
caactgccctgtatgcaggcctctctctggggcttctcatcagcctagcagcacggctttctcagggcttcc

SEQ ID NO: 17292 - DNA, 70 bp, Homo sapiens
ggaagccacatcagaggctactgtagtggtccaagcaatgggtgctgatagcatagactagagaggtggc

SEQ ID NO: 17293 - DNA, 70 bp, Homo sapiens
gggtgctggggatgctggctcagggactgtccctcccgggagggatctgccatttcagaggctcaaaatg

SEQ ID NO: 17294 - DNA, 70 bp, Homo sapiens
gctgtctggatcccacagtgctgacttcatacctgcccagtgggactcagcatgggccactatagccagc

SEQ ID NO: 17295 - DNA, 72 bp, Homo sapiens
gcaattggatgacggtctgtcctggaggagcaggagagagggcataaaccgtgcatgccacttgaccaatca

SEQ ID NO: 17296 - DNA, 73 bp, Homo sapiens
atcgggtcaatgtttagctgcgttgccatgagaaatagcttaatgctttgatgttgtcacacccagaaaggaa

SEQ ID NO: 17297 - DNA, 74 bp, Homo sapiens
acaaaagtgatgccacgtgactagctgggtcagaaaggccgattccatttctgcctggccctctgggcgagctt

SEQ ID NO: 17298 - DNA, 73 bp, Homo sapiens
aattcacggtccactcgcaggcgcgcacgtccccagggctccgggacggctgttccctgcgtgcggccgcggg

SEQ ID NO: 17299 - DNA, 70 bp, Homo sapiens
tcctctcactcaagtcgcctggataacgggtcagatttggttttcgtaactgatctgtgccccgatagct

SEQ ID NO: 17300 - DNA, 75 bp, Homo sapiens
tttcccagaatggtaaagattaactgaaacctgtgaaaacactggatacttagttggcttgtaagtgtctgtcta

SEQ ID NO: 17301 - DNA, 75 bp, Homo sapiens; identical to SEQ ID NO: 17300

SEQ ID NO: 17302 - DNA, 72 bp, Homo sapiens
ccaatgagtggataaggccaatgatagaggaagtggctaaaaagtatagacacattcttgggctcatgatgg

SEQ ID NO: 17303 - DNA, 72 bp, Homo sapiens
ggtgggtgggtgcaggtggtcgtgggtggctgtgatgctccggctcccacccacaggcaccatgactcctgt

SEQ ID NO: 17304 - DNA, 72 bp, Homo sapiens
ggagatagggaagccaaaggcaatggtattgactcatggctaagtgaatgcagccctgcctagcagtttatt

SEQ ID NO: 17305 - DNA, 74 bp, Homo sapiens
ctgtcccccttgctgcgctgcttggctgccctgggaggaggaggccgagttgagggcacgccctgcacacagca

SEQ ID NO: 17306 - DNA, 70 bp, Homo sapiens
ccccagcatgttccacatgcccctgcggtccagctgcaaggacatggcgatgaccagtgtacccagaaga

SEQ ID NO: 17307 - DNA, 71 bp, Homo sapiens
catgtccagcccccccatagccctcagcaccagggctggccactgttggggtagatccgggtcctgggcct

SEQ ID NO: 17308 - DNA, 72 bp, Homo sapiens
tgcagtagatgatccgcagcatggtccacgtttgcgccacctaggggcgggcactggtcacttgtgggcgtc

SEQ ID NO: 17309 - DNA, 74 bp, Homo sapiens
cccgcgccctccccgcccgccgcgcgccggggtttgttattgtgcgggtgcccgcggcgagcggggcgggggcg

SEQ ID NO: 17310 - DNA, 70 bp, Homo sapiens
ccgcgcctccctccccgggggagcagacgggcccggggcctcccagcacccctcccgggcgggctgcacc

SEQ ID NO: 17311 - DNA, 72 bp, Homo sapiens
ttggaggagctctcgctggcccagacgtgaggcccagccctgcccataatgggcactggcgctggcaccccg

SEQ ID NO: 17312 - DNA, 73 bp, Homo sapiens
acatcccagtggtcgggatcctcaccttttgatgagcttgatggatttgaaggcttcgtccatgtctcctatg

SEQ ID NO: 17313 - DNA, 73 bp, Homo sapiens
gggggcccaggcgggctcctggggactcgccggctgttctgggctgacagctctcccacccctcctgggtgac

SEQ ID NO: 17314 - DNA, 74 bp, Homo sapiens
cgagaccggcgttggttgaaaatcgcccccggctttggccgtggccgcgggtgagattcggcgcccagagcccc

SEQ ID NO: 17315 - DNA, 74 bp, Homo sapiens
ccgggagggcaggtatggagccacggggcctgatagctgttgaccagctgtgcttccctgcacccagcgccctc

SEQ ID NO: 17316 - DNA, 72 bp, Homo sapiens
ccacagaggcgccctgcaagagacaggtctgcagcatcagcattgtacagggcagggggccggatgcaccgg

SEQ ID NO: 17317 - DNA, 72 bp, Homo sapiens
aaacgttccctggcctccagccccagggtcccgcccgcctccatgtccctggctggggctgaacactgaacc

SEQ ID NO: 17318 - DNA, 72 bp, Homo sapiens
cggggggcggctgggccgcgcggggggcccgggcttcgtgctcacgccggcccgccgcccccaggacgtgtt

SEQ ID NO: 17319 - DNA, 70 bp, Homo sapiens
aaagggcaggatggcggagagggctgagggcgggtcgcttccggcggcttttcccgcagctcctgcgtaa

SEQ ID NO: 17320 - DNA, 72 bp, Homo sapiens
ataaatgtggaatttagagcaaaggaaattgaaccaagttgtgatcagtttttgaattgccctatccttaac

SEQ ID NO: 17321 - DNA, 73 bp, Homo sapiens
ccgtgcaagttaagtgcgggggcgatgctgggggtcttgactctgggattaagtgtccctgcaggtggcatgc

SEQ ID NO: 17322 - DNA, 71 bp, Homo sapiens
agtgagcatgagcttccgggcgggctgatggtgtttgacactttagccccaaatcacatctcactgggccc

SEQ ID NO: 17323 - DNA, 74 bp, Homo sapiens
tctcgcgctgttgcccagggctgagtgcaatggcgccatcttggctcactgcaacctctggcctcctgggttca

SEQ ID NO: 17324 - DNA, 72 bp, Homo sapiens
gctctttctggggttttgcatttacggttaaggtctgtaaacgtcctacacacacagtaaaggtccactatc

SEQ ID NO: 17325 - DNA, 74 bp, Homo sapiens
ggagagggtgggcccaacggggacgccaaagagagccattcaggcctccccgcgcccccggggagacgacttct

SEQ ID NO: 17326 - DNA, 72 bp, Homo sapiens
aaggaagagagcaggttgctgagctcagccagcaccgagagtaagcaacagcagactgactcactccctgga

SEQ ID NO: 17327 - DNA, 72 bp, Homo sapiens
cacaggagtcgggatgaggttctgatgagataagggagaaactgccttgtaaactgtaaagtaccctcaggt

SEQ ID NO: 17328 - DNA, 74 bp, Homo sapiens
caaagccccccactgctaagccttcctggccaccccgccaaacactggctttctccactgcaggacttgtcagt

SEQ ID NO: 17329 - DNA, 73 bp, Homo sapiens
tagtctttatcctcttagctcatcagagcaggacaggctctcaaagacttgaagttcccctcccttaattcac

SEQ ID NO: 17330 - DNA, 72 bp, Homo sapiens
tgtttaaacatggcaacggagcctcaacactgagccttcttggatggcttccgcgtgtcatcgtgcagcccg

SEQ ID NO: 17331 - DNA, 72 bp, Homo sapiens
cctggggaggtatctggacctcactattttggaacttatcatgcatagcttatctctgcaggcaactttgcg

SEQ ID NO: 17332 - DNA, 72 bp, Homo sapiens
tttatgccctgatgctgagtgtgtgcttttcctcttccttgaatttgcacctaactcactccatcatctcct

SEQ ID NO: 17333 - DNA, 71 bp, Homo sapiens
ctgggtttacatacaggcatgtaatagtgggtaagtctggatacttaactgccttgtaattcagtctcctc

SEQ ID NO: 17334 - DNA, 70 bp, Homo sapiens
ccttcctgcattttcagatggaaaatgaaatgttttgatgaacacatcatatcgtccctggcatgcacag

SEQ ID NO: 17335 - DNA, 73 bp, Homo sapiens
attgttctgcttacagagcaggatgtgctctttttcacacatttactggccatgcaagattcctcctctgtga

SEQ ID NO: 17336 - DNA, 70 bp, Homo sapiens
agtcagtttcaacaacctagtggctatggaataactacaaagaaatcacagctaggattgaaattgtcca

SEQ ID NO: 17337 - DNA, 73 bp, Homo sapiens
aagagcccttggggataaagggaccagccagtgagtgtttctgggactgtcccactgtattagtctgttctca

SEQ ID NO: 17338 - DNA, 72 bp, Homo sapiens
ctggaggttcgcttgggaggttgactgaggctgcagtgatcaaagatggcgccactgcactccagcctgggc

SEQ ID NO: 17339 - DNA, 72 bp, Homo sapiens
tgctagactagaagctccatgagagcaggagctgatctcccttgttcacagttgcacctcctgttcccagct

SEQ ID NO: 17340 - DNA, 73 bp, Homo sapiens
aactgaaaatccgggtggggaaaagaggacgtgtctgagctgtggaatctggcagcagacccccctcgcttca

SEQ ID NO: 17341 - DNA, 70 bp, Homo sapiens
tcttgagtaatcgcccatctggagtctagtttgcatcatcctgactctggcccagtggtgctgtgccaac

SEQ ID NO: 17342 - DNA, 72 bp, Homo sapiens
tcttggctctgtcgctctctggttgtgtgatcttgggcaaaatacctcaacccactgggcgttagtttctct

SEQ ID NO: 17343 - DNA, 72 bp, Homo sapiens
cgagtccagactcaaacccagctgggactgtcacttgacagtaatccaaagcctgtctggtgttcaggactc

SEQ ID NO: 17344 - DNA, 74 bp, Homo sapiens
gcaggcggccgcgcgggtgtttgtcgcttcgcggggccttgcggcagcatggcgaaccatctgatcagtggcgg

SEQ ID NO: 17345 - DNA, 72 bp, Homo sapiens
ctctccagtgcaattggaaatcctgaatctcagcaaagatcaggcatgctaaactcaaccctggagacctgc

SEQ ID NO: 17346 - DNA, 73 bp, Homo sapiens
tcttgacatgtaaaacactttgggtctgggcgtggtggctcatgcctgtaatcccaacattttgggaggctga

SEQ ID NO: 17347 - DNA, 71 bp, Homo sapiens
acagagcgtggcctggagctgggcgagtaaagctagaaatgtcgtcaggagctgagttcaggagcctggat

SEQ ID NO: 17348 - DNA, 70 bp, Homo sapiens
aagcctggggagagggactcttagcggggcctttgctcacttacaggccagctgcagccatattgtccaa

SEQ ID NO: 17349 - DNA, 71 bp, Homo sapiens
ggcctgccctgggctttgcagcctcattgctcttggcgtgaggagctgggggtcggggggcgaggtcacac

SEQ ID NO: 17350 - DNA, 73 bp, Homo sapiens
tagacagcagacccctttgaaggcaggagctgatctgtccatccatgccccgttaatgttggtgtatcgtcag

SEQ ID NO: 17351 - DNA, 72 bp, Homo sapiens
gctactgttcattgagcacttactggtcgccagtcccctttctaagggctccatgcaacttaactcccctaa

SEQ ID NO: 17352 - DNA, 70 bp, Homo sapiens
ctcttgactacttcaatctgcctgagctaaatcactaactcagttcagcagacagagaccacaggtatga

SEQ ID NO: 17353 - DNA, 71 bp, Homo sapiens
ttaagtggcagagcaagaatgcgatcccaggtatggggaacctcaaagtctgggacagttccaggcttcgg

SEQ ID NO: 17354 - DNA, 72 bp, Homo sapiens
actgggtgctgaggtcccatacccggccgtcgaaggtcaccacgtgctgggccccagccaccagggcatggt

SEQ ID NO: 17355 - DNA, 70 bp, Homo sapiens
ggctttgaagtagcaaattgtgttggtgggatggagccgccatcagccccatgttggactgttggcagcc

SEQ ID NO: 17356 - DNA, 73 bp, Homo sapiens
cctcttggctcacaagtcgtgtccactgccccgtggtccaaaggctccataccatctaagaggccttctacag

SEQ ID NO: 17357 - DNA, 72 bp, Homo sapiens
acctcatgagagaccctgatgccctggctaagccatcctcagagtcctaattcacagaaattgtggggaatc

SEQ ID NO: 17358 - DNA, 70 bp, Homo sapiens
tcctgggggagggctagctacattgtctgcactttgatgacaggcattacatgaggcccctggatcccta

SEQ ID NO: 17359 - DNA, 70 bp, Homo sapiens
aaatgtaagaagcattcttagctcacaggccccatcagaaagcgggcaatgggctttagtttccaacccc

SEQ ID NO: 17360 - DNA, 72 bp, Homo sapiens
ctcccgaaaagtgcaggagatgaacaggcttcttgagagacatggtcagtgttcacttttatttttattcac

SEQ ID NO: 17361 - DNA, 73 bp, Homo sapiens
gttgctgatcatgggaagcagcataccacagcattaggatcacaggctgcagggtcatattgcttagatttga

SEQ ID NO: 17362 - DNA, 72 bp, Homo sapiens
gtcttccttaagtcctgagttaaacagaaataaaaactggtaattattggggatttaaccaggtgctggata

SEQ ID NO: 17363 - DNA, 72 bp, Homo sapiens
gctgtttcttggcattcaggctttgtgtagtttgttaaggctgctgtaacaaggtaccaccaactgagtgcc

SEQ ID NO: 17364 - DNA, 72 bp, Homo sapiens
actgccgcagtcgccgcggaattcggcgagtagaaccgctgaggcgggcgcgggcccgggtggggccaaggt

SEQ ID NO: 17365 - DNA, 71 bp, Homo sapiens
acgaccagaatagcttattaaggaccagctttgcaggtgactgcgccatgctgagaatcgctgttcatttt

SEQ ID NO: 17366 - DNA, 70 bp, Homo sapiens
caacatcacgaaatggaagaaattataagccaggcatcatagtctggagcagaggtcttcaaacattggt

SEQ ID NO: 17367 - DNA, 73 bp, Homo sapiens
ctgggggatgtagcccagcttggtctcaggtcttggatagagaatgatcagtttgctgggatgggaaattcag

SEQ ID NO: 17368 - DNA, 74 bp, Homo sapiens
taggatgctgacaacagaaattcaaacaagtgcagagccatggagctgtgtgtgactgcacaggccgcatgtcc

SEQ ID NO: 17369 - DNA, 72 bp, Homo sapiens
cttagaagtggatcctccagccccagtggacaacacatggagccgagacaaacctcccagcagagcccttcc

SEQ ID NO: 17370 - DNA, 73 bp, Homo sapiens
agttgcaaactcaaaccccaacagccatcttgtgggtaacacagacaagtaaagtgacctggtgggcccgtgt

SEQ ID NO: 17371 - DNA, 73 bp, Homo sapiens
cagggatgaaatatgatgccaggattttattctccttttgaatggagaattttgcttgtcttcttttttcttt

SEQ ID NO: 17372 - DNA, 70 bp, Homo sapiens
ttctctctgtgggttatttcgactcttagcggaaagtctagaatcctgaatagggcttacgaggcactcc

SEQ ID NO: 17373 - DNA, 70 bp, Homo sapiens
ttactgatgatattcactttgatcaattgatgaaggggatgtctattaggctttccactgtaaatttact

SEQ ID NO: 17374 - DNA, 70 bp, Homo sapiens
ccctgctctccttactccctgctccaacaccaacttggacttggggcgcctcctccaggtttccagagct

SEQ ID NO: 17375 - DNA, 73 bp, Homo sapiens
aggttggccgaaatcatcaaaggagagatggacgtgagaaagctcacaggaacttttttttccctttccagga

SEQ ID NO: 17376 - DNA, 71 bp, Homo sapiens
gactggcacagctgaatcctggccctggcttctaacagctttggggggttagctctacaaaggctacagtt

SEQ ID NO: 17377 - DNA, 71 bp, Homo sapiens
gccatttcctttgacctccagtgtggttactgatgcagaacctgcttaacatatcataatggagttttctt

SEQ ID NO: 17378 - DNA, 73 bp, Homo sapiens
agacagagacctggaagtgaggctatcacaggagcatgccctgccctctcctctctctcctctccttcctctc

SEQ ID NO: 17379 - DNA, 70 bp, Homo sapiens
ttaaaaactctgactcttatgtgtagcaactattatgctatatgctacaagtaactgtcttaaaaagatc

SEQ ID NO: 17380 - DNA, 72 bp, Homo sapiens
ccttgcttttgggcatagtctgccaggtcagcacgtggatgtatttttctccccacagctctgtgcaaaagc

SEQ ID NO: 17381 - DNA, 73 bp, Homo sapiens
tgggctgtctgcacgtgcagtggcctgtcagcacttgggaggggccacatgtgcaatgtctttactgaagttg

SEQ ID NO: 17382 - DNA, 74 bp, Homo sapiens
aggatcagagctgcaactcataattcaatcttattttgtagcagttctttctgactagcatatttctatctgac

SEQ ID NO: 17383 - DNA, 74 bp, Homo sapiens
gggccctcacggtcatcgatgtccacggtaagccagggggcttcccctgtcattactgactatccaggagaagc

SEQ ID NO: 17384 - DNA, 74 bp, Homo sapiens
tcgcgccccctcggcccccgcgcgccgctcgcgccctccgcgcgcccgggaccagcagccgcggcgcggcccgc

SEQ ID NO: 17385 - DNA, 73 bp, Homo sapiens
ggtgagacaggaaagctagagagggctggagttgggtattcagttcagctccggtgaaatagtttcttttcag

SEQ ID NO: 17386 - DNA, 70 bp, Homo sapiens
gtagcagattggctttaactcccagcactgctgcctgctagctgggggcccaggatatgttctttcaacc

SEQ ID NO: 17387 - DNA, 70 bp, Homo sapiens
cttgacttcctttacaagctatgcatcaagtgcagatacttcagtgacgggcacctgctaaaggagccag

SEQ ID NO: 17388 - DNA, 72 bp, Homo sapiens
cttttgcatgtggctgtccagttttcccaggactataccctggttgacaaaattgtgctttccctgttgaat

SEQ ID NO: 17389 - DNA, 74 bp, Homo sapiens
ttcatcagagctccaacagcaggcacagagaagcagcacgggcagcggggaggggaagcagtggggcctgtggg

SEQ ID NO: 17390 - DNA, 71 bp, Homo sapiens
aggagaaggcgcgcgcgcagggactccgggcagcgcgcgggagaccgggtgcgagccagggttcgccgtca

SEQ ID NO: 17391 - DNA, 73 bp, Homo sapiens
taatttcaccagggcgactacagttcctttacagactctatcagatagcggtagtagtcagcaccttgaacac

SEQ ID NO: 17392 - DNA, 70 bp, Homo sapiens
ctctgcagtgatggaattgttcttgtcttcactgctggtggtcacaggagtctacacatgtgataaaatc

SEQ ID NO: 17393 - DNA, 71 bp, Homo sapiens
aacctgggcctcagacactggggaaaggtggccatgtccagttttctcaggaaattaggaggcaggtcatc

SEQ ID NO: 17394 - DNA, 73 bp, Homo sapiens
attgaattgaggtttatcattttcctgcacatgtaagcttatccacgtggcgttttggtaggtcagttggttt

SEQ ID NO: 17395 - DNA, 74 bp, Homo sapiens
cataagcatctgatgtaaacacttgtagggcgggtcagagattctcccggggccctcccttatctgcctcctgc

SEQ ID NO: 17396 - DNA, 73 bp, Homo sapiens
aaccccagtgggagcctccataattcccaggaatccatgtccttgtcccttggcaattcgggctcctattctc

SEQ ID NO: 17397 - DNA, 74 bp, Homo sapiens
cctgacctcaggtatacctgcccacctcggcctttcaaagtgctgtgatgtaaggtatgagccaccatgcctgg

SEQ ID NO: 17398 - DNA, 74 bp, Homo sapiens
ttctatgggtgaatgaatatctgtgcagtatagcatagcagttagatagatgcataatcttcagtgtcaggcac

SEQ ID NO: 17399 - DNA, 72 bp, Homo sapiens
ttttagtctcttgactcagtttccctaatgttgcctttatctcaggcaggtcttaccatatggtcccagaga

SEQ ID NO: 17400 - DNA, 70 bp, Homo sapiens
cccacaggaaactctgtgttcctgccaggctgcgttttgtcattccaggagctctccaggcccctccctg

SEQ ID NO: 17401 - DNA, 72 bp, Homo sapiens
atattttctgatatctagctatgactcatgaagttgattccatgacccacagtgtagcatggccctcggact

SEQ ID NO: 17402 - DNA, 70 bp, Homo sapiens
atccagctgtggtggttcagtggttcctccaacacgctgatccaccccacaaccttgccataaagcctgt

SEQ ID NO: 17403 - DNA, 70 bp, Homo sapiens
ctggctcagggagttgctgaagctgcggtaagcagggttgcctgcgatgacgaggggcgtctctgtgcaa

SEQ ID NO: 17404 - DNA, 70 bp, Homo sapiens
ggcctcccaaagtgctgggattacaggcatgagccaccacgcctggcctggggccatcgatttttgaaag

SEQ ID NO: 17405 - DNA, 72 bp, Homo sapiens
atacctcccaggccccccatttgattcccagaatgctgatggctgagtttattaatacactggagatgggag

SEQ ID NO: 17406 - DNA, 71 bp, Homo sapiens
ctctgcctcccccaaggccctcctggcccctgagccagacctatgggccataccattgggacagcaggggc

SEQ ID NO: 17407 - DNA, 74 bp, Homo sapiens
gcagtgctgcaagcccagggtttgtacccacaaaaccccaaatttataactcagggtgcttgtagataccactg

SEQ ID NO: 17408 - DNA, 73 bp, Homo sapiens
tggggagggggagagggaggggacatgtggcaacagcagctcaagtgactcaggtctcgtatccgcacctcag

SEQ ID NO: 17409 - DNA, 73 bp, Homo sapiens
tgggggtgcaggagagcattagcagcctctcttccaagagacacagcccccggcacctccacccggcccagca

SEQ ID NO: 17410 - DNA, 73 bp, Homo sapiens
atgcctgaactggggaaactgaagccccatgggaccaggggttccactgggcatcaagggaggaaagttgagc

SEQ ID NO: 17411 - DNA, 73 bp, Homo sapiens
ttttccaaggcactagcatggaaagcacaggagtgtccctgtcctccaggagccagttcacagcataggaagg

SEQ ID NO: 17412 - DNA, 70 bp, Homo sapiens
gcagcacagccctgcttctgcccaaggcgagggccacggccacacggggggcctacaagaacatctgtgc

SEQ ID NO: 17413 - DNA, 72 bp, Homo sapiens
tcccgccccctccccgcccccggagccgcggcctcgctgagtgcccagccgcccggcgcccaggcctggggc

SEQ ID NO: 17414 - DNA, 70 bp, Homo sapiens
gtggatttcatttctgccttttacttcttctttctttggaggcagaaattgggcataaaacaatatgagg

SEQ ID NO: 17415 - DNA, 74 bp, Homo sapiens
gctgtttgagaggccccggccgcccccgtttctgggccctagcccaccagatcgctgtgctggcttcctggagc

SEQ ID NO: 17416 - DNA, 72 bp, Homo sapiens
tcaccttggcctcccaaagtgctgacctaaactggcccagtctgggtccagtttagggaggaagaaacaggc

SEQ ID NO: 17417 - DNA, 70 bp, Homo sapiens
ttctgagcagcaggtctccagagtgggcttaaaacactcagtctttggccgggcacggtggctcacgcct

SEQ ID NO: 17418 - DNA, 70 bp, Homo sapiens
cccaggctagagtacagtgtatggtggcatgatcatagctcactgcaacctcgaccccttgggtgcaagt

SEQ ID NO: 17419 - DNA, 74 bp, Homo sapiens
caattttggagcttgcctgccctgcatcagtagaatgggctaactacttatggtgcactcaggctaaagaggct

SEQ ID NO: 17420 - DNA, 74 bp, Homo sapiens
ttcaccgatttaatgggagccttagtgaaggggaatgatccctcccaaagtctcaggatcattgtgaagatgaa

SEQ ID NO: 17421 - DNA, 72 bp, Homo sapiens
ctggccaacatggtgaaatcccatctctactaaaaatacaaaaattagctggacatcatggtgggtgcctgt

SEQ ID NO: 17422 - DNA, 73 bp, Homo sapiens
gtcttcataatattccatgagggaggctgtttcccacagtggtgcagcctttccatgctggtgaagattgaca

SEQ ID NO: 17423 - DNA, 73 bp, Homo sapiens
cctgaataaatcgcagggggctcattgaatctgcacaatctgattcagcaggcctgagattctgcttttgtaa

SEQ ID NO: 17424 - DNA, 71 bp, Homo sapiens
ctggggcccggtctgtagcttccacgtcggggaagggcgtcgccgccgcttcctcggacccgtcccccacc

SEQ ID NO: 17425 - DNA, 74 bp, Homo sapiens
agcaagtccagttggcccaggatagggagttggggaaagtaacttgccctttaaatttatactgtcctctccag

SEQ ID NO: 17426 - DNA, 73 bp, Homo sapiens
tgtattttgactctctaaaaaaagtacttggtggcatattaaagaatgagtcattgagtttacaaaacacaag

SEQ ID NO: 17427 - DNA, 74 bp, Homo sapiens
ggacagggaatcagagctttttgtggctgccttacccagccagggcagcaccagagagaatcgtggctgaggct

SEQ ID NO: 17428 - DNA, 73 bp, Homo sapiens
agcagaccttctttgttcaagtccctgttcaggtgccacttgtggctgtcagttcaggactgaagaagaagga

SEQ ID NO: 17429 - DNA, 71 bp, Homo sapiens
aaggctcattaatccaagattactggaagcagatgatcctctttctgaaggttaatggtagcctaacacta

SEQ ID NO: 17430 - DNA, 70 bp, Homo sapiens
caaggtgctgattgctggtaaagtggtggggctctctagaggtccacttccgatctcatctagggtacca

SEQ ID NO: 17431 - DNA, 72 bp, Homo sapiens
aacagagagcctccggatatgcggacgccaagtgcagaggagggccatgtaccaaaccagacccagaggact

SEQ ID NO: 17432 - DNA, 72 bp, Homo sapiens
atgctgtgggttggggcttgctatctctgagatccagaccatggctgagtcaaactcattatgaaccattta

SEQ ID NO: 17433 - DNA, 73 bp, Homo sapiens
ccaggcttactactatattgcccagtaccctcgccctattggtgtgactttgggtgagagctttaacctctat

SEQ ID NO: 17434 - DNA, 72 bp, Homo sapiens
tggacgatgttccagacacaggactaagcacttggcaggactgcactctgataacttgcccaggattgcact

SEQ ID NO: 17435 - DNA, 70 bp, Homo sapiens
tttgggctcctgaggactgtggtaagaagtttaaattttattctagtgtgaatgtggtggccatgagaat

SEQ ID NO: 17436 - DNA, 72 bp, Homo sapiens
gttggatcctcagctatgctggcgtttgtctaccaagagtagtctgtgtgccacccttgtctctgctgacag

SEQ ID NO: 17437 - DNA, 70 bp, Homo sapiens
atggtgagtctcacattgaactcagaagtaagccacacctggcctatttctagattaatgagttttcatt

SEQ ID NO: 17438 - DNA, 70 bp, Homo sapiens
gcataccccaaatctggcagcactcggactcctgaggacagcaagggaaaatgccatgcctgggctcggc

SEQ ID NO: 17439 - DNA, 72 bp, Homo sapiens
gtggtgtggtggggtcagtggtgtggtgggcagtggcttagagaggtcagtggtgggtgggaaggccgtgtg

SEQ ID NO: 17440 - DNA, 73 bp, Homo sapiens
tcaggcatagaccaagtatgaaggtggcagtcaagggccgcccactctctccctggcttgtcctccccactgg

SEQ ID NO: 17441 - DNA, 73 bp, Homo sapiens
tttagatatgaaccaactgatcagtgctcagcagtgaggaggacagcatgctgggctcatcctgcctggccct

SEQ ID NO: 17442 - DNA, 71 bp, Homo sapiens
tccagcaggatccaaaatggcctttgtggagtttaatgggcatctaggctgtggtccttctaaaagtagcc

SEQ ID NO: 17443 - DNA, 72 bp, Homo sapiens
ccaggctttggctcagtcaattcccatttgcagcaaaggatgcttgagtaccacaaggcacaatgttcccct

SEQ ID NO: 17444 - DNA, 74 bp, Homo sapiens
atggtatcttcacggtagaggcatgtcccggcagagatagatgaataagactctgggatctccactgccatcat

SEQ ID NO: 17445 - DNA, 73 bp, Homo sapiens
cacagtttaaaagggaggcagacgactgatgggaaaccacagttcagcagggtgagcactcagatagaggaca

SEQ ID NO: 17446 - DNA, 73 bp, Homo sapiens
agactaaatgttgcccagaatcagtgttgggttatcagtttatattaaatatactgagttgcccgttttgaaa

SEQ ID NO: 17447 - DNA, 73 bp, Homo sapiens
tctaagactggggacattcacatgtaactgctaatggttacaggtttccttttttttttcttttagagacagg

SEQ ID NO: 17448 - DNA, 71 bp, Homo sapiens
ctcaaatgctttttctgcatctaatgagatgaccatctggtttttgtccttcatgtagaatgtaatttcaa

SEQ ID NO: 17449 - DNA, 72 bp, Homo sapiens
aatttattagcataaagtttataacatccccttattatccttttaattggtatgttgaaacttctgtgtgta

SEQ ID NO: 17450 - DNA, 71 bp, Homo sapiens
gcacaggtaaactcttaagaggctggctaatgccaggtgatactctcagcttgtgaaatctcagcctttta

SEQ ID NO: 17451 - DNA, 73 bp, Homo sapiens
cgggcgaggccgcccacccccgcggatcccgcgcgcggggcggggcggggcaggggcgggagccggagcgccg

SEQ ID NO: 17452 - DNA, 72 bp, Homo sapiens
tgcagtttacaggttgagtgacatagggaaagctacgtaatctcttggaacctcagtttgctcatctgtaag

SEQ ID NO: 17453 - DNA, 70 bp, Homo sapiens
taggattggcaggattagcttatgtccatgatgttctatcacctggaaggggttgtgttgccttctagaa

SEQ ID NO: 17454 - DNA, 70 bp, Homo sapiens
ggctctatcgggcccacaaaaatgtcataaaaacccctgtagttcaggtatggctggtgtggtgcactgg

SEQ ID NO: 17455 - DNA, 74 bp, Homo sapiens
ggcttgggattctgtcacttggagctgtgtggtgaccttatgcagtgtttatggggtttacacagtggttgtca

SEQ ID NO: 17456 - DNA, 73 bp, Homo sapiens
tataaacatccaggtgaatagagtggcctccatggagaggcatgttctgtgtgttttcttgccctgagaacta

SEQ ID NO: 17457 - DNA, 73 bp, Homo sapiens
gctcaacagatggtagctgtttttattcctactattgttattaagaagaatgaagcactgtactcatctgggt

SEQ ID NO: 17458 - DNA, 71 bp, Homo sapiens
tggggcagggcagctcaactgatgggggcctggacccccccactgctcccgaggaccctcctccccaccag

SEQ ID NO: 17459 - DNA, 73 bp, Homo sapiens
agtttatcatcgaggaatgggggcccttaatcatagatgtcatgacactaagtgcagaattatgggtctccat

SEQ ID NO: 17460 - DNA, 72 bp, Homo sapiens
tttccttttatggctggaaggtcccagaacctatgagctaaggggctgttttctgaccttctcatggccttg

SEQ ID NO: 17461 - DNA, 73 bp, Homo sapiens
tgtaaatgccttgtaatggtgatgactgcccttcctgggctcattgtctctgggaccaagaggccaacaaatg

SEQ ID NO: 17462 - DNA, 74 bp, Homo sapiens
gagcctgcccaatgtcacggagccctcgcctgctactaagcagcacgtaggcgcgctctgagggagtcctcagc

SEQ ID NO: 17463 - DNA, 73 bp, Homo sapiens
caaactgcaatgcgacatttgtgagccccagtttagagactgggaagtgaaggctcagagaggaagtgacttc

SEQ ID NO: 17464 - DNA, 73 bp, Homo sapiens
aagacagtcgtattcacagaggctttccctgaagtatcagagggtcattacatctgtgacatgaaagaaaatc

SEQ ID NO: 17465 - DNA, 74 bp, Homo sapiens
gggaggggtaagcatcttgcaagaagtccataccttattgtgaattagcttatcagatagatgccaacccacac

SEQ ID NO: 17466 - DNA, 74 bp, Homo sapiens
cagaggccccacccactgacctataggccatcacaagggccaccagctggtggtagagttctagggagcgaacc

SEQ ID NO: 17467 - DNA, 70 bp, Homo sapiens
tggccacacctgagacaagtccgctgttggaaacaaaaaaggaatcagtgggcatttaagcccttcctcc

SEQ ID NO: 17468 - DNA, 71 bp, Homo sapiens
aatgtgggaccagcgcagagggacctgcccaaggtcaggtagtggtgagtgctggagccagcgctggaagc

SEQ ID NO: 17469 - DNA, 70 bp, Homo sapiens
tgtaacagctaacatcccatatcctgactaatgcactaatcgtatgcatgtcagaggctattatggcaaa

SEQ ID NO: 17470 - DNA, 71 bp, Homo sapiens
gcacaacgatgtaacatcatcttcttactacaaaaatggtgagaagagtttaatgagcatatctggaaact

SEQ ID NO: 17471 - DNA, 73 bp, Homo sapiens
gtttttagcttatcaagtgagacaaagttatcaaaatatcttgttgctttgcaacttgctaagcctgttttgt

SEQ ID NO: 17472 - DNA, 72 bp, Homo sapiens
aaatttgaaacttttctctaattaggatggctactagtaatatatatatatactactagtagtatgtgtata

SEQ ID NO: 17473 - DNA, 73 bp, Homo sapiens
gtttagcatgggtctagcaaagagcaggtgctcaatcagtgttagccctacagtagcaacaggtttttagaaa

SEQ ID NO: 17474 - DNA, 71 bp, Homo sapiens
tgtgtatatatgtatacatatatacacgcatacatatatacgtgtctatatgcatacatatgtacgtgtct

SEQ ID NO: 17475 - DNA, 73 bp, Homo sapiens
cttggccagtgggacatcagcaaacatgttataagcagaggcttgaaaggtccttgtgcattgtatctgccct

SEQ ID NO: 17476 - DNA, 74 bp, Homo sapiens
catagaatcaactcatattgctttttgattccggagataccagagtattcatgtattgaaaagtaattccaagt

SEQ ID NO: 17477 - DNA, 72 bp, Homo sapiens
gagtgtagtggtgcatgacagtaatccaggcactttgggaagccaaggtgtgaggatgacttgagcccaaga

SEQ ID NO: 17478 - DNA, 73 bp, Homo sapiens
ctaattctttgcttaggctgatatctgtagaagtgttctgatgttgtcttctagaatttttatagtttcaggt

SEQ ID NO: 17479 - DNA, 72 bp, Homo sapiens
cccaaccagaaacagggtattattaaacgctgtgtccttcctagattcaagtaattatcctatctggtctat

SEQ ID NO: 17480 - DNA, 70 bp, Homo sapiens
gagaacaagactttctggagttgacgatgagagacttttatcagagtccagttttcccagtcaaggcttt

SEQ ID NO: 17481 - DNA, 71 bp, Homo sapiens
gacaacttctgagggtgatagatcattattttgattgtggtgatggtcttgcagatgtatatttatgttaa

SEQ ID NO: 17482 - DNA, 74 bp, Homo sapiens
gaagtacatttctgcacatatgcataggatttttcagagagaaaatagcctgtcataagtgggattatttagtc

SEQ ID NO: 17483 - DNA, 72 bp, Homo sapiens
tgaggaagcagcctgtcccatacccctttcccccggacacacctcttattctcattctgcttctcaagtggt

SEQ ID NO: 17484 - DNA, 73 bp, Homo sapiens
ttgtgtaaggaaggggtccagtttcaaacttctgaaaatggctagccatttatcccagcaccatttattgaat

SEQ ID NO: 17485 - DNA, 74 bp, Homo sapiens
caggtcataagtttgccaggaaaacaattattgttgtttatcatttaccactgtctggtaaatgtgctgtgctt

SEQ ID NO: 17486 - DNA, 72 bp, Homo sapiens
tccgaatagcttatcagaccaaggggcctgagatgagaactggggaacatgtgcaggagctgaggtggggta

SEQ ID NO: 17487 - DNA, 71 bp, Homo sapiens
taggactttgtatcaggtcactttatcatgcacagtgtcagggagcagatctgttattcacagggactatt

SEQ ID NO: 17488 - DNA, 73 bp, Homo sapiens
tgtgtgtgcttgtgtgtgtgtgcttgcgtatgtgtatgtatatacatacatatatacaatattaaattttata

SEQ ID NO: 17489 - DNA, 70 bp, Homo sapiens
caacagaccaaggcagggagtgtctacttcatttccctcccatctagtttctactctacctgctgggata

SEQ ID NO: 17490 - DNA, 74 bp, Homo sapiens
cggggcctgaggagccggcgccccgcctcgccccgcccctccccgaggcccgcggcgccgccgcctccacctcg

SEQ ID NO: 17491 - DNA, 72 bp, Homo sapiens
aattaacgaagtttgaggtcatcaccaccacctaaattggaaccaggactagggtcttgttgtcttcttgcc

SEQ ID NO: 17492 - DNA, 72 bp, Homo sapiens
agaactggaggctgctgcaggctcagcaaggaagatgctggtggtctgggctggggtggagcaggaagaatg

SEQ ID NO: 17493 - DNA, 74 bp, Homo sapiens
aggggttggctcacagggagggtaaggaccctgggcctcaggcccctcctgacccacctctcccccagcaagtc

SEQ ID NO: 17494 - DNA, 70 bp, Homo sapiens
ggtcttcctacgactcttagcaggtgacagtaatttgtggcacttccaaaggcagctgtggggctggggc

SEQ ID NO: 17495 - DNA, 70 bp, Homo sapiens
cctgggagctggtctggagagagaaacacagtctggacaagagaaacgctcatcagacaccaccaataaa

SEQ ID NO: 17496 - DNA, 73 bp, Homo sapiens
atgctttggctttccacgtggattacttacttcatcaataaaatttccaatttcatcgggattggcagggcgg

SEQ ID NO: 17497 - DNA, 73 bp, Homo sapiens
tcttgtgctgacccagaaattaccccattttcaagtcacaaaggaattatcaagtgtgatgggcccatggtca

SEQ ID NO: 17498 - DNA, 74 bp, Homo sapiens
gtggagtgggggcgcggtgccggagaccggttcgttcgggcgcggtctccagtcctctttttgccctcagcatt

SEQ ID NO: 17499 - DNA, 73 bp, Homo sapiens
gatgtctgccctgttgccaccgtcattgctaggcagctgctgccaccaggatagtattgcctgggggccaggg

SEQ ID NO: 17500 - DNA, 70 bp, Homo sapiens
ccattcacactctaccagagtgagtctagtctgtatgaccaagagcatatggtggaagtgataatgtgtc

SEQ ID NO: 17501 - DNA, 74 bp, Homo sapiens
tgagttgggagtcttcagcaggagtggggtaatcacactcaaaggtggcagagatcttactggctgctgtgaga

SEQ ID NO: 17502 - DNA, 70 bp, Homo sapiens
ggcggggctttgtcatattgcccaggctggtcttgacctcctgagctcaagcgatctgcctgcctcagcc

SEQ ID NO: 17503 - DNA, 74 bp, Homo sapiens
ttgcttgaacctggaaggcagaggttgcagtgagccgagatcacaccactgcagcataggcaacagagcaagac

SEQ ID NO: 17504 - DNA, 71 bp, Homo sapiens
gtttaagacctatgaattgacactgaaggatgtccagaacatcctcatgtactgggaccggaagcaaggag

SEQ ID NO: 17505 - DNA, 73 bp, Homo sapiens
gggctggcccagtgccttctctagcagcatggtctagctatgccacgtgagaaggggaagccaactaaagaca

SEQ ID NO: 17506 - DNA, 70 bp, Homo sapiens
tctggtgggagggttttcaagtgacccactttgccatactgtgggtagcagcactgccatattgccagtt

SEQ ID NO: 17507 - DNA, 73 bp, Homo sapiens
ccaaacaagagaagagccgaaccatccatagaggatggtgcaacaaagcagcagccaaaatcagtgttggaga

SEQ ID NO: 17508 - DNA, 73 bp, Homo sapiens
tcccccagtgcctctcagatgctggtccccagcctggtggcagcagcaacagcatcaccaacacatcgggaac

SEQ ID NO: 17509 - DNA, 71 bp, Homo sapiens
tcctcagatgttggtattgaacttcgttaccggagtgctcagggaatacactccgaccttccaatgcctca

SEQ ID NO: 17510 - DNA, 71 bp, Homo sapiens
actctctaggatgccggagcggtcttctcagtggttgtgtggttttactcccgggaggagtttccacccgg

SEQ ID NO: 17511 - DNA, 73 bp, Homo sapiens
aaaagtttacctagtggaggtactgtgctttgtgtgttggaggatgaaagtacggagtgatccatcggctaag

SEQ ID NO: 17512 - DNA, 73 bp, Homo sapiens
tggcaactgttcagttatggaacctgctgcgtcatagccccaggctgcgggtcatcagcaggacactgagccg

SEQ ID NO: 17513 - DNA, 70 bp, Homo sapiens
ctttagcgatagtctcttcatatcagtaggaactgaatagagccatattcagtgagacaataagctagtc

SEQ ID NO: 17514 - DNA, 72 bp, Homo sapiens
tctggagtcacactgaccctgtgggattatggtcacacacatcagacgtgtgaccctgggactttcggttga

SEQ ID NO: 17515 - DNA, 71 bp, Homo sapiens
ctggccttacagcctggagagtcttttcctcgggcacaataatgaaccatgcaagtgttagaaatataatc

SEQ ID NO: 17516 - DNA, 74 bp, Homo sapiens
tgggggccgggagcggcgggggcgggggcactcggcaccgcggacccccccatactccccccaccgccggccgc

SEQ ID NO: 17517 - DNA, 72 bp, Homo sapiens
tagggctgctttggcgctacaatggcagaatggagagttgctacggagaccatcagacccgcaaaactgaaa

SEQ ID NO: 17518 - DNA, 72 bp, Homo sapiens
cctttctagatctcactgaatctctgaaaaggggaagtggtgttttctaagaaagtgtgatgatctacttct

SEQ ID NO: 17519 - DNA, 70 bp, Homo sapiens
ttttttttttttgaaatgtagtctcgctattgttgcccaggctagagtgcagtggcgtgatctcagctaa

SEQ ID NO: 17520 - DNA, 72 bp, Homo sapiens
taataattgtgggtctgccagagtatgaataattcatctaccagggagaattttcactgtaactcctacagt

SEQ ID NO: 17521 - DNA, 70 bp, Homo sapiens
atggtaattctgtgtttaacttttggagggaaccaccaaactatttccacagtggctaaaccttttatac

SEQ ID NO: 17522 - DNA, 73 bp, Homo sapiens
ccaaagtgcttgaattataggcgtgagccagcacactgcctggcctttcaaataggattctttactattaatt

SEQ ID NO: 17523 - DNA, 70 bp, Homo sapiens
ctattcctgcctatttttaatgcatgtatgtaaccataaggttaatgcatatgtgcaaccaacaaggtta

SEQ ID NO: 17524 - DNA, 71 bp, Homo sapiens
acctcacttggagaaccactggtctagtttgtaacagattgacagactactgcttcattctacatgtcggt

SEQ ID NO: 17525 - DNA, 71 bp, Homo sapiens
aggctgaggcttattgtgttgactgagtggtcaccatggttgctgcctcccaagagaacatggtcacttcc

SEQ ID NO: 17526 - DNA, 71 bp, Homo sapiens
gtagggcagaccattaggaagaactgaaactgctctccatggtgatatttttttcttcttcaggaagcctc

SEQ ID NO: 17527 - DNA, 71 bp, Homo sapiens
tgggaatgtaaattggtagaaccacttcagaaaactgacattttctaccgaagctgaatttgcacatgcta

SEQ ID NO: 17528 - DNA, 72 bp, Homo sapiens
gcctcgggttcccaaagtgctgggattacaggcgtgagcccccgtgtccagcccttttgatggcttttctat

SEQ ID NO: 17529 - DNA, 70 bp, Homo sapiens
caatagtcgttttttgttggagagaggcgactgaagtccagttttcccaaggagtcgttaatatctgtaa

SEQ ID NO: 17530 - DNA, 73 bp, Homo sapiens
ggctcatgcctggaatcccaccacactttggaaggccaaggcaggtggatcacctgaggtcaggagtttgaga

SEQ ID NO: 17531 - DNA, 70 bp, Homo sapiens
caccattagacctcagtggcccgcagcaataaacattcgattctcgccatctctgggtttgaggtgacct

SEQ ID NO: 17532 - DNA, 74 bp, Homo sapiens
ctctgcccttagggccatggtttcccctctgctggcagcatcgggtccatgtccctggaaggttcccatctcta

SEQ ID NO: 17533 - DNA, 73 bp, Homo sapiens
actgaactgtcgtgccagtttaatccaagttggaaacgtgaagtgaatttcagtggagccagagggtgtgagg

SEQ ID NO: 17534 - DNA, 72 bp, Homo sapiens
gaactgcagagggtaatgctaggtggtctggaagagaaaataggcagagtgtttcccattcatctctaaggt

SEQ ID NO: 17535 - DNA, 70 bp, Homo sapiens
aggaagtcagtctgcatctctactggtactttttttactcttctagtaaaaaatcactgtgatgctgatg

SEQ ID NO: 17536 - DNA, 74 bp, Homo sapiens
gctgaatcaccctggagaatctttcttcctatgaccaggttacccgggagtttcagcttgattgcattaggaaa

SEQ ID NO: 17537 - DNA, 74 bp, Homo sapiens
tggatgacacaggaggggctggggcggagggtcagagctctgcacgcctggtcccctttcccttgcgtccctga

SEQ ID NO: 17538 - DNA, 73 bp, Homo sapiens
atgggtggaggggaggagggcgggtgcctgaggcagggtcctgaccttcaggggctgggtgacgaacatgctc

SEQ ID NO: 17539 - DNA, 73 bp, Homo sapiens
tcctgacctcaagtgatctgcccaccttggcctcccaaagtgctgcaattgcagacgtgagccactacaccca

SEQ ID NO: 17540 - DNA, 72 bp, Homo sapiens
gccacttttgatggggcagagacaccgtggcctgttgctcacacctggctcagcctgacaggctttcccgaa

SEQ ID NO: 17541 - DNA, 74 bp, Homo sapiens
aaactcagctttggcaacacaccctcatggtcagctcagagaggactggcatccccgggttatgtagagagagc

SEQ ID NO: 17542 - DNA, 65 bp, Homo sapiens
ttccttccatctccatcaccttgagcatcttctgggcagctgaggtgaccgcagatgggaaggaa

SEQ ID NO: 17543 - DNA, 74 bp, Homo sapiens
tggtgtgtgtgtgtgaatgtgtgcacatgggtatgcaaatgcatgtgtgcactgtacacatacatgtgactgtg

SEQ ID NO: 17544 - DNA, 71 bp, Homo sapiens
tgtggggaggaaagttgttgggaaaatacagttatcaggcccaaattgtgttgagctccccgaagatggaa

SEQ ID NO: 17545 - DNA, 73 bp, Homo sapiens
agtgtaggatttcgttttgtcaatctccaaccctaacacccaaggaggcagagaataagagcaatatacactt

SEQ ID NO: 17546 - DNA, 74 bp, Homo sapiens
cctggtggggggtgtttgggtcatggaggtggattctctcacgaatagcttggtgctgtccttgtgataatcag

SEQ ID NO: 17547 - DNA, 72 bp, Homo sapiens
tggccactgcaggaaggttagagtcagagaaggggaatctatttcagcagccttgtacagggcagaaattgt

SEQ ID NO: 17548 - DNA, 70 bp, Homo sapiens
aattgcccagcagtcaagttttctcttcatgctagtagcagcacatcatagcggttgacgatatgggctc

SEQ ID NO: 17549 - DNA, 70 bp, Homo sapiens
gtgcatccttttttcttcttatcaggactcatgcaatcacattgggtcctcccagataatccagaataat

SEQ ID NO: 17550 - DNA, 70 bp, Homo sapiens
gtatggcaagttgttggactgtcaggatatgccctgggtagggtatgaatatatgtgatttctcttgcca

SEQ ID NO: 17551 - DNA, 71 bp, Homo sapiens
gctcaggaagccagaacctgaatctcttcgaggaagttctacagctgacttttaatcattgggccatagca

SEQ ID NO: 17552 - DNA, 72 bp, Homo sapiens
tctataaaataatgaaccatgcataattgcagcagagttaccaaggaaggctgtaaggatgatctcactggt

SEQ ID NO: 17553 - DNA, 73 bp, Homo sapiens
agaagtgacagaggacaagtttaaaggactgcacatatgcaagcttgcatgcttgactagttgcatgtttgac

SEQ ID NO: 17554 - DNA, 72 bp, Homo sapiens
ttgctggcccatgtcacctgttcctgctttgtgacagagacactctttagtgtgggaactgaatatgcaaat

SEQ ID NO: 17555 - DNA, 71 bp, Homo sapiens
gggatctgaggttcagccaggaggaggggtgatgtttgagaggccctcccatagctgtgcttcagtctcac

SEQ ID NO: 17556 - DNA, 73 bp, Homo sapiens
agtgggtcatgcctggctaagacccctgcccttgattggcttaggtatcagcacatcatgcaacactggcccg

SEQ ID NO: 17557 - DNA, 72 bp, Homo sapiens
gactgtcaaatctctgaaaaggggctcgcaggaacagtggaagatgcagatgtggagcccctgaatgaggga

SEQ ID NO: 17558 - DNA, 70 bp, Homo sapiens
ggacaggcttatctattctgtggagccaaacctccatagtttttattttcataacaccaacctgtgtggg

SEQ ID NO: 17559 - DNA, 72 bp, Homo sapiens
cataggccctggtagtctagtggcccattgcacagcctggtagcctgaggcccaggcgtgctgggacctgac

SEQ ID NO: 17560 - DNA, 74 bp, Homo sapiens
gggtcggcacattccacttggggattatcttcatggtccagtgcctttgagttaggagttctccaagacgtgcc

SEQ ID NO: 17561 - DNA, 71 bp, Homo sapiens
atggttagggaacagaatcgctgcccagtggcctttctgcaccgcatcccattgccagggaatacagagca

SEQ ID NO: 17562 - DNA, 72 bp, Homo sapiens
gggtctgcttgtggggggccgggcataagcccagccatgctgtcttgggactctggagccagacacaattgg

SEQ ID NO: 17563 - DNA, 70 bp, Homo sapiens
cctggaggacatttcttgcgctggctctttaagagtctatgccggtgcttccagcagatgtccaggttct

SEQ ID NO: 17564 - DNA, 72 bp, Homo sapiens
ggccagaactagtcctatgagccttcctagcaagggggctgggctgtgcaccgattgtgtggctggagggta

SEQ ID NO: 17565 - DNA, 71 bp, Homo sapiens
acagattgggtggggagctcagtcaagtcagggtggactgggcaaggtggctctgcccaaggtgcaagccc

SEQ ID NO: 17566 - DNA, 73 bp, Homo sapiens
tctcctggaagccagcgcgacctcctcgacttccgcatagtgctggaggggcaggcaggaggctgtgaagctc

SEQ ID NO: 17567 - DNA, 70 bp, Homo sapiens
catcccactgagagagtcagccagggacccaggcaaacacacgttcccaaggtgccaaccacaggctcgg

SEQ ID NO: 17568 - DNA, 74 bp, Homo sapiens
tccagggttcgcccctgcatgtctcggtggttgactccagatggctagcacacagagacaagcagggctttctt

SEQ ID NO: 17569 - DNA, 70 bp, Homo sapiens
cagactaactctgcgtgccatgtggtggctgtgtcatccgtggaggctgctaatgaagctctttctataa

SEQ ID NO: 17570 - DNA, 72 bp, Homo sapiens
gcccagcacattctaatgagaaaggtgacaccacctacccctctatcattcacgagcttaggacagctgggt

SEQ ID NO: 17571 - DNA, 72 bp, Homo sapiens
agccagagaattaatcattctcacccattcctccctcgctgtgatgagtgatggggaggagacaaaaggaga

SEQ ID NO: 17572 - DNA, 70 bp, Homo sapiens
tgggtgcctcctatgaattggcagcgctctattcaggagcccaaaattaacccagtaaatcatggcctca

SEQ ID NO: 17573 - DNA, 72 bp, Homo sapiens
cgctgtacgtcaacactgggcggggatggtgactagagctgagaatgcaagcagcgcctcacctctgcccat

SEQ ID NO: 17574 - DNA, 70 bp, Homo sapiens
tttgcaggtttggaggaaagaccccgtggagcttggtggtctctgccattgcttgtagcccagcagtctg

SEQ ID NO: 17575 - DNA, 73 bp, Homo sapiens
gaggcttcctgtcagatattccagccgacagctcgtgctgaagcgcaggctctggtgtcgctagccttcccca

SEQ ID NO: 17576 - DNA, 73 bp, Homo sapiens
gtggctgtcttcttggcccggcaccttcaccacaatggtgttctgccgacgcccaggcacagcgctaaacggg

SEQ ID NO: 17577 - DNA, 74 bp, Homo sapiens
tcagccgcgacagccgtgtgatgatgtcagtgctcacctgacgctcacgtcttcacagcggggcagctgcgggc

SEQ ID NO: 17578 - DNA, 73 bp, Homo sapiens
gcgggtcggccgtgatgcctcacacccaagtgctgcctcgagcatgcgtctcctgggtgagggtgtctgagcc

SEQ ID NO: 17579 - DNA, 72 bp, Homo sapiens
ctggggggctctgggctgtgggggcctgtttttgtgacttaaagctctcccagcacagccccctgacctcct

SEQ ID NO: 17580 - DNA, 70 bp, Homo sapiens
gcccaggggcgtctccatcctgtagaaagggttttcccctcctcctcggcgcacacaggccccgccaggt

SEQ ID NO: 17581 - DNA, 74 bp, Homo sapiens
tgctctctgaggtccgatggagggcatcgttctgggagcttccctgacccctgggtgtcccgcgcctgccctct

SEQ ID NO: 17582 - DNA, 71 bp, Homo sapiens
cacccgctcccatctcagcagcacactgtgacccaaacacgggctgtgggttcagagacctgggttccgga

SEQ ID NO: 17583 - DNA, 73 bp, Homo sapiens
cgtatggcctcgctgattctccgcgcagccgctcattctggtgcagctgccgcgccgccctccaggcgctggg

SEQ ID NO: 17584 - DNA, 72 bp, Homo sapiens
ccccatcttctgcctttggctgaaaattctgggaactcccagcctcggtgtcactcaacgtgggcagcaatg

SEQ ID NO: 17585 - DNA, 70 bp, Homo sapiens
tgtaactctcggggccatatattatggagatggctgtgtgtaattttacagcatccttgatggagccttt

SEQ ID NO: 17586 - DNA, 74 bp, Homo sapiens
gactccggcagtgtcttagctgtgtggccatggctcagggtctttcgtgaggctgcagttaggatggcagtggg

SEQ ID NO: 17587 - DNA, 74 bp, Homo sapiens
tgcctgacaggaggaagcagcaaacacacagcagccaccaaggccaccccatctctgaagagctgctgcaaggc

SEQ ID NO: 17588 - DNA, 73 bp, Homo sapiens
ctgggctctcaccctgccattctgagcattctatggtcaatatttgaggttactactggttacgggacccaaa

SEQ ID NO: 17589 - DNA, 71 bp, Homo sapiens
ccccgcccccttttaaggtcaggccccaccccctttaaaactcaggccccgccctcttttaaaagtccggc

SEQ ID NO: 17590 - DNA, 74 bp, Homo sapiens
ccggagccccgcccagcgcctgcctcgctccgcccccgcccccggagccccgcccagcgcctgccacgctccgc

SEQ ID NO: 17591 - DNA, 74 bp, Homo sapiens
ctctgagctggggtcgctccgacgtttgcgggacagcccccttcggcacctgctccgcggcggcctcccaggca

SEQ ID NO: 17592 - DNA, 74 bp, Homo sapiens
ggacaactacagagactgttactttacgtgtcgtaatggataaaatggagcaggatgtcaggtcaggactgtgg

SEQ ID NO: 17593 - DNA, 72 bp, Homo sapiens
gaggccgtggcagtgtccactcaagggatgctagtaggatgtggccaggatgaaaagaagcagacggacatg

SEQ ID NO: 17594 - DNA, 71 bp, Homo sapiens
gacacacagcagctgtcaacaccttccacccccacaggcgcaacctggtggaggaggtgaatgctgcccac

SEQ ID NO: 17595 - DNA, 71 bp, Homo sapiens
attttgaggcctggagcttgctactcactccgcgtgtaatgctctgtccagttttcccaaagctgactcct

SEQ ID NO: 17596 - DNA, 73 bp, Homo sapiens
tagagatcttgaatcagtagcttagggtgggatctagaaatcttttttctgtcaaatatcccaagtgactgat

SEQ ID NO: 17597 - DNA, 71 bp, Homo sapiens
tgcaaagtgccagaatataaagaattggcttagaatagcacctcgactttagctgggctttttcttttccc

SEQ ID NO: 17598 - DNA, 74 bp, Homo sapiens
ctgtggaatccaagatgtctgcaacatgctccccaccgcccacacagtctagttgggaagcagttatgtccacg

SEQ ID NO: 17599 - DNA, 70 bp, Homo sapiens
tgcctctaagtgatgatgtataactctgatgagggcaggcaccttatgcaagcgccgtactgcaggcaga

SEQ ID NO: 17600 - DNA, 73 bp, Homo sapiens
ggagttcatggccctctgggcgtggcaggggtgagtgtgacacttggtcctgtgcccaagggtcagcctggcc

SEQ ID NO: 17601 - DNA, 72 bp, Homo sapiens
ggtgtcaggctgggaaggtaggattagcgtttattcatcaagcatttattgatgtttattctatctaatagt

SEQ ID NO: 17602 - DNA, 70 bp, Homo sapiens
tgactgagttgggttaaattgccaggccaggcacagtggctcatgtctgtaatcccagcatttcgggagg

SEQ ID NO: 17603 - DNA, 72 bp, Homo sapiens
tgggtttttctacaataaagtgaattccaacagttggcatttgccacagtagagaccactaaccattcccta

SEQ ID NO: 17604 - DNA, 74 bp, Homo sapiens
aggtcatgaccatacttaactgtattaagatgaaccatattactgcatataataatgtcaaggcctcagcagta

SEQ ID NO: 17605 - DNA, 73 bp, Homo sapiens
ataaggaccacttgctcgtattacagataaaatgcagcttgaccaatctatccacctggctgtggtggttcct

SEQ ID NO: 17606 - DNA, 73 bp, Homo sapiens
gctggtatagacacctgatgactgtggctaaccaagaaatgaatgaaagatttagaagtctgtatgggttccg

SEQ ID NO: 17607 - DNA, 74 bp, Homo sapiens
ctgccactaccaaccaagctcccactcacagcaccagtgaatgaagagagctggccacatcagcacaagagcca

SEQ ID NO: 17608 - DNA, 73 bp, Homo sapiens
gttgtcttagtctgttttctgttgctattgctataacagaataccacagactgggtgatttatttttctaaaa

SEQ ID NO: 17609 - DNA, 72 bp, Homo sapiens
gcagtgtcacagtggctactggaaggcccaggcctgtgctggggatgttgcagctgcggctgtgctgcattt

SEQ ID NO: 17610 - DNA, 73 bp, Homo sapiens
tggggtggtggggagcatagaggatgtgccttaggcatattaagaaagcttatcagacacatgtgatggttga

SEQ ID NO: 17611 - DNA, 74 bp, Homo sapiens
ggcggccgcgccccccccccaccccaccccccgcgccgccggggagggactgacgaaggaaggcgcccaacgcc

SEQ ID NO: 17612 - DNA, 72 bp, Homo sapiens
atatgctgttggtgaggctgtgggaagcaggcgccctcatagaagaggtgctggtggtcatgcaaattggca

SEQ ID NO: 17613 - DNA, 72 bp, Homo sapiens
gtggttctggcctgcacaccctaggactcccaccttgtgtgtgctcaaaggttaatgcacttgggatgaacc

SEQ ID NO: 17614 - DNA, 73 bp, Homo sapiens
gagtttgccagatggatctgtgggcaggggcgttccaggcaaaggaagcagcttgtggaaaatcacaaaggca

SEQ ID NO: 17615 - DNA, 73 bp, Homo sapiens
cactggacttagatttgagggcccagaagcagagaacacgtccgaggagcagcagctgtttccaggcccagtg

SEQ ID NO: 17616 - DNA, 70 bp, Homo sapiens
ctgcccggtcaactgggtggagcacgagcgcagctgctactggttctctcgctccgggaaggcctgggct

SEQ ID NO: 17617 - DNA, 74 bp, Homo sapiens
gaaaatttatttcatagtgtgagtgtaggtatctggatttattgaagactaaagcagatgcttttacgatgggc

SEQ ID NO: 17618 - DNA, 74 bp, Homo sapiens
gggacaccagtcttcggtgtgtggaatgtggtattttcccgcgtggaggtgtgctttctcacaacggggtgtgt

SEQ ID NO: 17619 - DNA, 70 bp, Homo sapiens
tagctccaacaccagcccctgtcccagcctctgcccccagccctgctccagcactggtcatggccctgac

SEQ ID NO: 17620 - DNA, 73 bp, Homo sapiens
tgctgaagggtaaccctggctctgtctcttgcaaccaggaaaccggagatcccctgatggctgggacctttgt

SEQ ID NO: 17621 - DNA, 73 bp, Homo sapiens
cttcaccgtcttctagttctagactcccaaagcaaaggagggggttctaggagaagagcaggaacagtctgag

SEQ ID NO: 17622 - DNA, 72 bp, Homo sapiens
aagcaacccaggggagggaaggggagccgaggtcaacgctgcgcctcggtccctaaccccctccggacaacc

SEQ ID NO: 17623 - DNA, 70 bp, Homo sapiens
cgtggtggcatgcgcctgtaatcccagctacttgggaggctgaggcaggagaatcgccaccgcgcgcggc

SEQ ID NO: 17624 - DNA, 72 bp, Homo sapiens
aggtggggaagttagggcaagaggcctgggaacctccaccccaagcctcttctcatctccccacagatggct

SEQ ID NO: 17625 - DNA, 74 bp, Homo sapiens
cttttgggggtgtagctcagtgtgtgcatgcgtgcgtgtgtgtgtgtgtgtgtgtgtgtgcgtgtgcacatgag

SEQ ID NO: 17626 - DNA, 73 bp, Homo sapiens
tttggggcggccgtggtgagtacccagcaaataaatgtaccaccactcccgcattctaaaaccagggcagaca

SEQ ID NO: 17627 - DNA, 72 bp, Homo sapiens
gtgggtacacagcttatagccctggtacagcagctgagtctgggcttgagataggcccaaatatgcaaataa

SEQ ID NO: 17628 - DNA, 74 bp, Homo sapiens
caaagctttgacctagaggaagctgagctgatggtgacaggcagttctcagaggttttagtggcttcaggcgga

SEQ ID NO: 17629 - DNA, 73 bp, Homo sapiens
tccaaactgagtagaacgaggagctgttgttttctccagattgacccccagtctggagaaaacaggaagtcct

SEQ ID NO: 17630 - DNA, 74 bp, Homo sapiens
ggcagtttttatcagggaattggcttcctggctgacaaagccattacctagctttagaatcttccaccaggcat

SEQ ID NO: 17631 - DNA, 72 bp, Homo sapiens
aagccagaagcagctgtcttcaagtgaaaatacaaactggacttggagtcaaaagatgtttgttttagctct

SEQ ID NO: 17632 - DNA, 74 bp, Homo sapiens
cttagcatcttatgtctgtgatgttaggtcaagatcaagatcatacttgatcttgatcctgctgcctgacccat

SEQ ID NO: 17633 - DNA, 72 bp, Homo sapiens
aagcatggagtagattctcaaccaaaggtagccagtgctatcagcagggataaggatccatgtctctccgta

SEQ ID NO: 17634 - DNA, 72 bp, Homo sapiens
cattcatagtctcatcacagggctatgataactctcatttcctctgacacaacatagtccaaagggactttg

SEQ ID NO: 17635 - DNA, 70 bp, Homo sapiens
acctctgtgctgcctgccctggagggagttttcggacgctggggcagctcccacacaggtctgcttaatg

SEQ ID NO: 17636 - DNA, 70 bp, Homo sapiens
accatgctgatttcctcagtgattttagggacaacatcccaaatagtaacatgagtgagtttcaccactc

SEQ ID NO: 17637 - DNA, 73 bp, Homo sapiens
caaggcaccagtttggaagtaagtccaaaaggctcatctacaggtgatgctgttgggcagagtgttagggcca

SEQ ID NO: 17638 - DNA, 72 bp, Homo sapiens
ggggtctctgccaactccaggtagttgtggcataattgaattgcaggacacatagctggtgtaaggaaaacc

SEQ ID NO: 17639 - DNA, 72 bp, Homo sapiens
agctacgtactgatccaacagtaaaagatgaaaatcttattctcctggaagtgtcttagtcagctgtggctg

SEQ ID NO: 17640 - DNA, 70 bp, Homo sapiens
gaatctccaagctggaagagacatgagaggtgatggttcaactccagcactttgcagatgaggagactgg

SEQ ID NO: 17641 - DNA, 74 bp, Homo sapiens
gcttactctatgccacaaggtgttataggtactgtgtggcacacagtgtcctgctgctgggcgtggtggctgtc

SEQ ID NO: 17642 - DNA, 72 bp, Homo sapiens
ggagcgctgatcttccgtgcatgaaaaagccagcctgaggaaaccagggaacaaatgcactatcttctttct

SEQ ID NO: 17643 - DNA, 71 bp, Homo sapiens
cagccagcccccttctgcttattgcctgtgaagtcagcgttctacctggcttagctaaagagatcagggtc

SEQ ID NO: 17644 - DNA, 70 bp, Homo sapiens
gggagaagataatgtagaggcggcggaaccagaggagctggctgcggtggcaggacatggctttctagaa

SEQ ID NO: 17645 - DNA, 70 bp, Homo sapiens
actatcagtcaggagaggttaggttttgttatgacactatcccagataaacgatgccgaccgacactggt

SEQ ID NO: 17646 - DNA, 73 bp, Homo sapiens
ttctagaagggggtgcagttgctgcttggtgtgctgtccatcccctccacaggatggcagctgcatttaatct

SEQ ID NO: 17647 - DNA, 70 bp, Homo sapiens
cggaagcctcgtcctacagcctagcccctgtctcagccacagcaggcaccactgccaagagccttccagc

SEQ ID NO: 17648 - DNA, 74 bp, Homo sapiens
ttctagaagggggtgcagttgctgcttggtgtgttgtccatcccctccacaggatggcagctgcatttaatctc

SEQ ID NO: 17649 - DNA, 71 bp, Homo sapiens
cccctgccattgagaggcaagcggcgttgcagggcctagatggtttcctcgttctgactcccgatggcagg

SEQ ID NO: 17650 - DNA, 73 bp, Homo sapiens
ctcactaggtgccattgaaggccctatgccagagaggaggtgggggagggcccatggtgggagacaccctgag

SEQ ID NO: 17651 - DNA, 73 bp, Homo sapiens
acacgacagtcaagtgacccgctcaacgtcacacagctactaagtggtagaaaaggcagttgaacccaggctg

SEQ ID NO: 17652 - DNA, 73 bp, Homo sapiens
aaaatgaaaagtgccaacactcacaggagactttccatgaaccggcatgtctctgagtgctctgcaagtatta

SEQ ID NO: 17653 - DNA, 72 bp, Homo sapiens
gcacacagtaggtattcaataatgtgtgtcaaacagaatagaacataaatagctgctgtctgtgtctcagga

SEQ ID NO: 17654 - DNA, 74 bp, Homo sapiens
aaaggctggagttatgttacagtgacttttgcgattatgatgatgccttaacactgactttatgcctagaaaac

SEQ ID NO: 17655 - DNA, 72 bp, Homo sapiens
agcctcccaaagtgctgggattacaggcgtgagccaccgcgcctggccggtatagctactttggaagacagt

SEQ ID NO: 17656 - DNA, 73 bp, Homo sapiens
acaagcttcactgtagatgatgcaagctacttctgtctaacaacgaccgggaaagctcacatgcactccctgc

SEQ ID NO: 17657 - DNA, 71 bp, Homo sapiens
atgctagaggggctggggtgagagtccgtgggagggaacatcatctgagctgagtgagaagcatttgggca

SEQ ID NO: 17658 - DNA, 73 bp, Homo sapiens
aagggtccctgagaccctttctggaggtctgcgaggtcaaaacttcataatcagactaagatgtggggtgtca

SEQ ID NO: 17659 - DNA, 74 bp, Homo sapiens
cttagctcctccgacccagccagcaggacccagctcaggaagcagattcagcccacaccgggactggtgggacc

SEQ ID NO: 17660 - DNA, 72 bp, Homo sapiens
actgaggccaggaagagtgaccccatcttggtggcaacatctgcctctcttgcccccctgagtctgtccaag

SEQ ID NO: 17661 - DNA, 74 bp, Homo sapiens
tttaaaagcaccttagctgcatattcttaagtcattcaaatggcaatgcctggatttaagtgtaagaggtattt

SEQ ID NO: 17662 - DNA, 74 bp, Homo sapiens
accatagcaacagccttcataggctaggtactcccatgaggccagatatccttgaggggccacggtaatcacaa

SEQ ID NO: 17663 - DNA, 73 bp, Homo sapiens
agggactgggaatcacggctgtaccaccacaacttaaatgtaaagcctcctagtggctcaagatatgatcccc

SEQ ID NO: 17664 - DNA, 73 bp, Homo sapiens
tggatgtggttggctggccgtgatgaaacaacctgagttgccaccccgtgggcagccacggaagaccatgccc

SEQ ID NO: 17665 - DNA, 70 bp, Homo sapiens
acacatcagagggaaaggaaagatcactggcatttagggatgcctggaacctagtgagccgagcaatgag

SEQ ID NO: 17666 - DNA, 74 bp, Homo sapiens
atctggtcaccactttgagggggtaggggactgaattcgccgaactctccttaacttaaaacttcaagatatgt

SEQ ID NO: 17667 - DNA, 71 bp, Homo sapiens
ctcctcagcccttctccaaggtattactgagcagaggctgaaaagagttgtgttttggaaagagtggtcac

SEQ ID NO: 17668 - DNA, 74 bp, Homo sapiens
gtataggggtgattttgctgttgtagtttatggggttacaagtctgcagagaaggtatagcaaggaagaggacc

SEQ ID NO: 17669 - DNA, 73 bp, Homo sapiens
tcaggtactgacccactaccgcccccatcttcccccatgggaagatgagcactgagggcagattaccctcctg

SEQ ID NO: 17670 - DNA, 71 bp, Homo sapiens
cgctcaccagttacctgtattgctcataaaagtagttaaagcaggtttttggaaataggagtccatataaa

SEQ ID NO: 17671 - DNA, 73 bp, Homo sapiens
caaacaaaatatttttcttaactattttggcggcaaaacctggcagtttatcctctatgcccctgtagtgtga

SEQ ID NO: 17672 - DNA, 70 bp, Homo sapiens
gggccgcgcgccgccaccgggttacacaaccccggccggcgacgggggggggggcggccgcggtgcgggg

SEQ ID NO: 17673 - DNA, 72 bp, Homo sapiens
tatttgtgtatgtctgtgtctgtgtgtgcattatctttttgcagatattgcactgagaaattaagtcatcta

SEQ ID NO: 17674 - DNA, 74 bp, Homo sapiens
agccctcgcgccgggtcaagcgctcgcgccggagacccctcctcccgcccacgccggacagcggcccggaaggc

SEQ ID NO: 17675 - DNA, 73 bp, Homo sapiens
tcaaagtgctgggattataggcgtgagtcagcatgccggcggtaattctgtttttagctctttgaggaattgc

SEQ ID NO: 17676 - DNA, 73 bp, Homo sapiens
ttacaaagccaattagggctagacctggggattcctggctcagttcaggagtcttattaatattaagccttga

SEQ ID NO: 17677 - DNA, 74 bp, Homo sapiens
aaggtcagatatctctgtgactctgggattggtcactgtgttctcttactttgtttgataaggtcatgatgttt

SEQ ID NO: 17678 - DNA, 73 bp, Homo sapiens
gatcttactgtcacctaggctggagtacagtggtgtgatcatagttcaacgtaaactggagctcctggcctca

SEQ ID NO: 17679 - DNA, 72 bp, Homo sapiens
gtttctcctgtgccagacccgcaggttcaaggatcatacttgcctgtgtttgaacatggctatgaggagacc

SEQ ID NO: 17680 - DNA, 70 bp, Homo sapiens
tcatccttgaagctcatgttggtctgttcgggctccagtttctgtggactctacccgctaggatagtatt

SEQ ID NO: 17681 - DNA, 72 bp, Homo sapiens
tctttcattattataaaaatgcatatgagtgtgtgtgtgtgtgtgtgtgtgtgtgtgcagaaggaaagacca

SEQ ID NO: 17682 - DNA, 73 bp, Homo sapiens
ggcccgccgctgcctagcgcgcggggggcgccccccagcccggaggtgagcgccgcgtgggggccaggagcaa

SEQ ID NO: 17683 - DNA, 73 bp, Homo sapiens
ggaggtgctgtgtgaagtctgtgccagcagccgcaggctccttccaccgctgcaccgattatctgacagtccc

SEQ ID NO: 17684 - DNA, 72 bp, Homo sapiens
gggcaagcaagctccgcggcctatcagatcagcagcggcattggattctcataggagcaggaaccctgttgt

SEQ ID NO: 17685 - DNA, 73 bp, Homo sapiens
aatgaggtactagatgtattgctataaataaaataaaaatagtaattatctgctagctacttcacagtgattt

SEQ ID NO: 17686 - DNA, 74 bp, Homo sapiens
acctcctaccatgccacagctcccacctgacactcacagtactgaagcagctaacatgtcctgagcatggcatg

SEQ ID NO: 17687 - DNA, 72 bp, Homo sapiens
acattctgctctctgggatttccacagcccagaagagtgcatggtaacaggatgcatatgttgtccctctta

SEQ ID NO: 17688 - DNA, 72 bp, Homo sapiens
cattggcacagaatagaggtcgtgcatggcatcattatgcaaagcactaaaaagtccactttgttcccattc

SEQ ID NO: 17689 - DNA, 74 bp, Homo sapiens
ctagcgcttgaccttcccaggaaaaaagcagggctctgagtgagacctgaactctttccctgggctgagttagt

SEQ ID NO: 17690 - DNA, 74 bp, Homo sapiens
atgaaagccagattttaataagccccagggggtttcagtgcaattggcccctggagctcacttagggaagcttg

SEQ ID NO: 17691 - DNA, 70 bp, Homo sapiens
aaagctttgtgactcattttttgtgatcatatcgtccagcatcttcactagtaaagggcacagggctctt

SEQ ID NO: 17692 - DNA, 74 bp, Homo sapiens
gaagtacaggtagtaggttgcgtagtttgaggacagggattttatccacaaggaggtaattatatgacctgctg

SEQ ID NO: 17693 - DNA, 72 bp, Homo sapiens
aaagtgacagacatacaccgctagtgactctgcagacctaccaggttctgtgggctcaggcgtcccactccc

SEQ ID NO: 17694 - DNA, 71 bp, Homo sapiens
tgaaggcactccagcctctggcggatagcgggagggaggagctgagacgtagatgctggctgctagaaaga

SEQ ID NO: 17695 - DNA, 74 bp, Homo sapiens
acaaaggcagtggttttgtttccttgttcctgtaccccttggcaggttagacgcccttgaccccaatgcctatg

SEQ ID NO: 17696 - DNA, 71 bp, Homo sapiens
acagttggcctcttttggaatggcaacggcagagacatcactgtccaggtaatttcattctggcttcttcg

SEQ ID NO: 17697 - DNA, 73 bp, Homo sapiens
tgtgctcagatcattgtccagttttcccagaggaccaatggtggccgtctctgctggaggaagagaagaccca

SEQ ID NO: 17698 - DNA, 72 bp, Homo sapiens
gaactgccctttctgcactggtggaaactagttatttatgccatgtggagagccagtgagatagatagatag

SEQ ID NO: 17699 - DNA, 74 bp, Homo sapiens
gtgagccaccgcacctggccttgttattactaaagagacctagtctctttaaataatatgttgcccagcctggt

SEQ ID NO: 17700 - DNA, 73 bp, Homo sapiens
tattgctgtgacatatcaggagaacagtttattttcaatggtgatagcatttttgtcatcttgccagtctgca

SEQ ID NO: 17701 - DNA, 74 bp, Homo sapiens
taggcgtggtggtgcgcatctgtagtcccggttactcacgaggttgaagtggtaggattgtctgagcctggggg

SEQ ID NO: 17702 - DNA, 74 bp, Homo sapiens
gactttgagtcaggcatggtagtgggtggtggggattctaaaatgccctgaaggagttcccagcctggctgggg

SEQ ID NO: 17703 - DNA, 70 bp, Homo sapiens
gggagtcggtggaggggccccctgccctgggcttcaggtcagccagcgcccacaacctgacggtgggaga

SEQ ID NO: 17704 - DNA, 74 bp, Homo sapiens
tttttggaaggtgagccagctataatgctaggagacaggcactcaattctgcggtaggattttctttaagtctg

SEQ ID NO: 17705 - DNA, 70 bp, Homo sapiens
caacctctgtgggcagagacttctcctgggcaccaaggagagacctgttcatttgtttcatctttcaaca

SEQ ID NO: 17706 - DNA, 73 bp, Homo sapiens
gtcgtggagggcctggaatgccagcctgaatttattgagtaggtcagcagtgaaagggtccttagggtagtgt

SEQ ID NO: 17707 - DNA, 73 bp, Homo sapiens
tgatccagcatgctgaaggggaatatagcccatccttcctaggggctgggctgtaaggacagcaggggagatg

SEQ ID NO: 17708 - DNA, 73 bp, Homo sapiens
ctgccactgtctttgctcaggacctcagcgcctcctgcaggcggtaacagcctgtcacgtccacctaaaggca

SEQ ID NO: 17709 - DNA, 72 bp, Homo sapiens
acggatccctgagacttcggagacattgttaaggaagaaatgtctcttgtgagcacggggtcacagaacctc

SEQ ID NO: 17710 - DNA, 72 bp, Homo sapiens
tgagccgagatcgcactattgcaatcccgactgatcaaggagagcgaaattccgtctctgggcaacataggg

SEQ ID NO: 17711 - DNA, 71 bp, Homo sapiens
gacgactttctggtttgagttttctctgttggggcttcactgcccctgggataggaattaaaatgccaagc

SEQ ID NO: 17712 - DNA, 72 bp, Homo sapiens
tgggcatagaggacctgacagaaggagagtgtggctggctcagttcagccatccctgctgcaggaggagcag

SEQ ID NO: 17713 - DNA, 72 bp, Homo sapiens
acccgggaaagctgtacctctgagaacgcctagactgagcccccagaaaaggtgatccaggaactagacggg

SEQ ID NO: 17714 - DNA, 72 bp, Homo sapiens
agtcacttatgttttctgtcctgggtgacccatggggcagaggccacagatgcaaagggcttggactggagg

SEQ ID NO: 17715 - DNA, 71 bp, Homo sapiens
ccaggctgctcttgaagtcctcggctcaagggatcctcccacctggactcccaagatgctcggaatacagg

SEQ ID NO: 17716 - DNA, 73 bp, Homo sapiens
gctgaggctccaggctggatagggaggcactgatgtaggtccagggtccaatttcttcaggaatccaggaaaa

SEQ ID NO: 17717 - DNA, 72 bp, Homo sapiens
atcattctactacagctgcaacctacctcttcttgtagtttgcttaacagaggaagagaagaatcagtcccc

SEQ ID NO: 17718 - DNA, 73 bp, Homo sapiens
agtcgggcgagtgtctggaagggctgagctgctctgaagctttggcctcacttgcctctctccccaggaacgg

SEQ ID NO: 17719 - DNA, 74 bp, Homo sapiens
cactgctcctaatattctcccacgtcccttccagaggatgttggccctgcagttccatcccccttagctctccc

SEQ ID NO: 17720 - DNA, 74 bp, Homo sapiens
gaggaagtgggcttcggccgccccaggctcgtcctcgggcccgcccagcgccgcagcccgctcgtagtccagtc

SEQ ID NO: 17721 - DNA, 73 bp, Homo sapiens
tctcaagctcctgacttcaagtaatcctcccgctgctgcctcctcccaaagtgttggcattacaggcatgagc

SEQ ID NO: 17722 - DNA, 73 bp, Homo sapiens
tgtctgcaatccttgggctgtgcctgctgggcatcacagtcttggtggtgactaagtcacttctgtcctgggg

SEQ ID NO: 17723 - DNA, 73 bp, Homo sapiens
tttcagatgcggcggcggcggcggcggcgactcaggacagcgccccctccccctaacggccgcctctccctct

SEQ ID NO: 17724 - DNA, 70 bp, Homo sapiens
ccagggaaccttcactttttaaagccaaccctttgcggctttgaggccgccgtggtgcattgtttgctgg

SEQ ID NO: 17725 - DNA, 72 bp, Homo sapiens
ggctggcagcagctggagccgcatgtcccactggtggagcagctgggatatccacagaagctggtctggcag

SEQ ID NO: 17726 - DNA, 72 bp, Homo sapiens
agctggatacacagcagctagggcggcagcaggtggtcctgcagcaggtggtctgacagcagctgggacagc

SEQ ID NO: 17727 - DNA, 72 bp, Homo sapiens
gccttttcaagtaatatgaaggctcaaagagagtggacaaaaagggggtcataaaggcaggaaaaggataag

SEQ ID NO: 17728 - DNA, 72 bp, Homo sapiens
caactccacaagggcagtgaccctgactgtcagggacataaaccagcagtccatgggcatgcatatttttgt

SEQ ID NO: 17729 - DNA, 73 bp, Homo sapiens
gcaataggcgcctggcagtgtcaagcctgaaaccaagcaataccgtcatgtttcagccaagcccagagcccta

SEQ ID NO: 17730 - DNA, 73 bp, Homo sapiens
gggggtcctgggctcatgcagtgagcagggttgggtacctgagcatgcggaccagagcagggatgccacccga

SEQ ID NO: 17731 - DNA, 73 bp, Homo sapiens
tccaagatctctggaatcgccgctgagtcagcaacgcgcgcgcgcgcccgcggaggccgcggccccgccccgg

SEQ ID NO: 17732 - DNA, 74 bp, Homo sapiens
gtgagccactgcgcccggccagcaagacactgtttctacaaaaaattaaaaacttaaaaaacttagctgggtgt

SEQ ID NO: 17733 - DNA, 74 bp, Homo sapiens
ccacctgcttacatctatgcaaagtcagggacagataatccagtttgtggattatccagacccccagctggcat

SEQ ID NO: 17734 - DNA, 72 bp, Homo sapiens
tggggtatcgcctgctcattccagcctctgtaggagggaccaggctaaacagtgttggtgtcctaagtccct

SEQ ID NO: 17735 - DNA, 73 bp, Homo sapiens
ggcgggaaggctggctggagggctgagtcagcgtcagggagcaggcagcgcctggaggagaggcttcaaggcc

SEQ ID NO: 17736 - DNA, 72 bp, Homo sapiens
gtgctccagtgctgatgtcttgttactgaatagattggagaatagggcatgcagactctggaatgaagttat

SEQ ID NO: 17737 - DNA, 72 bp, Homo sapiens
gcgacccccgcccggccccgcgcccccgccccggctccgcagctggcgcctccccacccccgtccctgctcc

SEQ ID NO: 17738 - DNA, 72 bp, Homo sapiens
ttcattgatgctgctgagggggtgagtcagactcagctcccagaatctcatccacctgttatgtttgccccc

SEQ ID NO: 17739 - DNA, 73 bp, Homo sapiens
ttggtcttgaagcctgggcctccactccgcctactgcaatggtggaagctccagtttacaagacacccccacc

SEQ ID NO: 17740 - DNA, 74 bp, Homo sapiens
ccagctgctgcagttcctgctccgggacggttgctttccgctctggtgagctggggtttctggcaggggctggc

SEQ ID NO: 17741 - DNA, 72 bp, Homo sapiens
gagaatcagcagcctcttcaccaactctgcccaagggcctgaggctccctgagactgcggtccactgacatg

SEQ ID NO: 17742 - DNA, 71 bp, Homo sapiens
ataaagtgcctggcaagcagtaacagttgccaaatggcagatgtttggctcggccctgtgtccagcccaga

SEQ ID NO: 17743 - DNA, 73 bp, Homo sapiens
ccacatgctacctcacagtgctccagagtcaatgctagtgcaatgttgcaagggcattgccaatacagttcaa

SEQ ID NO: 17744 - DNA, 74 bp, Homo sapiens
aatctgaagcagagagtcaaaaagaatggaaaggatctcaaccaaaggtaaccacacattcttacactctgctt

SEQ ID NO: 17745 - DNA, 73 bp, Homo sapiens
tcctctggggactgacttgagtgacctgggagctgtctccagagcccttgtcgctgaggggcctgtcctctag

SEQ ID NO: 17746 - DNA, 70 bp, Homo sapiens
gtgaattaggtagtttcatgttgttgggcctgggtttctgaacacaacaacattaaaccacccgattcac

SEQ ID NO: 17747 - DNA, 74 bp, Homo sapiens
gctcggcgactgcctccctgctgtgagcaggagaacaggaagtctgcccgacagggaggtggccgggcgggagc

SEQ ID NO: 17748 - DNA, 74 bp, Homo sapiens; identical to SEQ ID NO: 17747

SEQ ID NO: 17749 - DNA, 72 bp, Homo sapiens
gggaagagtaccaggatgcccactcctcttccccaggaaccaccaaggagcctggagcctggctttatctca

SEQ ID NO: 17750 - DNA, 74 bp, Homo sapiens
tgagccaccgcgcttggtcctttttttatttttttttgagacagagtctcgctctgtcgcccaggcctgagggc

SEQ ID NO: 17751 - DNA, 74 bp, Homo sapiens
aggtgcaggcaggattgtcctcctgggtgcagcggcagctgccagacccgcaactgcagacctgggcctcgcac

SEQ ID NO: 17752 - DNA, 72 bp, Homo sapiens
ataatgatggtattatgattatggagaaggatgtttttattctcaggagatgccactgttatgaagtgacaa

SEQ ID NO: 17753 - DNA, 74 bp, Homo sapiens
ttcattgacagcctactatgtaccaatcctgggctgagtcccaacccggggatgacttagaggaggccaggatg

SEQ ID NO: 17754 - DNA, 74 bp, Homo sapiens
ggaggagcggctgtgcaaaaacaaatgagtgttcccatcaagatgtttgcaatttaattctagcctagctactc

SEQ ID NO: 17755 - DNA, 72 bp, Homo sapiens
gttcatatcacctgatatactggtgtctttatttttgtatgatagatttccaagagtgagatgggtatgtac

SEQ ID NO: 17756 - DNA, 72 bp, Homo sapiens
cgcacccgccagccaacggccgccactgcgtccacagcaaccggtgccccgcgcgggggcgcgcatccaccg

SEQ ID NO: 17757 - DNA, 70 bp, Homo sapiens
tctggggaatgaggggcccaccccgagcagcctctgtcctcttcctcccacgtcgggcgccaatcccttt

SEQ ID NO: 17758 - DNA, 71 bp, Homo sapiens
ctgaaggtgacactcagtccaattaaaactgatctgataagacctcagatcagacagaggtaagtgtattg

SEQ ID NO: 17759 - DNA, 73 bp, Homo sapiens
gctgctataagtgtgctgcataaatgtttaaaaagagggcccagggggctctgttctgcaggatgggggtggt

SEQ ID NO: 17760 - DNA, 70 bp, Homo sapiens
aggggtagggctgggtttcgaacccaggggcaggccctctccgccccccggcatcggtgcagagccctgg

SEQ ID NO: 17761 - DNA, 70 bp, Homo sapiens
attcccagtgcaatgttatttctgtctgggacacacatgtggatgtgcctggattacacgtggggaggac

SEQ ID NO: 17762 - DNA, 72 bp, Homo sapiens
tagatacatatagagtgtatatatatatctatagatttacatacctatagatatgtcaatatctatatagat

SEQ ID NO: 17763 - DNA, 73 bp, Homo sapiens
aaactgggagacaccaactctttttctgtctagggattgaggtcagaaagtctcaaagcatgatgtctccagt

SEQ ID NO: 17764 - DNA, 72 bp, Homo sapiens
tagctgatatatacccatcaagggaagtttatttttgccaatactggagaaaggcttggcactttgctttgg

SEQ ID NO: 17765 - DNA, 71 bp, Homo sapiens
tgctcatgtctagatacaacctctgatccttctggagggtaattatggtagttagtctagtctgcaagttc

SEQ ID NO: 17766 - DNA, 72 bp, Homo sapiens
tgtccccaagtctcctagcagcaagtaccagcacccactctgattgggatggcaggagagcgacatagattc

SEQ ID NO: 17767 - DNA, 73 bp, Homo sapiens
ccaatgtaatcaaaagggtccttaaaagtggaagaaggagtcagagtaatgtgatgtgaggattttgggtagc

SEQ ID NO: 17768 - DNA, 72 bp, Homo sapiens
taatttatttcatttatctgtagtaaaaactacaggcaatttttttttttttgagatggagtcttgctctgt

SEQ ID NO: 17769 - DNA, 73 bp, Homo sapiens
gattctgcatattggctcccaggtggcacatatgcacattgtagtttgagaagccctgtcctggggtattaga

SEQ ID NO: 17770 - DNA, 73 bp, Homo sapiens
tcatatgaatggctaaatatgtgtgggtcctcaggtctcctgacccttgtactgactgattaatgtggctgtg

SEQ ID NO: 17771 - DNA, 73 bp, Homo sapiens
ctgtggttcaggaattcaggagcagcttagctggtcggttttggataagaatagctcatgatgttgaagtcaa

SEQ ID NO: 17772 - DNA, 74 bp, Homo sapiens
acttacgggacactgacgcggaccgtatacagatgggacactgacgcggaccttatacggacgggacactgacg

SEQ ID NO: 17773 - DNA, 73 bp, Homo sapiens
ggggtgatgatatattgatccgctgagtaagcacctccggtgtttgaaggctctgtgtcattcagagcaaaca

SEQ ID NO: 17774 - DNA, 74 bp, Homo sapiens
gggctagatttcagggttactcaatgcacacagcacagattgctgccactgtgtcttagaccactagatggcgc

SEQ ID NO: 17775 - DNA, 73 bp, Homo sapiens
tccaaagtgcctcagagagagggaagggatgtcatttctgtttgtcaaatattttggctcttaaaaaacaaaa

SEQ ID NO: 17776 - DNA, 73 bp, Homo sapiens
ctgcatgcctgagccgagcttatcctcatggcaccctgtgaggcaggctgctgctcctactcccactcaccag

SEQ ID NO: 17777 - DNA, 74 bp, Homo sapiens
aatttcaacatggcaacggcagagcatcaaatcagctagaatgtgagcacatactagatgtccagcctgtggtg

SEQ ID NO: 17778 - DNA, 73 bp, Homo sapiens
ggtaccttgtgagagtgcagcaaaagggtccttagcctatgaggtaaccaaatagcttatgactacaacaagg

SEQ ID NO: 17779 - DNA, 73 bp, Homo sapiens
attcagaatccagaaatctgaattgctgccctgatgttacaacagactagctacttatttgaacctgagattc

SEQ ID NO: 17780 - DNA, 73 bp, Homo sapiens
aggtaatgccccttttcctagccgaaagactgaagaccgaattctcctaagattgttgggcttaccttaaatt

SEQ ID NO: 17781 - DNA, 71 bp, Homo sapiens
ggcaggaagggcttggtgtcactttatgaaggagacaagctgagaatcgcaccttctaaacagtccctgct

SEQ ID NO: 17782 - DNA, 71 bp, Homo sapiens
ggctgggaggatgggtgttccttgtccaacctctcccttcggaggaggggtttggctgtgtcccacccccg

SEQ ID NO: 17783 - DNA, 72 bp, Homo sapiens
agacaaaacagctgagaatagtgcctgatgaaggtgaaccacacttgcaactgcttatatgtggtcaggttt

SEQ ID NO: 17784 - DNA, 72 bp, Homo sapiens
atttgaatctctagggtggcatttctcaaactgtgttccatagagatgttctttaatgttctgtggtcaaat

SEQ ID NO: 17785 - DNA, 72 bp, Homo sapiens
caggcatccacatcagtccagctctgtggttggtgccccccaccccatcagagcagccagacacctcctgcc

SEQ ID NO: 17786 - DNA, 72 bp, Homo sapiens
ccccgcaggatcttggctcccccccacgcccggggcattagccggagcggcggggctcaccgcgttcatgtc

SEQ ID NO: 17787 - DNA, 74 bp, Homo sapiens
tagaagccaggactgtagaggtagtgaccatacacttggaaacaaaatggttagcttctttcatcttcaaaggt

SEQ ID NO: 17788 - DNA, 74 bp, Homo sapiens
agactggattattctgctggctataaccggctgaaagccacaggatggatcagctgattttaagaaataccagt

SEQ ID NO: 17789 - DNA, 72 bp, Homo sapiens
ggctggagcacccagaagcatgcccagggcatcccaacacctgcagctcccactgctgccaccaatctttcc

SEQ ID NO: 17790 - DNA, 73 bp, Homo sapiens
ggaagagcgatgggtgcaaatactatggaacaggaagcaatatatgagtccattcttatgccccatgagggat

SEQ ID NO: 17791 - DNA, 73 bp, Homo sapiens
ccaaagtacaggaattacaggcgtgagccaccatgcctggccctccagctgtatttcttgctgacaccccctt

SEQ ID NO: 17792 - DNA, 74 bp, Homo sapiens
atctaatccagttttcccaccttgggctttctccaaacccagggaagcctgctaagcccaagtgcaggtgtgac

SEQ ID NO: 17793 - DNA, 74 bp, Homo sapiens
tagatgttgcctagcacatacttagaacaaatactaagcatataatgaaaacacgtatagctaggtatagctag

SEQ ID NO: 17794 - DNA, 72 bp, Homo sapiens
cacagtctagcatcacagaggatgccataataagcatcatatgtctacgtattgtctgggccaaaatgttat

SEQ ID NO: 17795 - DNA, 73 bp, Homo sapiens
ctgactctgatgcctatgagactagatgccctcctggaactgtttccagaaggctttcttccaccatcaccct

SEQ ID NO: 17796 - DNA, 72 bp, Homo sapiens
gattagcaagctgagtccaagagaggccatgtaacttgccttgcggtcactgggcttgaggatatgaacgcc

SEQ ID NO: 17797 - DNA, 73 bp, Homo sapiens
gcaaaccgagccaggttctaataagctccctttatgggaggagctgggttcttggcctctcactgtctcatgt

SEQ ID NO: 17798 - DNA, 73 bp, Homo sapiens
cccaagagattccacaggcaagatgctggcagtttacagctcattagcaacccttgagaatcattttgtgctc

SEQ ID NO: 17799 - DNA, 72 bp, Homo sapiens
atgatttaggtcaatatgggccgaccttcctcatccttcctctctttctcgaaagatggggccccatgggcc

SEQ ID NO: 17800 - DNA, 72 bp, Homo sapiens
gctgcgctcaatttctcgccgagccgtagctgccttcccgccgggcagccctcgggactgcagcccgccatg

SEQ ID NO: 17801 - DNA, 72 bp, Homo sapiens
agcctgccctgctattccccaaggaagactatccatggctcagaatgatgaaggtcatcagtgttaaccaag

SEQ ID NO: 17802 - DNA, 73 bp, Homo sapiens
gccacgcaatggcgatctgactcagctggagttgggaatccatctagtttccccatcttgcctcccgtcttgc

SEQ ID NO: 17803 - DNA, 72 bp, Homo sapiens
ctgagatactttttcctatgatggcttggggtccctctccccacccatgtaccagtgatgtgggctctcaga

SEQ ID NO: 17804 - DNA, 74 bp, Homo sapiens
aaattgggaaatgtttaaatgagcaaagctaagtgctttctttactgcagaattgtttaagtgttcattaattt

SEQ ID NO: 17805 - DNA, 71 bp, Homo sapiens
tctttaccatttcatgatggatccaatttgagaggaatgtgtcaaatgtggagaaatgtctggtgcccttg

SEQ ID NO: 17806 - DNA, 74 bp, Homo sapiens
tggaatgaaataagcacagaattctaatcccctttgtaagatttaagaaagagaattttgtgtgtgtgctctct

SEQ ID NO: 17807 - DNA, 71 bp, Homo sapiens
gagctacccatcgaccaaggaatgtcattcctttacacggaggtttctttggtctggagtccctaaagaag

SEQ ID NO: 17808 - DNA, 74 bp, Homo sapiens
aatttcaggggaggacctcgtttaggaagggtgtttagaggcggactctttgaaaaggtgcaactgcaactgaa

SEQ ID NO: 17809 - DNA, 74 bp, Homo sapiens
ggggctggctttaggggacctcccagacatcctgggacatgagaggtgtaggataaatcctttcctggcttctg

SEQ ID NO: 17810 - DNA, 72 bp, Homo sapiens
aaccctcctgccttagaatctctcaggatgcttgtgatcaatatattcctggattctggagtcagaatgagt

SEQ ID NO: 17811 - DNA, 74 bp, Homo sapiens
aggagacaggaacagccaaggaggggaggggcatttgggaaaagtgaccataccccaccctctctcagaactgt

SEQ ID NO: 17812 - DNA, 74 bp, Homo sapiens
gcgctcagggctgcgcgcccggctccgggacccgcaaagtttgctagccggctgggcgcggagccgagggcgcg

SEQ ID NO: 17813 - DNA, 73 bp, Homo sapiens
caacaaccacagaacgaggttggaagtggattggctccagttgagccttcagatgagatctcagcctcagttc

SEQ ID NO: 17814 - DNA, 70 bp, Homo sapiens
tgggtcttcgccatggcctcagggccccttgcaatgtggcctgagtgaccgctctgaccaccccttcccc

SEQ ID NO: 17815 - DNA, 71 bp, Homo sapiens
gaataatcccacaaaaatctcagtgcgtggtgtcaccctccaaatggggacgttgtacagatgcaagcagg

SEQ ID NO: 17816 - DNA, 72 bp, Homo sapiens
aagccccagtctgtggtctgtagttacagcagccctagctggctgagacagcaggtctggggtgagcctggg

SEQ ID NO: 17817 - DNA, 73 bp, Homo sapiens
atgacagcgatttaaaggaagaagaccaggtaggtgacatggacccaaactcgtgggctcaagcaatcctcct

SEQ ID NO: 17818 - DNA, 74 bp, Homo sapiens
tcacctattaatcctagggaaaggtctggatacaacagtgttctccttccctgccagaaaattgtacaagagaa

SEQ ID NO: 17819 - DNA, 73 bp, Homo sapiens
ggcattgtctcagaagtcacttcacagttttgcatgtggctcccagggtgtgaggttctgcagaacagtagcc

SEQ ID NO: 17820 - DNA, 74 bp, Homo sapiens
caaccgcacagcggcgttgcgggaggcgaagggcgtcgaccgacctcgcgcgctgcacatctcgggttgaggtt

SEQ ID NO: 17821 - DNA, 72 bp, Homo sapiens
agccctctcccaacccctgtagtgacaaccaaaaatgtctccagacattgccaaatgtccctaggaggcaaa

SEQ ID NO: 17822 - DNA, 70 bp, Homo sapiens
cagcctgggcaacatatcgaggccccatctctacaaaaaaatgcaaagggccaggcacagtggctcaggc

SEQ ID NO: 17823 - DNA, 70 bp, Homo sapiens
gcctgggcagcaggagggcctggtggcagctgggctacactccctcttaaggccagagggagccaccact

SEQ ID NO: 17824 - DNA, 72 bp, Homo sapiens
ctgcaggcgatggggcaggggccacggaaagagtctgagggctgcttggtgtagtcaggttgtgtccaggca

SEQ ID NO: 17825 - DNA, 74 bp, Homo sapiens
ggggagctttcgttcactcagcagacgtttatggggcgcatgcgtgactctggggcgtttagctgagccggagg

SEQ ID NO: 17826 - DNA, 73 bp, Homo sapiens
atgactgcttaggagctcagatgggcctgcgccgtgccccccggccccggcagctcccctccagcctgtgtca

SEQ ID NO: 17827 - DNA, 74 bp, Homo sapiens
agttctaatactgccgggcgcggtggctcacgcctgtaatcccagcactttgggaggctgtgggcagatcaccc

SEQ ID NO: 17828 - DNA, 72 bp, Homo sapiens
aagaggtgtgtgtattccggggtgggtgacagggcatcacatctatagcttgctgtcaaatgttttgggaag

SEQ ID NO: 17829 - DNA, 72 bp, Homo sapiens
cagggatggagtaattagcaccatttgagatccattacaactggtaactgatgccttgggactgctggctga

SEQ ID NO: 17830 - DNA, 73 bp, Homo sapiens
acacaatcttactattgggcagtttggctccattacttggggagccgtaggtcccttctttgtccaggaggtg

SEQ ID NO: 17831 - DNA, 73 bp, Homo sapiens
tgaaaaattataaaaaggcagagcatcaatgcaactgtgtgtgcgcactatggatccactgaggctccagggg

SEQ ID NO: 17832 - DNA, 74 bp, Homo sapiens
ggtatgtcaagcatggtgacaaagtgttcaggtcagacggtctggggaaaggctcctgtgttgttgagcctgcc

SEQ ID NO: 17833 - DNA, 71 bp, Homo sapiens
ctcgtggcccctcccagttttgcgtcacttgttgggggcggggccgggctgggcttcgcgagtagcgggcg

SEQ ID NO: 17834 - DNA, 74 bp, Homo sapiens
gtcaccagtcaatcatgatggctgctgggtgcactggctaacatctataatcccagcactttgtgaggctgagg

SEQ ID NO: 17835 - DNA, 70 bp, Homo sapiens
gacagtggctgggagctggcgggaaaatccagtcttgactggaggggaccaagggaggcttcaagctacg

SEQ ID NO: 17836 - DNA, 74 bp, Homo sapiens
atggtgcatgacagtagcacctgccgagcactgagaacaaggaagccctcagtgcacgttagctgtcattgtca

SEQ ID NO: 17837 - DNA, 73 bp, Homo sapiens
aattcaacttacttgcccatctggcgtcactttgcatttttagtgaagttgtggcttgagatagtaggttttc

SEQ ID NO: 17838 - DNA, 74 bp, Homo sapiens
agcagagttcagaggaagccaggtgtcagggggatgaccagacccttgcccaggagggaggagtctcaactgtg

SEQ ID NO: 17839 - DNA, 72 bp, Homo sapiens
agcgtacagtagtctgcagtggtgtatagtagtgtacagtagtctgcagtaatgtatagtagtgtacagtag

SEQ ID NO: 17840 - DNA, 73 bp, Homo sapiens
gggccgcagagttgctgccgctgctgtcctcacacccgctcgtgggaagcagcgcctgtcgcaactcgccact

SEQ ID NO: 17841 - DNA, 71 bp, Homo sapiens
ggacagcgctccgctgccgcctccacgacccccggcctgcacgccggtcttcgccgtagtcgtcgtccccc

SEQ ID NO: 17842 - DNA, 73 bp, Homo sapiens
atcccttctgccctgtaaggatgcagtgttcattctctccggagggtgcagcaccaagtcaccatcttggaag

SEQ ID NO: 17843 - DNA, 73 bp, Homo sapiens
gcagagagccgttcgcagagacttccactgtagctctgtgccagggcggtagagagtccttggtgactttggc

SEQ ID NO: 17844 - DNA, 73 bp, Homo sapiens
tcatggtgctggagcgtgggccagtactacatgccttcttgctgctgggtcatcttccatggtatggataaac

SEQ ID NO: 17845 - DNA, 74 bp, Homo sapiens
gaaacaacaaagaggtctgcccgaggcttcccaggcagctgcgaggagggatgcaacagcagggaggaggagat

SEQ ID NO: 17846 - DNA, 70 bp, Homo sapiens
agatacagttgtgcgcagggactggagcttcccatttgtgtcttgtcctcaggggtccctgttcctgggc

SEQ ID NO: 17847 - DNA, 70 bp, Homo sapiens
caaagcaggtgagtgccctcgggaactgatgaggcctgacctagtccgattgtaggcacggcccctgctg

SEQ ID NO: 17848 - DNA, 73 bp, Homo sapiens
tgggaagagggatggcagtgcctgtctcaggcaccatgagatgaagtgtcacggcactcgggatagcccagta

SEQ ID NO: 17849 - DNA, 74 bp, Homo sapiens
tcaagggtgcatgtggagcatggggctgtgtgtggctgtgcgtgtgacagcagctctgtggatgagtgtgagtg

SEQ ID NO: 17850 - DNA, 72 bp, Homo sapiens
gagctcctgtggaggacgcaggcgacccccgcccctcactccactgtgaggcctgaggatgtacaggggcag

SEQ ID NO: 17851 - DNA, 71 bp, Homo sapiens
agcggagtgtggggtcaggggcccagcggggggcaccccggggaggggccgcctccgccagacccaccccg

SEQ ID NO: 17852 - DNA, 72 bp, Homo sapiens
gtggcctcaggtctgctgggtcaccagtgtccttgggtatatggggcattggtggtgactgggacccacctg

SEQ ID NO: 17853 - DNA, 73 bp, Homo sapiens
gaactccaaacccccaaatctgacccaggtcctgtgactggaaatatctgaagtcttcacgcaacctctgggg

SEQ ID NO: 17854 - DNA, 70 bp, Homo sapiens
ccaggttgggaatgaaggaaactctgacaagggtcggctgtggtccacacctggggtatacgggtcactt

SEQ ID NO: 17855 - DNA, 73 bp, Homo sapiens
cagcccatgcaggtgtctgtgagatgcccctttagtgccccagcctccctgggtgctcacctcggtgtgggtg

SEQ ID NO: 17856 - DNA, 70 bp, Homo sapiens
gctgccaactgcggagggttccggggggagttgggcagctgctctccctccacgggcaggggtggcaggg

SEQ ID NO: 17857 - DNA, 74 bp, Homo sapiens
ctgcagggaagatggcagcctcagggtgtcagttcatccagccattgactcagcttgtggccgccagccctggg

SEQ ID NO: 17858 - DNA, 74 bp, Homo sapiens
ggggttgggggcgggtcgggcgggcgcgcgggtcgggcgggagccgcgcgctggagaggcggggagcacggcgc

SEQ ID NO: 17859 - DNA, 71 bp, Homo sapiens
gctgcctgccagagtcaggaaccggcccagagtgtcatccatccccttcactccagcctgactcagaaggt

SEQ ID NO: 17860 - DNA, 72 bp, Homo sapiens
gttaagcccacggcggggcgcgggatcctgtcctttgggccctggtggcccggtgctgtctggtgagacacg

SEQ ID NO: 17861 - DNA, 70 bp, Homo sapiens
ccatttgtaaccaagatcccactcctgacaccacatccaggggaagcaagagctctgcaagctggcccag

SEQ ID NO: 17862 - DNA, 73 bp, Homo sapiens
tgggctggggtcggggggcacagtgggcgtgcccgcttggcctgtgaccacctgcactgtgccccaggtgaag

SEQ ID NO: 17863 - DNA, 70 bp, Homo sapiens
ggccgccccctccgcccgcgtcctcggaccccacgtgtaggtcccgggaagcgcgaccaggaggagcgcg

SEQ ID NO: 17864 - DNA, 73 bp, Homo sapiens
tccctgtagccggctttaatggggtagatctctttcttaggaacagagaacttgggaacatggctgtatgtga

SEQ ID NO: 17865 - DNA, 74 bp, Homo sapiens
tccccctctcttttcctcctcctcctgccgtgggagacacttgctccagcttcgccttccgccgcgagttgaag

SEQ ID NO: 17866 - DNA, 72 bp, Homo sapiens
gtccctgtgcccgtgtgcttgctgctaaacagtgacaaggacattaggaaaacagggccttcttaactcttg

SEQ ID NO: 17867 - DNA, 71 bp, Homo sapiens
tgggtgcatatatatttaggatagttagctcttcttgttgaattgatcccattatcattgtgtaatggcct

SEQ ID NO: 17868 - DNA, 72 bp, Homo sapiens
aggtctgggctgggaggagtgttttttttccctaaaacaaggatctagcttatcaagatgaaatcagttatg

SEQ ID NO: 17869 - DNA, 71 bp, Homo sapiens
agcctctgacccgacagaataattagcttctattgtgttaacctgtgttagccagcaagtagaagcgcaga

SEQ ID NO: 17870 - DNA, 70 bp, Homo sapiens
cacttggtcgctcagaactgggggttgttagaagctctacttcagatcccactcctgacaccattaaaat

SEQ ID NO: 17871 - DNA, 73 bp, Homo sapiens
caccaggttctcatggtgaatgaaactaaggaggatccttctggcagatcattgtcaaatacaccaagatcct

SEQ ID NO: 17872 - DNA, 70 bp, Homo sapiens
aaggtgcttggtatcattatcctttccttcacactctggagctcaaaagtatagattaagcccttatagg

SEQ ID NO: 17873 - DNA, 72 bp, Homo sapiens
agaaacaaatggccagtagagaaaaataacagttattatgttatctgagggattggcagttgataggtttca

SEQ ID NO: 17874 - DNA, 73 bp, Homo sapiens
tcattcaaattttctctacaaaattctggtaaggaatctatactgctgcagctttgtgactttctaaccagaa

SEQ ID NO: 17875 - DNA, 74 bp, Homo sapiens
gggctagcctgtgggaggcccagcagcttccactttcccttgacagtcgccatagtctgactacttgacaccgc

SEQ ID NO: 17876 - DNA, 74 bp, Homo sapiens
tgccctcccggcgccgcggcgggtcctggcggtggattggggccgacccgggcgtgttcgtgtggagcacctgc

SEQ ID NO: 17877 - DNA, 70 bp, Homo sapiens
actatccccttgcctctcggctctctcaaaactacccttagttttctaggcagggctgtctaaaacatga

SEQ ID NO: 17878 - DNA, 74 bp, Homo sapiens
aagacagtgggctgggtcttgctgccaaacatgtgcgacagtgaatgatgcttggatcgaaacccttagggcca

SEQ ID NO: 17879 - DNA, 72 bp, Homo sapiens
agagtgagaaaccaagggtgcacagcagaggatgtgaaagctggagcactgtagatccatcaaccttgcaat

SEQ ID NO: 17880 - DNA, 71 bp, Homo sapiens
tacccctcctgggaggaaccaagttcccattgcctgcagtggtagacttgctaacccacccataatttggc

SEQ ID NO: 17881 - DNA, 71 bp, Homo sapiens
actatatcatatttatctttgtgccctggggctgtaataaacttgaaaggcagtctaggccacaaggactg

SEQ ID NO: 17882 - DNA, 73 bp, Homo sapiens
aataatacaaaataataaaatgtatgtaacattatgctgaataaaaagcagcatacaaatattatatgtacac

SEQ ID NO: 17883 - DNA, 74 bp, Homo sapiens
ggaacagtcgtgatatggagcttttggctaaggcagactcttaggccacagcccagaatttccgaatcagaacg

SEQ ID NO: 17884 - DNA, 74 bp, Homo sapiens
ctaggtgatgctgagaatcattgtagaggattgttgatagcaggccatgtgcaaaggatctggggaaggcaaag

SEQ ID NO: 17885 - DNA, 74 bp, Homo sapiens
aggagggatacctgcatagccaccttcctgattctgtaactggggcccaggaagtttggttatggctctgatcc

SEQ ID NO: 17886 - DNA, 73 bp, Homo sapiens
tgggggcgagcgcgggccggcccctcccccggggaggtgcgggggacagggggcgacactgcggcgccgcccg

SEQ ID NO: 17887 - DNA, 72 bp, Homo sapiens
ctccgccgcctcccctcacgcctcctcctccccgaggaatcggcgcttccgaagggacgggcggcgggcggc

SEQ ID NO: 17888 - DNA, 73 bp, Homo sapiens
accaacataggtcctcaggaatagtctctgatgggttgaaaatgggggctttgtgattgctgtgtttgtatct

SEQ ID NO: 17889 - DNA, 73 bp, Homo sapiens
gtggcttccagggtatgtgaagataattgccttaaaaaaatttccgtccagttttccccttctggggagccaa

SEQ ID NO: 17890 - DNA, 73 bp, Homo sapiens
aagtggttacacatggccttgtaatagcagctgagcatatggtgaatatggtgatgctattaaccacaaaaaa

SEQ ID NO: 17891 - DNA, 73 bp, Homo sapiens
gggaggagggtctgctgtcacagcataagaataaaagtgtaatgcaggggagcagagagagtttaagcctaaa

SEQ ID NO: 17892 - DNA, 73 bp, Homo sapiens
agggaggaggtaggaggttgtaaagaatagacacacaagtaccagaggatgcatgtgcggctttgccacccag

SEQ ID NO: 17893 - DNA, 73 bp, Homo sapiens
gtgactagctggagctctgatgatccaacccagctctgatgacccgagagcaagtctggtgccagctcaggct

SEQ ID NO: 17894 - DNA, 73 bp, Homo sapiens
caccttcccacctgccgtgaccacagagtgcccatatgaggtgctatagcacctctcagcatgggtctttgag

SEQ ID NO: 17895 - DNA, 74 bp, Homo sapiens
tgatagttatccaatggagttgaaaacttatgtccacacaaaaacctgtacatggatgtttatggcagctttat

SEQ ID NO: 17896 - DNA, 73 bp, Homo sapiens
atgtgaatagccacttgcgtacagcagcgtgccatattcaacttggcaggtttccatccccaagggccttagt

SEQ ID NO: 17897 - DNA, 71 bp, Homo sapiens
gttttctctccaccactaacactgagaccattcctaggagggaatgaggaggtgggatttgaattcaggtt

SEQ ID NO: 17898 - DNA, 72 bp, Homo sapiens
agcgggagtggggtaggggcagaggtgggagatgcagggactctggggtgaccacaggagcaagagctgaca

SEQ ID NO: 17899 - DNA, 74 bp, Homo sapiens
tgaaggccatggggctggaggagctcactcagagaatgagagcagatggaggaaaatgtccaacaaccaggcct

SEQ ID NO: 17900 - DNA, 72 bp, Homo sapiens
agcgggacgtaccaagcggcaggcggcggaggggtgcgggccggaactccgcccttcgtgctggtcggtctc

SEQ ID NO: 17901 - DNA, 70 bp, Homo sapiens
actgctattgctgaatagcaaatattccttcatcactgacctaggaattgtgtcttctgccagcatccat

SEQ ID NO: 17902 - DNA, 73 bp, Homo sapiens
cccgccccgcgcgcgcgcccccgccagcccggccctcctcctccccgccgcccctcccgcgcgcgtccaccgg

SEQ ID NO: 17903 - DNA, 70 bp, Homo sapiens
tgtaggacgcgccggggaggtggagagtccttggaggtgcctggcgagggctgcccggtgctgttggcac

SEQ ID NO: 17904 - DNA, 70 bp, Homo sapiens
tagagagccatattcatgcccagggctgagcacattctcaggaaagactggataaggccatgagctctca

SEQ ID NO: 17905 - DNA, 70 bp, Homo sapiens
gtgtctgatgaactcttgaggtgattctcatgcctgttaatgtttgagaagccccactggaggtcactgg

SEQ ID NO: 17906 - DNA, 72 bp, Homo sapiens
ttagtagagatgggatgtcacggtgttagctaggatggtctcgaactcctgacctcatgatctgcctgcctc

SEQ ID NO: 17907 - DNA, 73 bp, Homo sapiens
taggatgcagtagtcttacagccaaggcagccagtgtctttcttacttgtgagtctgtattttgttcaagtag

SEQ ID NO: 17908 - DNA, 70 bp, Homo sapiens
gctgtggcactaatccatccagaaggaatgacagctttagctagggtggcgatgatgtagcagagaactg

SEQ ID NO: 17909 - DNA, 73 bp, Homo sapiens
caggaatccagctagaatttctaaatgtagatctctccttaagggaagactctgttttaggtgagcaactgtt

SEQ ID NO: 17910 - DNA, 74 bp, Homo sapiens
tctgatctgtattctctttgctttgttttctgaccttacagaaatcccagtgcaatgttgaaagggcattctgg

SEQ ID NO: 17911 - DNA, 71 bp, Homo sapiens
tcggcactcagctgctcggtgcgctgccgcttctccttcggcttgtctgctttgggccgagcgcatgccgg

SEQ ID NO: 17912 - DNA, 74 bp, Homo sapiens
ttttaagttaagcggttttgagtggccctctctggtgatctgacctgatgagggattattacccactgttagat

SEQ ID NO: 17913 - DNA, 70 bp, Homo sapiens
catgagatgatgcaagtatagcccttgggagcctccctgattggtaagctttgtatttgtattctttctc

SEQ ID NO: 17914 - DNA, 74 bp, Homo sapiens
ccattcccactgcttcacttgactagttaaaaccattttttttaaaaaagagaagctacaggccgggcgcggtg

SEQ ID NO: 17915 - DNA, 73 bp, Homo sapiens
tctgtctcccaggctggggtacaatggtgcgatcatagcttactgcagactccaactcttgggctcaagagag

SEQ ID NO: 17916 - DNA, 70 bp, Homo sapiens
ggagaatcacttgaacccaggaggtggaggttgcagtgatcagagatcgccactgcactccagcctgggt

SEQ ID NO: 17917 - DNA, 73 bp, Homo sapiens
tcagaagcctggcatgccagcaaaagggtaaggctttcttaccagtcagacttctacctctctctccctgtgc

SEQ ID NO: 17918 - DNA, 74 bp, Homo sapiens
aggctgggggagaagggtcggggggaaggggttgcagtgtgccaagatgccaagatggtgtcagtgcactccag

SEQ ID NO: 17919 - DNA, 72 bp, Homo sapiens
tgcagacagcaggcacaggcaagcagaggcagcctcagccttttatcccctcagagcagctgctgggcagga

SEQ ID NO: 17920 - DNA, 72 bp, Homo sapiens
tctggaaagcaaatgaaatggactaatttctaaattgatgaaaatgtagtgtttgattttatttttccggtc

SEQ ID NO: 17921 - DNA, 72 bp, Homo sapiens
acctcaggtgatctgcccgcttcaacctcccaaagtgctgggattacaggcttgagtcacggcaccaggcaa

SEQ ID NO: 17922 - DNA, 74 bp, Homo sapiens
gaagacaaagtgaatatagcatagttcactgcaacctggatgttttcaactgaaatctatgttttatccacttt

SEQ ID NO: 17923 - DNA, 70 bp, Homo sapiens
gttgggattaaaggcacgagccaccgtgcccagcctgcttatgcttcttgttgctggctgtggtggtggt

SEQ ID NO: 17924 - DNA, 73 bp, Homo sapiens
agaggagcgagggaggcagtgggggtcgtctcaggctgcgtgcagaggttcagctgatttatctcaattctct

SEQ ID NO: 17925 - DNA, 74 bp, Homo sapiens
tagaaggtattatttctaatatttcagaacttgggtgtcacaaaggtggccgttttgggaaacatatactatct

SEQ ID NO: 17926 - DNA, 73 bp, Homo sapiens
gcttttgacatcataagctccatttcttgaaggcttctataaaaatccatggcttatggaaggtaaaggcaac

SEQ ID NO: 17927 - DNA, 74 bp, Homo sapiens
ggattagggactctggagcacttgtgttctgcattcgtcttgtatagacactgacgtgttatttcatttgctcc

SEQ ID NO: 17928 - DNA, 73 bp, Homo sapiens
tgaattctcaagtggtgccgatgatgctgatctgaggactacattttgagaatctctggtttagtgctgtctc

SEQ ID NO: 17929 - DNA, 73 bp, Homo sapiens
ttgcatatagtatgaggtggggatcctactagattattttgggatgtccagttttcccagcagcgtttattaa

SEQ ID NO: 17930 - DNA, 72 bp, Homo sapiens
atcagacattagagcatttatctcatgaattcctttggataaattcagagtagtagtttcatgtcaaagata

SEQ ID NO: 17931 - DNA, 71 bp, Homo sapiens
tcagaatcacattgccagggctgccctttctcctaaggaaagctgatctcatgtgactctgaagtcaatgt

SEQ ID NO: 17932 - DNA, 70 bp, Homo sapiens
atcaccccagtaccctgtgcgtccagagcccagggtcagggcacaacctggcagcagggttcttgttcct

SEQ ID NO: 17933 - DNA, 74 bp, Homo sapiens
tttggggccagcaattgagtcattagtgggcatttactgagatgaagatggagaagaggcagatgtggccagga

SEQ ID NO: 17934 - DNA, 73 bp, Homo sapiens
aataggagatagtttattcttggaaactatagttaactcataaggactattttagtcactttgggaggccgag

SEQ ID NO: 17935 - DNA, 73 bp, Homo sapiens
ttaaggggctacagacacagatcaatgcgtatgtttactgttaagcgtatggtggttcagtccttaagctttt

SEQ ID NO: 17936 - DNA, 70 bp, Homo sapiens
gggatatattctatgtgctgatgcctatgtgggttactcagggtagttctgttatgagagagccatagaa

SEQ ID NO: 17937 - DNA, 72 bp, Homo sapiens
aggaagaagcctggattcagcatgcttgagatagatggagaatgggaataggttctaggtcagtgattccca

SEQ ID NO: 17938 - DNA, 71 bp, Homo sapiens
gcattcccatcacaactgggaggctggactggaggaaagcaagactagcagccaggagtgcaactgggagt

SEQ ID NO: 17939 - DNA, 71 bp, Homo sapiens
gcgcggggccgccggtccgacacacgcccttccctgagcggccgccgccgggcgcacgcgccccgcagccc

SEQ ID NO: 17940 - DNA, 73 bp, Homo sapiens
agcagtgccccttccactgccccctcattgccccccggagccggggggtcggggcggcggctgcgccgggcgg

SEQ ID NO: 17941 - DNA, 70 bp, Homo sapiens
taaaatagcagctgcatttaatcttgggcttcagcccaggaattggagcctgcagtgagttataatcgca

SEQ ID NO: 17942 - DNA, 74 bp, Homo sapiens
gttctctgacctatgaattgcatgttattattatctccatttcacagatggtaaaatggaaatttagaggggtt

SEQ ID NO: 17943 - DNA, 72 bp, Homo sapiens
cccagcttgcatcccataccatctgatttaggacttctactacgcagaaatatgtatttgagtaagctttca

SEQ ID NO: 17944 - DNA, 72 bp, Homo sapiens
tgttagctatatttagaaacagggaaaactgcactttgcagtgacagtttatttttgtatgtagcggatttt

SEQ ID NO: 17945 - DNA, 74 bp, Homo sapiens
taaaggctggaagtctgagatcaaggtgccagcaggtttagtttctttgaaggcttcttctccccgatagcctt

SEQ ID NO: 17946 - DNA, 72 bp, Homo sapiens
ttttagctgtcacaactgcgagggggtgctactggctactagtggctactggctctcagttggtttctggca

SEQ ID NO: 17947 - DNA, 70 bp, Homo sapiens
tgtggttggtgattaagggctgtttcccaggtttccttacagctaaatgtagttcacgtgactaaagttc

SEQ ID NO: 17948 - DNA, 74 bp, Homo sapiens
gctcctacagcatcctctacttcacagtcagataatggattatactttattgtaattgtatttttctctgtagg

SEQ ID NO: 17949 - DNA, 74 bp, Homo sapiens
tgggggtggcattctctcagtggctgctggactctctcgtggacggtgcagagccgtgcattcccctagctgca

SEQ ID NO: 17950 - DNA, 72 bp, Homo sapiens
tgcaagagttttgtggaatgtcagttacacctcagaatagttctgagctgaggtgttggagatttaagtcct

SEQ ID NO: 17951 - DNA, 74 bp, Homo sapiens
atacattttaggtcatagatatttgcattatcagagaattttgtgttatagttctatgatcctggtttatattt

SEQ ID NO: 17952 - DNA, 72 bp, Homo sapiens
gctttcagtaagatcctcccctcagctccctctagcctctaaactctaggaggacatggttatttggatcta

SEQ ID NO: 17953 - DNA, 71 bp, Homo sapiens
gacggccgtggtccctgccctggggtcaattacagagcgaggtctgagccgcagaggctgggttttaggtc

SEQ ID NO: 17954 - DNA, 72 bp, Homo sapiens
ttaatctccttcctgcaaagagagttctagaagtccagcctctgttaatttcaaacaactctctccgccttg

SEQ ID NO: 17955 - DNA, 70 bp, Homo sapiens
agcatgggacatgtggccagtaagggaggcccagaaaaaagagatgcccaataccatggccctccatgat

SEQ ID NO: 17956 - DNA, 74 bp, Homo sapiens
cgtatgtggcacaaatggctcatgagtgcaggacacttatggtcttgtgtcttatacttcatgtgtgatgccac

SEQ ID NO: 17957 - DNA, 73 bp, Homo sapiens
cattttgttctgtggactgtggacactgtcttcttgctgtaattgcctcagaacctattccctgtcctgaatc

SEQ ID NO: 17958 - DNA, 72 bp, Homo sapiens
tttttctgctagccaatctcattgctatttgttgctaggccccccagatagcatactgggggcagctgtctt

SEQ ID NO: 17959 - DNA, 73 bp, Homo sapiens
gagttcaggaatttgaggctatagtgcactatgatagtgcctgtgaatagccactgcattccagcctgggcga

SEQ ID NO: 17960 - DNA, 70 bp, Homo sapiens
ggaggcagggaggcagaggcaagctgagcgccatagcctctctctccagttgtcatattgcttctatttt

SEQ ID NO: 17961 - DNA, 70 bp, Homo sapiens
ggctaatgagcttgtcaacctttgtaaccttcaggaaggttacaaaatttatcaaacttgcaaatataag

SEQ ID NO: 17962 - DNA, 70 bp, Homo sapiens
gcagttattttatttttatggttcctttggagagaaccagagagctgctttaaaaagtgctgttgaatta

SEQ ID NO: 17963 - DNA, 70 bp, Homo sapiens
atgttgctgacatttcaatgtcacaatattaaaatattgtgccattgaagaataaatcctagaaggagca

SEQ ID NO: 17964 - DNA, 71 bp, Homo sapiens
gttagatatataggataaagatgaactgagcaccacactcctggtgctccaagtagtttatggttgataat

SEQ ID NO: 17965 - DNA, 74 bp, Homo sapiens
taagaaagtcagtaagtttcttccccactatcaattgtactgggactcctatggggatatgatatcaggttggc

SEQ ID NO: 17966 - DNA, 73 bp, Homo sapiens
aaataaaatgaaaaaaaatctacagtgaggttgtctcagtctttgtagttatgggctaccagccagcttagat

SEQ ID NO: 17967 - DNA, 72 bp, Homo sapiens
tgcagggtttatctcttcagacaaaggtcgaaaggctgatggcagtatgggtcagggaggggatgttgactc

SEQ ID NO: 17968 - DNA, 72 bp, Homo sapiens
agtagcaggaagccctaggacgctgctccagcaccacaaggtggtcctactgggtctgtgccctgtgtcttt

SEQ ID NO: 17969 - DNA, 73 bp, Homo sapiens
cagtgtcctgatatttctccatcatccttgtgtgaagtcagttccgtgctcacacccctgccacatggagagg

SEQ ID NO: 17970 - DNA, 70 bp, Homo sapiens
catcagactggataaggccagataccagaacatgagtgtgtctgatgatcctagctcagttattgcaacg

SEQ ID NO: 17971 - DNA, 72 bp, Homo sapiens
attatgttttctgtaaattgttagcagaaacatgattttccctgagtcttgctgcttggtatagatcataac

SEQ ID NO: 17972 - DNA, 71 bp, Homo sapiens
gaactatgttctccaaaaggatccactgaagtcctacccccagtacctcagagtgtgaccttatttggata

SEQ ID NO: 17973 - DNA, 70 bp, Homo sapiens
gtctagagcttatcagactgttcagggcagagtaatcctgacattttttcagtttctggaagccacctgc

SEQ ID NO: 17974 - DNA, 72 bp, Homo sapiens
gtgaattagacaacaccaagatcacatcgtgcctttcctcagagcggaacaggctgatgaaattgcaaatca

SEQ ID NO: 17975 - DNA, 72 bp, Homo sapiens
gcaggccacccacacaggtgccatcatgtcccagttcagctgggagcaaagaccccacggaaggcaccatca

SEQ ID NO: 17976 - DNA, 73 bp, Homo sapiens
ctgtctttttaaataggtagttcaagcagtctgaatctcctcgtggaggggttgggtgcggggtgggaggtgg

SEQ ID NO: 17977 - DNA, 72 bp, Homo sapiens
gggtgtaattgcaaattccttatcagactgatagggtttgatggtgattttgtctgatgctcttcgtttagc

SEQ ID NO: 17978 - DNA, 72 bp, Homo sapiens
cttatgtgaaatgtttaggactagaagtgtttgagttcttttggattttggaatatttgcatacatatgaga

SEQ ID NO: 17979 - DNA, 71 bp, Homo sapiens
ttttctctgaggaccatgttggttttctgtggtgcagcagccctgcctggatgagagagtgacgacttcct

SEQ ID NO: 17980 - DNA, 72 bp, Homo sapiens
catgagggtggatcctatctggccctcttgtttgccaagagaggatagagcaggatgtcagcagtctaaaac

SEQ ID NO: 17981 - DNA, 73 bp, Homo sapiens
gcacaggaccatggattgaagcactgatgatgacatagcaccaaaacaaatcaacaatttaagctctaggtcc

SEQ ID NO: 17982 - DNA, 71 bp, Homo sapiens
actggggttaatagaacaccacttggagggcttaaaaatctttgggaattggttctaaattagctaaaaac

SEQ ID NO: 17983 - DNA, 70 bp, Homo sapiens
ttatatagcagtaaactgagagtactgcttagagaaaggagctctttatctgggccttgaaggattgttt

SEQ ID NO: 17984 - DNA, 71 bp, Homo sapiens
gaacttcagcaaactacttattctcaattgtaatacctattggtaataacaattagtgattagcagctgat

SEQ ID NO: 17985 - DNA, 72 bp, Homo sapiens
ctcagtgcagggaaacaaaaataagtggaatggggacctctccccaccaagaggaactctgtccccaagctg

SEQ ID NO: 17986 - DNA, 74 bp, Homo sapiens
agttcctgacctatgtattgtgttgggcatgtctgactcagaaacctctgttggacccaccagcaacctttatg

SEQ ID NO: 17987 - DNA, 74 bp, Homo sapiens
gatctatctattgatagacagatagatagatagatagctcatctgtcagttgttgtcaaataccatgtgaaaga

SEQ ID NO: 17988 - DNA, 71 bp, Homo sapiens
aaagaatcttgctgcttggtgctcaaacatgggatattattgctaatcctacatgacagatgagtatagca

SEQ ID NO: 17989 - DNA, 72 bp, Homo sapiens
gtggctgaagtgggcagtttatggggtgaagggagaaatccagacaaggtgggaaagctggtctaggtgtag

SEQ ID NO: 17990 - DNA, 72 bp, Homo sapiens
aagcctaaagtaagtatcactggacagaaataaaggtgttggcaagaccatgctccttccagtggctttaga

SEQ ID NO: 17991 - DNA, 74 bp, Homo sapiens
atgaggggttagcatgctgtggtggggaaagatagaatgactctgtctagtccacaggaaaaggtcataagctg

SEQ ID NO: 17992 - DNA, 71 bp, Homo sapiens
tttggtttgattagtgctgataagaagaggagggacttccccatccctcctcagtcaccaaacatccattt

SEQ ID NO: 17993 - DNA, 73 bp, Homo sapiens
cacataagaaccatggccttggattattcactgcctgtcacaagcctcagtgtggcctgagaaatccctatgt

SEQ ID NO: 17994 - DNA, 71 bp, Homo sapiens
cctgtgcctataaaaaccctgagaccctagtggtcacacacacaagtggtcacacacacaagtggctggac

SEQ ID NO: 17995 - DNA, 72 bp, Homo sapiens
gttacatacttaaactaaagcctcaaagcctaacactggctttgtatgtaactagtgtttgacagggactcc

SEQ ID NO: 17996 - DNA, 71 bp, Homo sapiens
gcagggctgagagatccttaggccttgtgtgccaacagagcaggatgtcaatggtaaggcagccaatgtgc

SEQ ID NO: 17997 - DNA, 74 bp, Homo sapiens
ttcttagggaaactaaacctaattctaatgctttgtgaatagaaagagcagacaaaattattgggtagagtact

SEQ ID NO: 17998 - DNA, 72 bp, Homo sapiens
acagggaagtcctcgtgttgctggaaaggggtcctgatccagactccaaaagagggtgcttggatctggcac

SEQ ID NO: 17999 - DNA, 72 bp, Homo sapiens
gtcatttgcaggctgaggagcaaggaagccagtagtggctcagtctgagtcccacagcctcaaaattaggga

SEQ ID NO: 18000 - DNA, 71 bp, Homo sapiens
tatgtgactggataaaattgagagttagggacttgagatcctaggtcctgactttctcactgtctcttctc

SEQ ID NO: 18001 - DNA, 74 bp, Homo sapiens
cctccactctggaagtggattagaactcagataccctgattccaggaacatggtctctctgcctctggacagag

SEQ ID NO: 18002 - DNA, 72 bp, Homo sapiens
aatttggaagttggggatgtcagtggaaaagtcggctctgacggctcaaataacaagccccaaatgtgatag

SEQ ID NO: 18003 - DNA, 72 bp, Homo sapiens
tggctaaaaggttgtggaggtaaaatcctgagccaaagctcatggtagcaccaaaactttctggcatggagg

SEQ ID NO: 18004 - DNA, 72 bp, Homo sapiens
ctgttctgttgggggtttaggggttaaaaggaaggtctgaaacatttttcttgccccattcactggctacag

SEQ ID NO: 18005 - DNA, 73 bp, Homo sapiens
tttaatacagtgtctgtgctccacctgtgtcccacagtggaccaaaggatcgcatagtccctgtggccagatc

SEQ ID NO: 18006 - DNA, 74 bp, Homo sapiens
tatcagctcaatagtatcccattgccagggattaatttgccaaattagctagtttgggggtagtgaaaagcaga

SEQ ID NO: 18007 - DNA, 74 bp, Homo sapiens
aactgaggcgcagtagtgtggcatgcccagggcttcccccacactcccacacatggccagaggacatgaggcat

SEQ ID NO: 18008 - DNA, 74 bp, Homo sapiens
ggctgatatttagccagtattaacagttatggtgatactggttgttattattgaaaagctttcttaccagttga

SEQ ID NO: 18009 - DNA, 71 bp, Homo sapiens
tgataagatgcatcagaggctgggtgcggtggctcacacctgtaatctcagcactttgggaggctgaggtg

SEQ ID NO: 18010 - DNA, 71 bp, Homo sapiens
ctgccagggatttcccagggtcagcttaagccaatcttttggtttcctgcaacttgccttccttttatttc

SEQ ID NO: 18011 - DNA, 72 bp, Homo sapiens
tccaaaagtaaaggaaccactcttgtttatttgtcctttcagagtggactaggtgctggtaaagattccttt

SEQ ID NO: 18012 - DNA, 74 bp, Homo sapiens
tctcttggctcatcccaccttttccttctctcctttctcagtaactgtttatggggcatctccccggggaggct

SEQ ID NO: 18013 - DNA, 70 bp, Homo sapiens
gttgcccaggcgggagtgctgtggcgcgatcttggctcaccacaacctgcaccccccgggttcaggcaat

SEQ ID NO: 18014 - DNA, 70 bp, Homo sapiens
cagcagatttggtatctggtgaccacctgctttctggctcacagcttgctacagtttggatgtcccctcc

SEQ ID NO: 18015 - DNA, 70 bp, Homo sapiens
cagagcaaaggtgagtctcattactctggcttagtcttcagagagggagagaaagaccctgctctcaggg

SEQ ID NO: 18016 - DNA, 74 bp, Homo sapiens
ttacctgctccagaccacacagaggtactaccacatatcagagaatgggactctgggatcaggtctttctggca

SEQ ID NO: 18017 - DNA, 72 bp, Homo sapiens
ctataatcgtcgtactattcattgttctagtgttatctagaattgagtaataccataaagaagtgcgaagcc

SEQ ID NO: 18018 - DNA, 71 bp, Homo sapiens
tgtagcacatttaaggaacctgctatgacatgctgaggctgagcatcaatgcctttgttcctttttcagac

SEQ ID NO: 18019 - DNA, 74 bp, Homo sapiens
cctcttagaaatgaaaattcactggcctcacctcagcctgctgaaacagaacctgtagggttgggtcccaggaa

SEQ ID NO: 18020 - DNA, 73 bp, Homo sapiens
ataaggggctgagtcttaaatttcacagtggaatagctactgtaccactggtccatcaaattccccaagccta

SEQ ID NO: 18021 - DNA, 72 bp, Homo sapiens
atgtttatatccacatctaccaaatgtttagctctcacttatgagtgagaacatgcagtctttggttttctt

SEQ ID NO: 18022 - DNA, 74 bp, Homo sapiens
atgggtaggaatagtccatgcctggctggagggggtcctctgctttcagcttcagcacaggaatggtagacctg

SEQ ID NO: 18023 - DNA, 70 bp, Homo sapiens
tgcgtgactatttgtagattatttgcaaggtcttggctattgttttggtttatgagtttgcaggtgctga

SEQ ID NO: 18024 - DNA, 72 bp, Homo sapiens
atttgctgctgaaaccctaacttgtgagtcagccttagaaagagtgaaagatgtcagtagacatagtttgtg

SEQ ID NO: 18025 - DNA, 72 bp, Homo sapiens
ttcttgagtgcaatcaattttctctggggaaggaagacttcaaaggggtgtcgtttaactgagtgcttacat

SEQ ID NO: 18026 - DNA, 73 bp, Homo sapiens
agaggtcttcatatcagaggcagaaggtaagaatctgctgaatacagcagcaaaagccaggataggtcatctg

SEQ ID NO: 18027 - DNA, 72 bp, Homo sapiens
caagacctgagtaatccaagatagcaagagcagatcaatgatctctatacagaatgctctacaaaggacttg

SEQ ID NO: 18028 - DNA, 72 bp, Homo sapiens
cctttgtctcaagttcaaataccaagcttataaaagtcacagccaccttggtaacaggcattggagataaaa

SEQ ID NO: 18029 - DNA, 74 bp, Homo sapiens
agggccagggaaaggcctttacatccttgcatgcatatcagttgcagttaatggagttcataggtttattaggc

SEQ ID NO: 18030 - DNA, 72 bp, Homo sapiens
ggttcctgtctgcggcttgtgatgttctcatcagttagcacacacagacatcactgtcagtaatcattttta

SEQ ID NO: 18031 - DNA, 73 bp, Homo sapiens
ataattagcagtattgacctatggggtgatttcaggggaacaggaagggtttctgttcttccctgctcacttt

SEQ ID NO: 18032 - DNA, 71 bp, Homo sapiens
caacccatgccaacccacagagaattactgggcctcatctctacaaatcaggggttctcaatgtgggcact

SEQ ID NO: 18033 - DNA, 71 bp, Homo sapiens
ccaagttacactgttagtctggaccaggttttcgtgtccacatatgcagtagatacttcccacctgctcta

SEQ ID NO: 18034 - DNA, 70 bp, Homo sapiens
gcctttttatctggccattttatcagcaactacaagtgtgttgagtggttattattacataggaggcttt

SEQ ID NO: 18035 - DNA, 74 bp, Homo sapiens
gctttagatgttgatgtagatatgtacacatataaatatgaatgcacgtggcagtctacttgattaacattagt

SEQ ID NO: 18036 - DNA, 72 bp, Homo sapiens
ccacttccctctgactgtacacaacagggataccccacagcagctggagtactagcaggaggaagagaaggt

SEQ ID NO: 18037 - DNA, 74 bp, Homo sapiens
tgccttctctgagacaagcactgtgtctatcatgattgtaattcagtctattacctcaggcagagacatgcatg

SEQ ID NO: 18038 - DNA, 72 bp, Homo sapiens
ttataattctaccttagtcttccttgaggcttgcataaagcctcaagatcgccacagcagagaaggtagagc

SEQ ID NO: 18039 - DNA, 71 bp, Homo sapiens
aactgttgcacctcacagagtggattgtttttagaatgtggactctgtgacttcagtaatgtgtcggcatt

SEQ ID NO: 18040 - DNA, 70 bp, Homo sapiens
tgtgtgcctgagctattaggaaacactgtcaggaaagaaatgtccaacctcacatcaagtgctggggctg

SEQ ID NO: 18041 - DNA, 73 bp, Homo sapiens
cacctagctatgtgtgacatcatcattagcacttctatgttttattagaatgtggacacataggtaataagaa

SEQ ID NO: 18042 - DNA, 72 bp, Homo sapiens
ttattgttatcaggcaggtgcaatggattacacctgtaatcctaacactctgaaaggccatagcaggaggaa

SEQ ID NO: 18043 - DNA, 72 bp, Homo sapiens
tctgtttacctccttccccctagctctgttaccaccacgcagcgaacctacagcagaagaggaaggtaccca

SEQ ID NO: 18044 - DNA, 73 bp, Homo sapiens
ttttgaagacggtgaaaatggtgatgagagcacttgccatagttgtgcctctggcataaatctataccaaggt

SEQ ID NO: 18045 - DNA, 72 bp, Homo sapiens
tgttattgttgttttgttttgtgatccttaactatcattattacttttggttgagagttaagtccatggaat

SEQ ID NO: 18046 - DNA, 74 bp, Homo sapiens
ttaatatggccactaggcagtgagctgcataggtgaccacaaaagctaccactagctacaccactgcccagtcc

SEQ ID NO: 18047 - DNA, 72 bp, Homo sapiens
acattttgtgtataaacgtacggtgtcattattaccgtactttcattttataatgtaaatatagtaggaggt

SEQ ID NO: 18048 - DNA, 70 bp, Homo sapiens
gccgaaccaaatggaggtgaaggcagtcacctccatggtgtgaatttgggacatcttggctaaaacattc

SEQ ID NO: 18049 - DNA, 70 bp, Homo sapiens
ttgtttagcaccatctctgtacagttgttcttgcgatatgattctcaggagatctggtggtttaaaagtg

SEQ ID NO: 18050 - DNA, 71 bp, Homo sapiens
catgttggttgaaatttcagtgcaacatttggggagagtgtacagcactccatgtgctgcagttgataaat

SEQ ID NO: 18051 - DNA, 72 bp, Homo sapiens
tttcaatctatgtgcagacaatgtgaggacagtcttcttacattctgatgtcaagatactaaatttggatta

SEQ ID NO: 18052 - DNA, 70 bp, Homo sapiens
tcattctgtagatgattaaatttgcttcatgtttctagtcattttttctgcaggatgtctgctagcctca

SEQ ID NO: 18053 - DNA, 70 bp, Homo sapiens
cctgcttgttctctgcctgagattggaacaattgagagacaaattagtcaccgagctacaagcagcactg

SEQ ID NO: 18054 - DNA, 72 bp, Homo sapiens
aagttcactgctgagtatgtacctaatggaaggaataaatctctgaacaccactgagagtacaaatttggtt

SEQ ID NO: 18055 - DNA, 74 bp, Homo sapiens
gtattactaagaagtcagctcagcttcctattggaagttacatttgagtagtttgggataatgagtaggacttc

SEQ ID NO: 18056 - DNA, 71 bp, Homo sapiens
taccgctcacagggcattttcctagacacagaatctctgagctaagaggagggagttggaggtagatattc

SEQ ID NO: 18057 - DNA, 71 bp, Homo sapiens
agaatctataaaatgagggccagagccttaaagaagaacactatgaggcatctagctggttatcgtattta

SEQ ID NO: 18058 - DNA, 72 bp, Homo sapiens
gctgagtattggcaacaggtacaccatataggcttgctttttgttcaagtatgaatgtgcctttttccccaa

SEQ ID NO: 18059 - DNA, 70 bp, Homo sapiens
gtccagaccattaagtctttaaggggaatacaggacaaaaagaaccccggagagaagagggctgagtcac

SEQ ID NO: 18060 - DNA, 73 bp, Homo sapiens
caagtgtttagcatagtttccttcaatatatatccctgatgttgcccaggcagcgttagctattaatatttgg

SEQ ID NO: 18061 - DNA, 70 bp, Homo sapiens
cattttgagagaggtgtctgctgaagttaggctcctacctttctacagaaaatgagagatagaggcactg

SEQ ID NO: 18062 - DNA, 74 bp, Homo sapiens
ttttactgtacaattaccaggtttgtcaaatacaaactatatcaaacctatgaatctcaggttatttatagtag

SEQ ID NO: 18063 - DNA, 71 bp, Homo sapiens
ggtttgttcttgatcctaacatgttgcttatgttagaccacatgttttactgaaggagattttgggaatta

SEQ ID NO: 18064 - DNA, 74 bp, Homo sapiens
gtctcatcaaggaggtgataacctgagcaaagattggtaggaggtcaggtaacatgccaaggagatttatgggg

SEQ ID NO: 18065 - DNA, 72 bp, Homo sapiens
aatttcctgtacagctgcctagagcatttttatatgctcttttatcagacaaacagaaataccaacatacat

SEQ ID NO: 18066 - DNA, 70 bp, Homo sapiens
agagacatgatttacggaaggtgaaaaccactaagtggtagaatgagatggataatgtgtgtctcagctg

SEQ ID NO: 18067 - DNA, 73 bp, Homo sapiens
tgtctacccagtgtatagctgctcaagaatatgacacaggtccttttgaggaagcttagacaaaggattgata

SEQ ID NO: 18068 - DNA, 74 bp, Homo sapiens
taatctccattctacagttggtgttttaatggattcattattacttttggtatgttaaggccaacagatcagga

SEQ ID NO: 18069 - DNA, 71 bp, Homo sapiens
gatgatagcaccatggttttggctaaatggaagggtatccattaggatatccagcaaactcttcttagatt

SEQ ID NO: 18070 - DNA, 72 bp, Homo sapiens
ggagcagggagagattttaacagcgtaaaactctcagaggcctttgatacttaagatgcagcttccagcttc

SEQ ID NO: 18071 - DNA, 72 bp, Homo sapiens
agtattgagcccccaaagtatagcatgagtgtatgcttgtgtttgcaaggagggactgggcgtgggtgagag

SEQ ID NO: 18072 - DNA, 74 bp, Homo sapiens
acatgagatcaatggctttcaagtgtgactgtgcaatcacattgccagggcaacttttcaaagagcctgagtct

SEQ ID NO: 18073 - DNA, 73 bp, Homo sapiens
atatttctatgccttcatcttgaaatatcatcaatatatggctgagtaatagcagatagtggatatttcaaga

SEQ ID NO: 18074 - DNA, 74 bp, Homo sapiens
gcagagtcgagtagagtagctgcgacgagactacaaagttgaaactatctcccagctgatcctttgcagaaaaa

SEQ ID NO: 18075 - DNA, 71 bp, Homo sapiens
aggagtcatgttatacaacttccactgagacatttcctgacaccacactggaaggagcagcaggtcctttg

SEQ ID NO: 18076 - DNA, 72 bp, Homo sapiens
cctcactatcagtcaataaagtgaagggccattactaccaggtagactttagccaacatgtttcctactgat

SEQ ID NO: 18077 - DNA, 70 bp, Homo sapiens
gctggcatagactggactactgctagaacacttgtaatcctgtaagcactcaagagtcataacaggccag

SEQ ID NO: 18078 - DNA, 70 bp, Homo sapiens
tgcttggggctccctgactgctctccacattgtcacgggagttaccgccttgtaatgcacagctcactag

SEQ ID NO: 18079 - DNA, 72 bp, Homo sapiens
caggatctaattaacatatatatgattatatatataataggttatatatatatgattatatatataataggt

SEQ ID NO: 18080 - DNA, 73 bp, Homo sapiens
gtcctgagttaggtgagggctgcggagatgaaggtgactctgaagacgcgtcctttctgctgggagcagaaga

SEQ ID NO: 18081 - DNA, 73 bp, Homo sapiens
aagcagggctctgcctcagtcccaaccctacatggtcatttgatagaggtttgagaggtttcacttcagaaca

SEQ ID NO: 18082 - DNA, 74 bp, Homo sapiens
aaatctgctgagttgaggttattgatacaatatcgtaaataaaatgatgtgcaatatcacaaagctcaaaaaag

SEQ ID NO: 18083 - DNA, 74 bp, Homo sapiens
ccgttacttttgctcacgcgcgcatgcgcataaggggtgtggcgacgtgcgggcgtgggggcggtgcgtgcact

SEQ ID NO: 18084 - DNA, 72 bp, Homo sapiens
gacgcacgtggccatgtgatccaccgcctcagaaggtccccaggaaatgtggtaaacttgctacggctccca

SEQ ID NO: 18085 - DNA, 74 bp, Homo sapiens
acccagctaggcgaacactgatgggtcagattcatgctgctgcgatcatcccagtgccctcacgctgtgccagt

SEQ ID NO: 18086 - DNA, 72 bp, Homo sapiens
ctggagtcctaatgttaaacaggactagacgctttactacctaaaaaagaggctattgtttagcagggaaag

SEQ ID NO: 18087 - DNA, 71 bp, Homo sapiens
gaaaaagacagaacttgttgtgccacattcttaacctagaagagagtcagctcagtgagcccttctgacct

SEQ ID NO: 18088 - DNA, 70 bp, Homo sapiens
gttacttcatctaatcctcagccagtgtcttctagactgacactgtccaatagagacagtaacttgagcc

SEQ ID NO: 18089 - DNA, 74 bp, Homo sapiens
actgacatctttgggacgagcacaggacatcatcctccagctcagtcccctttgctaaagacacactcaggagg

SEQ ID NO: 18090 - DNA, 72 bp, Homo sapiens
gaaagtctcaacccactgggcattttttactgcaggactttggccttctgttcatgggaaatggccagaaac

SEQ ID NO: 18091 - DNA, 74 bp, Homo sapiens
atcaaagcacattgtagactgtaaagtaccctatgaacataaggtgctactaaatgcaaatacaagccacagct

SEQ ID NO: 18092 - DNA, 71 bp, Homo sapiens
gggtgcccgtgtatacgcaggatgtcagtttctgaatgaacacttgctttatgagtgcattggagacctcc

SEQ ID NO: 18093 - DNA, 72 bp, Homo sapiens
tttcaatctgagcgaaggtggaggtgcattagttgctaagccctaatgttcttgttgtacctcccacaccag

SEQ ID NO: 18094 - DNA, 71 bp, Homo sapiens
cgcgcccggggggcccctccccggcgcacccccctccccagcgcctccccccctacccccagcggcgcaca

SEQ ID NO: 18095 - DNA, 70 bp, Homo sapiens
aatggactggcctcctctcctagggttggctgccgcttgttggggatgtggataaggcacttcgggtctt

SEQ ID NO: 18096 - DNA, 73 bp, Homo sapiens
aaaatagcataaactggactgcatataaatagcataaataaatttctcacgatgtgagaggctgggaagtcca

SEQ ID NO: 18097 - DNA, 74 bp, Homo sapiens
tgtgtatgtgttggtagggggtggacctgtgccttgcaggacatgtggctgcatccctgacctccacctaccca

SEQ ID NO: 18098 - DNA, 74 bp, Homo sapiens
ccagatgggcccaatgtcatcaaaagagtccttagaaggggaagaggaaggcaggagagaaccaataaagatgg

SEQ ID NO: 18099 - DNA, 74 bp, Homo sapiens
actctctgtggcatgggagaccacttgcccatccctcctgacttgaggggcgttttgtctccattctccttcgg

SEQ ID NO: 18100 - DNA, 74 bp, Homo sapiens
agcaggcaggagagggtgggatgagcagtttgctgaacctcctggcttccttctttctctccctgtgtcagatg

SEQ ID NO: 18101 - DNA, 72 bp, Homo sapiens
gcatttgcatgttatccatggccaatcaaatacaaacagggctttatgtttgtggaagccggtgggaagcag

SEQ ID NO: 18102 - DNA, 71 bp, Homo sapiens
gttattgatgggaagaggaaagaagtgggctgtgcttgtgtcgctctgctgagctgagccactttgaggct

SEQ ID NO: 18103 - DNA, 72 bp, Homo sapiens
ataaggacatgctaaagtccaggctggtgggatcgctcccataatggatttgagaggaccacgtgattcaca

SEQ ID NO: 18104 - DNA, 72 bp, Homo sapiens
ggccctgcaatcctgtcctcagtgttgtgcacacaggtgcccccgcacgcaacctctggccctgcagtcctg

SEQ ID NO: 18105 - DNA, 73 bp, Homo sapiens
tggtaaaaatattgcttgggtagaatccgatctttgtcccaaagattattatatacgtggtatttgtattgtt

SEQ ID NO: 18106 - DNA, 72 bp, Homo sapiens
gaaacctccggcagcacagcaggctctctgtgtcctgccttggctcacctctcgtctgctgcatctgcctgt

SEQ ID NO: 18107 - DNA, 73 bp, Homo sapiens
tgaatgtcgaccgggaaagcgatgggaaaagctgttcagacacagctgagctgcctctacctggtcacctgca

SEQ ID NO: 18108 - DNA, 72 bp, Homo sapiens
cctagcaattgacgagacctgcgcctgccctggagatgatttcaggagactttgcaggtgcaactgtatcta

SEQ ID NO: 18109 - DNA, 72 bp, Homo sapiens
gtctgtgctgctcactcaggcctcacagctggtgcttcctcattgagtcagcgagctttccttcccagaaag

SEQ ID NO: 18110 - DNA, 72 bp, Homo sapiens
ttcttttcttgcattgctgtgggtagtttagccccatagtgcagtgattaacagaatcagttatagtgggtc

SEQ ID NO: 18111 - DNA, 73 bp, Homo sapiens
gacagtgtctttgagagggcagaattttttcattttcatgaagttcagctcatcagttacttctgtcatagac

SEQ ID NO: 18112 - DNA, 73 bp, Homo sapiens
aggagagcttatcagactgaaaacctgtgaagtcgtttcacatttcatcagcagtttaacagtgacaggtact

SEQ ID NO: 18113 - DNA, 72 bp, Homo sapiens
cgtggacgggaacgccgtgtgactcactgtgtcttaggtttactcctacgttcgctcataaggttgagattt

SEQ ID NO: 18114 - DNA, 72 bp, Homo sapiens
ggagggcctgggggccgtggaggtggtgtctgcagctgcctgtgaaggtgggaagaggccccaggcccccat

SEQ ID NO: 18115 - DNA, 73 bp, Homo sapiens
gtgcagtgggtgctcagtaatacagggctggtgtacagtaggtgcttagtgaatgcagggctggtacatagta

SEQ ID NO: 18116 - DNA, 74 bp, Homo sapiens
cactcccctccgtcccctccagcatgaccttcgacagagatgggtgcaccgcagcgtgggggctggcaggtgga

SEQ ID NO: 18117 - DNA, 73 bp, Homo sapiens
cccccagatgcgctgggaggggctcccgagcccgggagatccagggctgggctgggcagagaccccggccgga

SEQ ID NO: 18118 - DNA, 74 bp, Homo sapiens
ctttccgggcggctttgctgggcgggcttcccttgggagaggtgggagccccctccagaaaggccgtgtcccgc

SEQ ID NO: 18119 - DNA, 70 bp, Homo sapiens
cgcggggaggggatccagcccctggggggacgaacggggaaaccgaggcgcgcggggcggggatccagcc

SEQ ID NO: 18120 - DNA, 74 bp, Homo sapiens
agggcgggctgggcgggggtgtcaccggggtacccactcacggcccgtctcgccccagcccctgaccctgcggc

SEQ ID NO: 18121 - DNA, 74 bp, Homo sapiens
acagccccccgagcctggaggaagagggggcaacaacacgccacctccatggcacccccagcctggcagctgac

SEQ ID NO: 18122 - DNA, 74 bp, Homo sapiens
tggagaatggctgtcggtgttgcccgggtgtggctgggctgaccggggcattttcgggggcttttatcagatcc

SEQ ID NO: 18123 - DNA, 74 bp, Homo sapiens
ctagtgttcagcgtccaatttcatcctggccctgagtgtgtaacggctttgcccttgcggggccccctgggatg

SEQ ID NO: 18124 - DNA, 72 bp, Homo sapiens
gacctgggctgagacgggatacagaactgggtacaggagcctgcagctagggctgagtcagggcaggcccag

SEQ ID NO: 18125 - DNA, 73 bp, Homo sapiens
cgggggccccgccggcgccacggccactttctccaaggcctgaggcgccccggccccgcgccctccctgcctc

SEQ ID NO: 18126 - DNA, 72 bp, Homo sapiens
tggaaggcagacgcgacagggtgggtgaggggggcgggggtcccccactctgccatcaggatggggtaaaca

SEQ ID NO: 18127 - DNA, 72 bp, Homo sapiens
acgccggggcgcgcggccggcgggagcccgccccctccccggatgcttccctcctggccccgggcgcgcccc

SEQ ID NO: 18128 - DNA, 74 bp, Homo sapiens
gagtttcacccttgttgcccaggctggagtgcaatgatgcgacctcagatcactgcagcctctccctcccgggt

SEQ ID NO: 18129 - DNA, 72 bp, Homo sapiens
caccccgtggtggcctcggtccccagcatctccacccaaggccgtgcaggggagcaggtgcctgctttccct

SEQ ID NO: 18130 - DNA, 72 bp, Homo sapiens
gatccacctaactggcctggcacctggtgccacgtgctgctgccgccaggatatgcgccttcccacaggtgc

SEQ ID NO: 18131 - DNA, 72 bp, Homo sapiens
ctttttctgtcacactcatcaacaactcctgttggctagtgttcaaaagagattcctaatccagtcattcct

SEQ ID NO: 18132 - DNA, 74 bp, Homo sapiens
gatggtctttaaaatcgtatccagagtcatttgtatttttgaagatgcttcatggtttcttacaggaaggtcgt

SEQ ID NO: 18133 - DNA, 73 bp, Homo sapiens
aaaggcaggctgtaaacgcccacaacagctccctggagcctcgtcacggcagggccagagttcacagccaccc

SEQ ID NO: 18134 - DNA, 71 bp, Homo sapiens
caacctggctcagttcagctggagacagggccgacccgcttgttggagtcgtcacgaggactgaggtgcgt

SEQ ID NO: 18135 - DNA, 73 bp, Homo sapiens
cccagccagaccccgctgcaccctcagcggcctccagtgcaggctcaactgtgggctcagctggagtcaccgg

SEQ ID NO: 18136 - DNA, 70 bp, Homo sapiens
gacccaaatagaacgtacaaagaggctgagagggtctggggctgcaaggcggctcccggctggacttccc

SEQ ID NO: 18137 - DNA, 72 bp, Homo sapiens
ggaagtccctgcacccctagtccacaggttcctggaaggcgttccttctcctgtccactagagtgcgccaga

SEQ ID NO: 18138 - DNA, 73 bp, Homo sapiens
gagggacgcgcgcctttttcgtcccgcctcctcctgcttcaaaactccggggctgggatgcggggggcgcggg

SEQ ID NO: 18139 - DNA, 70 bp, Homo sapiens
ccaggggcagcgacatggccggggggcgggcgaacggcagcgctggggcctcggggagtctcggagctgc

SEQ ID NO: 18140 - DNA, 72 bp, Homo sapiens
tccccaggctgagcaaaggcagcacaggacacagaacacgcatttgaggctttgcgccgcagcttggattta

SEQ ID NO: 18141 - DNA, 73 bp, Homo sapiens
tagcagctaatgccactgggaacatggctccgaggctccgaacctgagcttgctcagtcagcaccagtggggc

SEQ ID NO: 18142 - DNA, 72 bp, Homo sapiens
ctgtctcctccctcggctcatccccggccccctggggcggccgcctgctcagagccgatcaggtgtcagagt

SEQ ID NO: 18143 - DNA, 70 bp, Homo sapiens
ggcagcggaaggaaggccagcaggacatgctgtgctgggaaaagccagcaggtctccacttctccctttc

SEQ ID NO: 18144 - DNA, 72 bp, Homo sapiens
atctcttctgtcactacgaggcttccaggtgctacgctttataaccatggcttcctgcctttgacagacttc

SEQ ID NO: 18145 - DNA, 73 bp, Homo sapiens
gggggacgggaccgcttcaccgctgagtcctacacagttctgggtaaggaaggggagaagaaaggggagaggg

SEQ ID NO: 18146 - DNA, 70 bp, Homo sapiens
tgggggctgcaatcggatttggaagaccctggggcttgggggcatgtccagttttcccagctccctaaaa

SEQ ID NO: 18147 - DNA, 73 bp, Homo sapiens
ctacaaagccctacccttatggggctcccagtcccgtggggagacgggggtacactacacacgttaaccaata

SEQ ID NO: 18148 - DNA, 71 bp, Homo sapiens
ttttcctaagagttgggtagttctgagctgggtatactagctcacatctatatgcccaatgctttggaagg

SEQ ID NO: 18149 - DNA, 72 bp, Homo sapiens
ccagctgctacgcctgagtagtagttgccaccagcccagaccagccactaccccccagcagcgctcagcacc

SEQ ID NO: 18150 - DNA, 70 bp, Homo sapiens
cagctctgggtgtgcagtttgcaaatgctccacttctctggataaggccaggtccatctccaatgcagcc

SEQ ID NO: 18151 - DNA, 71 bp, Homo sapiens
tcctgccgcagaagtggggcggccttgattaagcagccagtgaaggggaacgccccagtttgcagtggctg

SEQ ID NO: 18152 - DNA, 73 bp, Homo sapiens
ataaatgttaccagttagggtctggagtcttcctttttgcctaggatctatgccactgtctgccacctttttc

SEQ ID NO: 18153 - DNA, 73 bp, Homo sapiens
tctgggcgggtctcagcctccctcgggctcagaaccttcttctgcgcttgactttcccaggaattgactccag

SEQ ID NO: 18154 - DNA, 72 bp, Homo sapiens
taaacagatccacgtacacgcaaacctccactgactgcacacgtgaaacgggaagtgtgtgtcgtgtgaact

SEQ ID NO: 18155 - DNA, 73 bp, Homo sapiens
gctggagcagcaaacaactgcttagggatttgaagccaggtgtcctaacttcctccatgggcgctcagcctgg

SEQ ID NO: 18156 - DNA, 72 bp, Homo sapiens
cttctgcttcctgggttcaagtaatcctcctatttagtcccccaaatagctgggaccacaggtgcacggcac

SEQ ID NO: 18157 - DNA, 72 bp, Homo sapiens
gagtgagtgggagactcccggctcaaagccagacactgactatatgcattgctgctccatagctagactccc

SEQ ID NO: 18158 - DNA, 72 bp, Homo sapiens
gggcggggccaggcgcaccgccctcggctgagtctccccggggagggcggcgggcggcgggcggcggggacc

SEQ ID NO: 18159 - DNA, 70 bp, Homo sapiens
taaaataatatttggggccacagctggacttggtagctcacgcctgtaatcccaacactttgagaggccc

SEQ ID NO: 18160 - DNA, 72 bp, Homo sapiens
ggccgccggctccccccgggcccgcaggaagccccccgcccgccagccccgccggcggccccctcggcccag

SEQ ID NO: 18161 - DNA, 72 bp, Homo sapiens
gaccctcccacccctcctccccgcgccatgcttggaaggccgactgaggccgccatgctgagtgtggccgcg

SEQ ID NO: 18162 - DNA, 70 bp, Homo sapiens
cctaatgcaatatcactggtgtccttgtaagatagttatatgtctgcctggttctgtgtaggtggttggg

SEQ ID NO: 18163 - DNA, 72 bp, Homo sapiens
catctgcgaccaggctagggctgtgctgtcaggctcctggccggcccactctgtctgttcccagggtctcct

SEQ ID NO: 18164 - DNA, 74 bp, Homo sapiens
agaatcacttgaacctgggtggcggaggttgcagtgaggcgaggtcacgccattgcattccagcccaggcaaca

SEQ ID NO: 18165 - DNA, 70 bp, Homo sapiens
ttcaccaccagagggcgctgctatctagggtaaaccccccggggccgcggttgtcaaaccgggtatatac

SEQ ID NO: 18166 - DNA, 71 bp, Homo sapiens
acgtggaaggaagatccagaattatcccacggaaatcttaccatcgtcacaccactgggcgtttccttccc

SEQ ID NO: 18167 - DNA, 71 bp, Homo sapiens
gacaaagagaagcctgaaaaatcaagctgcagacatagataagcaactgcaagcttgcatgggtgaatcct

SEQ ID NO: 18168 - DNA, 72 bp, Homo sapiens
acgggtttggcggcgcggagaaagcgccggaaaacacagcagcgctccgtgacgtcacttccgcctccagcc

SEQ ID NO: 18169 - DNA, 70 bp, Homo sapiens
ggaggtgggggaggggtgcccgtcacgtgtttgtaaatttcaccctccgggggcatttcccacgttgcag

SEQ ID NO: 18170 - DNA, 73 bp, Homo sapiens
ggccgcagacaccttgggcctggccagcagcgcgcgccacaccgccctgccgccgtccccatgcgcgccccga

SEQ ID NO: 18171 - DNA, 70 bp, Homo sapiens
aattttggtaataataacagtgatggttgtaatagtagcagcaccaagtcactgaacatctgctcttcac

SEQ ID NO: 18172 - DNA, 72 bp, Homo sapiens
aagccaacctggaccgcatcagagtagcaacaagctatcacacagaagtggcttcccttccaggccactaag

SEQ ID NO: 18173 - DNA, 74 bp, Homo sapiens
ctggaagaagcgcttgagcgtgcagacctgcagcacagccaccagcagcagcaccgccacgttgacagctgacc

SEQ ID NO: 18174 - DNA, 71 bp, Homo sapiens
ctcccaaagtgctgggattacaggcgtgctggattgtattttgctgtcagtttcagtttatttgacttaga

SEQ ID NO: 18175 - DNA, 72 bp, Homo sapiens
tgcttgtgctgtgcgctgaagagggctttgtgcagtacttataatgccgaggttgcagtgagctaacttgca

SEQ ID NO: 18176 - DNA, 72 bp, Homo sapiens
atggcggctgccgttctgcctccgtgacgcgcgggggtgtgtccggagggcttcccggaggaggtggcgtgg

SEQ ID NO: 18177 - DNA, 74 bp, Homo sapiens
gcccacagtcccccagtctctcccagtttatggggtgacaacaaagtggtcatccggagagaaatctgaccttg

SEQ ID NO: 18178 - DNA, 70 bp, Homo sapiens
gtctacctgaaggctcactcttagcatgtcctctagcattcgtgtctagtggcctcaggttcccaaagat

SEQ ID NO: 18179 - DNA, 74 bp, Homo sapiens
gaggggggttagggaggagtgagtgggactcaaatccagatgccttccccgtccgtccgtccgtccgtccatcc

SEQ ID NO: 18180 - DNA, 73 bp, Homo sapiens
ccagttcggcctgggtaaacaccccccggggcattcccctcaacggatcccagcaacgcctcgaagtcagatc

SEQ ID NO: 18181 - DNA, 73 bp, Homo sapiens
gaagacagcagcaatctctgttttgaaacacagggagccccgctgtgcggagatccaggcacctttaattcag

SEQ ID NO: 18182 - DNA, 71 bp, Homo sapiens
tctagacacggtaagaaagaacttggtgggggccgggggcggtggctcacacctgtaatcccaacactttg

SEQ ID NO: 18183 - DNA, 70 bp, Homo sapiens
attaaaaactagcataccttgcagccaggtttcttgggttcggcctaggcattgcaatttcctggctgtg

SEQ ID NO: 18184 - DNA, 73 bp, Homo sapiens
gttgctttttggtgtgtgtttgctgttaccgcttaaattaaccctgagtgacggcttgcaattcgccacaaag

SEQ ID NO: 18185 - DNA, 74 bp, Homo sapiens
gcaccaacccggccctccttgtccacagggcaccagccccagaaggtggcccggcgcgtgttcaccaacagccg

SEQ ID NO: 18186 - DNA, 72 bp, Homo sapiens
ttgagctaagcaggtgggagcggggcacctagtcctcctccccactggctgccttctttcccacaggtgagt

SEQ ID NO: 18187 - DNA, 74 bp, Homo sapiens
ctgcccgggtcggggatggggaggggcgtggccggagcgcaaagccccgcccctccgcgccccccccccggaag

SEQ ID NO: 18188 - DNA, 71 bp, Homo sapiens
ctccaccccccggccacacgtgtcctattcccctgtgatccgtaaggccggcggctcggggcccccgcagc

SEQ ID NO: 18189 - DNA, 73 bp, Homo sapiens
ctcatccttcagctcgcagtgcaggtataattttaagtggagtcaaggggttatttgaccgatgcctgcctcc

SEQ ID NO: 18190 - DNA, 72 bp, Homo sapiens
aggcaaactgacttagaaattaccaaccttgcaaaaaatagaagatttcttaaagtcagtgagcatgatggt

SEQ ID NO: 18191 - DNA, 70 bp, Homo sapiens
gggcaggggggaagggcacctagctaggacgtttgatttaggacctggttggggccactgacccctgccc

SEQ ID NO: 18192 - DNA, 74 bp, Homo sapiens
tagagctactatttattgggcatctaggctgtgccacaggctaaatggccaggcggatagagatacctactctg

SEQ ID NO: 18193 - DNA, 70 bp, Homo sapiens
acaagccgcctgctcgccccgctccccggcgcacccgctccgggaggggggcggtgggcgcgcgcaaaac

SEQ ID NO: 18194 - DNA, 71 bp, Homo sapiens
cccccggcagcgcgcgggcggggtccgccggcgccgtccggtcgccccgggactccagacgcaggtgcgcc

SEQ ID NO: 18195 - DNA, 72 bp, Homo sapiens
ggttgttctgtggcttctctccaggccttgtaagtggctggctgttccctgagacttcacattgtcttcctt

SEQ ID NO: 18196 - DNA, 72 bp, Homo sapiens
gagccaccgcgcccagctagcttttttaaccttgtagctatcttacttaggaatagaatgggaggcaggttt

SEQ ID NO: 18197 - DNA, 73 bp, Homo sapiens
tgggttatgaccgctatgtggccatctgccaccccctgcgctactctatggtcatgagacccaccgtttgcct

SEQ ID NO: 18198 - DNA, 73 bp, Homo sapiens
aacgggggtcgctgcgtccagactggggcctattgcctttgtccccctggatggagcggacgcctctgtgaca

SEQ ID NO: 18199 - DNA, 74 bp, Homo sapiens
ctcagtctcctgagtagctacgcctgacatctttgttttgttttgagagtctcgctctgtcacccaggctggag

SEQ ID NO: 18200 - DNA, 70 bp, Homo sapiens
ccacccgcgccccgccggccagcccaagcccgggtccgacggcaccaaaggcaggacagccgcgagcgac

SEQ ID NO: 18201 - DNA, 72 bp, Homo sapiens
gggggaggctcccactggtggctggcctgatacttcttaacatggctgcacctccgacctccccaggctgaa

SEQ ID NO: 18202 - DNA, 71 bp, Homo sapiens
gttagttataacaggaaccttgctttagtttagaatagctcttaaggttgacctgtgggtaataaaaggtc

SEQ ID NO: 18203 - DNA, 72 bp, Homo sapiens
tccaaggctgtgccattgaaacggcctcatctggggtagatacccgagatttgtcatctcatggccatggag

SEQ ID NO: 18204 - DNA, 70 bp, Homo sapiens
aaagtgctgggattatagacatgagccactgcacctggccattctctaatattttctaacttccattata

SEQ ID NO: 18205 - DNA, 73 bp, Homo sapiens
ggggctgccaggccctcccatcccgccgtggaggtggaacaggttgggccctgaaattcaggcagccccctga

SEQ ID NO: 18206 - DNA, 74 bp, Homo sapiens
aagcatcctgggtgctcacatgcatgctacctaataatacacaggcttggtggtagagagcccatctagctccc

SEQ ID NO: 18207 - DNA, 73 bp, Homo sapiens
tggtaagcggatgagccacctggtttatgcatgtgatggaacattacacagcaatgaaaaggagtgaccttct

SEQ ID NO: 18208 - DNA, 70 bp, Homo sapiens
gggagttctagggtctttttttttttttcttttttccttatgcttctgtaggcattgaagccctagggca

SEQ ID NO: 18209 - DNA, 73 bp, Homo sapiens
aatcagccacagggcctggctgccaatttgtttcctagtgattatccaggatagatccgatttctgcaggcct

SEQ ID NO: 18210 - DNA, 73 bp, Homo sapiens
gggtaagcagggcacattgactagcaaccatgtagtaccctcccaaatggcaatgttgtcctagcacctggac

SEQ ID NO: 18211 - DNA, 70 bp, Homo sapiens
gctgcctggacacagggtgggcaggccggggagccgggaaccgcccccgccgcccctcctcctccctccc

SEQ ID NO: 18212 - DNA, 71 bp, Homo sapiens
cataatggcactgcgatacgttctaggggcttaatgggaaaattccatttttagccaggccagcatctgac

SEQ ID NO: 18213 - DNA, 71 bp, Homo sapiens
cctctctctgtcctctaggtgtgtttggtggccggggccgaggtgggatcccgggcacaggcagaggccag

SEQ ID NO: 18214 - DNA, 71 bp, Homo sapiens
gtttttgagatgaagtgtcactgtcacccaggctggagtgcagtggcacaatctcagctcactgcagcctc

SEQ ID NO: 18215 - DNA, 70 bp, Homo sapiens
caccagggatggctgatgggacaggccccacaaatggaggaagagcggggccgagggagccatctgacca

SEQ ID NO: 18216 - DNA, 73 bp, Homo sapiens
atcgcttgaacctgggaggctgagatagcggtgagccgagatcatgccattgcactccagcctgggcaacaag

SEQ ID NO: 18217 - DNA, 73 bp, Homo sapiens
ctgggagctgcctcaggagccccaaggagaacactggagtggggggcacagcaggcacagcacataccggaga

SEQ ID NO: 18218 - DNA, 71 bp, Homo sapiens
aattggggtcctgggtagtggggcctagtcaataagtgacctagtctggtcactaaggacctggtcagtca

SEQ ID NO: 18219 - DNA, 74 bp, Homo sapiens
gttcctgtataaagattctcggttagagctagttttggaccccccacagtagttaagaggacaggcagcagcag

SEQ ID NO: 18220 - DNA, 72 bp, Homo sapiens
actttggtttttctcataggagaaattgtgacatgtctctgaacccagcacctcggtgatgtcactgttctc

SEQ ID NO: 18221 - DNA, 72 bp, Homo sapiens
caatcccatatgtatctaggttcgaggtgtaagattcaatagctcatgtatgttgggcctacgtaaagagtc

SEQ ID NO: 18222 - DNA, 72 bp, Homo sapiens
tgtcatgcatggatccagtacaccattgagatcatgactcatgtacttatacccaacatgacatttcactgg

SEQ ID NO: 18223 - DNA, 73 bp, Homo sapiens
ccccgcgcacggggtcggcagcaggaagcccgcggggacagccttccctgacgctcgcccgcgccgacctctg

SEQ ID NO: 18224 - DNA, 73 bp, Homo sapiens
ccacggcagggatggcttcgaatccgagcccccgacaccccggccccgtccgcccagcccgcaccctgcgtgg

SEQ ID NO: 18225 - DNA, 74 bp, Homo sapiens
aaagagaaagaaataaagggcatctaggctgagtgtggtggctcacacctgtaatcccagcactttgggaggcc

SEQ ID NO: 18226 - DNA, 74 bp, Homo sapiens
ggagggcctcccggtgttgggagtccctcaccaaagaactttgtgaaactcttagcggtggatcactccactcc

SEQ ID NO: 18227 - DNA, 71 bp, Homo sapiens
atctctccaattagctgggtccagagaggagagtcctcaccactatgagctgggtttagaaatgattcacc

SEQ ID NO: 18228 - DNA, 70 bp, Homo sapiens
gcattcttcccacagagataaaactttcttttgattgagaagtctggaaacactgtcttggtagaatcta

SEQ ID NO: 18229 - DNA, 72 bp, Homo sapiens
cattctccagtctcgagcacccagggacaaaattgagcagtttaattgtagagacatctgggcaactcaggc

SEQ ID NO: 18230 - DNA, 73 bp, Homo sapiens
ctcccgtttgactccaggcagtctaatgatagaaatacctggttgacttcaggcattgtaatgggagagaccc

SEQ ID NO: 18231 - DNA, 72 bp, Homo sapiens
tgacatagctgcctggaatgtacactgcacactgcagtgttccttccaaagatggagccacttctgtgtctc

SEQ ID NO: 18232 - DNA, 74 bp, Homo sapiens
attttataatctcatctaaaaactgttgatatgaaacataacaacagaaatacaaacagtgaatcttgatgagg

SEQ ID NO: 18233 - DNA, 72 bp, Homo sapiens
actgtgaaagtctcattcgacttgtcttccttctgttttgaagggaaaaagaaaatgtgtcctggcagtcat

SEQ ID NO: 18234 - DNA, 73 bp, Homo sapiens
cctgcatccactctatcaggaggcagaaagggagcatctgagacctaatactgcctgcatgcagaagtggtcc

SEQ ID NO: 18235 - DNA, 72 bp, Homo sapiens
atttccgcgaagccccagtgcacgtgatgggaacgtgctcccacttcctatgagttgctagaatgccgaaca

SEQ ID NO: 18236 - DNA, 74 bp, Homo sapiens
ccagggtggttgtgaaggttcaataaggtgcatatgcaatatgcttagcaccaaaactggctcgtaattacatg

SEQ ID NO: 18237 - DNA, 71 bp, Homo sapiens
gatttggtgcccaagagcagcccactggcgcaaggcagggcgctaaggtgatgatgtggctgagaagcatc

SEQ ID NO: 18238 - DNA, 70 bp, Homo sapiens
gcgactcgtgcttctcccccgcccctggccgcaccgccagagcctggctggggcgcgcctactcccgctc

SEQ ID NO: 18239 - DNA, 72 bp, Homo sapiens
gaactgctgggctcaagcaatcctccctcctcagcctcactggcagctgggattacgagtcccacccaacct

SEQ ID NO: 18240 - DNA, 72 bp, Homo sapiens
tgggcctgtctcaaagaaaccccaggccaggaaggagccccagaggtgctcagttcagcagagagagccatt

SEQ ID NO: 18241 - DNA, 71 bp, Homo sapiens
aggaagatggttgaattgaaaccaaaggtatggtcagtcacaggttttaaagattttcctgcggtgttgtt

SEQ ID NO: 18242 - DNA, 74 bp, Homo sapiens
cttcggcaggaggggccagcgtgggtgaggaaaggactgtgccatcaggcgccctgtcctccctcggtccaccc

SEQ ID NO: 18243 - DNA, 74 bp, Homo sapiens
agagcctgggctgcccagatagcggggtggaggtttgcttgcaggtagctccctgtccaggcgccttgtacagt

SEQ ID NO: 18244 - DNA, 72 bp, Homo sapiens
ctaaatagcagcgactcagtcagggtcctagggggaccatcccacagaagttaggggaacctgagaactggg

SEQ ID NO: 18245 - DNA, 71 bp, Homo sapiens
taactcactggagactgccactagtactcccctttgcgggtggacggaaggttaatggtgattcccatatt

SEQ ID NO: 18246 - DNA, 73 bp, Homo sapiens
ctccttaaagtgctaataggatgacatcctatgagacatgatcatctggggatgtcaaggtggactcctggaa

SEQ ID NO: 18247 - DNA, 71 bp, Homo sapiens
tccacttcatcagacgtgtatctgggacacagtgtctccacctgtggacctcatggggtgggtatgagggg

SEQ ID NO: 18248 - DNA, 70 bp, Homo sapiens
ggctgcacctcatggtgtgacgtccaccttctgtaatgaatgcacttggagcccacgggggtgacacagc

SEQ ID NO: 18249 - DNA, 72 bp, Homo sapiens
cctccagctccacacaaattgctgtaaaagacattatttgatttgtctttatggttgtgtagtattccatga

SEQ ID NO: 18250 - DNA, 72 bp, Homo sapiens
ccaaggagaaggtgtccacacctcgggctgacagttgtcaggcaggcgggcagcagcgtcctgctggggaca

SEQ ID NO: 18251 - DNA, 74 bp, Homo sapiens
ggcaggtgtgccatctccagcaccatctcagcacctgctgtctctgaggtggtaccagggctgtgtgaaccagc

SEQ ID NO: 18252 - DNA, 74 bp, Homo sapiens
tgttttcagtagagacgggtcttgctatattgcccctggtctcaaactcctgggctcaagggatctgcctatct

SEQ ID NO: 18253 - DNA, 74 bp, Homo sapiens
aaggatgtcatccagggcccaggcgtcttctttttggttcacttccaacacctgaaccctggagagcaatgggg

SEQ ID NO: 18254 - DNA, 70 bp, Homo sapiens
tgtcttcttttgggtttcagcacaggcttttaattaggttaatgttcttgttgggtacccaaagtagtct

SEQ ID NO: 18255 - DNA, 73 bp, Homo sapiens
gcccttagcttatctctggtagcaaaatctgagaactccaaggtcctgggactctcactcagctccgaaagag

SEQ ID NO: 18256 - DNA, 70 bp, Homo sapiens
ccgttctttctagcctaagcccccaaccctgggccttgtggctccaaggtgcctcacttacgttccatga

SEQ ID NO: 18257 - DNA, 74 bp, Homo sapiens
atgtgtctcccaaaaagcaaaatgttggaaacttgatcctcaatctaagtgttgagaggtgaggcccaaagaga

SEQ ID NO: 18258 - DNA, 74 bp, Homo sapiens
gggggaccgatcgcgccgggggccgaagaggaacgccgccccgcgccctctcgctccccgcacgctccggctgc

SEQ ID NO: 18259 - DNA, 74 bp, Homo sapiens
ttccatggcacagaccagggcaatgctgtggtccctggctcagggactgtctttgccccacggggaatgctgtg

SEQ ID NO: 18260 - DNA, 74 bp, Homo sapiens
gtcattatcccataagtatatatgtggtagccagactatccataattacagcagtttgataccacgtcatgctt

SEQ ID NO: 18261 - DNA, 74 bp, Homo sapiens
cactatggcttatcagatgtcgtgtaagggatgagccatggctaaaagtcttcccacattcacgacattcatag

SEQ ID NO: 18262 - DNA, 71 bp, Homo sapiens
tcggcgcctggcgttcccgaggcactttgtaccatcttcagtgatgacacgaatgcaatggggttagtgcc

SEQ ID NO: 18263 - DNA, 72 bp, Homo sapiens
aagcaacctgcccagggttacacagcttgtgagaagcagtaccagaccataagtccaggcagtctggcttca

SEQ ID NO: 18264 - DNA, 70 bp, Homo sapiens
cagtctctgatggttctcatctctgcctctgagcctcctgctcacagcgccatctctacctctgcttgcc

SEQ ID NO: 18265 - DNA, 70 bp, Homo sapiens
tgctgctgctgctcaagcatgtgtgggctatagcctgaccatcatccaacactctgatgaccctagtagc

SEQ ID NO: 18266 - DNA, 72 bp, Homo sapiens
cgtcagcgcgccgcgtcggggctgtttccgagccacctcctcccgcccccgccccgcgcaatccccacttaa

SEQ ID NO: 18267 - DNA, 72 bp, Homo sapiens
cccaatgggacgctggagctgctggtcaccgagccgggtgatggtggcatcttcacctgcattgcggccaat

SEQ ID NO: 18268 - DNA, 71 bp, Homo sapiens
tgtgctcctggggggacctgagcctgaacctgtggccatggctcatctggggcttgcacaagtgaccgtaa

SEQ ID NO: 18269 - DNA, 70 bp, Homo sapiens
gccaaactgaacagcagctgaaagtaggagggtttcatccaccccaacagcagttgagtgcaaggggtaa

SEQ ID NO: 18270 - DNA, 71 bp, Homo sapiens
ttcactgtgacccaagcggcggctcgggccttgcgcatgcgcgctggcgaggccgactcccccgctccacc

SEQ ID NO: 18271 - DNA, 72 bp, Homo sapiens
atttttccgactctgtgatgtctgtgatggaatctcttcgtgaggtcttatacacacacacacacgcatata

SEQ ID NO: 18272 - DNA, 73 bp, Homo sapiens
ttttgaattggtctttccatgagcttgcagtcttctgaaggctccttggggcggaaggatctgttttccaggt

SEQ ID NO: 18273 - DNA, 74 bp, Homo sapiens
aaggttggcctccgttgccctctgctggccagactataaatttaactgtcatgtttccagagcagctgaaaagc

SEQ ID NO: 18274 - DNA, 72 bp, Homo sapiens
acacacctaacagatatcactatgccctccaataccactgggacccttggtggggcatggtggttcacgcct

SEQ ID NO: 18275 - DNA, 71 bp, Homo sapiens
gggagcttgtgggcccagcatcatatcaagagcagttgttgtgatcactgctgagtatgtactggggctct

SEQ ID NO: 18276 - DNA, 73 bp, Homo sapiens
cagaattgtactttccccagtgtttagactgaggctagttacttagtaaacttggatttacaataaggcaatg

SEQ ID NO: 18277 - DNA, 72 bp, Homo sapiens
ggtgttttgggtaaagtccccaggttggctctgattggctcagcctgggtcctgtgcctgtttctgaaccaa

SEQ ID NO: 18278 - DNA, 71 bp, Homo sapiens
agagctggccgagtgcgcgggcgagctggggatcgtgtacccgcggcacgtgtgctcgcgccgtgtgtgcg

SEQ ID NO: 18279 - DNA, 73 bp, Homo sapiens
tggcaccagagcatgtgaagggctacatctacgtggaggcctacaagcagacccacgtgaagcaggccattga

SEQ ID NO: 18280 - DNA, 74 bp, Homo sapiens
tgcctcggcttcccaaagtactaagtgctgggcgtgagctactccactgggcgtttttttttttacaactacaa

SEQ ID NO: 18281 - DNA, 72 bp, Homo sapiens
agggactcagagtccttatcagagtatattgtagctgctgctgtttatataggtctaggccttgccctcttg

SEQ ID NO: 18282 - DNA, 74 bp, Homo sapiens
cacgtttttctctccagataacaggaagattgtcttgaagaatcaagtatatttgattctgaaatctctcatgt

SEQ ID NO: 18283 - DNA, 74 bp, Homo sapiens
cctgccgagccctccccgggggcgcgggcgccgtgggagccgacgccgtccgcgccccccgctcggtggggaca

SEQ ID NO: 18284 - DNA, 99 bp, Homo sapiens
tgggtgaaaggaaggaaagacataggatagagtcacctctgtcctctgtcctctacctatagaggtgactgtcctatgtctttccttcctcttacccct

SEQ ID NO: 18285 - DNA, 74 bp, Homo sapiens
ctcaggcttcagaacggttggggatgctcaagtttcctagaattagaggactctgggattgaatgaggctccag

SEQ ID NO: 18286 - DNA, 73 bp, Homo sapiens
agtgatctttcccagatcccacttctgacaccatatatggtaacaaacagagtgaggctttctatgagaaact

SEQ ID NO: 18287 - DNA, 72 bp, Homo sapiens
gctgcctgatttgtcttagagaagcacagactttctcaagtgtaaattgtgcagcagcgttggcccatggac

SEQ ID NO: 18288 - DNA, 72 bp, Homo sapiens
agcgcagagatgcccaaagcggctgtacaccagaaatgggacactcaacctcagtcttgttgggttgggact

SEQ ID NO: 18289 - DNA, 73 bp, Homo sapiens
ccaaaggaatcacaagggtccttaggagtggaagaaggaagttagagagagagatttgtggatcctatgctgc

SEQ ID NO: 18290 - DNA, 73 bp, Homo sapiens
acggcctcccgctccccccgggcccaagcggcgacggccgaggagcgggctgcgggcggagcggcgtcggccg

SEQ ID NO: 18291 - DNA, 73 bp, Homo sapiens
ggaaaaggagaagaagcggactctgacctggagcttccagaaagcacacagccatgagggcgccttggttcat

SEQ ID NO: 18292 - DNA, 72 bp, Homo sapiens
tggcctcaaatcagaggcagggcttgtacaccatggccgttttcaatactgtgtctggttcaagtggctcca

SEQ ID NO: 18293 - DNA, 73 bp, Homo sapiens
cacacgcacacatacaaacaaacacacacaaaaaacgggcatgtgtgtttgtgtatgtgtatgtgtgtgtgtc

SEQ ID NO: 18294 - DNA, 72 bp, Homo sapiens
catcagactttggtggggtggaggaggagagaagctggaggcctcaatccatccccatcccctcagccccag

SEQ ID NO: 18295 - DNA, 71 bp, Homo sapiens
gaggtgctggaggaggcgccgccgccagtgttccccctacggcctggcggactcccagggctatgcgaatg

SEQ ID NO: 18296 - DNA, 72 bp, Homo sapiens
taatcaagttaccgccgctactgagtacccaatctgctagcagcagaggctgatcctgagcacttgatatgc

SEQ ID NO: 18297 - DNA, 71 bp, Homo sapiens
tgggagatgtgattctgttaggtaattccagttggatttctgtttacttgcaagagaatcctcctgcctat

SEQ ID NO: 18298 - DNA, 71 bp, Homo sapiens
attacagatgtgggccaccatgccttgctgatggtaagatattaatagcgttgtagtactagccaacatat

SEQ ID NO: 18299 - DNA, 74 bp, Homo sapiens
ctcggattcccgcgccgaaagggttaaatcccaggaaggcctggtgccccctccccaccccgcgccgagtagtt

SEQ ID NO: 18300 - DNA, 71 bp, Homo sapiens
agagaaggcagatgaggggccagaggaggtggagcaggaggttggccccccactgctaacgccactttcag

SEQ ID NO: 18301 - DNA, 73 bp, Homo sapiens
tcccttcgatgtaatgatgctgctctgtccagcagacaccgctctcgggtctaggctgctatcagttcaggaa

SEQ ID NO: 18302 - DNA, 73 bp, Homo sapiens
ggcgatggcggcggcggcgactctgatggcggcggcgggggggtcccgggcgcggcctccatagttcctttgg

SEQ ID NO: 18303 - DNA, 74 bp, Homo sapiens
tccccggcagccggcgggagggccggggaggcactgggcgccgggtctgggcagggaagccggttggggggggg

SEQ ID NO: 18304 - DNA, 72 bp, Homo sapiens
tccgttgacctatgaatgtcatctatttaacctccaaggaggaagtaggcctctctagctgattagggaaac

SEQ ID NO: 18305 - DNA, 72 bp, Homo sapiens
gagagaccctgagagggatgtacacagaaaaccacactgagactgtcccaagggaggcagagcgatgggaaa

SEQ ID NO: 18306 - DNA, 74 bp, Homo sapiens
attctctaggaaactggctgatgatgaggctgaaggccacagtggggtcctgaggtttaacaccggggagggga

SEQ ID NO: 18307 - DNA, 73 bp, Homo sapiens
caaatagtttcttgagcacctgctgtatggtagcctgtgttttaggtactgggagacagcagtgagcaagact

SEQ ID NO: 18308 - DNA, 72 bp, Homo sapiens
ttgtttcagctgctgagtttatggtaatttgttatggcagtaacaggaaaggaattcgacagttctctgtta

SEQ ID NO: 18309 - DNA, 72 bp, Homo sapiens
catgagcagaggagctgggggcatggggtatcagggccccagatgcccctcccaattccacagtgcctcctc

SEQ ID NO: 18310 - DNA, 74 bp, Homo sapiens
ggaattgaggaaagaaaatagagtggggactgaggagagagatgccagagtggccgacacagagtcctgtctct

SEQ ID NO: 18311 - DNA, 70 bp, Homo sapiens
gtggtgacgggcaggcggccggtgatgagaacttctcccactcacattcgagtttcccgaccatgagatg

SEQ ID NO: 18312 - DNA, 71 bp, Homo sapiens
aaaggcgggggctcacaatgttgcccagcctggtctgcaactcctgggctcaaacaatcctgcctcgtcct

SEQ ID NO: 18313 - DNA, 72 bp, Homo sapiens
ccgtctctggtcccttcgtggtcgccaaaaatgctgcgggaaactgaggactggtgagaccgatacggagaa

SEQ ID NO: 18314 - DNA, 74 bp, Homo sapiens
ttcctccataatccttaatactgcctgcattctatgggatttacttaatgcattttactgtgtggtatgggttg

SEQ ID NO: 18315 - DNA, 70 bp, Homo sapiens
cagtgtggtccgtggtggggccaggcgctatgcctgccggggtggcggaacctgccagatggacgctttc

SEQ ID NO: 18316 - DNA, 73 bp, Homo sapiens
cggggaggcgcggggggcggggctgcggccgggcctggagcctctcgcgctctcccccctccccggctcctgg

SEQ ID NO: 18317 - DNA, 72 bp, Homo sapiens
gacggcccagccctgctcctcgggatgccgggccccagccccggcacccgctgcatccctgtcccaccatga

SEQ ID NO: 18318 - DNA, 71 bp, Homo sapiens
gcccagggaagactcagtgtttgtcaaaccgaaccaacatggtgccggcacttctctccccacgtgctcct

SEQ ID NO: 18319 - DNA, 70 bp, Homo sapiens
ggagggggcttcgcagcgctgccgcgcgtgggggaggggtccgccggccctgggttagaggctcgctcgc

SEQ ID NO: 18320 - DNA, 72 bp, Homo sapiens
cgaagcgggcgcgggttgcagcacgcgccattttatagtgcgcgccgctcgcaaggccggtcctcggcgcca

SEQ ID NO: 18321 - DNA, 70 bp, Homo sapiens
aggactcgtgggggctctgtttgaggaaggacagtcccctcacaccatctgcttccttactacttctctt

SEQ ID NO: 18322 - DNA, 74 bp, Homo sapiens
tgcgcctgggggaacacagcctcagccagctcgactggaccgagcagatccggcacagcggcttctctgtgacc

SEQ ID NO: 18323 - DNA, 72 bp, Homo sapiens
ggatctcagaggtcatttggcagcaacagcatagactgttcttatcctcctgtaggacgcctgtggtattcc

SEQ ID NO: 18324 - DNA, 72 bp, Homo sapiens
gcacggctgcatctctggctctctgaagcctccacgaggatatggagggtcctagagggatgtgggggtggc

SEQ ID NO: 18325 - DNA, 72 bp, Homo sapiens
gtgggccatggggagagggactctggggctgaactgagctgaccctcgtttctccactggagccctggctca

SEQ ID NO: 18326 - DNA, 72 bp, Homo sapiens
tcttaaaatctgaacaggatgcaagatttgggaattactggtttgtaccatcaaaacttaaatctgctctta

SEQ ID NO: 18327 - DNA, 72 bp, Homo sapiens
ttttcctgaatctctgaaaagaaagggcctggactctcagatttcttggcctttgatatttggaaggatgaa

SEQ ID NO: 18328 - DNA, 72 bp, Homo sapiens
aattccatgggctgaatatagattgaggaccatgttgggtgcagctagttcagctgattggggagttagctg

SEQ ID NO: 18329 - DNA, 70 bp, Homo sapiens
attacagggctcactgtcattcaaggatgtagctgtgggtttcacctgggaagaatggcagctactggac

SEQ ID NO: 18330 - DNA, 74 bp, Homo sapiens
cttttagtcttcagcctctcctggaagtcaggctaatacctagagtgtccagtttttccaaaggctggaagtga

SEQ ID NO: 18331 - DNA, 72 bp, Homo sapiens
gggggacctgggctgcactgatgccccctttatggcacagactcatccctgatcaaagcctccacccccccc

SEQ ID NO: 18332 - DNA, 72 bp, Homo sapiens
tagaaccggcagagggcggggccggggcgggacagagtcagtcttgagcccagcgcctccgtttttcgggtt

SEQ ID NO: 18333 - DNA, 73 bp, Homo sapiens
agccaaatggcaatgcatttctgagttacaattacttgcctctgctgtgagacaaaactcagctgcagctcca

SEQ ID NO: 18334 - DNA, 72 bp, Homo sapiens
aggtttccctttgtgagttgatacaatggttttgttaggacagcaaagccaggtgtccaaaggtgaaagtat

SEQ ID NO: 18335 - DNA, 72 bp, Homo sapiens
aataaaactttatttcacctgggtgcaggtgggctgagtccaaaaagagagtaaagggagatagataggggt

SEQ ID NO: 18336 - DNA, 70 bp, Homo sapiens
accatacaaatgtagggtttgcgacaaggcttttgggcgtgattcataccttgcacaacatcagagagtt

SEQ ID NO: 18337 - DNA, 73 bp, Homo sapiens
cctccagaggcccgagtgcgtgaggccgccggggtccttcttctccgaggcgccgccgcccccgcggtggggg

SEQ ID NO: 18338 - DNA, 71 bp, Homo sapiens
cctgtgtccccattacctggtgatgacagatggaatgaaaccagagcccagctgcttgcacaaatggacat

SEQ ID NO: 18339 - DNA, 72 bp, Homo sapiens
cttcttcagattatgatatcactcagatcagattaggactcatcctaattcgttatgatcccttgatcataa

SEQ ID NO: 18340 - DNA, 74 bp, Homo sapiens
gagaggatgccttagattagaggctattgttcagtgggatttggagaggatgccttagattagagggtattgtt

SEQ ID NO: 18341 - DNA, 74 bp, Homo sapiens
gctctttcgtttattaagtcccattggtctagttttatttttattgcctgtgcttttgaggtcttagtgatgaa

SEQ ID NO: 18342 - DNA, 72 bp, Homo sapiens
agcttagggcgcagatacaaaggaatgcggagtattttatctaaatagcttgcttagtcatatggtcctaaa

SEQ ID NO: 18343 - DNA, 74 bp, Homo sapiens
atcactgaattctgaaaatgtggcctcaggctcacagcagcattagcacttgcttgctctggatctcatcacat

SEQ ID NO: 18344 - DNA, 73 bp, Homo sapiens
ggacccctcggtcggagggaaaaggggctggaggtctggactcctgggtctgagatggggggcgaggtctggg

SEQ ID NO: 18345 - DNA, 73 bp, Homo sapiens
agggacgggccagacagggccccgagagggagcgagacgcggagaccgagcaggggcagggacgcagggactg

SEQ ID NO: 18346 - DNA, 72 bp, Homo sapiens
tggcacaaagagatgcctccactgctgccaccatgttgtagaaggcagggcaggcccagagtccaggaccac

SEQ ID NO: 18347 - DNA, 70 bp, Homo sapiens
aaggaagggctgggggggccgagggctgagaccgtgccctcggggccgcggtatccggccaggccagccc

SEQ ID NO: 18348 - DNA, 71 bp, Homo sapiens
tgaagagccaggaagaggtagaggtggcaggaattaaactttgtaaagccatgtccctggtgagttagtat

SEQ ID NO: 18349 - DNA, 72 bp, Homo sapiens
ggaagtccctgatcaaagtatccacaggaccacgctccctctgaaggctcaagggaaggctctgttccaggc

SEQ ID NO: 18350 - DNA, 72 bp, Homo sapiens
tatttatttaatatgtcttcagagtttcagtccagctgggaagagacattcaataaacctttaaagattatg

SEQ ID NO: 18351 - DNA, 73 bp, Homo sapiens
caggttttagtggctccctctgcctgcagaatggaagaccacgtgcaggtgagggtggagccaccgatacctg

SEQ ID NO: 18352 - DNA, 70 bp, Homo sapiens
agaccttcttcactcacgtccctgttcgggcgccacttgtggctgtcggttcgggactgaatgaagaagg

SEQ ID NO: 18353 - DNA, 71 bp, Homo sapiens
ggagctgacagtaatctgggctatcatgaaagtaatcagagtgactgctagagagtaaccctgggcctcat

SEQ ID NO: 18354 - DNA, 72 bp, Homo sapiens
tggcatctggtgtcagaatgatggagtgacggcatctgtacaggtgtggaaaggacatctgaacctgagata

SEQ ID NO: 18355 - DNA, 71 bp, Homo sapiens
ttccagcagccctgacaggcgtagcgcttccggccgccatggctgctgtggtgctccatcaggtgcgagag

SEQ ID NO: 18356 - DNA, 71 bp, Homo sapiens
ttcaaaaccttctgagccagatgtattttggaattcatgatcatttggattttagtaggatggtaatgtat

SEQ ID NO: 18357 - DNA, 73 bp, Homo sapiens
ccaggagccccatgactcagatagctgttgttgtattttagaggcccagttgggtagtttttgggtggcattt

SEQ ID NO: 18358 - DNA, 71 bp, Homo sapiens
ccacaggacagggctgtgtttccacagtgcacctcactgcatggacattccctgatgctggtgggacaccc

SEQ ID NO: 18359 - DNA, 72 bp, Homo sapiens
ccagccagcaccatctctagctgtggctcctcacagctgccgccttcctgcccctggacttgccacagcttg

SEQ ID NO: 18360 - DNA, 71 bp, Homo sapiens
cgtcctccgacggtgtcggggaggcggcggcggcggcggccgccccctcgcccgacggcccttgggcgcgc

SEQ ID NO: 18361 - DNA, 73 bp, Homo sapiens
aggctctgggctcagcatggcggttaaagagatgagccagacccatccctgtcctccaggagctcactggcta

SEQ ID NO: 18362 - DNA, 73 bp, Homo sapiens
ccacctcagcctctgagtagctgggactattaacccatgccaccacgtccgacctgggtaatttttgtatttt

SEQ ID NO: 18363 - DNA, 70 bp, Homo sapiens
aaaagcttagaggaggaaaagtggggtggaggcatgaggttgacctgtccctgctaagtgccactgtttt

SEQ ID NO: 18364 - DNA, 72 bp, Homo sapiens
accatgtctctttgtgaaatatccccacacagcatgtctggagccttttcctatgagaacagatggtcatga

SEQ ID NO: 18365 - DNA, 73 bp, Homo sapiens
ttgaacatgcattcctaataataactctcagcaaactgggaagacaaggaaggtttttcaagttgataagggg

SEQ ID NO: 18366 - DNA, 72 bp, Homo sapiens
cttcggtcagtggttttgtttaaggagcttttatttagctcctcgaacatagtccgtgttgtttctctttgt

SEQ ID NO: 18367 - DNA, 74 bp, Homo sapiens
ttgtcacagctactcaactctgctgttggagcaagaaagcaggcacagacagtacgtaaatgggtggttgtggc

SEQ ID NO: 18368 - DNA, 71 bp, Homo sapiens
tccacattctcaagccccacccagctctattgaatgggaagctctggtggaggatcccagaaatctggact

SEQ ID NO: 18369 - DNA, 74 bp, Homo sapiens
cgcagccctcgctccctcccccggggcgcgcaggcgggcgctcgctcgcagagaaggtgccggcggggccggag

SEQ ID NO: 18370 - DNA, 73 bp, Homo sapiens
tggggaagaaaactcagttcctgctctcaaaggacttataagtgagtctatgacagggagatgagcgctttta

SEQ ID NO: 18371 - DNA, 71 bp, Homo sapiens
tgtggagctgtgtgtgtctggctgctattgctacagtcaccactgctcctacaaaatgcctaccccactgt

SEQ ID NO: 18372 - DNA, 71 bp, Homo sapiens
catcaagaccagccactggtcatcagaggccattgtggcttagggttgggtgctgggagggtggggagaat

SEQ ID NO: 18373 - DNA, 72 bp, Homo sapiens
aactgcaaaatgatgaggtacctgatactgcaggtcattccctgtcttagcatcaacagcctttcacgttgt

SEQ ID NO: 18374 - DNA, 72 bp, Homo sapiens
ggctcttcactgccagacccgccagagctcttcttgccttccaccctgggaatctggcaggccctttgtagg

SEQ ID NO: 18375 - DNA, 72 bp, Homo sapiens
taggctatatggtatggcttgttgctcctagctacaagcctgtgcagcatgttactatactcaatactgtag

SEQ ID NO: 18376 - DNA, 74 bp, Homo sapiens
ttttcctctgtgagatctacagggcctgagtacaatttgccttatttttcagagtcctaatccacggtagaaag

SEQ ID NO: 18377 - DNA, 73 bp, Homo sapiens
cctgacccctggccctgacttctacccaataggcagggccgattagtcactggggaccaggatagggtgtggc

SEQ ID NO: 18378 - DNA, 70 bp, Homo sapiens
aaacaccaagttctttctcatgtcatcgtgtttcgtcggtgccgaggacatgaggggtgtagatcaggcc

SEQ ID NO: 18379 - DNA, 71 bp, Homo sapiens
ttccccttgccccagctggaacacgggtgtctctgctgcctccatgcggctggcaccctgcccatccctcc

SEQ ID NO: 18380 - DNA, 74 bp, Homo sapiens
taaagcaacggaaatttggggatgggggattgctattgctatataacctaagcccatcctaagcccatcctgaa

SEQ ID NO: 18381 - DNA, 70 bp, Homo sapiens
tagtgcattgggctgcctctttacagtgaccgtttcatactgtgatttgtttccatatttgtgcctaccc

SEQ ID NO: 18382 - DNA, 72 bp, Homo sapiens
aattaacttctaatcagcataactccaagccaggtgtgtttgcagtgtatttgtgtgtgggaggaacatgat

SEQ ID NO: 18383 - DNA, 73 bp, Homo sapiens
gagaacatccttcgtgggatagtccatgcaaatataagcaaaacacactgacatgtctttatgggtggatgta

SEQ ID NO: 18384 - DNA, 74 bp, Homo sapiens
aattcaagatcatgtcccacctctgcatgcctgggtgctcagagcaaaggggctccaggtatccaggccaagag

SEQ ID NO: 18385 - DNA, 70 bp, Homo sapiens
gagtggggacacggggtgacggaaggggtaccttttctgcaatgccgttttccgtagtgtagatcgccat

SEQ ID NO: 18386 - DNA, 73 bp, Homo sapiens
tggtcggaccccactcatcaaggtaaatggattaccctaatgtgaaataccactgtgaggggagggtggtgct

SEQ ID NO: 18387 - DNA, 70 bp, Homo sapiens
cctcctcccctcctccaacatgcagtccctggaagctcaaccatattagaaagtagcaagggcagggact

SEQ ID NO: 18388 - DNA, 74 bp, Homo sapiens
gaagaatgggggacattggggtttgagtttatgtttggaagaatataagcatgacttggagactcctatgttct

SEQ ID NO: 18389 - DNA, 71 bp, Homo sapiens
taagtaattatcatcaaagggccaaggacattaacatcatggaacggggcttgtacatgattttggacttt

SEQ ID NO: 18390 - DNA, 74 bp, Homo sapiens
tctaagtgaacagcctctggcaatggcagagttaactataccaaatttgcccttctgctataaatggctataaa

SEQ ID NO: 18391 - DNA, 71 bp, Homo sapiens
gttcagtggacataaatctaagtagaaattaacttggatttgccttccactctctaattaacatataagcc

SEQ ID NO: 18392 - DNA, 72 bp, Homo sapiens
aattctagcttcaattctacaacaaactggctttgtgactacaagccagacatttagtccccggggttgttt

SEQ ID NO: 18393 - DNA, 74 bp, Homo sapiens
atggtagaactggcacttggcatgggaatcagaagtcccaaattctacccttagttctgccatttattgcataa

SEQ ID NO: 18394 - DNA, 72 bp, Homo sapiens
ccatggggtataatttggatgtttgtccccgcaaatatcatgttgaaatgtaatccccaatgtttgagctgg

SEQ ID NO: 18395 - DNA, 72 bp, Homo sapiens
gcaccatgtccagcattcatcattaggtcagcctgctctctgacctgcatccttggagttgtttggtgctga

SEQ ID NO: 18396 - DNA, 73 bp, Homo sapiens
gagtaaatgtgtgctagaagaaatggtgcatgcaaataaaagatggcatgccaagcttttagtggggattttt

SEQ ID NO: 18397 - DNA, 72 bp, Homo sapiens
tgaaattattacaatggtcttttaccgttcagtgtgctcgtgaacttcagaaggcttctgatagattttagg

SEQ ID NO: 18398 - DNA, 71 bp, Homo sapiens
tcagggactgctcagtaaaagtatagtgtaagtcacatttgtgattttacattttctagtagtaatattaa

SEQ ID NO: 18399 - DNA, 74 bp, Homo sapiens
cttactccagccctatgaggtagtactgttatatccacttctaacagatgaggaaacagaagctcacagaggtt

SEQ ID NO: 18400 - DNA, 73 bp, Homo sapiens
atgcgagctggcttcagcataccactatgcaaagtactcccttccaggtactcgctgagatagaagatgggaa

SEQ ID NO: 18401 - DNA, 73 bp, Homo sapiens
tctacttcattcagtacattagggagaagcagctatgttttgctggctacgtgctcagaatcgtgccaaatga

SEQ ID NO: 18402 - DNA, 73 bp, Homo sapiens
agaaggagatgtaaaactgtcaaccttgatccccacagtgatgggggatgatgacagcaggagtaagttatgg

SEQ ID NO: 18403 - DNA, 72 bp, Homo sapiens
gataactgacttggatcaggtgtgcctcccaagacagcgcagctggagccaggtgctgcttgttacctactg

SEQ ID NO: 18404 - DNA, 72 bp, Homo sapiens
tgccttctcaaccacagtgtaagttacaagcaattatttttctgtctcctcagtgtaattacactgtaatct

SEQ ID NO: 18405 - DNA, 70 bp, Homo sapiens
atttgatagggctccatcccacacgacccactgcccctacttaaggtctgggggataggctccaacagcg

SEQ ID NO: 18406 - DNA, 73 bp, Homo sapiens
ccccatttgatgttggtataatcactggcaccacgcaggcctgtgcaaacgaccaacatgatctcagatatgt

SEQ ID NO: 18407 - DNA, 72 bp, Homo sapiens
cgctctaccacttagacatcagtgttgggtggaggtgcattccagagtgctctgtctcttcctgtggttttt

SEQ ID NO: 18408 - DNA, 72 bp, Homo sapiens
tgaaataacttatcagactgatttcctatacgggtaggtgttgccacctaaatcacttattatcagtgctgg

SEQ ID NO: 18409 - DNA, 72 bp, Homo sapiens
ttgcaggactcatttccaggataaagccagagtgggaccttctagaaagaagttctccccagcagagcttgg

SEQ ID NO: 18410 - DNA, 73 bp, Homo sapiens
gttgtgcttatctgggaaggagagttgtgtgtctgttctcatatatctttctgcagctgcaggcatagccccc

SEQ ID NO: 18411 - DNA, 70 bp, Homo sapiens
ggtttcaccacgttggccatgctggtcgggaacacctggcctcaagtgatttgcccaccccaggctccta

SEQ ID NO: 18412 - DNA, 72 bp, Homo sapiens
cctcaggctctggcatacttgaggggtgagtgtagaccttcataggcatcagagtcctgacttgcagctaag

SEQ ID NO: 18413 - DNA, 74 bp, Homo sapiens
gaaggtgaggtagtagtttggcatggcatctgcaaggaaccagcttggagatgatacctgtggggttggggtgc

SEQ ID NO: 18414 - DNA, 71 bp, Homo sapiens
gaattgaacatgttaatattgctgagatatgcctgtattaggtgctcagtaacagcactccactgtagtac

SEQ ID NO: 18415 - DNA, 73 bp, Homo sapiens
atttccagtcatggctttcaagagtacttataatttaaattagctctcagagcattctggatttcctaaataa

SEQ ID NO: 18416 - DNA, 71 bp, Homo sapiens
ggagtcctcctgccctctctccctgcactctgcccccagagatgcatgacctattccgcagtgggaagcaa

SEQ ID NO: 18417 - DNA, 72 bp, Homo sapiens
agtgctcctcagagtttcggttcactctccagttaggtagacctctctgaagtttgaagtgaaagactcttc

SEQ ID NO: 18418 - DNA, 71 bp, Homo sapiens
ttgtgctgaggatacttaactatggaattttttaaaaaacattctagagctagggttggttataggtgcaa

SEQ ID NO: 18419 - DNA, 73 bp, Homo sapiens
atacaatggggtggtgaacaactggacatttggggcttcctgaaggtgctcaggtggactatttctggaaccc

SEQ ID NO: 18420 - DNA, 74 bp, Homo sapiens
ggattttcaaggtatagaatcatctcatcagcaaagagagatagcttgactacttcttttcctatttgggggcc

SEQ ID NO: 18421 - DNA, 73 bp, Homo sapiens
atagcaggatgctggtctgtgggaggatgctgacctatggtgggctgcctgtctacagcaggacactggccca

SEQ ID NO: 18422 - DNA, 73 bp, Homo sapiens
tgaaaggtttaaattatggagctgtaaaaaccacatcggtatagacatcagtccacttttataaaccaagtca

SEQ ID NO: 18423 - DNA, 70 bp, Homo sapiens
ccacaggttcaggctgatgatttggccatccacagatgtctgggtgctgtagttgtcaaagacattgggc

SEQ ID NO: 18424 - DNA, 70 bp, Homo sapiens
attaccagagatgaagagctcaggactttgacgtgtagtctagaacttcatctcccattcctggtttagt

SEQ ID NO: 18425 - DNA, 72 bp, Homo sapiens
aggaggttctttttgataccaggagatactccacactctaaggcttcacatgggacttgtatcagttagctc

SEQ ID NO: 18426 - DNA, 73 bp, Homo sapiens
agcacagcctggctggactattatagacagagctattataataggagtcagcacactggctcatccaccaaat

SEQ ID NO: 18427 - DNA, 73 bp, Homo sapiens
gttaaattcccacctctgctaggaggggtggaactggcctgtccagaacagcatgagaatagggaagaagcaa

SEQ ID NO: 18428 - DNA, 71 bp, Homo sapiens
ccaatgtgttatttactgtgtcgaaaacgggtgcgtacttgtacattgacagtgggactataaatgggcat

SEQ ID NO: 18429 - DNA, 73 bp, Homo sapiens
ggttcctttcatgctacagtggcagagttgaatagtagcaatagtgaccacgtggcccgcaaagcctaaaata

SEQ ID NO: 18430 - DNA, 74 bp, Homo sapiens
taatgggaatacacgtaacactactcaacggtatgcttaaaaatggttaagatggtaaattttgttatgtgtgt

SEQ ID NO: 18431 - DNA, 70 bp, Homo sapiens
ccacatcccaaataggcccttatggacctccttccccagaagattgatggggctggtcaagagagacttt

SEQ ID NO: 18432 - DNA, 72 bp, Homo sapiens
gtttgctgggcagggaaaaccaaaatcaagcacatagctacagtttccacgttgttttccttgttagagatg

SEQ ID NO: 18433 - DNA, 71 bp, Homo sapiens
ctcagactcagctgcagccatatggggtgggtgtggaggagccggtccaagatgctgagcctgttggagag

SEQ ID NO: 18434 - DNA, 72 bp, Homo sapiens
gtcatgcccagcttagcaggtaacatgtcatagctgacctcagaccttgggttttgatgttagtttaaatta

SEQ ID NO: 18435 - DNA, 72 bp, Homo sapiens
gagcctctgtacaaggaaagctagaaagctgaacactgcatgtcccagactccttgcagctgggttggcatt

SEQ ID NO: 18436 - DNA, 74 bp, Homo sapiens
ccttcctctgtaccgcctctgctctttttctcgttcttattttttctcctttgaggggaagtagaggactccag

SEQ ID NO: 18437 - DNA, 71 bp, Homo sapiens
gaggaacgcgtggaccatgcaagactgtggggctccccgtggatcgccccgaagtgctctgaataccaagc

SEQ ID NO: 18438 - DNA, 72 bp, Homo sapiens
ccagagtctctgaggacaaaggataaacaagtgtttcctgtgtgttatgcatgaaggagcatcttcctggag

SEQ ID NO: 18439 - DNA, 72 bp, Homo sapiens
aaccgtcttcgggacaaaatgggatgggacagaaacgagcctatttctcccccaaaggagcaactattcaca

SEQ ID NO: 18440 - DNA, 73 bp, Homo sapiens
gaagtaggacctccagtccagttgtaaacttctagggaaaaaataccaagtctgccctctggggttccaagag

SEQ ID NO: 18441 - DNA, 73 bp, Homo sapiens
gaggctttggagctggcttggtcttagtggaaattaaacatctgagtccctaaagaaacttctagggaagaaa

SEQ ID NO: 18442 - DNA, 72 bp, Homo sapiens
ggttctcaagtccttctcaagagttaagagggctggcgatagtcttgtctcaaactcaaataaagggcattt

SEQ ID NO: 18443 - DNA, 74 bp, Homo sapiens
gtgtcacaactgcatattaggtaagttctggtgtgatataatatgaaatacacagcacagttatgatgcattct

SEQ ID NO: 18444 - DNA, 73 bp, Homo sapiens
ggtgccagcccaggagcagcacggcaggagagagagaaaagccacatgtcaggggtgtgggctggggactcaa

SEQ ID NO: 18445 - DNA, 72 bp, Homo sapiens
actctatgcgtatgccaaaagccattgaattatacattttagataggtaaactgtatgatgtgtggattata

SEQ ID NO: 18446 - DNA, 72 bp, Homo sapiens
ggcggttcctggaccagcagcatcagcagaaatgcagtcttgggctccaccccagatcggccaagtcagaag

SEQ ID NO: 18447 - DNA, 74 bp, Homo sapiens
ctggatttataacagggagtcattaggcttatagggttatttgagtttatgggaatgggtgaacgtgtctatag

SEQ ID NO: 18448 - DNA, 71 bp, Homo sapiens
tgtggcaggcacatacctagatgtgtatctggtattagcttatcagatactcatgggcgaggcatgctcac

SEQ ID NO: 18449 - DNA, 72 bp, Homo sapiens
cattttctcagttgggaacacaactgttactctggtcttggctgggatgcagctgtttcctctgaacacagc

SEQ ID NO: 18450 - DNA, 73 bp, Homo sapiens
acccatcagtgctctacctccaggcttggcttaacaaagaagaaagtctctacatcttccacggagctctgtc

SEQ ID NO: 18451 - DNA, 70 bp, Homo sapiens
gactactataagtgcctcatataagggagtcctatgatatttgtctttttggggttggcttatttcattt

SEQ ID NO: 18452 - DNA, 74 bp, Homo sapiens
cccagtgctggtcaggccccatgttgggggaagagagtcggaagtctggtagttgattcccccagctctggtca

SEQ ID NO: 18453 - DNA, 71 bp, Homo sapiens
aacccaatagcctaagctcggaaggagccagtgccccagtgagctcattccaattaatgagaaaaagcagg

SEQ ID NO: 18454 - DNA, 70 bp, Homo sapiens
cctcatcctcccaaggtcagacccaggggcagaggcccgtggccgagggagcatcgtggttcgtcacact

SEQ ID NO: 18455 - DNA, 74 bp, Homo sapiens
gggagagcgagggttccgccggccaccgcggtggtggccgagcgcggctcgtcgcctactgtggccggcgcctc

SEQ ID NO: 18456 - DNA, 72 bp, Homo sapiens
taaagagaacattgccaggagcccttcactcttctagaaggactttatttgataggtcctttttccatggtt

SEQ ID NO: 18457 - DNA, 73 bp, Homo sapiens
ggtcgggagggtgggggcggggccggctgccttgaccccgccccgcgccggccttgaccccgcccacctcacc

SEQ ID NO: 18458 - DNA, 72 bp, Homo sapiens
taccccttggctgtgacactgtttcaattatttttgttatggtgtgagcagggacagtttatggggtagaga

SEQ ID NO: 18459 - DNA, 71 bp, Homo sapiens
gcaagcacatgcctgcagctgtaagaagagctgtaaaataaaagtccaggctgggggtcaaggagggcttc

SEQ ID NO: 18460 - DNA, 73 bp, Homo sapiens
gggcacctgtagtcccagctacattggaggctgaacccgggaggcggggagcagagttcctgacactgcgctc

SEQ ID NO: 18461 - DNA, 74 bp, Homo sapiens
gggcctctgagttcctgtctgtttgtcacccgaaggtttattctcttccaggtactccaaactcggactgtgtc

SEQ ID NO: 18462 - DNA, 70 bp, Homo sapiens
tttgaaaacagtgcccggggctcttgtttgtagacacaggattgaacccaggattgttgagtgcacagac

SEQ ID NO: 18463 - DNA, 70 bp, Homo sapiens
gaagccacgctattgaaagctgatgatttttgagtgttctctctgcactggacgctggtgacaaggtagc

SEQ ID NO: 18464 - DNA, 72 bp, Homo sapiens
ctcctaaattggcttccagtaatgacccaagcatattttcatagcgagggtccttgttggactggaggcaca

SEQ ID NO: 18465 - DNA, 71 bp, Homo sapiens
ctccacctcccgagtttgagcgattctcctgcctcaggctccggagtggctgggactacaggagtgtgcca

SEQ ID NO: 18466 - DNA, 70 bp, Homo sapiens
aagaatcgtcatacccgcgccccccccacccccacggcttagggtagctgtgacaattcaatgacacaag

SEQ ID NO: 18467 - DNA, 73 bp, Homo sapiens
ggctggacctgctgctgctgtgtgtacagagctgtccgagaagcccctgcctctagtagccttgagggtggcc

SEQ ID NO: 18468 - DNA, 71 bp, Homo sapiens
ctgaatcactgcccccagagaaatacagggttaggtttctagtgggcgatggtcacattttttttgtcaac

SEQ ID NO: 18469 - DNA, 70 bp, Homo sapiens
cctaaaacggaatcccagaagcatggagcctcaaagaactttgagtccattccagaccagttggacagaa

SEQ ID NO: 18470 - DNA, 70 bp, Homo sapiens
aggcaatgcagaggaacaaagcgagtcttttcaacaaatggtgctggaaaaactggagatcctcatgcca

SEQ ID NO: 18471 - DNA, 74 bp, Homo sapiens
tgatgtgagcatagctggggcagctggtcattggttccacagccactcgccaggctggccccggcttccacctc

SEQ ID NO: 18472 - DNA, 73 bp, Homo sapiens
ggattggtggtatgcctgtgacccctcctgatggatgtcagcctgctgggcacccacaggcccttgcctcccc

SEQ ID NO: 18473 - DNA, 70 bp, Homo sapiens
gactcttcggggcgcggggacggcggagcgtgcgcgctcggctttgtgctccgaactgggcccggagggg

SEQ ID NO: 18474 - DNA, 73 bp, Homo sapiens
gcccccaagtggtcgcagtgtccttagtcggggtcggggggtgcggcaggtcgggctggtccttaggggtagg

SEQ ID NO: 18475 - DNA, 70 bp, Homo sapiens
accccaccgcatccaagttgggagagcatcgggatatggtttctctggaacccgagccactcaggagctg

SEQ ID NO: 18476 - DNA, 70 bp, Homo sapiens
ttgacttgcctagttaaaaaaaacttgggtttttttttaattgggatcacattgaacttctagattgatt

SEQ ID NO: 18477 - DNA, 72 bp, Homo sapiens
agcccagaatccccgcaaggactgggggcacaggtgctggtgccaacaacagggaggggctgtcggggggtg

SEQ ID NO: 18478 - DNA, 71 bp, Homo sapiens
ccccgacagcccctccctgttgttggcaccagcacctgtgcccccagtccttgcggggattctgggctcac

SEQ ID NO: 18479 - DNA, 74 bp, Homo sapiens
cctcgcccggctccggcccagccccggcttcggggagcgagcgcacgcccagccggccgcctccgactgcggga

SEQ ID NO: 18480 - DNA, 70 bp, Homo sapiens
gctttcccctttgtgcccagcataagaatagcatgggccggggggtgcttgttttaagttcagatgtcca

SEQ ID NO: 18481 - DNA, 70 bp, Homo sapiens
caagcaggagtattgtaattggatcaaggaagaggatgtgtgttcccccgtcctcccccctccctcctcc

SEQ ID NO: 18482 - DNA, 70 bp, Homo sapiens
aaccttccctgagaccctaccctgagactttggctggggaatgtcctgctcattggaactgtcccatcta

SEQ ID NO: 18483 - DNA, 74 bp, Homo sapiens
tgaaagcgcttccccgtgtttgaagggtccactcctatcccttccaaactctggagctttcgtacatgccttta

SEQ ID NO: 18484 - DNA, 72 bp, Homo sapiens
gaattgctgaaagccgtttcccgtgtttggagggttcacacctgtccctttcaaatgctggcgctttcacac

SEQ ID NO: 18485 - DNA, 74 bp, Homo sapiens
ggggggtgaggccctagggtaaagggtaggggacctttgtaaaggctccttgtggcacagggggctggcccttt

SEQ ID NO: 18486 - DNA, 70 bp, Homo sapiens
tacataatacaaaccaattcacgtatgtaagtacaattatgtgcatggattggatcatagatacatttta

SEQ ID NO: 18487 - DNA, 73 bp, Homo sapiens
ctcagtgattggcagaagagcaggctacagtctgtttacaattccatttagattatagttcgcaatgtactga

SEQ ID NO: 18488 - DNA, 72 bp, Homo sapiens
ttcatttcacttaatccagaggcttatttctgttacttgcagccaaggagccctaattcatccaagtgcacc

SEQ ID NO: 18489 - DNA, 74 bp, Homo sapiens
agataaggaggtttccagacaagcaaaagttgtaggagttcatcattagtagagctgccttacaagaaatgcta

SEQ ID NO: 18490 - DNA, 74 bp, Homo sapiens
tttatggactagcattttggttagtgaagataggagggtgacttagcaaatacaaaccaagatggaaggtacca

SEQ ID NO: 18491 - DNA, 71 bp, Homo sapiens
gaagatgaggcacaagaaaagtgggaggtccttagggatggcagcacagtgattctctgccaggtaccagc

SEQ ID NO: 18492 - DNA, 72 bp, Homo sapiens
gcaaggaaagggtgaaaatgtgagatgctgaagagacagcttgcaacattccataattacagccttcaatgc

SEQ ID NO: 18493 - DNA, 72 bp, Homo sapiens
atggcgcccgcggctgcgcccggggccgcacaagtaagcgcgggcgggcggcgggcgggaagagggagggat

SEQ ID NO: 18494 - DNA, 74 bp, Homo sapiens
tcctgcctcgagagtgactgtcctgttccccactgagatgtccagctggctctcagaagcaggacactaggaga

SEQ ID NO: 18495 - DNA, 71 bp, Homo sapiens
agaccccgcagtcccaccagctggggagacagcaccccaattttgcctttcgtgataacattctggggcct

SEQ ID NO: 18496 - DNA, 70 bp, Homo sapiens
gctaaagaatgttatgattctaggggaggcagctcccttggggatggcagcaggtctccactcaccagtt

SEQ ID NO: 18497 - DNA, 71 bp, Homo sapiens
gtcccatcaggttctatcacattgcatccctttgaagctgtgcatctgatctgagtcatcatcagggctcc

SEQ ID NO: 18498 - DNA, 74 bp, Homo sapiens
gcagaaaacagcaagctagaggtatggcatgtgggcactagttttctggcgcaaagttacccctgctgggctgc

SEQ ID NO: 18499 - DNA, 71 bp, Homo sapiens
cctgttgtccaagtggagtcacatggttgctaatgtgggcaagtctgaggacacacttcatgagcagctgg

SEQ ID NO: 18500 - DNA, 72 bp, Homo sapiens
accaaggcactccaaagcaatggcccatatctgacaaagccccatcaccctagagccctggaggtcattgtt

SEQ ID NO: 18501 - DNA, 73 bp, Homo sapiens
agaactaattattaactactagactgtgaggactctttctttggcttttaaggaaagtcaccgagttaatgct

SEQ ID NO: 18502 - DNA, 72 bp, Homo sapiens
cagagtattaagggtgtttctggcaaaggttcaaaagaagaaagctggagagaaaggctcaatcttcttaga

SEQ ID NO: 18503 - DNA, 70 bp, Homo sapiens
gggttgactggaacaggttctgccatatggctgttcaacaaattgtagctatagctcttgttatttacct

SEQ ID NO: 18504 - DNA, 73 bp, Homo sapiens
tacttgcagagtgcaagggaaccagacttcagaagcactggttcaccaaatgcaaacacagcaattatttcca

SEQ ID NO: 18505 - DNA, 73 bp, Homo sapiens
gagaagagtgactttggaagtctttgtaagatttttcttatccttttctctctctttcccccctccttctctc

SEQ ID NO: 18506 - DNA, 72 bp, Homo sapiens
ctcagcctcccaaagtgctgggattacaggcatgagccactgcaccgggccttagggtgggatgaaagaggc

SEQ ID NO: 18507 - DNA, 70 bp, Homo sapiens
gtgtaaatgccccagctcccccaccccttgggtggggtagttctgagttgagtgttttgtatcacttccc

SEQ ID NO: 18508 - DNA, 73 bp, Homo sapiens
ggccacaagctgagctcttgctctaaccttgcgttgtagcctctctctaaaatcagtgcagctgtgacccctg

SEQ ID NO: 18509 - DNA, 71 bp, Homo sapiens
agcacagtcccaaagcccagtaatatattttaaagaagtctattaaaggtacgagcttagctggactgacc

SEQ ID NO: 18510 - DNA, 72 bp, Homo sapiens
tatctcatcacctgtgtttctgctccttttgggtgcaacaaatcatgactcattgtgatggataaaattaac

SEQ ID NO: 18511 - DNA, 74 bp, Homo sapiens
taggtgatgggccaggggccatctgaagaggccttcctcggaagcccctgccctgctccccacagccccctacc

SEQ ID NO: 18512 - DNA, 71 bp, Homo sapiens
agagtgagagggcccctgtgacagtggccatctccatggagcccacgacagaaaggggcagcttgaagcca

SEQ ID NO: 18513 - DNA, 71 bp, Homo sapiens
ccatccctagcaggcacctgggtatactgtggtcccagatgtccactgtggccttcctgaggggtcatggc

SEQ ID NO: 18514 - DNA, 74 bp, Homo sapiens
tgggttggtgcaatggacctatggacaaggaagattgatttcccacccctagctgggtcacagagcttcagtct

SEQ ID NO: 18515 - DNA, 72 bp, Homo sapiens
cagcagcgactgctgttcccgaaagaggcttgacaccttgctggtgacaatgtctaggctgtccatgtaggt

SEQ ID NO: 18516 - DNA, 71 bp, Homo sapiens
ctttttatggcttttcattccctttctactgaactgggccagagtatactgatctgtggaatgggacttcc

SEQ ID NO: 18517 - DNA, 70 bp, Homo sapiens
ctaagcgccaggccttgctttcagcatgtcacatacaagatctcatttggcaatggtaatgtgagctagg

SEQ ID NO: 18518 - DNA, 74 bp, Homo sapiens
acacagtaggcatgtgtgtttaccgaatggatgaatgaatgggcttgcatgcccagttggaaaaacaggaatgc

SEQ ID NO: 18519 - DNA, 71 bp, Homo sapiens
ggtgttgcggtgttgcagtgctgcagcaggaaatgcagcaaaagcaggagctgcaagaagttggttaacag

SEQ ID NO: 18520 - DNA, 73 bp, Homo sapiens
atgaaagaatgtaccaccatatattcatgttcaaaacttgcatctaaatctgatcaaggccaggtgtggtggt

SEQ ID NO: 18521 - DNA, 72 bp, Homo sapiens
tggagaccctggggtgcgacaaaggggttagggggctcccccctccccgcccctcgcccccacctttccccc

SEQ ID NO: 18522 - DNA, 71 bp, Homo sapiens
gtataacctgggagcagggctgcagcatgaaggttcaggaggacagatgggcaagacggccccaaagggtt

SEQ ID NO: 18523 - DNA, 73 bp, Homo sapiens
aggttatctatggcctcttaatcttcctgatctgaaacggcaacttggggtaagggaagaatgttgaggaagt

SEQ ID NO: 18524 - DNA, 74 bp, Homo sapiens
taggtaaggtacttgaggggagcattagtatctgctgagcttgagcaactccttgcctctgtccctaatactgc

SEQ ID NO: 18525 - DNA, 74 bp, Homo sapiens
aggcatgagccaacacacctggtggcattgcttccatactatgcaatgctgtgcagacattaaaaaggcatgtg

SEQ ID NO: 18526 - DNA, 73 bp, Homo sapiens
tgttaaagccatcctctgttagagcaccctgggccaatgccacagtgttgtttgtctacagcaagctttgcat

SEQ ID NO: 18527 - DNA, 70 bp, Homo sapiens
gattcagtattggagcagcaattcctgatgtgctgaagtcaacagctatctcatctaacaattctgtttc

SEQ ID NO: 18528 - DNA, 73 bp, Homo sapiens
tcacctccttatcctcagagcaggaacagtggcagacaggctcaccttgcctacctgctgaatgggtgggcag

SEQ ID NO: 18529 - DNA, 72 bp, Homo sapiens
agctatccagtcgggttctttggtttccagcaacagaaactggatctggctcactgaggccgatggggttta

SEQ ID NO: 18530 - DNA, 71 bp, Homo sapiens
catctcccccggcatctccaccgccctgcctggcccattcagagcagccaccacggagatttttaaggatg

SEQ ID NO: 18531 - DNA, 71 bp, Homo sapiens
gtccagggatgctgctgaacgtcctacagtgcctagcacagccttatcacacagtattacctggccccaat

SEQ ID NO: 18532 - DNA, 73 bp, Homo sapiens
tcttgaactcctggcttcaagtaatcctcccgcttcagtctcccaaagtgctgggcttacaggtgagagccac

SEQ ID NO: 18533 - DNA, 71 bp, Homo sapiens
aaaaatccagcccctgctgctgaggcctgtttggccgggaggtggcatcgctggagaatctcatgccaaga

SEQ ID NO: 18534 - DNA, 72 bp, Homo sapiens
ttcattagcaggtagagaaataggggcaagtagcagacctgggtagttatttgtggtgtgaacagaccaaac

SEQ ID NO: 18535 - DNA, 73 bp, Homo sapiens
ccaaggatggaggctgtctgccgtcagggtcctcattgctgatggtaggaatagttgctgatgtttcattgga

SEQ ID NO: 18536 - DNA, 74 bp, Homo sapiens
gcacatgccactacgcctaatattttttttttttttgagacggagtctctgtagcccgggctggtgtgcagtgg

SEQ ID NO: 18537 - DNA, 73 bp, Homo sapiens
ttttttttttttttcttcagacgggagtctcgctctcttacccaggctggagtgcagtggcgtgatctcggct

SEQ ID NO: 18538 - DNA, 73 bp, Homo sapiens
ccctctgagtggagcagtttatgcccagggggttgcgaagaacagcgagggcattcatctgctcacaggctgg

SEQ ID NO: 18539 - DNA, 73 bp, Homo sapiens
agaggtccagctatttagacagtgcaacacaaaagttcaaggccgacaggaagaaggcgtgtgttgtggaatc

SEQ ID NO: 18540 - DNA, 72 bp, Homo sapiens
gacgccaggggtatctggggctttttcgtttgctggtgaccaaacctgtccctggcttccatcttcagttct

SEQ ID NO: 18541 - DNA, 72 bp, Homo sapiens
ggtggctcacaatctgtctgattgcagaaagcaaccaatcagaggctgaagtgaagttacaaaggccacact

SEQ ID NO: 18542 - DNA, 72 bp, Homo sapiens
tgtctcacccaggggtcccttcctctgcgctgtttggctgggtgctcaatgatgtctatggaagatgggttt

SEQ ID NO: 18543 - DNA, 74 bp, Homo sapiens
tgagcccacctcccttcatcccccaccccaccaaggagctcgctgagtggggtagggaaatagacaagccagct

SEQ ID NO: 18544 - DNA, 74 bp, Homo sapiens
gaagatgggtctgtgtctgactctgaagcccctgcatgtgacttcaagtctcatcttgagacagagccatgtca

SEQ ID NO: 18545 - DNA, 73 bp, Homo sapiens
tttgtaaaaaattagctaaaaaagactgggggacagtttgtgttctgtccttagttaccatatgcagatcttt

SEQ ID NO: 18546 - DNA, 71 bp, Homo sapiens
gctctggcattggtggttcagcttgagcatcctattgcaccctgagtttggcaacatgtgttggagttatt

SEQ ID NO: 18547 - DNA, 74 bp, Homo sapiens
caagaatgttacaatgattattagtgaggctggtgatgagattaccgaaccatctggagttggcttttcttgtg

SEQ ID NO: 18548 - DNA, 73 bp, Homo sapiens
aattatgtagccagtcttgatagaaccagcacttgttggtgtcccagaggttgtgaggtaatagtttatatat

SEQ ID NO: 18549 - DNA, 70 bp, Homo sapiens
ccaggactgacccgcagggtgaagcagaacatccttgttctctttcttttaatgctcttgttcaatcagg

SEQ ID NO: 18550 - DNA, 71 bp, Homo sapiens
catttcaggtgcaggtagcaggtagcaggtagcacacagcagtagcacagcagcaggtagtggagctgaga

SEQ ID NO: 18551 - DNA, 72 bp, Homo sapiens
tgagattctgcttgatctttggtgtatcctgggagaaagagttcaatttttcctccagcatctgactcatgt

SEQ ID NO: 18552 - DNA, 72 bp, Homo sapiens
agcctattcttctcgtagagacggtcactgattccctctcttctgattagcctgggcaatgattgggataat

SEQ ID NO: 18553 - DNA, 74 bp, Homo sapiens
agagccattttagctgcgactcccaattctattttgtttccttggggacatgctgtttttatttgtgggcttca

SEQ ID NO: 18554 - DNA, 74 bp, Homo sapiens
ttaatcgtctcctcgtgtttctatgacctcagatcctggcagggcatgaagccatacttacaggaaacaaaagg

SEQ ID NO: 18555 - DNA, 74 bp, Homo sapiens
agtggtcacacgttttttgttttttgttagacaaaacaaaacaaaaacccaaaaacgtgtgaccactgaaggtc

SEQ ID NO: 18556 - DNA, 71 bp, Homo sapiens
ttgttctaaagaatcaggcggttctctatcagggattgcaaactcaaatacccacagggaaagggccggta

SEQ ID NO: 18557 - DNA, 72 bp, Homo sapiens
gactggggtttcagtccgagcctgcttgctgcatttccctgagcaagatacttaacttctctaagcctaatt

SEQ ID NO: 18558 - DNA, 72 bp, Homo sapiens
aattgtttctaattagctaggggaagccgcccatgagtaggggaccacttgttttgtgtttacgagaacagt

SEQ ID NO: 18559 - DNA, 72 bp, Homo sapiens
ttctcaaagcccatagtggcaaatctggtatggggttgtttccattgggttcctgtctgctattatgttttg

SEQ ID NO: 18560 - DNA, 74 bp, Homo sapiens
ttgggtcatgtgattattttttggggtatttttggattttttggatgtgcgaatcccaaaagcatagtgcaggt

SEQ ID NO: 18561 - DNA, 70 bp, Homo sapiens
ttgttagaatcatagtgtccttggattaggggcatccaggagctatacaacggctgggttctggcatcct

SEQ ID NO: 18562 - DNA, 72 bp, Homo sapiens
ttttgtgaggtagtagtttgtgtctttcaagaaattggttcaggccaggcacagtggctcacgcctgtaatt

SEQ ID NO: 18563 - DNA, 74 bp, Homo sapiens
gtcacattcacagattctgggggttaggatgaggatagccaatatttggaggacattgtgttcagtggacatat

SEQ ID NO: 18564 - DNA, 72 bp, Homo sapiens
atgtgaagccatctaggaagttggggaaatgccagtcaaaatgagattttaatatcgttttcccagctagat

SEQ ID NO: 18565 - DNA, 74 bp, Homo sapiens
tgggtgctcaggggagaaagctcaggggagaaagcatgtctctctaccccggcatctccaggcaaacggcgtca

SEQ ID NO: 18566 - DNA, 73 bp, Homo sapiens
gaagggtgctcctggcagcaggaacagtgtgcacaaaggggctggggagagtggggctgaagggagcacagac

SEQ ID NO: 18567 - DNA, 74 bp, Homo sapiens
tgtgcaggaaggatgcctgtggccctcggagagcacagtgtcaggcaacggaatcccagaggtgagacctccct

SEQ ID NO: 18568 - DNA, 74 bp, Homo sapiens
gtgtgcacccgctcactgttcctctccttggtgagcctcccggggcttgcgggtgaggcaggatctgcccagtc

SEQ ID NO: 18569 - DNA, 72 bp, Homo sapiens
acctccaaatagcagggtccatatattggatgctttgagtggtccccttacacatcctctttcttgacctaa

SEQ ID NO: 18570 - DNA, 73 bp, Homo sapiens
ttacctctgagtaatccctgatgaatcctagccccaccctatttgggggaataaagattagttattggagttc

SEQ ID NO: 18571 - DNA, 72 bp, Homo sapiens
cgtcacccgccgcgccgggctccgtccttccagcactggggcggaggccgcgggcaggaaggtggcggcctc

SEQ ID NO: 18572 - DNA, 70 bp, Homo sapiens
aagggcccccacggttgaggtagtagtttgcaagtctgcaagcccatctgaggactgccctgagctcgat

SEQ ID NO: 18573 - DNA, 72 bp, Homo sapiens
atgaggctcacagattcgacaccattaacatcactgtccccctgagagtttcgtacagacctggtccaaaaa

SEQ ID NO: 18574 - DNA, 73 bp, Homo sapiens
catgtctgaggaaagccaaatggcccaggtgccacaggtggcaaacagtggcgttttgaaaatatggaacccc

SEQ ID NO: 18575 - DNA, 74 bp, Homo sapiens
agaggggtggggggcgtgctgcgcagaggaggacctcacaaagcggcctcagagtttcgcaggtcctgctgttc

SEQ ID NO: 18576 - DNA, 71 bp, Homo sapiens
tggcctatcaacttagcaaatcgaaatatagctcttattcaaagttggtgaatatgaagtgaggtaggtac

SEQ ID NO: 18577 - DNA, 74 bp, Homo sapiens
ggcgcgccccccgccacggccacgcatcccgccggagggccgcggagcggagccggggccgcggggaggcgccg

SEQ ID NO: 18578 - DNA, 73 bp, Homo sapiens
aaagaggatattttcaactctgatgtgagattcagcatcagaataaattatgccagagagaattagtttctat

SEQ ID NO: 18579 - DNA, 73 bp, Homo sapiens
ctgaatggaggactgccagtccctgcagctgacagcctaggctttgacatattttttgtcttatcatttgaat

SEQ ID NO: 18580 - DNA, 74 bp, Homo sapiens
taagtgtgtcacggtctgctcttcactctgcacctctccaaggtgaacagaagaggtgtcagctccagtttgtg

SEQ ID NO: 18581 - DNA, 73 bp, Homo sapiens
ccttcacagtcactcctaaaggccacccactccttaaacatctgggagaaaccaaaggtgcctctgtgaagcc

SEQ ID NO: 18582 - DNA, 73 bp, Homo sapiens
atcgggacagctaaggactgcaggtgaccttgaagccatgaggataagtccccgctttttggaagaggcagcc

SEQ ID NO: 18583 - DNA, 73 bp, Homo sapiens
atatttactgaactcttgccacgtggcttgccttgttctcaccactggcggtcaagtggggacaagaccggtg

SEQ ID NO: 18584 - DNA, 73 bp, Homo sapiens
aatcatgcaggctgcatggactccaattccagctctggcaccatccatgcaggtgaccttggacaagacactc

SEQ ID NO: 18585 - DNA, 71 bp, Homo sapiens
cacagaggcctatggtttatcagaggcaaacacaggcaaagcattgcctccaactggacattttggagctc

SEQ ID NO: 18586 - DNA, 71 bp, Homo sapiens
caggaggtgagtggcaggcaagtgaggattacttcctgagctccgtctcttatcagatcagcagcagcatt

SEQ ID NO: 18587 - DNA, 73 bp, Homo sapiens
atctgcatgccttagggaaaagcccatatactcctggaggtataaaccctaccctctgggaggtgctttaccc

SEQ ID NO: 18588 - DNA, 73 bp, Homo sapiens
aggcatagcttactgcttcagcagcattatgtagcacgccagggacagctgggctcagaaaaatgccaacaag

SEQ ID NO: 18589 - DNA, 73 bp, Homo sapiens
tggcccttcctcagatgcattaaagaggagtggcttggctcacaagtcacttgtcttcagggaacacctgagg

SEQ ID NO: 18590 - DNA, 73 bp, Homo sapiens
agtaggctgtgggtttcagatcctggccatcacgctcttgaaaactttgaaggcttctgtccatctcttcttc

SEQ ID NO: 18591 - DNA, 74 bp, Homo sapiens
gtcctctggggatcaggccagtggttcaaggtgagcaaaccagggaaccgtctgctggaaacctgactgtgcca

SEQ ID NO: 18592 - DNA, 73 bp, Homo sapiens
gtggcctccctttttgaaagaacttcactcagtctcctctgggccctcttctggacggagccttgaccttggc

SEQ ID NO: 18593 - DNA, 74 bp, Homo sapiens
tgcacttgcccatagccaggaaggggatgggacgtgggaaactcgcgccatccagagctgcaaagggactgcat

SEQ ID NO: 18594 - DNA, 70 bp, Homo sapiens
cgtgccaagagcttcggcagaggtgggatccctctcctgtttcccgtgctcctgctgcatgtgccccttc

SEQ ID NO: 18595 - DNA, 74 bp, Homo sapiens
aggccgaggctcaggaggttggggcatggttttggggaacacgggtcctgccggctcttgttgcctccctggcc

SEQ ID NO: 18596 - DNA, 70 bp, Homo sapiens
actttccccacctgggctaagggggctcattctgtggcccactcacgacacggtaactttggaatcccaa

SEQ ID NO: 18597 - DNA, 71 bp, Homo sapiens
agccaagggtggagcagagcctcatgggtctggtggctaggctccgcgcgcccccccccaccccgtgtgct

SEQ ID NO: 18598 - DNA, 73 bp, Homo sapiens
gtctctgacgatgatgttgattctgagcagctgcctccatgtcaggagctgtccaaggctcagcacccggggc

SEQ ID NO: 18599 - DNA, 72 bp, Homo sapiens
ccaggacagagccagacagcaggcacaagtgagccagccacactaggggaaaagaatccatcctggacgagg

SEQ ID NO: 18600 - DNA, 71 bp, Homo sapiens
ccgctgccgggccccgaggggctgtgcgcgaaagggaaggcggtggccccgggcgggtgcgcggctggggg

SEQ ID NO: 18601 - DNA, 72 bp, Homo sapiens
cgtcccgggctggggactgggaagcgctgcccgaagcggcggcacctgcccggcataagctcgggcgctggc

SEQ ID NO: 18602 - DNA, 71 bp, Homo sapiens
tgggaaacatacttctttatatgcccatatggacctgctaagctatggaatgtaaagaagtatgtatctca

SEQ ID NO: 18603 - DNA, 72 bp, Homo sapiens
ccttggaggctatttccaggggcctcagggtgggccgtgggggatttggagtcttctgcctgtgcagggtca

SEQ ID NO: 18604 - DNA, 72 bp, Homo sapiens
agaacagttgatgtttggatccctttcggagatgctctcaaagtgcagtcttttgaaaattatatccagacc

SEQ ID NO: 18605 - DNA, 70 bp, Homo sapiens
ggatggggaagacacagcaggggctgggtcagcaaacgggcatgacacagcacagggaactgcaaagaag

SEQ ID NO: 18606 - DNA, 71 bp, Homo sapiens
gggaatattcttctgttctgcaagaaggggcttgtaacctctttttataggactggaaaaccttgacaccc

SEQ ID NO: 18607 - DNA, 74 bp, Homo sapiens
cttccagctcaacccaacaacctcctatgccccattagcaccaagactgatcgcctgggaaggaagggggctgg

SEQ ID NO: 18608 - DNA, 72 bp, Homo sapiens
gaggcctgtcaccccacagcctcccagactgaggccagtgcaatcagggggcaatgcccatagatgttgcag

SEQ ID NO: 18609 - DNA, 72 bp, Homo sapiens
aaacttccctgagaaccttgtccatgagcttccactggagactttgagctgctcttcagatttctttcagaa

SEQ ID NO: 18610 - DNA, 71 bp, Homo sapiens
aaacttcccacactgaagaatagaaatgcctgttccagcagcaattctagtttagagcaggaagaccgaga

SEQ ID NO: 18611 - DNA, 73 bp, Homo sapiens
tattatgtctgtctccttaggctcctgatgcctgtgacagtttcctagtttttgtttttacttgatgatctga

SEQ ID NO: 18612 - DNA, 74 bp, Homo sapiens
tgtggaataaatacataacataatttagtgtaggttctcaaccacagtgttgtgacaccctactgtgctgttat

SEQ ID NO: 18613 - DNA, 74 bp, Homo sapiens
agagttccgtagatgtctattaggtccgcgttgtgcagagctgatttcaattcctggacatccttgttaacttt

SEQ ID NO: 18614 - DNA, 74 bp, Homo sapiens
gtggtcacattttagatacgttttgaaggtgaagttgtcaagatttgccgagatttgcatgtgagatgagaaac

SEQ ID NO: 18615 - DNA, 74 bp, Homo sapiens
tctatatcatatagtctccctgtcatcctcctttctgaagtaaagatgaggtagtaggttgctaccttataaga

SEQ ID NO: 18616 - DNA, 72 bp, Homo sapiens
tgattttaaatactcttttttaaaaactcttgcttgttctcaagctctagttagttgaaatcagtgtatagg

SEQ ID NO: 18617 - DNA, 73 bp, Homo sapiens
acctaggcatcctgtgcttctggggcccaggaagcccccctgcccctgcaggcttggaagtgcctgctcccac

SEQ ID NO: 18618 - DNA, 71 bp, Homo sapiens
ggatggaggaagatctaccaggcaaatggaaaacaaaaaatgcaggggttgcatatcctagtctgataaaa

SEQ ID NO: 18619 - DNA, 72 bp, Homo sapiens
ttaaatagcatgttttccaaactgggatgtactgacagcaagagaaagcattgctatttattacaccagaca

SEQ ID NO: 18620 - DNA, 70 bp, Homo sapiens
ttcacatacagcgtttgtgatgccacgtgaacgcagaattcttgtggacccacagtgcttgaaagttcag

SEQ ID NO: 18621 - DNA, 73 bp, Homo sapiens
ctccatgagatgaagcactgtgttgatatcagtgacagctggctcctaagcacgttgcacaatgcccagcaca

SEQ ID NO: 18622 - DNA, 73 bp, Homo sapiens
agcccttgatttctaatattcctacaaaattggacagtccagtttttccaggaagaggtcttgctgtcctctg

SEQ ID NO: 18623 - DNA, 73 bp, Homo sapiens
ctgcttctcaggcctttggactccgggattaggtgctaaaccccaggtttccaggttcttcagcttgagacag

SEQ ID NO: 18624 - DNA, 74 bp, Homo sapiens
acctggtccagccccttcaggaatcatacacactgtccagtgggcaatcgaggggcctggagactggaaaacca

SEQ ID NO: 18625 - DNA, 71 bp, Homo sapiens
ttcactgcacctctctgcttcactgcaaaatatcagtgacgacattgccctgcagagttgttgtgggtgta

SEQ ID NO: 18626 - DNA, 70 bp, Homo sapiens
taagggtcattcttggaagcagatgctttattccacccccggcatctctgttttcatcttaccaacaata

SEQ ID NO: 18627 - DNA, 74 bp, Homo sapiens
ctgtcagaggtagtactggtataagtcaacaaggcttagagaccagcatagcaaataaaaatcacatattctct

SEQ ID NO: 18628 - DNA, 70 bp, Homo sapiens
aatttatggctaacaggttaaataatctaataaacagccttattggccacttgaccagtatagcacacaa

SEQ ID NO: 18629 - DNA, 72 bp, Homo sapiens
ttcccatgggcactacaataaagactcttgtttttgtcttgctgctgttgttgttgtcattggtagccttct

SEQ ID NO: 18630 - DNA, 73 bp, Homo sapiens
ttggacacaactccaaataaaacatggtcaaatgagtattcatagccaaagagcagggtgggtgtcacaggat

SEQ ID NO: 18631 - DNA, 73 bp, Homo sapiens
gccttttgagttgacccttcacaccatgtacccaggatgtgggatatgaaatcaaaggagattattttggagt

SEQ ID NO: 18632 - DNA, 71 bp, Homo sapiens
cacctgagcctggggttgtagagattacagtgaccactgatggtgccactgcactcctgcctgggtaagag

SEQ ID NO: 18633 - DNA, 73 bp, Homo sapiens
ctgaagcaaggtgctgtgctgttgactggctatgcaagaaggggccgtaaggcaaggtaaacaagaattacag

SEQ ID NO: 18634 - DNA, 71 bp, Homo sapiens
tgtgaggatgaggcactgacctatgggccaggggctctctggggacccttctttgctatctacctaaggca

SEQ ID NO: 18635 - DNA, 73 bp, Homo sapiens
tttccctaggatatcagacactaaaactctttctcttttccctgggctgtgtttaagttcaagggagacttat

SEQ ID NO: 18636 - DNA, 73 bp, Homo sapiens
taggatgacaaactgttccagttttcccaggaaagagaggttcctggaatgtgggacttcagtgctaagcctg

SEQ ID NO: 18637 - DNA, 71 bp, Homo sapiens
agcaagtagtcatgtctgtgttccaataagactttatttacaaaaacagcaggcacagacaagatttggcc

SEQ ID NO: 18638 - DNA, 72 bp, Homo sapiens
cgcatgttgggtacccacacctgttgtgtcttaattgcaagtctgagtaggaagttggggccaacatgtgtc

SEQ ID NO: 18639 - DNA, 73 bp, Homo sapiens
agccaactgaacttcctgggcagcactcttttctctaagtagcctctgctgtgggtgtgctgctttgctagaa

SEQ ID NO: 18640 - DNA, 73 bp, Homo sapiens
tttttccccaaaaagtagcttataatcagctacaatctacagcttgctctttggggggagttcatgaaaagga

SEQ ID NO: 18641 - DNA, 72 bp, Homo sapiens
caagccattccagtttagcaccatagtccatatgcagagcttgggctgtgttagaatgataacattgagcta

SEQ ID NO: 18642 - DNA, 72 bp, Homo sapiens
cactaggcctcttaaggggaaggccacattcctttacagtgctccttccaatacatacaaccagagtgttct

SEQ ID NO: 18643 - DNA, 73 bp, Homo sapiens
tgtcacttacctatgaatgtcacttacctgctggtctatgtaaaaattgtcagtgccttttatctgggtgggt

SEQ ID NO: 18644 - DNA, 70 bp, Homo sapiens
attccatcccacatagtaacaagggtatgtaatccctggattgccattaccaggtcgcaaatggaccacc

SEQ ID NO: 18645 - DNA, 70 bp, Homo sapiens
tggtttatgtaataactgcgctggagtcttgtgtgccccacaatgtacaagaatgcgccaacatgacaaa

SEQ ID NO: 18646 - DNA, 70 bp, Homo sapiens
gctcttggaagcatggaaggcatgctcttgttgcccaggctggagtggagtgcaatggtgcaatcttggc

SEQ ID NO: 18647 - DNA, 70 bp, Homo sapiens
atcacaaagctgggttgagagaggaaataacaatcaggagcagtcttgagtgtgtctctgttacctggag

SEQ ID NO: 18648 - DNA, 71 bp, Homo sapiens
ccaagatctgaacctcactgtctggttcttagtttggacaactggagtgtatggtgagtttcagttcctct

SEQ ID NO: 18649 - DNA, 70 bp, Homo sapiens
cctcagtgactcaatgcccgtggacaacacaccatctaaaagtgttgggtccttatttgtcccctgaaca

SEQ ID NO: 18650 - DNA, 73 bp, Homo sapiens
cgaccaagatttaactgcaagcgcttacagtgaggtctcattttctcaagactttatcgcagttaaaagacat

SEQ ID NO: 18651 - DNA, 73 bp, Homo sapiens
tagtctgtgcatgtcctacggtggcagcaattccactcctgggtgtagaaactaaagacatggtcacacagat

SEQ ID NO: 18652 - DNA, 71 bp, Homo sapiens
tgtagcatttcttgggggcttggacctcgggaatccctaggcgagagccataacaccccttggggctacgt

SEQ ID NO: 18653 - DNA, 71 bp, Homo sapiens
aaacctgagcatgagatagtctctctagggtcctcagctcgagtctgtgatctctgttccttatctcaccc

SEQ ID NO: 18654 - DNA, 73 bp, Homo sapiens
tacttacgaggttaatgcactagtcctgaaatgactggctgtcctgggcttaagtcacgggaattaagaggca

SEQ ID NO: 18655 - DNA, 74 bp, Homo sapiens
tggcagggctgaagggtatacatgggctcagtaaggtggatccaatccagccactgctgagtgctcaatctgcc

SEQ ID NO: 18656 - DNA, 72 bp, Homo sapiens
gcattaaacatgttcccctggggatccagatgctctgtcagtttgagaagcaccccaggggaaagtgatcct

SEQ ID NO: 18657 - DNA, 72 bp, Homo sapiens
ggaccgcgccccaccccgcgcgcccgagcagggcgactgtcattagcttcctggacgggacccggggcggga

SEQ ID NO: 18658 - DNA, 70 bp, Homo sapiens
ggcagtaggatgctataggagcccagagtgaaagcaactactatacattttttagtatttgaagatgctg

SEQ ID NO: 18659 - DNA, 72 bp, Homo sapiens
ctccaggggagacactttcttgggctctgtctttgaaaggctgtggggaggttgaaggtgcaactcaggtcc

SEQ ID NO: 18660 - DNA, 74 bp, Homo sapiens
aatgaaattatcctggttgggatgtatgagcattttagaaactgaaggtatggtcattattgccacataaagga

SEQ ID NO: 18661 - DNA, 71 bp, Homo sapiens
aagagtcagaagctgagaagatgccctggcaagaagcagtctcaagtatagatctgagttatggctctggg

SEQ ID NO: 18662 - DNA, 70 bp, Homo sapiens
gctcacttggcgtcggaggtgaggcgcggcaggctgccggcgcccatagccgacacgtggtggtgcggcg

SEQ ID NO: 18663 - DNA, 72 bp, Homo sapiens
gagaggcacaagaaccttttgggggaacagaagtgtttgctctcttgggaatgatgatttcacaggcatatg

SEQ ID NO: 18664 - DNA, 71 bp, Homo sapiens
aggccaggagtctcaaatccaggtgtcagcagggctgtgctcccttcaaaggctggaaggaagaatctttc

SEQ ID NO: 18665 - DNA, 73 bp, Homo sapiens
cccctgtccacaaaacccaggaaacaccttgcagagttgatgcaatatttgctatcccagcccttggtgacag

SEQ ID NO: 18666 - DNA, 72 bp, Homo sapiens
gcttgccagatgggggttatgttaaaaagagcaaacagaagtcagagctctgaacacaccgcagggtattcc

SEQ ID NO: 18667 - DNA, 71 bp, Homo sapiens
gacttcaggtggaaaaatactttatgctgagaatcacaaaacattacaggccagtaaggaaatgttccaca

SEQ ID NO: 18668 - DNA, 71 bp, Homo sapiens
ctcattaccagcagggacagcgtcaggcccatttacaggaactaatgacagcaggggctgttctcaacact

SEQ ID NO: 18669 - DNA, 70 bp, Homo sapiens
gcggctcttccccaccgcgcgggtcggggcggagcctggaagccgggcctcggcgcttggggcggggctg

SEQ ID NO: 18670 - DNA, 70 bp, Homo sapiens
gctctggcagaggacactctgagtgccatcaacccaggactcaggggggctgggcctatccacgagcatc

SEQ ID NO: 18671 - DNA, 70 bp, Homo sapiens
tcctgccctctgtgggacctagatgctggctagctgagcaccgtcaatgtgtcctcgcagaagacgaagc

SEQ ID NO: 18672 - DNA, 72 bp, Homo sapiens
tgcctgccagagtttggacagacatttgtttgtctgatttaaggttcagtagaagtcaaatccctcattcgt

SEQ ID NO: 18673 - DNA, 70 bp, Homo sapiens
gaaaaagttctggagatggggggccggttgcacaacaatgtgagtggatttattgccactgaattgtaca

SEQ ID NO: 18674 - DNA, 71 bp, Homo sapiens
aggttgcagctaagaagatgtgggaagaactggttcctatgttaaagggaacattactgagctgttgttca

SEQ ID NO: 18675 - DNA, 74 bp, Homo sapiens
gacaatgagcccctctgcaaggtgcaaacgccctgcagctggttactgcatgggctcatgcaaagtcaagatga

SEQ ID NO: 18676 - DNA, 72 bp, Homo sapiens
ctgcacaggctggggagcaggcagtagcgccaagtttgacccagttctataaacggcatctccacccatcca

SEQ ID NO: 18677 - DNA, 73 bp, Homo sapiens
aattcctgggtatccagactatgacggttaattttatatatcaactcgactgggcatggggcacccagatatt

SEQ ID NO: 18678 - DNA, 72 bp, Homo sapiens
gtctatctgctccagtgcccctctagaggagcctacacaaatcctatggcatgtttgaggagctccaagata

SEQ ID NO: 18679 - DNA, 73 bp, Homo sapiens
ctgagatgaccaggctgatgtggggctgactgcttctcacctgcctggcatggggttcggctgtgtctttgct

SEQ ID NO: 18680 - DNA, 70 bp, Homo sapiens
tgcctcggaggagtgatgcggaccaggggaatggcaaaggcaaggaccccaaggcggggacaggcagagg

SEQ ID NO: 18681 - DNA, 72 bp, Homo sapiens
ttccgggatccaaaggcaagactgcgatttaagagacactttgtttttgtaggtgttcaaggatttggaatc

SEQ ID NO: 18682 - DNA, 72 bp, Homo sapiens
tccttagaggccccatctccaagtaccaccacgctaagggttagggcttcagcataagaattttggagaaac

SEQ ID NO: 18683 - DNA, 70 bp, Homo sapiens
agggtaggcgtcagtctgcatggattggatggaggaaggctgtgcgtggcaggagatgacactgcccttg

SEQ ID NO: 18684 - DNA, 72 bp, Homo sapiens
gttgtgtaatgatttcattacatattacagtgtaataataatagaaataaagtgcacaatacgcatcatgcc

SEQ ID NO: 18685 - DNA, 72 bp, Homo sapiens
ggagctgaggaaggaaccagctcatgccaagaggtagagattggacttttgaccagacttgggcccgatatg

SEQ ID NO: 18686 - DNA, 72 bp, Homo sapiens
tcgttgctcagctggatgggttggtggctgtcagactctgcaggtagagcaaatgcaagccccacccctacc

SEQ ID NO: 18687 - DNA, 71 bp, Homo sapiens
ctagaagcagctgttagcagtgacgggagaagcatcttagttcctacacttctcaggtgcttaaagggccg

SEQ ID NO: 18688 - DNA, 74 bp, Homo sapiens
tgagtaagcttggggttgggggaaagaagggctgaataggtcccatagcctgcatccagtgcagaccccaaact

SEQ ID NO: 18689 - DNA, 73 bp, Homo sapiens
ctctccctcattccccaaagtgctgctgacataagtctgctgtggttacctgttttatacagggagatgtagg

SEQ ID NO: 18690 - DNA, 72 bp, Homo sapiens
ctacgtgcagaggagacaggatggataagagccaatccttgcccttgagaagctcaaagtcaggtgggaatg

SEQ ID NO: 18691 - DNA, 70 bp, Homo sapiens
caatttccagagagttgtatttgtggtatatcaactttcggaactataacccacaaacgaacccacagac

SEQ ID NO: 18692 - DNA, 73 bp, Homo sapiens
ttttggttcactcatgttgggtttggagccaggaatgcatttagaaacgatgtcagagagattccatcttatg

SEQ ID NO: 18693 - DNA, 72 bp, Homo sapiens
acacccctcagtgcgccccgggcgggggctgccgtcctccgcgactcaagagcgagcgcccccgctccccgg

SEQ ID NO: 18694 - DNA, 73 bp, Homo sapiens
agcgctgtgggaaagagagcaagtgataaatgatgcgttcaagtatcacgttattcatgcaaagctgaaagca

SEQ ID NO: 18695 - DNA, 72 bp, Homo sapiens
cccgttggaccccgcccaaaagcagctgcctgaacgcagcttgttcagaatggtattggaaatccacaaccc

SEQ ID NO: 18696 - DNA, 73 bp, Homo sapiens
tctacaataaatatacagaagtttgctgggcgtggtggcacatgtctgtggtcccagctactcaggaggctga

SEQ ID NO: 18697 - DNA, 72 bp, Homo sapiens
catcatagctttacaggtgtcaaccagccatgtgacctgcatgacctccatgtctacctgtgaagtctgggc

SEQ ID NO: 18698 - DNA, 73 bp, Homo sapiens
gtgagcctctggggcaaagctcctgcagccgtggagtcgcaggctgctagcaatgctcaggcggcatcctcat

SEQ ID NO: 18699 - DNA, 71 bp, Homo sapiens
tttcagatgagctctggcaccttctttcccacatgctttggccatgatctcaaccaggtgcaagaccccag

SEQ ID NO: 18700 - DNA, 73 bp, Homo sapiens
atcatctccatcctgtttgttccaacagaggctgtagtcaggggcagtttatggggtaagaaggatgtgctgg

SEQ ID NO: 18701 - DNA, 73 bp, Homo sapiens
cgccgccgccgccgcccccggggcatggcctgtctgatggccgctttctcggtcggcaccgccatggtgagtg

SEQ ID NO: 18702 - DNA, 73 bp, Homo sapiens
agtctagggctagcccaggttagttagtttggagctagcacaggttgattagtctggggctagtagcctaggt

SEQ ID NO: 18703 - DNA, 71 bp, Homo sapiens
ttttggagaaagcggggtggttgtgtgtgtttggtccccagccccacatcaccccataggtgccttttcta

SEQ ID NO: 18704 - DNA, 72 bp, Homo sapiens
ctgataagctactccttgcttatcagagcaggagtagctcgggcgtaaagaaggttttggtggaaggaggaa

SEQ ID NO: 18705 - DNA, 70 bp, Homo sapiens
ccagtcttgggtacaactttatcagcagtgtgaaaatggacaacacaaggtgtgagctacctgagtagac

SEQ ID NO: 18706 - DNA, 70 bp, Homo sapiens
gggccggagagccggccgagtggcatgctcccgagagcacagctggctgtgcagtcagggccttggtgga

SEQ ID NO: 18707 - DNA, 72 bp, Homo sapiens
ggcctcagacctgttcaggcaggacccagcagaaacccctcccccgtctccgcccacaggcctctttgccct

SEQ ID NO: 18708 - DNA, 74 bp, Homo sapiens
cagattagtcattgccagggatggagtcactgctaataggtatgggggtttctattggtggcaatgaaaatatt

SEQ ID NO: 18709 - DNA, 71 bp, Homo sapiens
cccgggggttccggctccagtggtgaccttggccttagcttatgtctgtgactcacattgggccctcctgg

SEQ ID NO: 18710 - DNA, 74 bp, Homo sapiens
atgtatccgagtcacggcaccaaagtacgtcagcaccaaagtacgtcagcagcggtggatccatccgggcctga

SEQ ID NO: 18711 - DNA, 72 bp, Homo sapiens
acgtgtgtgtaggtatacatgtgtatgtatacatgagcaggcctgtgtatctgcatgtgtatccacatgtgt

SEQ ID NO: 18712 - DNA, 72 bp, Homo sapiens
gtgtggggccctactcgttcctggtggtggccaacaccttcaacggcacctccaccaaggtgcactcgcacc

SEQ ID NO: 18713 - DNA, 70 bp, Homo sapiens
ataggtctaaaatattcctctttggattaaattcgaggtatttcatagggatgttttactagtgtgaatg

SEQ ID NO: 18714 - DNA, 72 bp, Homo sapiens
ggagagagtgaggatgctgcttcagaaactggtatgtccaggggaggcaggaatcctgtactctgggtgttg

SEQ ID NO: 18715 - DNA, 73 bp, Homo sapiens
aagctactagaagaaaacataaatgaaatgctccaggacattggtctaggcaaacagtttatggctaagacta

SEQ ID NO: 18716 - DNA, 72 bp, Homo sapiens
attggagtcacctgccagggatttccaccagcgggtttatttggtggttaagtgtctgtgcagttggatttt

SEQ ID NO: 18717 - DNA, 73 bp, Homo sapiens
acccagggctcccagaacccagttgccttggctgccttcctcctgcctggacggcttgggatagggtgccctg

SEQ ID NO: 18718 - DNA, 71 bp, Homo sapiens
tgtgagttcaggcgctgtgttttggagagaggcaatgttagagttctgatggcatccagccagatgcctcc

SEQ ID NO: 18719 - DNA, 74 bp, Homo sapiens
ctctgtccccaaagtcctgatgccaccccaaaggtgctgacgtgagaggggtggtatgtcctgggtctggggac

SEQ ID NO: 18720 - DNA, 73 bp, Homo sapiens
cgctgacccggaggccccaggagtggcccagacagagaggacgcgagccgagccctgtgtagcctccttgccc

SEQ ID NO: 18721 - DNA, 72 bp, Homo sapiens
tggctcaggtagggactgttacggaggcaggggcatgtcatgggtgacctaaccccacactccctgccctgc

SEQ ID NO: 18722 - DNA, 73 bp, Homo sapiens
ggggctaaacctctcttggagttcaccctgtcttccccatgggcacctagcggggttcctggaggcggagtct

SEQ ID NO: 18723 - DNA, 70 bp, Homo sapiens
cagggccagtgggtaaacagttaccagcatggtaggcctcaccacaccccaccgctgccacccgcgagcc

SEQ ID NO: 18724 - DNA, 73 bp, Homo sapiens
agaaccctcagcaaataccttagactctcagctggtcccttggaaagttaggctctaggattaggggaaaact

SEQ ID NO: 18725 - DNA, 70 bp, Homo sapiens
ggaagtgagatgaaatgtcagctgtactctcctggttaggtatgatttcagggtcaggtatgcctgataa

SEQ ID NO: 18726 - DNA, 72 bp, Homo sapiens
catcagccattgccctattttttttggcaagttcttgtcagttttgaaaatattggtaatagtttggtgaat

SEQ ID NO: 18727 - DNA, 73 bp, Homo sapiens
gcacgcgtgggcaccgcgtggcaccgcagggcccgggttggggcggccccctccacgcgccccgcgcagacgc

SEQ ID NO: 18728 - DNA, 74 bp, Homo sapiens
agtggaaaacgaccagtgccttgtggctgttgggcccagttttgcgtcagtttgtcaacgcatttccagtttcc

SEQ ID NO: 18729 - DNA, 74 bp, Homo sapiens
tgtgcagggtggccctcgtcagtgatgagcctgagactgtctccatccctgcagcagcctccaagccagccatg

SEQ ID NO: 18730 - DNA, 74 bp, Homo sapiens
gatcagctactacaacctgacacgcctgtggcagatgtggcctcactgcccgggtgcctcacagacctgtgctg

SEQ ID NO: 18731 - DNA, 72 bp, Homo sapiens
tgatggctggagagggctgtggtgccagaagcctccaggttagccctggctccccatttccccccatgccca

SEQ ID NO: 18732 - DNA, 72 bp, Homo sapiens
atttgcccacgaaagctgcctggaccggggcacagcaagtcagagtgagtcaggcaaccagcaaaacagggt

SEQ ID NO: 18733 - DNA, 74 bp, Homo sapiens
tcgggtgggactctgggaggctgtcactgctggaaggcagtcactgtaggcacgtcggcccaccctgcccatct

SEQ ID NO: 18734 - DNA, 71 bp, Homo sapiens
ccttgcagcatggctgagtgagtgctccctcagtatctaatgatggtcttgacaagctacactcctgggtg

SEQ ID NO: 18735 - DNA, 73 bp, Homo sapiens
caaagggctcacaaatctgatggataatgttgtagaatttggaggggaaacctcagatgcagcagtcttatct

SEQ ID NO: 18736 - DNA, 72 bp, Homo sapiens
tgccagcccctgggcctcgaagctcccttcctgatggagtgctgccatttggaaggggtaactttcgtggtc

SEQ ID NO: 18737 - DNA, 70 bp, Homo sapiens
cccaggagaagctggggcgggcttagccgttctttgtcttctgcaagtaacagcaactccgggacagggt

SEQ ID NO: 18738 - DNA, 71 bp, Homo sapiens
ctccgcgagggggccggtcatccgccgggactgacatcccggaggcccaatggcaagccgtcatctccgcg

SEQ ID NO: 18739 - DNA, 73 bp, Homo sapiens
ttgttctggtccaacgacaggagtaggcttgtatttaaaagcggcccctcctctcctgtggccacagaacaca

SEQ ID NO: 18740 - DNA, 72 bp, Homo sapiens
gccagcttgcctgcttgtaaagcagctccatcacttcctggctgtatgaccttgagcatgtgggtgaacctt

SEQ ID NO: 18741 - DNA, 74 bp, Homo sapiens
aaagcactggacttggagtcagaatccctggactggatgcagcccagctgctggcctacatatccatgacgtgt

SEQ ID NO: 18742 - DNA, 72 bp, Homo sapiens
cagtgctgtcggaggtggggtgcacaggccggaccaccacccacctggcgttgccgtcatagccagcaaaga

SEQ ID NO: 18743 - DNA, 73 bp, Homo sapiens
gcctgtgggcctgtagagccggctgggtggacggatcccccgtgatgagaaactgaggccaagttggggggca

SEQ ID NO: 18744 - DNA, 72 bp, Homo sapiens
gacacctatgagatgctggccatcgagggtgcccaggccttctacaacggcagcctcatggcccagattgtg

SEQ ID NO: 18745 - DNA, 70 bp, Homo sapiens
tctgcttgcttcatccttgtccacaagctggtcaggccacttgtggagtatagcatgcagttctaggcag

SEQ ID NO: 18746 - DNA, 73 bp, Homo sapiens
ccttgaatcgactggaaacatgacaccggttccatgctctggaactgtcacctgtgatgtgctgggctgtgtc

SEQ ID NO: 18747 - DNA, 70 bp, Homo sapiens
cgagctcccatgtgggacaagtgccatgcaggcttcgaggatggcggagcggggtggcgggagcaggggg

SEQ ID NO: 18748 - DNA, 73 bp, Homo sapiens
ttcagtggattctgctctcttatcagactgagtcactgcacagactgctcacagggtttctccactgcattct

SEQ ID NO: 18749 - DNA, 74 bp, Homo sapiens
tcaataaacctttaccaaatgcagacctgcctctcaccacactggacacattgtagtgagctcaggatggggct

SEQ ID NO: 18750 - DNA, 73 bp, Homo sapiens
ggtggcgctggtcctgctctcatcacacccagtcttctcagtaatggtacgcaggcatcccctggtgtccatt

SEQ ID NO: 18751 - DNA, 72 bp, Homo sapiens
aattatgctgactggtacccgcaaaagccaggccaggcccctgtgctggtgatatataaagatggtgagcgg

SEQ ID NO: 18752 - DNA, 73 bp, Homo sapiens
ggccaagacccaggggagggctctggtggccgggcagaaggcggtgcaggggcctgactctggttttgcatcc

SEQ ID NO: 18753 - DNA, 74 bp, Homo sapiens
cctggccctttctagacgtggacagagggcagatgctgacctgctcattgatagccagcctgggggtgggacag

SEQ ID NO: 18754 - DNA, 73 bp, Homo sapiens
cacaggcagtccttttggctcagttcagcatttgttgaatactgactctgccaaaatggggccaggcacattt

SEQ ID NO: 18755 - DNA, 72 bp, Homo sapiens
ctgccttggcctcccaaagtgctaggattgcaggcgtgagccatcgcacccagctgacaactgtgaagatct

SEQ ID NO: 18756 - DNA, 72 bp, Homo sapiens
accggtagaggcgaagcagagcaccaggcactggcacatgagatgggggtgaattcaagcaggttgcacggt

SEQ ID NO: 18757 - DNA, 71 bp, Homo sapiens
ttcttgctaggagctcacagtctagtggaggaaacagaggtagtcaccaggtattcctcagtgctgggtga

SEQ ID NO: 18758 - DNA, 72 bp, Homo sapiens
tttaaagcatagatcaacaaagcagctatcagcaccaggttggagcagctaaggtctcttttaggaaaatca

SEQ ID NO: 18759 - DNA, 71 bp, Homo sapiens
caggtaccagctgccccggcccgcgctggtccccacgccgccgtccccaagcggccgtcagcgacctcctg

SEQ ID NO: 18760 - DNA, 72 bp, Homo sapiens
taaacaccaacttggtggcaggccttccaatgagcactctagagtgctaatttgctacagttgttaattctt

SEQ ID NO: 18761 - DNA, 70 bp, Homo sapiens
gaacactccaatttctcccaggctcaagtaatttcagttttctgattagcttggtgcagctctcaggaac

SEQ ID NO: 18762 - DNA, 71 bp, Homo sapiens
ctaaagcccaagctcctgtctcgcaggccagtagttctcgagctttcatatccttgggcaattcccaaaga

SEQ ID NO: 18763 - DNA, 72 bp, Homo sapiens
cactgtgctgagctcagaagggtcacagagtagtgatctatttagatttgtaagccagggattgtggcagga

SEQ ID NO: 18764 - DNA, 72 bp, Homo sapiens
atctcggctccaccttcctaggttggctttgctctcatgccagctttgcaggtggtgactagagatggcccc

SEQ ID NO: 18765 - DNA, 72 bp, Homo sapiens
caaatcaatgcagatcctaggaggcgtgggagaggaagctcgctctcacagcaaactcctcaggtcacagcg

SEQ ID NO: 18766 - DNA, 74 bp, Homo sapiens
atggttcctgaggagacattggatgtaattcttactttgctgctctataagtaaggtgtttcttccctctggtt

SEQ ID NO: 18767 - DNA, 72 bp, Homo sapiens
aattaaactctctgtgagctacagccaaagatttcaatcccactctccaatgcatctctgttgtagaagaga

SEQ ID NO: 18768 - DNA, 72 bp, Homo sapiens
tactgggggatgggaggttgggatttttcagtcctgagtcaaacctcccttcctggggccagtgtgaatata

SEQ ID NO: 18769 - DNA, 74 bp, Homo sapiens
gccgggctgccgctgggatgatgtgttgttgccatccatcaccagcctgacaggcacccagtgccagaattcgg

SEQ ID NO: 18770 - DNA, 74 bp, Homo sapiens
aattgtaattgttacagcagcactgtgagattgagaggactatcttccttttcaaatcaacagttaaggtccca

SEQ ID NO: 18771 - DNA, 72 bp, Homo sapiens
gacttttcacacagcaactgcaagttccaagagagcaaaaggcctcttaaaacctaggcttggtactggcac

SEQ ID NO: 18772 - DNA, 70 bp, Homo sapiens
tttagtcttggcttttagcccaaaacaagcagtacagtggacagttaaaggcatcacgctgtggagccag

SEQ ID NO: 18773 - DNA, 72 bp, Homo sapiens
ccctcctgcagcacctgcagccgtcgctctgagggttccagccaccggaaggccccagctgcatctgtctgc

SEQ ID NO: 18774 - DNA, 74 bp, Homo sapiens
gcgtgctcaccctggagcctatgatgccgtcctgagaaatctccttcagagcaggccgtgagagcagtgtgtgg

SEQ ID NO: 18775 - DNA, 74 bp, Homo sapiens
gaaatgggtgggggcggttttccaggccttggccacctctttggacactgtgctgctcagatcagaccatgggc

SEQ ID NO: 18776 - DNA, 74 bp, Homo sapiens
ggggtcaggcacaatggctcatgcctgtaatcccagcactttgggaggctgagacaagctgatcacttgagcct

SEQ ID NO: 18777 - DNA, 70 bp, Homo sapiens
agggctgggtagccacctgagaatcgccacaggtgcactgttgggggtgagaggtataggtcagtgagct

SEQ ID NO: 18778 - DNA, 71 bp, Homo sapiens
tgctccgtcaaccaggctggagtgcagtaacgcgaccttggctcactgcaacctctgcctcccaggttcaa

SEQ ID NO: 18779 - DNA, 72 bp, Homo sapiens
acccgccagccgccagggcagacgaaggcaggcatttgcttatgtcacacggtggctttgagggagattggg

SEQ ID NO: 18780 - DNA, 73 bp, Homo sapiens
taagtgggatcaagagagcagcactcggagagggtgtttgccagtctgagtgtcccgcggtgcccgccaaccc

SEQ ID NO: 18781 - DNA, 71 bp, Homo sapiens
ggctataatctctgtctgcttcaggacttaatgtgaagcggctgtgcaaactgtggagtgctgtgccatga

SEQ ID NO: 18782 - DNA, 72 bp, Homo sapiens
ggcccaaagatctctgctacaggtggcgaaagtaggccacctggggttctgagtcctcctgtggaagctccc

SEQ ID NO: 18783 - DNA, 74 bp, Homo sapiens
cagctaataaatgtttgagctgggattagaccacaggtctagtctccaaagcctgtctttttttttttttctga

SEQ ID NO: 18784 - DNA, 73 bp, Homo sapiens
taggtggggtcagcctggagcagtcctttctttacaactatgatcctaggactttggctgcataatgtctgtc

SEQ ID NO: 18785 - DNA, 73 bp, Homo sapiens
ctgaaggaatttcagagctatgtgggagggtgagagcatccaagccacactctgatgagacctgagagagctt

SEQ ID NO: 18786 - DNA, 70 bp, Homo sapiens
cctttccagtaatgagatctgcaggttggggtgaggattttttttaataagtgggaggcctttctggaat

SEQ ID NO: 18787 - DNA, 73 bp, Homo sapiens
aaactgttcttatgaatgcaagatgctggcaagctgacaactgcgtctgttgcccagaaggaatgctgagggc

SEQ ID NO: 18788 - DNA, 70 bp, Homo sapiens
gagcccaggaagttgaggctacagtgagctatgatcacaccgctgcactctagtctggcatgatctcaaa

SEQ ID NO: 18789 - DNA, 72 bp, Homo sapiens
gcagttacgtccctttcccaaagcagtagccacagagcagcccactggctcaaatggagaagggtctcaaga

SEQ ID NO: 18790 - DNA, 72 bp, Homo sapiens
cagagttcctgagaaaggcaagatgctggcagatagatttgtctggaatcccagggtgactgataagatact

SEQ ID NO: 18791 - DNA, 72 bp, Homo sapiens
ttctttctaacttcctctcccttctttgagtttggtccttgagaccctacagctgaggctgattggttgtac

SEQ ID NO: 18792 - DNA, 72 bp, Homo sapiens
ataaatgagatgaagcactagaggcatttagctgctccagctaagtatgagataagggcttgacaacttatt

SEQ ID NO: 18793 - DNA, 70 bp, Homo sapiens
ctggactgtgcatcctgattggtctgagtggtatctttttccttggtacaagcaggaacacaaaagcctt

SEQ ID NO: 18794 - DNA, 72 bp, Homo sapiens
gctgctgagcgagtccggcgctctgggcacgcggaggcggcggggccagcccggagcccggaccccagcgcc

SEQ ID NO: 18795 - DNA, 73 bp, Homo sapiens
atatgtgtatatatgtatatgtgtgtgtgtctgtgtgtatatatatatatatatatatgtatacgcatacata

SEQ ID NO: 18796 - DNA, 73 bp, Homo sapiens
atcttatatgtatataagatactatatttatataaatactctgatatactgtcttatatataagtatatatac

SEQ ID NO: 18797 - DNA, 71 bp, Homo sapiens
tctgattaacttgcattagacagaagttaccccaacttccttctgagaacaacacttgctcagaaagtctt

SEQ ID NO: 18798 - DNA, 71 bp, Homo sapiens
tgacccagagcagctactcaggatctccttgggctgagtttggtgcaaaggctcatgagaagcgctgggac

SEQ ID NO: 18799 - DNA, 73 bp, Homo sapiens
ggctcctccctttaccttttcacccccgtgccctgctggtgacccaggtttatggggcagcctatcttctcct

SEQ ID NO: 18800 - DNA, 72 bp, Homo sapiens
tccccatctttgtggttttgtctacctttggtctttgatgatggtgacgtacaattggggttttggtgtgga

SEQ ID NO: 18801 - DNA, 72 bp, Homo sapiens
gagtctgctgctgctgctgattggttaaattaggtcatctgcttacctccaaaattaggttggggtagacac

SEQ ID NO: 18802 - DNA, 70 bp, Homo sapiens
ctgtgttcaagtaatccagctgcctcagacttctcaaagcgctaagattacaggagtgagccactgcgtc

SEQ ID NO: 18803 - DNA, 72 bp, Homo sapiens
tttgtccctccactgctggggatccgagggcttaggcagaggggacctggcccttagaaagcagatgattac

SEQ ID NO: 18804 - DNA, 72 bp, Homo sapiens
tagggatgggctctgagagtagatgccaacaagaaaacaagctaactgcaatgtctgccattccctgtgatt

SEQ ID NO: 18805 - DNA, 72 bp, Homo sapiens
agccacttataaaaccgtcagatcactgggcgtggtggctcatgcctgtaatctgagtttgctgcccttgat

SEQ ID NO: 18806 - DNA, 74 bp, Homo sapiens
tatgagtggaggctcttcactgccttcagagggaaccatacttcctaacttcctagcctggcattcaaggtctc

SEQ ID NO: 18807 - DNA, 74 bp, Homo sapiens
tatggcggtgttgcccagggctgagccttgaggtaaagtagggatcccactcctcccccacacagcatgggcag

SEQ ID NO: 18808 - DNA, 71 bp, Homo sapiens
taccctagcaatggcctgcaccccagcagcactaactgcttcctgtcttggggtgtgtgtgtgtgtgtgtg

SEQ ID NO: 18809 - DNA, 71 bp, Homo sapiens
gaagacagctccgtctctgggcaccaagtctgcatcctagacatggcaaaggaggaagaccaaagccagag

SEQ ID NO: 18810 - DNA, 73 bp, Homo sapiens
ggggacgggacatctaggctggggtgtccagatctttctgctgactaccccaccggttctgctgtctcaccca

SEQ ID NO: 18811 - DNA, 70 bp, Homo sapiens
agaaatcccccgcagaccctgtgccgggtcagttttcccaggtcctaatgtttcagggcatggctgtggg

SEQ ID NO: 18812 - DNA, 74 bp, Homo sapiens
ctactctccgtctcctagcagcaaactgggctggggaaagtggctctcacagcagagtcccctgttgggaggag

SEQ ID NO: 18813 - DNA, 73 bp, Homo sapiens
gctctgcccaggtcacagggccaaggagtggggcaccctgctctgactgccccaaagccctcatcctccgcac

SEQ ID NO: 18814 - DNA, 74 bp, Homo sapiens
tagacggtggaggggaggggcagacaaggagggtctgaagccactgcgaccactgcgccatccaggtttgtgtt

SEQ ID NO: 18815 - DNA, 71 bp, Homo sapiens
aagcatcactgcacgtgccagctccccaaacggctggtaagggggcctggatacttaactgtaacttgcaa

SEQ ID NO: 18816 - DNA, 72 bp, Homo sapiens
agccgcggtggctcaggccggttgccctggcactcggggaggtgaggctacacattcgaggctaacctgatc

SEQ ID NO: 18817 - DNA, 72 bp, Homo sapiens
catctcatcctcccaaagtgctgggattacaggtgtgagtcaccgcactttaccccaggtggtagggtctta

SEQ ID NO: 18818 - DNA, 73 bp, Homo sapiens
cgcgcgcgcggagcagccgtgcccgccgcccgggccccgcgccagggcgcacacgctcccgcccccctacccg

SEQ ID NO: 18819 - DNA, 73 bp, Homo sapiens
gatctccaaatgctgctgaggtacacaggattcggaagctgtaagacctcagtctttctggcaagcctgggac

SEQ ID NO: 18820 - DNA, 73 bp, Homo sapiens
ggcagaccagatagaggcagcaaacatgggccaaaacgcaaaacaccaagtggtccatcagctcaggccagca

SEQ ID NO: 18821 - DNA, 71 bp, Homo sapiens
ccaacccctatgaggcacagacttgaacaagagtcctcaggatatccggtgactagcgtgtcctcactact

SEQ ID NO: 18822 - DNA, 70 bp, Homo sapiens
ttggcctggtcccagctacacccacctgctggtccacagcaacagcatccagtccattgtacatgatgtt

SEQ ID NO: 18823 - DNA, 73 bp, Homo sapiens
ctatcaggctctagggcccaagtctactaaaattctggtgcttctgtggctttgggattggataatgatagaa

SEQ ID NO: 18824 - DNA, 73 bp, Homo sapiens
gtgagtatgaagctgacacagcagctcagtagctgccacagcccatccattgcctactcagcatcatacacat

SEQ ID NO: 18825 - DNA, 73 bp, Homo sapiens
gaaccttgtagggagaagaatatggtggcacatctggttccagctgtgctgtcagccttaatatcttccccct

SEQ ID NO: 18826 - DNA, 71 bp, Homo sapiens
gcgcccgccccccggggctccgttcggggccgcccgcggcggcgggagaagacgccgcggggcgcggggtt

SEQ ID NO: 18827 - DNA, 72 bp, Homo sapiens
cgcaggacccgctcgccctcctgcttacccgtccccacggtgactgagctgcgagagcctgcgctgggctca

SEQ ID NO: 18828 - DNA, 74 bp, Homo sapiens
tgataagcaggagtgagtgggtgatgtttgctgacactccacgtctttcaatgcccttcctctgcctcctgagc

SEQ ID NO: 18829 - DNA, 71 bp, Homo sapiens
ctcacaagtcctcagctaataatgagggtcctgcgcttctctgctggtgggctggggtgacaacctgggca

SEQ ID NO: 18830 - DNA, 73 bp, Homo sapiens
cgcggatgctgggcgggcatcgggccccaggggctggcgcccaccccccgccccccgccgcgcccgcgctgtc

SEQ ID NO: 18831 - DNA, 73 bp, Homo sapiens
ttctatgcactgggtcccaggaatccctcctcatttcccatagggaaagttttgcagatgtgtgtgtgtacaa

SEQ ID NO: 18832 - DNA, 70 bp, Homo sapiens
agggctgcacagtggctaagggacagagcaggaactcaaacgcaccagtcctcttaaccagcaggccagc

SEQ ID NO: 18833 - DNA, 70 bp, Homo sapiens
atgttaaccaacggaatccagactccaagagcagcgccagagctgctgaccacaaagggttacgaagcat

SEQ ID NO: 18834 - DNA, 72 bp, Homo sapiens
tagctccaactttctggtggacagggatctttctttcttctctctgccaactgtctggtaacagcacactaa

SEQ ID NO: 18835 - DNA, 70 bp, Homo sapiens
taaattcccaaaaattctgtaatggggcccttgagcccctatgctcaggccagctcccacaccgtagagt

SEQ ID NO: 18836 - DNA, 71 bp, Homo sapiens
ggcctccctgtcatgcctggagtgtcacagaatggccacttaacaggcttgctgctgggtgttggcaccta

SEQ ID NO: 18837 - DNA, 72 bp, Homo sapiens
atatttgttcagggacacatgggtggtaagtgacagagtcagggtttgaacccaggtcagtcttggtgtttt

SEQ ID NO: 18838 - DNA, 74 bp, Homo sapiens
ttcccccggtgtagtcactgggatggaatgcacacaggtccctggtagaggcccagaccagcaagctgggaggg

SEQ ID NO: 18839 - DNA, 74 bp, Homo sapiens
gcatcaccatggagtcccgctgtaccagtatagcacagcacgatggaggcccaccatgccactgtagcgcagcg

SEQ ID NO: 18840 - DNA, 71 bp, Homo sapiens
tgatttcaacagatctgtcttcaggtttgctcattctttcttctgccagcttgaaactactgttgagaccc

SEQ ID NO: 18841 - DNA, 71 bp, Homo sapiens
attattttaccacgcctgacagcggaatgtcactgatgtggctaaccgtcttgagggggccattccccagc

SEQ ID NO: 18842 - DNA, 73 bp, Homo sapiens
gccatccccatgagctgagtgctgcttggtgtgtcacatgagtacagaaagaactaaggcaggggtggggagg

SEQ ID NO: 18843 - DNA, 72 bp, Homo sapiens
ggcattctgggggacctagagcaggatgtcagcaaacccaaccgcagagggcctggtccctcatggggcctg

SEQ ID NO: 18844 - DNA, 72 bp, Homo sapiens
ggcacctactgggtgaccatagcttccattatagggaaagcacgtttggtttcaataatgagtaggtgattt

SEQ ID NO: 18845 - DNA, 73 bp, Homo sapiens
ccaaaccacccatcgagattggatatgcagaagccttatggctgtggacagagttctaatcaccgtttaagtg

SEQ ID NO: 18846 - DNA, 73 bp, Homo sapiens
cctgagagagaaaggtgagacggggccggctccagctggatgacgtgagggctgctgggtgcacctctctggg

SEQ ID NO: 18847 - DNA, 71 bp, Homo sapiens
atctccgtctcctcgtggggacacgggcagctgcacgcttcctccaggccccgcgggctctagagtcctgg

SEQ ID NO: 18848 - DNA, 72 bp, Homo sapiens
aatccggatggagtcattctgggttcgggtgggccctcatcccatatgactggtgtctttatggaacaagga

SEQ ID NO: 18849 - DNA, 73 bp, Homo sapiens
gatcagaagctatttcattatcagaacaatgggcagtaatgctgctgtcagttgtctggtatccaccacaggc

SEQ ID NO: 18850 - DNA, 73 bp, Homo sapiens
ggacagagaggcggggtgggggcgggttcaggaggacacagggtcccctctgcccggctcccagcctcattgt

SEQ ID NO: 18851 - DNA, 73 bp, Homo sapiens
gggaaggcagtaggttgtatagttatcttccgaggggcaacatcactgccctgaaaccacacaacctactacc

SEQ ID NO: 18852 - DNA, 73 bp, Homo sapiens
aggcatgactccatctgattagcaccaagtgctgcatgctacatgttaaccagtggtcacagctgaggtggtg

SEQ ID NO: 18853 - DNA, 74 bp, Homo sapiens
ccgggctccagttccacaggcaagggagacagaaaatctgccatctccaatcccggacgagcccccagaaaatg

SEQ ID NO: 18854 - DNA, 74 bp, Homo sapiens
taaaacgatactgctcaggggatgacaacttccacacacacagccagagggttgaggcggaggtgtggccctct

SEQ ID NO: 18855 - DNA, 73 bp, Homo sapiens
accccctgctcccatgctgctgcaggccccgacagtctcctagccgcttctgggtcccaggaatgccaagccc

SEQ ID NO: 18856 - DNA, 73 bp, Homo sapiens
cgcggacggcgtggccgtggccggcggcggccgcgcgtgcgcgtgggtgcgagcggcgggggcgcacgtggcc

SEQ ID NO: 18857 - DNA, 70 bp, Homo sapiens
acgtcgcccgtggcgcccccatccaggcccgccccccgccgcgcccgatcgccaggactgcgtttccacg

SEQ ID NO: 18858 - DNA, 71 bp, Homo sapiens
cctccttcccgcattctccaccagctgctggagcccggccctggcctgtcctggcccctccacagcaggcg

SEQ ID NO: 18859 - DNA, 71 bp, Homo sapiens
catggcctggtgagtaggggtttgtgagggatggtcctgttgttgcttctctcttcctgtgctccctgatg

SEQ ID NO: 18860 - DNA, 70 bp, Homo sapiens
accactcaggcggtagccagccctgctccctacagaaaggaggctggaagaaccaccctggagctgtaac

SEQ ID NO: 18861 - DNA, 72 bp, Homo sapiens
gagcagtttttacatggcaagagaaagacaatgatttctcacatctatacatgtggcagcctcaacaacatt

SEQ ID NO: 18862 - DNA, 73 bp, Homo sapiens
ggtcagtctctgtttcctgaaggctttcacctgattggatgaggcccacccacgttacagagaacaatctgct

SEQ ID NO: 18863 - DNA, 71 bp, Homo sapiens
cccacactgacgtccagaacggagctaatatttccttattctttcagggtctctcagtttatgggacccca

SEQ ID NO: 18864 - DNA, 70 bp, Homo sapiens
atgacacgtgagctggttttagatccattctgtctctcttgagaagtgagcatgactatctccatcttta

SEQ ID NO: 18865 - DNA, 73 bp, Homo sapiens
gctacatagtggaatttagccatttcaaagtgggaaaacctgactctgaaatgaagctattttggcttccact

SEQ ID NO: 18866 - DNA, 74 bp, Homo sapiens
gcatcccaaaggcgaggggctgatagtcacttccactgttgtgcagtgagtactcacgtctgctcccgaatcct

SEQ ID NO: 18867 - DNA, 70 bp, Homo sapiens
cctctctgccactgaggggccacagctcagctgtgctctgcaccctgcccctaccagcctcaagggcttg

SEQ ID NO: 18868 - DNA, 73 bp, Homo sapiens
ggaagggggaacaatgtgggagtggacttggctggggcaaaggccccatattctgctccctacaagatcctcc

SEQ ID NO: 18869 - DNA, 72 bp, Homo sapiens
gctcagttccagggttcagtcatccactgtgctttgctgagtgactgaactggggaccaggagacccaggcc

SEQ ID NO: 18870 - DNA, 70 bp, Homo sapiens
cagcgcccagacggagatgggttcctagaaaacttggaaataaaacctcccccctccccggggaaaaaga

SEQ ID NO: 18871 - DNA, 74 bp, Homo sapiens
gcggccatggtgtgaacgtgggtctgctctgggaacacgaatcatggggtggggtccgcgcaggccgggaccac

SEQ ID NO: 18872 - DNA, 72 bp, Homo sapiens
tgaagtggtaacccactgggcgttttccctgccgccctttgcagagcagggctgacccacaggcacgtgcca

SEQ ID NO: 18873 - DNA, 71 bp, Homo sapiens
ttgtccagcgggaacaggcagaggcccgcaccgggccccccactgctccggctgtctctgctgaagacagc

SEQ ID NO: 18874 - DNA, 74 bp, Homo sapiens
cgggagccctccgcggagccgcagccgccgcaggtccccgggccccagcgcggcaggcccgggcggagcggcgc

SEQ ID NO: 18875 - DNA, 72 bp, Homo sapiens
cacaggcccagggcagtgaggggccttgctgacagtagaccccgtcttgccctgcagaacatcgagacctgg

SEQ ID NO: 18876 - DNA, 74 bp, Homo sapiens
acccgcctcggcttcccaaagtgctgggattacaggtgtgagccaccgcgcctgtccctttatttttttgagac

SEQ ID NO: 18877 - DNA, 70 bp, Homo sapiens
agagacccatggccacctctgtcctctcacttcacacatcacatctctcctcgtgggggcctgggtctca

SEQ ID NO: 18878 - DNA, 70 bp, Homo sapiens
ggctcctgcttctgctactggagccggggccagcctgggggtggggccctgtgtgtcagtggcagcagac

SEQ ID NO: 18879 - DNA, 71 bp, Homo sapiens
gttgcctgggctttgggaaggcggctgtgcaccccctactcctctgggagggtggctgtgtaccccctact

SEQ ID NO: 18880 - DNA, 73 bp, Homo sapiens
ccgtatgaagaggtcactgggggatggagctggcacccacatgaatagctgtatgcactgtacttgtttctta

SEQ ID NO: 18881 - DNA, 74 bp, Homo sapiens
ggcgcgagcggccccggcccgggccccggcgcggggatggacggccccggggccagcgccgtggtcgtgcgcgt

SEQ ID NO: 18882 - DNA, 70 bp, Homo sapiens
gcagagcccagctctgggggtggatgcagggggtgctgcaggggccggctgtaccatcccaggcggtctt

SEQ ID NO: 18883 - DNA, 74 bp, Homo sapiens
gaggccgtgatgcggaggcgactaggggccaccggtgccccaaggatgcgtggactgggactagcgcagggagg

SEQ ID NO: 18884 - DNA, 71 bp, Homo sapiens
tcaacccctcggggctgcagcaatcctcctacctcagcttgccaagtagctgcgactcctgacgtgtgaca

SEQ ID NO: 18885 - DNA, 72 bp, Homo sapiens
gctgcccatgacaggggactacagactgggtgggttaaaccagggtctcccaacccttgcgccacagattgc

SEQ ID NO: 18886 - DNA, 73 bp, Homo sapiens
ttaagcacgtttagggacgggagcttttttgcctttcgagagggtggtggcgttttggaggtgaggtgctttt

SEQ ID NO: 18887 - DNA, 72 bp, Homo sapiens
ttgccgtgcatggattctggaagcaagatgagctactcgtcccaggcatgatataggggaaaagtcggtaag

SEQ ID NO: 18888 - DNA, 70 bp, Homo sapiens
gtgcaggatccagtcatcccaccgctcggtgtgtacccaaaggaaaggaaatctgcccatcaatggcata

SEQ ID NO: 18889 - DNA, 72 bp, Homo sapiens
cccaggactgtggccagggaaaaagaaagtgctaattgatagagagtcaatgccacgtggggaggtcggggg

SEQ ID NO: 18890 - DNA, 72 bp, Homo sapiens
aacagaaggcctccatctctgctctcaggcaggtgtccttcagggaggagcctcaggcagctgttctaaccc

SEQ ID NO: 18891 - DNA, 72 bp, Homo sapiens
gtcgtccaggctggaatgcagtggtgtaatcaatgtccactgcagtctcaaccacctgggctcaaacgatcc

SEQ ID NO: 18892 - DNA, 72 bp, Homo sapiens
tgcatgttctcacttatatgtaggaactaaatgatgagaacacatggttgcatagtgaggaacaacacacac

SEQ ID NO: 18893 - DNA, 71 bp, Homo sapiens
tcttgttccagttttcccagattaggacattgggagctcttccaagctcccaacgtgtctttccttctcta

SEQ ID NO: 18894 - DNA, 74 bp, Homo sapiens
tgtgcatgtctgtgtcttcatttcctcttcttatgaggtgttttagtccatttcaggctgctataacagaatac

SEQ ID NO: 18895 - DNA, 73 bp, Homo sapiens
catacagccctggcggtgccaccactgctgcagtcagcatctttatagcggcctctccagatgggctgccgct

SEQ ID NO: 18896 - DNA, 73 bp, Homo sapiens
atacatgtcagtttgtcaaatattaatatcacagaaccctggaagttggtaaacttatggggagtaggcactc

SEQ ID NO: 18897 - DNA, 71 bp, Homo sapiens
taatcactgagtttgcagttggtgcttgacaaatccaatagggtccttctatggtagccacctgggctcct

SEQ ID NO: 18898 - DNA, 73 bp, Homo sapiens
ctttttggcaccagggtccagtttcttggaaggctattcttccatggactgggagttgggagagatgtttttg

SEQ ID NO: 18899 - DNA, 71 bp, Homo sapiens
gctgccataacagaggatcacaggctaggtagcttaaacaacagatgttattctctcacaatcctggaggc

SEQ ID NO: 18900 - DNA, 73 bp, Homo sapiens
attttggtctcctgtaatcatattctggggtgatacgtcccgagccccaacaggactcagcaagtaaatgcca

SEQ ID NO: 18901 - DNA, 74 bp, Homo sapiens
ttatttgttttcatgatacatactttgaaatattcacacagtgtacatattttaaagatatgaatctgactaca

SEQ ID NO: 18902 - DNA, 73 bp, Homo sapiens
agctggacatcagaggctactgttggacattgaagagcaatagcttgaatttagagggatggcttgatggtgt

SEQ ID NO: 18903 - DNA, 73 bp, Homo sapiens
ggtagagagtaaatgcagcaaacggcttgagatagtagctgtacctactctgtgttctgttctactcttcttt

SEQ ID NO: 18904 - DNA, 72 bp, Homo sapiens
tttcatgtctcatcatctagtgtctgttgcactatttctgaaatagacccgcagggaagaaagacaggagat

SEQ ID NO: 18905 - DNA, 72 bp, Homo sapiens
ggatattatttggtggaacatggttgtggaacacggcccgtgtcaccggcacccacttaccttctccatagc

SEQ ID NO: 18906 - DNA, 72 bp, Homo sapiens
agagaactgtccctgagctatgccagctgcaggtgcttcagcagggcaaagagaaagacagagaaaaaaggc

SEQ ID NO: 18907 - DNA, 73 bp, Homo sapiens
tggaatttttttcttaaaaacaagaagtattcccatgggagtgacaggatatttgagatgaaagatacaaaaa

SEQ ID NO: 18908 - DNA, 72 bp, Homo sapiens
gtggctgctcatttagaagtttggtggtggtttatcaaagcataacagcataagagctcctaaactttagcc

SEQ ID NO: 18909 - DNA, 72 bp, Homo sapiens
ttgtatagcaagtgttacgttggtacagggcatacacagttgaaagaattcagcccttatcagggatgcaga

SEQ ID NO: 18910 - DNA, 72 bp, Homo sapiens
ttctttcaatggctgctgccgccaccctacagcatgagcacccatgccagtggccccaggcttgaccctccc

SEQ ID NO: 18911 - DNA, 72 bp, Homo sapiens
taagtgcatggtacagagcttatcaagctgtacaaaagtaacacaatgatatttactttgtattatgtgtta

SEQ ID NO: 18912 - DNA, 71 bp, Homo sapiens
gtaaaatgcatcatgctgtatgcttaagattaagggcatgtacaccgcatgccttttactgctggtaagta

SEQ ID NO: 18913 - DNA, 72 bp, Homo sapiens
ccctcaggtatggcttgcatggagaccagccaggacaggatttctcacccttggcactgcagacactggggg

SEQ ID NO: 18914 - DNA, 74 bp, Homo sapiens
taaggtacatcagaggcgcggggcctccactcctgcccatcaccaaccaccagtctcagccctgtgccctctgc

SEQ ID NO: 18915 - DNA, 73 bp, Homo sapiens
cttgcccatcaacaagacagcaggcacagacaggccagctgttgtgagcttggctttaggactccattcagta

SEQ ID NO: 18916 - DNA, 70 bp, Homo sapiens
ccgctgctccgcctcccccggccccgcgtcctccgcgcctctccgtcgccggctgctccgcccccagtct

SEQ ID NO: 18917 - DNA, 70 bp, Homo sapiens
tgtggaaacctgccggggcttcgtgctcagcagacctggagcacgtccctggacgtagtctaaccctggg

SEQ ID NO: 18918 - DNA, 72 bp, Homo sapiens
tggccagggtgaccaggtgagttggactgaggagctaacctctttagcagcaatgttgtcctaggtgccaga

SEQ ID NO: 18919 - DNA, 72 bp, Homo sapiens
atgtcttcagctcaaattgcatcaggagggatttccaaagggagagggcaagagctgacgtcccacaaacct

SEQ ID NO: 18920 - DNA, 72 bp, Homo sapiens
taattcagggttgggttcactgccgagtcaggctgataggtggtggaaacaaatccttattactttcacgag

SEQ ID NO: 18921 - DNA, 72 bp, Homo sapiens
tggttcctgaatgggttatacaagcctgctattgtatcatattgccagggattcttgagtaaattgattata

SEQ ID NO: 18922 - DNA, 72 bp, Homo sapiens
agaaagttaacttctgtctccatatcctaaaatttaaattatgttttatggtgatgatgaggtatggctaaa

SEQ ID NO: 18923 - DNA, 73 bp, Homo sapiens
ttacacggcgctggccgctgacttgcgacgttgtgtccctgggaccctagtccagtttaggccccatcccgcc

SEQ ID NO: 18924 - DNA, 72 bp, Homo sapiens
ctaaccctaaagcatcaacagtgtaccactatcaggcattggtgacctgacatggtagttctctgtgccagc

SEQ ID NO: 18925 - DNA, 74 bp, Homo sapiens
ttctggacctgagacaagctgaacaacctctcagttttctttccttagggtcctgagaggcagtggaagttggt

SEQ ID NO: 18926 - DNA, 72 bp, Homo sapiens
atacaccagtcaacaagtgaggggatggggacaccaggaaatgtcaggcgcgtggtgtcagccttcccggag

SEQ ID NO: 18927 - DNA, 74 bp, Homo sapiens
caaaatgcatttccggaaaataatgaagatgtaattccatatttttgctggcttgagtttatgtttggttgtgc

SEQ ID NO: 18928 - DNA, 71 bp, Homo sapiens
caatggccctggagcagatgttgctcagaatattggaggagtagaaaagatgccagtttcaggagtggtaa

SEQ ID NO: 18929 - DNA, 70 bp, Homo sapiens
tccaagtataatttattcccttggcttcttctgctgagctactgggaagtccatgggcataacaactaaa

SEQ ID NO: 18930 - DNA, 73 bp, Homo sapiens
cttagcagaaaaggttgtgcagcatatgccatatcatactggatatgccccatctcatgatgagctgtcagga

SEQ ID NO: 18931 - DNA, 73 bp, Homo sapiens
ctgggagacaaagtgagatctcatctctacaaaaaaaaatgttaaatgatgcgagaggatcatttgagcccag

SEQ ID NO: 18932 - DNA, 73 bp, Homo sapiens
gggcacttcggctttgtcaaggcccacaatacctggcacttactgtgatgtctgaagcatgagttgaagtgtt

SEQ ID NO: 18933 - DNA, 72 bp, Homo sapiens
acaacaattctgagatgtggcatagtccagttgttgtcttggcatccaacatatctggtctgtatttacttg

SEQ ID NO: 18934 - DNA, 70 bp, Homo sapiens
tcgaacccgggaggtggaggttgcagtgagccaagactgtgccattgaactacagcctgggcaacaagag

SEQ ID NO: 18935 - DNA, 71 bp, Homo sapiens
agtacttactagcatcagaacagtgctttggaaactaagaattaaaggctgagcactggcaggtatgggaa

SEQ ID NO: 18936 - DNA, 73 bp, Homo sapiens
ttcacattttcctgtggcaagactagagactagggcatggtcttttggctcagctcagaagaggtgacttttt

SEQ ID NO: 18937 - DNA, 70 bp, Homo sapiens
caccaaacttactaagcagccctgattcactccatggatctattgaatcagtcagactgtgagagaagcc

SEQ ID NO: 18938 - DNA, 72 bp, Homo sapiens
atggatgccatcttctagctcatcaggatgatccagttttcccctggatatatcagttagctttccttgcat

SEQ ID NO: 18939 - DNA, 70 bp, Homo sapiens
ttatgtgcacatagtaatggcaatggcaatggtaatttgcttcctgtccatggtgtgtgtgtgtttgtgt

SEQ ID NO: 18940 - DNA, 72 bp, Homo sapiens
ggaatgagtggtgacaattttccatgcagatcttcaaattaataaagtatagaagttagtgtctcactccct

SEQ ID NO: 18941 - DNA, 74 bp, Homo sapiens
tgtcaacaatagcacagaaggttaatttgctaagtttcttttgtgcacgttagcctaatatagtctctgacata

SEQ ID NO: 18942 - DNA, 72 bp, Homo sapiens
agccccagtggaaccatagccgtaaggcggctgtttttgcttttatagggtttcgttgtttgggttaaaaaa

SEQ ID NO: 18943 - DNA, 73 bp, Homo sapiens
acgcgccacgccgcgctgggcagctggagagctggcggcggagcgggccgggagcggcgggggcggcgccgag

SEQ ID NO: 18944 - DNA, 70 bp, Homo sapiens
ccattccagcctggatgacagagttgagactctgtctgagggggacaaaaaaaagtttgatttgggacac

SEQ ID NO: 18945 - DNA, 70 bp, Homo sapiens
ttgctgctgagtacgcggttaccacagcaacacacccagagccctcgcgcttgtggctgccgatgacgtc

SEQ ID NO: 18946 - DNA, 71 bp, Homo sapiens
ctaacctgtttgtttggtggggtcggcgggggacatctgcttaataatctgcccttttctggatgatgctt

SEQ ID NO: 18947 - DNA, 72 bp, Homo sapiens
atagtctgggctggggccagagagtctgcatttctaacaggttctctggtgatgctgctggtgtggaactcc

SEQ ID NO: 18948 - DNA, 72 bp, Homo sapiens
agttaccgtgctgcacagcaggtctccagaactcgtcttgtaattgcaagtttgtgccctttggctagcatc

SEQ ID NO: 18949 - DNA, 70 bp, Homo sapiens
ccagttctgaggaggcgttggcccagatccagaaatttttactgagaaaatcttgaccacgcctagattc

SEQ ID NO: 18950 - DNA, 70 bp, Homo sapiens
gtcagggccaagggagcaagggagacaacagcacactgacagcgtctaatacagctcctctttgtactga

SEQ ID NO: 18951 - DNA, 74 bp, Homo sapiens
tcaagactcagtttgtctttatccccaaactccaagcatgactccatgtgcgtattaatggctgtgtgtcttga

SEQ ID NO: 18952 - DNA, 70 bp, Homo sapiens
ggaaaccacagggttagtgaagtagtaccccaggagatagtcagagcaaggtgccgtcactaccgaaggg

SEQ ID NO: 18953 - DNA, 72 bp, Homo sapiens
ctggagagcatgctgagatagcctcaggatggtgatcactgagcccaggctgaggctgcaatgtcactgtgg

SEQ ID NO: 18954 - DNA, 74 bp, Homo sapiens
ccatgcaacctaatcattcaggaggtaagaagtctaatatgtttctgacctatgataaagtgactgaggaacat

SEQ ID NO: 18955 - DNA, 73 bp, Homo sapiens
actgtactgtggataagcggctcagttcagcagagctggagttgaacaactttgttcctctggtgtggtaaat

SEQ ID NO: 18956 - DNA, 70 bp, Homo sapiens
gaggagggaaaacaagctagttgttggactggaagcttccagaaccacagctgtagcccttaacaggata

SEQ ID NO: 18957 - DNA, 71 bp, Homo sapiens
tatcaacatcaaggtgccaaagttacaagcctctggcattggtggttcatggcaggatttgatgaagttgg

SEQ ID NO: 18958 - DNA, 71 bp, Homo sapiens
cattccagcaatgcctcaaaatgcctctacttttataaactcttccgtggtgggcccagctaggagtggtt

SEQ ID NO: 18959 - DNA, 73 bp, Homo sapiens
tggactagaagttcagtctacatgctgtgtgacagtgtgcaaaaaacgtactttcttctgggtctcattttcc

SEQ ID NO: 18960 - DNA, 74 bp, Homo sapiens
ctgcctaactattagggtctcttgtatttgtggtagagaggagctcactcagaaggcatcagtaggctatgggt

SEQ ID NO: 18961 - DNA, 73 bp, Homo sapiens
taaaggtctgacaaatttgaaggctttgccaaatatgcaccacaaaacattcattgttgttagattaatttac

SEQ ID NO: 18962 - DNA, 72 bp, Homo sapiens
gcagaagcccaaataaaactatcaggcctatagagcagacatcatgtttgtacagttcagttctgatgcatt

SEQ ID NO: 18963 - DNA, 70 bp, Homo sapiens
agagttcagtagtctgcacaggggaaagtgtgtcaccaagcaggtccattactacctgagccctgaagtc

SEQ ID NO: 18964 - DNA, 72 bp, Homo sapiens
acattgctgatgggtttgtgaagtggtacagctgctttggaaaacagtttggcagttcctcaaaaagttaaa

SEQ ID NO: 18965 - DNA, 73 bp, Homo sapiens
gataggagcccagttttattgtttttcatatggctatccagttttcccaggaaaatgtattaaacagggtgcc

SEQ ID NO: 18966 - DNA, 73 bp, Homo sapiens
cagttcactggtggtgatttattgggtgtgttttactgctaacccacacatgaagcccctgacatcttggctg

SEQ ID NO: 18967 - DNA, 73 bp, Homo sapiens
gccatgggctgaatgagatcactgtggagtgagggccccactctgggattgaacctccctcctctcagatgct

SEQ ID NO: 18968 - DNA, 70 bp, Homo sapiens
gaaggagagataaagacttcccaggcaaacaaaagtcaagggagttcttcaccaccagacctgtcttaca

SEQ ID NO: 18969 - DNA, 74 bp, Homo sapiens
tcccctccctgagacccgccaggctgaaatgagaggcaagccagttttatagttccgcctagggctttccaggg

SEQ ID NO: 18970 - DNA, 72 bp, Homo sapiens
gttgttacagtatcaaagcagccatagacatatacaaatgaatggttgtggctgtatttcattaaaatatta

SEQ ID NO: 18971 - DNA, 72 bp, Homo sapiens
tacctctgcaaacactcataccagggattgaacctctgaggagtttgtcagttttctccatacctttacaat

SEQ ID NO: 18972 - DNA, 70 bp, Homo sapiens
gtgagcttgggcggcggcggcggcggcgctccactttcggggagcccggcggctctgggaagctcactcc

SEQ ID NO: 18973 - DNA, 73 bp, Homo sapiens
cccttcccattgactttgggcttgactgtgtacctttgaccaatagaccatggacagacagaagggactgtgt

SEQ ID NO: 18974 - DNA, 72 bp, Homo sapiens
atgaataacagtgctgctcatgaacaccaaagtttactgaaaagtcaatatggttttagtgtggtaataagg

SEQ ID NO: 18975 - DNA, 72 bp, Homo sapiens
tactgaagccaactgtcttgatttgggtctcccagtagcaaacccagaaataaaaatttgagctcaagtagt

SEQ ID NO: 18976 - DNA, 70 bp, Homo sapiens
caactgacgagtaggttagaacattcgaaatcttcaggttttgatagttttgttttacatccgtgttaaa

SEQ ID NO: 18977 - DNA, 72 bp, Homo sapiens
gcttcttcctctggttcagccttgcaatggaccactactcacttccttgctaatcacccagaaaactctggc

SEQ ID NO: 18978 - DNA, 74 bp, Homo sapiens
gttttatgataatttaggtagcattcattgtacacttacaatatggcaggagcatgtggcagttacttgaatgg

SEQ ID NO: 18979 - DNA, 72 bp, Homo sapiens
gacagattcacttaatgcttaatgccattgtgagaatggctgaaaggctcagttcagcagggactgtcaacc

SEQ ID NO: 18980 - DNA, 70 bp, Homo sapiens
accaaagtgcttccaatctgacaaaattctccccagaggactatttgtaggaatagatgcagtgttgccc

SEQ ID NO: 18981 - DNA, 73 bp, Homo sapiens
caaaaattatcttgagtagtaaggttattgagatgcacaataaatgagctacgtactgcttatgagagatggt

SEQ ID NO: 18982 - DNA, 71 bp, Homo sapiens
agcacattttagtcatcctttgaagctgtgacagcttcatgaaaacaatctattgaactgactgaatttta

SEQ ID NO: 18983 - DNA, 73 bp, Homo sapiens
gcagtttgacctacaggccagtaggtggcacttatggctaaaagccagctgtagcaaaagcagatgggtaggt

SEQ ID NO: 18984 - DNA, 71 bp, Homo sapiens
cacatctgtaggcatccattgaatgtgggagtatgatccatctcgaaattccactggcaacttacctttag

SEQ ID NO: 18985 - DNA, 70 bp, Homo sapiens
aagggtgcgtagatataggaagtggcaaatctattcaatccagatgtgtctaacctcaaattctagttcc

SEQ ID NO: 18986 - DNA, 72 bp, Homo sapiens
aatgaataatcagagtatggcttttcatttctaatgtccatggcacattttgattacagcattcattatatc

SEQ ID NO: 18987 - DNA, 72 bp, Homo sapiens
ttcagaggcagagtgatcctatggttgactaacttactagcacaacagtgtcgaggatccaggcactttcca

SEQ ID NO: 18988 - DNA, 72 bp, Homo sapiens
cattttggagtgagattttccccaattcaggatcacattgctgagtacataaccttagtctacatttctgtg

SEQ ID NO: 18989 - DNA, 72 bp, Homo sapiens
tcttgtctcctggtaggtcatggaggtttggggagttcctttagtccccaataaagcttgcttgtggaggcc

SEQ ID NO: 18990 - DNA, 73 bp, Homo sapiens
tgcacttaagaaaagtaataaagacattgcctaccatttcagatgagatcaggtgctttcagagtggtatggc

SEQ ID NO: 18991 - DNA, 71 bp, Homo sapiens
caaggcagacatctgtaccagaaaggacagggaggcatggtaggccagagcaggatgtcagagcccaaaca

SEQ ID NO: 18992 - DNA, 72 bp, Homo sapiens
ctcttttctacagttgtgcatgcagaaaataggctacagcagatgtgagtgttgtcaactgtgtccactgtc

SEQ ID NO: 18993 - DNA, 73 bp, Homo sapiens
tcagaatagcagttgtctttatggggtagccactgggaggggccacaagggggtcttcaagggtgccagcagt

SEQ ID NO: 18994 - DNA, 72 bp, Homo sapiens
aatgctagcaccagccaggcagcaccccttcctagaaggctggggttcctgcctccaagcttctaggtcctg

SEQ ID NO: 18995 - DNA, 73 bp, Homo sapiens
gctgataggaatcttcccatgtgccacatgcacacagcagtttgccaacgtggatggctgccaatggttttct

SEQ ID NO: 18996 - DNA, 71 bp, Homo sapiens
aaaagtacagggaccattcttcgtcctgcacacacacacaaaaatctgataatggagcttgatggttccaa

SEQ ID NO: 18997 - DNA, 72 bp, Homo sapiens
acagcacaaaggcacagaggttcagggttgcatagtgcattttgggaatagcaagtagtttggtggggctgt

SEQ ID NO: 18998 - DNA, 72 bp, Homo sapiens
agtatgcaggaggatatgcgtaggttatatgcaaacactaagcaattgtatatagattttggtatccatggg

SEQ ID NO: 18999 - DNA, 71 bp, Homo sapiens
gttgtgcaactgtcttatatcacctgagctgagtaagacttgctcagggggaaaagtcagggataaaccct

SEQ ID NO: 19000 - DNA, 72 bp, Homo sapiens
attgtattccagggatcaggcctctagagtttacactggctctctgtgacctatgaatgtcctggccccagt

SEQ ID NO: 19001 - DNA, 72 bp, Homo sapiens
tgattcatccatcatcattgtataggggaggtaaccactgtgtcaagcctgacagggaagaacaccatagac

SEQ ID NO: 19002 - DNA, 74 bp, Homo sapiens
tcactaagccttggtttccccatctgtagagtgaagatgataaccatcacatttaagactcgggaatgctgagg

SEQ ID NO: 19003 - DNA, 70 bp, Homo sapiens
ggcagaacacctccagtctctttatgatgagatccccttccactactggtcaggactgaagtctgcttca

SEQ ID NO: 19004 - DNA, 73 bp, Homo sapiens
cattcattggactaggataaattctgggggtgttggctcagctgcaggtgctgccagaagagatttctcctgg

SEQ ID NO: 19005 - DNA, 72 bp, Homo sapiens
tggcctctcagcacctccctgctcattcgcaggtggaggtgaaacatcagaattcaatgttttgtcaccttg

SEQ ID NO: 19006 - DNA, 72 bp, Homo sapiens
cttggggtccgtgttctgagcaaaacagacatgatccgtgccctcaaggagcttacaatctagtcagagaga

SEQ ID NO: 19007 - DNA, 73 bp, Homo sapiens
gtttgtaccccactcctggtaccaaaaaaaaaaaaaaagaaaaaaaaagaaagggccaatggttgggagaact

SEQ ID NO: 19008 - DNA, 71 bp, Homo sapiens
accattcaagctacccagctgacactgagtgaagcacaaattatccctgctgagtacagccaagtagcaga

SEQ ID NO: 19009 - DNA, 70 bp, Homo sapiens
aagacgcataatgctggttggcccctggtgagagatttgctcaccatgcctaggtcctctcggcatgagc

SEQ ID NO: 19010 - DNA, 73 bp, Homo sapiens
aggcgggagccggcggccgagcccagcgccgacgactcggcgggtgacacggaaacatggcgcagcgcccctc

SEQ ID NO: 19011 - DNA, 72 bp, Homo sapiens
cctggcagggagcagagggactctgttgggtccagtcaaatcctgggcttccttccagcctggggtcctcaa

SEQ ID NO: 19012 - DNA, 72 bp, Homo sapiens
tccttgtagattggaaagtctttggaggtagagttgccagacttagcgaatcaaaatataggatacccagtt

SEQ ID NO: 19013 - DNA, 73 bp, Homo sapiens
gaagaacagaggaaagtcttgctgcagttgatatccccttaaatgtctttctgccattttacctttctttttt

SEQ ID NO: 19014 - DNA, 72 bp, Homo sapiens
agtcagtggaagggtactggacttggagtcacaagatctgtgttttatttttttattttattgattttttga

SEQ ID NO: 19015 - DNA, 70 bp, Homo sapiens
agtcagtggcactgccagcgccgtggtcatattacctaggccacagctgccaggcctgcaagctctttcc

SEQ ID NO: 19016 - DNA, 73 bp, Homo sapiens
caccgtagaggagctcacagtctagatgactggcactacatactgcctcatgttgtgtcacaatctttttgtg

SEQ ID NO: 19017 - DNA, 70 bp, Homo sapiens
atgcaaactggaaaggtgtgttgatttcacaactcaagttccatgagcagcattgctactaggaacctca

SEQ ID NO: 19018 - DNA, 74 bp, Homo sapiens
ctggtgaaataccctaacatcctggtgaaataccagtgactacagcactccaggacaagggtaacaattttcca

SEQ ID NO: 19019 - DNA, 73 bp, Homo sapiens
gtttatttggaaggtgatttaggaagtcaagcagactgcactaataagcagcttactgttatgggcaacgggg

SEQ ID NO: 19020 - DNA, 72 bp, Homo sapiens
cttctccctccaaccagccctgcatggtgctgccagtccagttttcctagggcctcattttcatgtattgct

SEQ ID NO: 19021 - DNA, 74 bp, Homo sapiens
ttcagagttgtcttcaaccgcatctaggtcagaacaactctagggaggggtgggaccttgagcgaggcattctc

SEQ ID NO: 19022 - DNA, 70 bp, Homo sapiens
aacctggctcttcagctaaacagcattcacagtgagccgatgtggagtcctcgtgttgattgccatccaa

SEQ ID NO: 19023 - DNA, 72 bp, Homo sapiens
ttggttgctaagtcgcttttggattattacatgggggttatagtcatccagaaaatttgaaggctgagagca

SEQ ID NO: 19024 - DNA, 72 bp, Homo sapiens
gtatctacagcatccccaatggtgagtgtcttgggcaggaagacaaacatagatatgtacgttaggttgttg

SEQ ID NO: 19025 - DNA, 72 bp, Homo sapiens
tggaaagactccaacagctgaagctaaaatagctggggcttctcaagctcctctctgtctctctctctcttc

SEQ ID NO: 19026 - DNA, 73 bp, Homo sapiens
gtgatttgtgatccccctggcctgtcttcagtaagaatcttgttaggccagtttagccagaaatcccccttac

SEQ ID NO: 19027 - DNA, 74 bp, Homo sapiens
tggcccgttctcaatgagctgttgggtacacctcccggaccgggtggtggccgggcagaggggctcctcacttc

SEQ ID NO: 19028 - DNA, 74 bp, Homo sapiens
tcaaggtgtcagtgcagtggcacagctatggtgatgagaccaagcggcaaccagagccccaagacacacactgg

SEQ ID NO: 19029 - DNA, 73 bp, Homo sapiens
atgtaaaccaacagatattacacttttttttctcctatgatgggtggtgaaatctactgtgggtcagtgtata

SEQ ID NO: 19030 - DNA, 72 bp, Homo sapiens
gggctcaagcgatctgcacgccttggcctcccaatgtgctgggattacaggagtgagccaccgagcctggct

SEQ ID NO: 19031 - DNA, 72 bp, Homo sapiens
gttgctagcagcactatctatagtatatgcccattaaatcgtggtacattcaccgtggagaactgtacaaca

SEQ ID NO: 19032 - DNA, 72 bp, Homo sapiens
gtcattttagtcaactagccaagctcagggctacacttaaaccagctccctagaatggcccacatcccttat

SEQ ID NO: 19033 - DNA, 71 bp, Homo sapiens
tcacctgggcaaggatgagtcccacaggggcaggggtgaggctgtgatccccagggggcaggccctgatct

SEQ ID NO: 19034 - DNA, 71 bp, Homo sapiens
cttgtgccgtcacgtttgtctccccttaccagacttatagagacagcaggacgatctgacttggcaggagc

SEQ ID NO: 19035 - DNA, 74 bp, Homo sapiens
caggtgtgggccagtagcataccactgcaggtagctctatctgtggactacttggtgactcagatgcagcctga

SEQ ID NO: 19036 - DNA, 72 bp, Homo sapiens
ccatgtcaccaagtgtcatggccgcctccagataactccgcgtgtgcaggacatcttggcggcccacatttg

SEQ ID NO: 19037 - DNA, 73 bp, Homo sapiens
atcaactatttcactttatggtgagtctgaaaggagaaggaagcatgatggaaagtgaaagcagagccagggg

SEQ ID NO: 19038 - DNA, 73 bp, Homo sapiens
tcaccgacaccacctctctttcacaccccagcagcagcagcattgtgtgaagagcgtttctgtgctctgtgga

SEQ ID NO: 19039 - DNA, 73 bp, Homo sapiens
cttgtctcctcagccagtttctttgtctttatggggtaaagccttaggagaaaaggatgcagccaggaaagag

SEQ ID NO: 19040 - DNA, 71 bp, Homo sapiens
tggggcccagtgtagtctgatgtactgtccaacacctggtttacagagggatcagcctccatgacccaaag

SEQ ID NO: 19041 - DNA, 71 bp, Homo sapiens
tcaggcaactatgggagctggaaagtacaaactttgcagagcaggatgtcaccctggagtcccctggcaga

SEQ ID NO: 19042 - DNA, 70 bp, Homo sapiens
gccatggtggcaggcatggaggttatgcatggactccacaatatggacttccaccacgaccaatctggct

SEQ ID NO: 19043 - DNA, 72 bp, Homo sapiens
tctcaagctcctgtcttcaagtaatccactcgcctaggcctcccaaagcactgggattacaggtgtgagcca

SEQ ID NO: 19044 - DNA, 73 bp, Homo sapiens
ttcctcgtgctcatccccacatggtcacaagatggctgtcacagctccagacggcttgactatattcaaagca

SEQ ID NO: 19045 - DNA, 74 bp, Homo sapiens
ctggcctcgaggagctcacagtctagtagaagccagatgcataaacagacatgtgctaagtgttgtaaccgggt

SEQ ID NO: 19046 - DNA, 74 bp, Homo sapiens
caggtatatggtatttttttcccaaagccacatgatagactactgtcaaatacaataaagatggtaccagatac

SEQ ID NO: 19047 - DNA, 72 bp, Homo sapiens
aggcacatgaccacagtgtctccaatctaatctggaagcattatgtggctcagttcacacttcaatacccag

SEQ ID NO: 19048 - DNA, 72 bp, Homo sapiens
ccatgccggcatagatatatggagtggggcgtgatgggatgttcatgaggtagtagactgtgtggctctgga

SEQ ID NO: 19049 - DNA, 73 bp, Homo sapiens
caagtgagcacgtctggctaattatttgtatttttgttagagacagggtttcaccatgttggccaggctggtc

SEQ ID NO: 19050 - DNA, 71 bp, Homo sapiens
agacttggatatcatgtgctgaatttttcttgaactgacgtttgggttgcgtttgtgtgtgtgtgtgcctt

SEQ ID NO: 19051 - DNA, 73 bp, Homo sapiens
aaataaataaataaataaataaaatatttgaggccaggtgcaatggattacgcctgcaatcccaggtactcag

SEQ ID NO: 19052 - DNA, 74 bp, Homo sapiens
gccccagtgactgtgatactgccaggctggattcttggtttggacatgactcagtatcatgcagagagcttagc

SEQ ID NO: 19053 - DNA, 71 bp, Homo sapiens
ttggggctagtaatagtttatggttgatatggtttggctgtgtccccacccaaatcttaacttgaattgta

SEQ ID NO: 19054 - DNA, 70 bp, Homo sapiens
ttggaagtagaaagcaagatatcaccagacattgaatgtgttgttgccttgatcttggacttcccagcct

SEQ ID NO: 19055 - DNA, 73 bp, Homo sapiens
tgggtacagcaaaccaccatggcactcatatatatatatatatatatatatatatacctgcacgttctgctca

SEQ ID NO: 19056 - DNA, 72 bp, Homo sapiens
aatacatcccattgcctccctaactggtagaaaagcatgcatgagtgggtagaggctggggagggggtacgg

SEQ ID NO: 19057 - DNA, 71 bp, Homo sapiens
aggaagatggatgtcgagatggctgaataggaatagcagcttcagtctgcagttcccagtgagatcaacgc

SEQ ID NO: 19058 - DNA, 73 bp, Homo sapiens
tttggtgttttagacatgaattccttgcccatgcctatgtcgtgcatggtattgcctaggttttcttctagag

SEQ ID NO: 19059 - DNA, 72 bp, Homo sapiens
ccatcgctgtcgtgccaggagcccttggagtgtccccttctctaaagccatgtcaagcacagtaagaataaa

SEQ ID NO: 19060 - DNA, 72 bp, Homo sapiens
catccagggtgcgtatctcaaccacaggggccacccaaagcagcaaggtagcccccagaggaaggggacgtt

SEQ ID NO: 19061 - DNA, 74 bp, Homo sapiens
gtctatgtgcctgtttctgtaccagtgctatgctgtttttgttattgtagctttatagtatagtttcaaggaag

SEQ ID NO: 19062 - DNA, 72 bp, Homo sapiens
cttcagtctgtgggtgtttataccccattaggtgggtctcttgtaggcagcaatttgctggattttgtggtt

SEQ ID NO: 19063 - DNA, 72 bp, Homo sapiens
cattttatgtagggcaaatgcaatggtaatgaactagtccagcatttgtttttctgggaatgtcttaacttc

SEQ ID NO: 19064 - DNA, 73 bp, Homo sapiens
gcggtctctcctgaactcaagcgttttgtccaccttggcctccaaaagtgctggaattacaggcgtgagccac

SEQ ID NO: 19065 - DNA, 74 bp, Homo sapiens
taaatggaattgttttctttccattagtttcatgtatatgtgaaactaataatagtacatgactatttatgagc

SEQ ID NO: 19066 - DNA, 72 bp, Homo sapiens
ggagctgggcccacgaggcactaacagactcaagttgatctgcccttctgaatcacctttgttcccaagtct

SEQ ID NO: 19067 - DNA, 73 bp, Homo sapiens
gcactcaaccttctcgccagtctcaggatgaggtggccttgccccacctcaaagcctgctcctccacctgtgc

SEQ ID NO: 19068 - DNA, 70 bp, Homo sapiens
ctttagacctagcctttctgcttcttaaattgaccaaagtccaattctaggctgaggttggtgttttaga

SEQ ID NO: 19069 - DNA, 73 bp, Homo sapiens
tcaagggcaatgcttccagcttctgtcatttcattatgatgttggctgtcagtttgtcaaataggaatcttaa

SEQ ID NO: 19070 - DNA, 71 bp, Homo sapiens
gagtgtgtggatttttgtctgattgattcaattatttagtcacaatattcagaatagcatcctcatgcatt

SEQ ID NO: 19071 - DNA, 72 bp, Homo sapiens
ttcagtatggcttttcattttccacagctgttagggtttaaggtgatagatagctgggcaattacgccaact

SEQ ID NO: 19072 - DNA, 70 bp, Homo sapiens
gcttaaccatgggccaccaagttaccatatctgagctgcctatcagaaactgggtgttgtttgacccacc

SEQ ID NO: 19073 - DNA, 73 bp, Homo sapiens
atggagttgccttagggtttagtttccctctttactcagtgattatttgatacagctccagggaagattccac

SEQ ID NO: 19074 - DNA, 72 bp, Homo sapiens
tttttcctaaatattgtcctaggagtgggcccacaactccgctattgccaatgagttattagggaaagtcag

SEQ ID NO: 19075 - DNA, 72 bp, Homo sapiens
tggcttgtggtattgtatcagtaagttaattgctggttcacaacagtttatggttaagtccttggaattaga

SEQ ID NO: 19076 - DNA, 72 bp, Homo sapiens
aacatatcacattcccaggtattgaacatgagtgagcaggaactgcacaagtacctgtcgggaagccccaag

SEQ ID NO: 19077 - DNA, 73 bp, Homo sapiens
ggagggagggaggggaggcttaatccctggagactgaattagcacccacctcaggggattttctcattgggga

SEQ ID NO: 19078 - DNA, 74 bp, Homo sapiens
catgtgtgctctgcctgatgactgtgaatttgggtcccaggaatgtgtttacaactgtttcaggtatactgtgc

SEQ ID NO: 19079 - DNA, 73 bp, Homo sapiens
atgaagacaccaaatatgttccagacatcactggagcaggagaataaagtgataatctacatactagacagca

SEQ ID NO: 19080 - DNA, 74 bp, Homo sapiens
gagggaggggcaacaagggaggggacaaggccataagcagttttcagtgatggacaaaggaaagggcctgacct

SEQ ID NO: 19081 - DNA, 72 bp, Homo sapiens
tgtatatattagttctaggaggtttggggttttttggtcaatttctgggactttctacactgactataatgt

SEQ ID NO: 19082 - DNA, 70 bp, Homo sapiens
cctagtgggaggtgttcgggtcatggaggtggatcccttatgagtggcttgatgctgtccttgtggtaat

SEQ ID NO: 19083 - DNA, 72 bp, Homo sapiens
tggtctatggtttttactgacataaccatgatgtgggggaaacaaactggacttggagtcagaatatttggt

SEQ ID NO: 19084 - DNA, 72 bp, Homo sapiens
agccatggcgagcttaggggagagctgtgcccaggagtctcctcgtggggtttccctcaagagttccaaggt

SEQ ID NO: 19085 - DNA, 74 bp, Homo sapiens
gagcccagcttatcagacagacagcagcagaccgcgcggtcccaaccccgtctacttgctgaaggagccggagt

SEQ ID NO: 19086 - DNA, 71 bp, Homo sapiens
gactttcagtgatgtggccagtgattgcagcctgacctcaggctgaggccataaaacatgggaaactcacc

SEQ ID NO: 19087 - DNA, 74 bp, Homo sapiens
ttgtttttcattttctggagcagggtctacaggtttccaccaaacagaagatctcgccctgggatctttttgag

SEQ ID NO: 19088 - DNA, 73 bp, Homo sapiens
tgtgctcagtagaacagtttagaaaatacaaggctgggagtggtggctcacgcctttagcaatcccagcactt

SEQ ID NO: 19089 - DNA, 73 bp, Homo sapiens
ggagggctggataggagatgatcacctggtatgacagtgtctaggaaactcggtcactgtgagaacagagtgg

SEQ ID NO: 19090 - DNA, 72 bp, Homo sapiens
gcagaaagctcgctcctacatgcccttcttctctagggctcactctgtgtctctgtgaaaaaagtaacctgc

SEQ ID NO: 19091 - DNA, 74 bp, Homo sapiens
gcggaggcagcgccggcgggggcgggatgggcagcagaggggggtcagcgggcccgtcgggggtgctgcgatcc

SEQ ID NO: 19092 - DNA, 72 bp, Homo sapiens
ctacaatggcctctagcggtacaggtgaaagaaagtggtacatctttcacttaaatcaatagctagaaatga

SEQ ID NO: 19093 - DNA, 70 bp, Homo sapiens
ttttttgtatgatgacttcttttcctctgggtagatatccagtagtgggaatgctgtatcaaatggtagt

SEQ ID NO: 19094 - DNA, 72 bp, Homo sapiens
taaggattttagcatctatgtacatcagggatactgtctgtacttttcttttttggttatgttttttcctgg

SEQ ID NO: 19095 - DNA, 74 bp, Homo sapiens
gtggcagaacttgtaccccattgttgtattgatgatgtcatctgacgtgtaacaggcattggaagagttgtcct

SEQ ID NO: 19096 - DNA, 70 bp, Homo sapiens
aagtcttctggaattaatgagaggagaggtgaagactcccttggtatcacattattgaaacagaaaaata

SEQ ID NO: 19097 - DNA, 70 bp, Homo sapiens
aacccttaattcccacagcaatgtggtcatattcattttggaggtgaggaaacccaggttaagagaagtt

SEQ ID NO: 19098 - DNA, 70 bp, Homo sapiens
ttgctaaaaccaggctattgcttggtaatctatcaagtagaccagcaaatgtgcaacaggtgggtagcaa

SEQ ID NO: 19099 - DNA, 71 bp, Homo sapiens
tattggagcattgtttgtaggagtgaaaaactagaacaaagcagatgcttataaatactaatatttgacac

SEQ ID NO: 19100 - DNA, 72 bp, Homo sapiens
atgcttatctgctctggtgcatcattgtcaggcatggtggtgccagcccccatgtagccatttgcagttgta

SEQ ID NO: 19101 - DNA, 73 bp, Homo sapiens
aaaaagggcagtatataatgataaaggattcaattaaacaagaggacttcatcatccaatatatctatgcacc

SEQ ID NO: 19102 - DNA, 72 bp, Homo sapiens
tttggtttgtaaatcaaggctgcctctctgggtcaaagtgacttagctcctatctaggcaagagtgagatgt

SEQ ID NO: 19103 - DNA, 72 bp, Homo sapiens
ccaggtcataagtaggaaatgatagctcagtcaatagcaaatactccaaggacctgaaatgatctgagacca

SEQ ID NO: 19104 - DNA, 73 bp, Homo sapiens
gagatcttattgtggcattattacttttgtattatattaagtgcaatggggaaagatgattttgtaattaggt

SEQ ID NO: 19105 - DNA, 70 bp, Homo sapiens
tggatatttttcctggtcacagtgtaggacagtgcctttcctacaatagatcagaggctattctcacagg

SEQ ID NO: 19106 - DNA, 73 bp, Homo sapiens
aagccatttctgccctgcctcagaagggtccttagggagggcagtcagaggcactgggaaaagggcacaggga

SEQ ID NO: 19107 - DNA, 73 bp, Homo sapiens
gttttcagcatttttgcattgattctttctcatttttgtgggcttatctaccttttatctttgtggttgctga

SEQ ID NO: 19108 - DNA, 74 bp, Homo sapiens
tcagtcaaaatacctgtgtcagcatacttctttcatctgtcacttggccagagtttgcaggacaggctcggcac

SEQ ID NO: 19109 - DNA, 74 bp, Homo sapiens
gtaagtggagggaaagatgacctgactttggggaagagacaacctgactttgggaaatacgacctgtctttcct

SEQ ID NO: 19110 - DNA, 72 bp, Homo sapiens
atgacaaaatattttagggcagccacagtcaaagacataatttactaggaattttttttttacctctgtggc

SEQ ID NO: 19111 - DNA, 74 bp, Homo sapiens
tttataaggtggaacttgaactcaaataagatttgcaagccttagggtttagtgttgtttttcaatttgggttt

SEQ ID NO: 19112 - DNA, 71 bp, Homo sapiens
agtcttgctccatcacccaggctggagtgcaatggcgcgacctcagatcaccgcaacctccatctcctgga

SEQ ID NO: 19113 - DNA, 74 bp, Homo sapiens
ccagaataaagaatctttctttttttctgcaagtggcttccatgatccactacttttagtagtaaaagagaaag

SEQ ID NO: 19114 - DNA, 72 bp, Homo sapiens
attaaacgaagaaaaagcaaaattggtgaagcaggttcaggagaaagaagactttcttttggaggcgaaatc

SEQ ID NO: 19115 - DNA, 72 bp, Homo sapiens
agaattctgagttccttctgtgtgttatcttgaatttttttgagtttcttcggcacagctattttgaattct

SEQ ID NO: 19116 - DNA, 72 bp, Homo sapiens
gtatgaaaaaatccacaatgttgggggcatgtcaaaggtacgcaggagcctactgaaagagttcccaatggc

SEQ ID NO: 19117 - DNA, 70 bp, Homo sapiens
acctggcatcattgccatacttgtggcccccagggggctgcttggaaccctgaagtttgctctaaggaag

SEQ ID NO: 19118 - DNA, 74 bp, Homo sapiens
aagcccagggtaggtgcagaaataatgtcaaagagtcaagtcctggaatcaggtactgcaagtacccacttggt

SEQ ID NO: 19119 - DNA, 71 bp, Homo sapiens
atctcactctgtcacccaggctggagtgcagtggtgcaatcgtggcatcatggctcactgcaggctcgacc

SEQ ID NO: 19120 - DNA, 71 bp, Homo sapiens
atctccatactgcttttcacagtggctaagctaattggcattcccaccaacagtgtataagtgtgtcctta

SEQ ID NO: 19121 - DNA, 72 bp, Homo sapiens
ttctctatgaactgtaaaaggattagtaaaaacagatggtgccattgaaagccattgtctactaattcttaa

SEQ ID NO: 19122 - DNA, 73 bp, Homo sapiens
ggtattttcttatgacagccacctaccagcagatagagcgatgtggtgactgattgctgatactaccaagtct

SEQ ID NO: 19123 - DNA, 74 bp, Homo sapiens
gactttgagggatagaaacatggcaacttatcagaaaatattttcaaagaagctattataactatgcccacaaa

SEQ ID NO: 19124 - DNA, 72 bp, Homo sapiens
tttaaaaatgagccttaacatcaccagcacaactaaaatttaaacaagatttttatgtgatattgatgaggt

SEQ ID NO: 19125 - DNA, 73 bp, Homo sapiens
ctagctgagatgggatgactgctagagcccaggaatttggggttgtactgagctatgatctttccactgcact

SEQ ID NO: 19126 - DNA, 74 bp, Homo sapiens
cagatttgttcagaataaaatacaggactttcctataaggatgtatcatggtgatgtaaattctgtaactgctg

SEQ ID NO: 19127 - DNA, 72 bp, Homo sapiens
ccctttgtctgtgggaagcagttatggaaaatagaccttcattcattctcccctaaagattcaggggtcttg

SEQ ID NO: 19128 - DNA, 74 bp, Homo sapiens
attcctgttgttttcactgtgtgacacagccctgaatcacatcatcagggcttgaacacttaagagaatctaca

SEQ ID NO: 19129 - DNA, 73 bp, Homo sapiens
agttacaatatattgtagcaattcagagcagcacactttgctgatatttgcaccatgattgtactaagaaaag

SEQ ID NO: 19130 - DNA, 72 bp, Homo sapiens
ggatttttgactgtgctgcaacctacaatggagatctgagccacagaactggttaggtaacagaaaagacta

SEQ ID NO: 19131 - DNA, 70 bp, Homo sapiens
catgaggctacactgacagagccaagaaaagcagagggctgtgtactcattgagttaaatgaatgacatc

SEQ ID NO: 19132 - DNA, 74 bp, Homo sapiens
ctcctgacctcaggtgatctaccacattggcgtcccaaagtgctgggattacaagcgtgacccaccctgcctgg

SEQ ID NO: 19133 - DNA, 74 bp, Homo sapiens
attaaatttactagagagatcaactgctcatgtagagatgattagtgtcacagggcattttaagtggatactca

SEQ ID NO: 19134 - DNA, 70 bp, Homo sapiens
tttcagactggatacttagctgtgcttccttcagggtgtagcagccattgagagttctgcgcctgataag

SEQ ID NO: 19135 - DNA, 72 bp, Homo sapiens
aaaaactagatatgagcgtattagtatttgtttttattttcagaataattaaaaataagtgctttgaatgct

SEQ ID NO: 19136 - DNA, 72 bp, Homo sapiens
agtggtcagattacagcattattgtatggtaatcctgttatttaggagcattattgtatggtaatcctatta

SEQ ID NO: 19137 - DNA, 74 bp, Homo sapiens
tgtttacatcatgtcagttactatgacaggagtgatacacatagtatcacatttaagttctaatgcatcgtgta

SEQ ID NO: 19138 - DNA, 73 bp, Homo sapiens
ggggtttcaccgtgttagccaggattgtctcgatctcctgacctcgtgatccgctggacactaaaacttctac

SEQ ID NO: 19139 - DNA, 74 bp, Homo sapiens
ttattggtaattaagatgaaggagcatgggttgattggaatttattataaaatgttcatggcagcaggattgct

SEQ ID NO: 19140 - DNA, 74 bp, Homo sapiens
gaaaagaaggctttggcattcagtcaagtataacctagaatactggctctactagttctgagctgagtgatgtc

SEQ ID NO: 19141 - DNA, 72 bp, Homo sapiens
tgaaacacctgcagttagagtcatcctgagtactaggatgatcagtagcttatcaagctgattagtaggttg

SEQ ID NO: 19142 - DNA, 74 bp, Homo sapiens
aaaacttatgtttgaacatttatctttggggatacatgtatttccacagcagcgttgagacttactgggaacct

SEQ ID NO: 19143 - DNA, 73 bp, Homo sapiens
ctgattcagtaggtcaggggagggcattgttggatggatcaaatgcatctccaagcttccccacttgggcacc

SEQ ID NO: 19144 - DNA, 73 bp, Homo sapiens
caaggagctattaggagggtacccctgttctttgtcctcagggccttggaatagtagcactcaccctgtggat

SEQ ID NO: 19145 - DNA, 72 bp, Homo sapiens
gagttgggagagaagagaagagtgcttggtatcttgacaaaccctcctaccttttctcctaactacatagat

SEQ ID NO: 19146 - DNA, 73 bp, Homo sapiens
cagttcactagtttggcaaataccctcacagaaaaagagtttttgtgctttccttacctactgggtttttgct

SEQ ID NO: 19147 - DNA, 74 bp, Homo sapiens
tctacttccagccatgtccagtttattgaggaatccatgaaaggtactcttcatttctatttatttctggcagt

SEQ ID NO: 19148 - DNA, 73 bp, Homo sapiens
tcattatccagtttgattgaagaagggatggagtatgtcaccaagaagccatttttttttttctcaagacaca

SEQ ID NO: 19149 - DNA, 72 bp, Homo sapiens
aagagtctatgcatctctgatctgtatgtgtttggagactgtcccttcaaatattcatcctcagtatgacac

SEQ ID NO: 19150 - DNA, 72 bp, Homo sapiens
aaaataatggtgtagaaataaatttgctgaggatacactgacttagaaatatgttcatacactgttgcataa

SEQ ID NO: 19151 - DNA, 73 bp, Homo sapiens
ttatatttctttgtaatataattatctggtttagttgtctggtcaattataacctcatggggtgacttggaaa

SEQ ID NO: 19152 - DNA, 70 bp, Homo sapiens
atgtactgtacatgcattacaaatacaattcataaagctgttataattatatgtacagtatagcatcctg

SEQ ID NO: 19153 - DNA, 72 bp, Homo sapiens
agacaaaaccgtttggaaatgacctgggccagggaaaggaactcaccttgcccttccacctgcaccaacttc

SEQ ID NO: 19154 - DNA, 72 bp, Homo sapiens
gttgaatgttgttgggtaagagcataagaataacagcttatgttttttttctactcaggcatctacctcttc

SEQ ID NO: 19155 - DNA, 72 bp, Homo sapiens
ccaattcaatgtactatgatgctgtttctgcatctgaatgtatagtaggaattaatgcactatattcttgta

SEQ ID NO: 19156 - DNA, 73 bp, Homo sapiens
caaacctttcaaagggctccccacctatgtgagtaatcgtcatttcccaggttagggaatcaggaaaagaacc

SEQ ID NO: 19157 - DNA, 72 bp, Homo sapiens
cccagacctggcgcccatcattctgtctctatgagtttgactattctaggtattggatataaggggaatcag

SEQ ID NO: 19158 - DNA, 74 bp, Homo sapiens
catatcattcagagtaagggccaagtactttttatgacccacaaggtcctttatgatctgactcttccccttgc

SEQ ID NO: 19159 - DNA, 73 bp, Homo sapiens
agggcctagtaatattggattctcaatctcacatggcagcaatcagctagggttgagtcagtacagctagtac

SEQ ID NO: 19160 - DNA, 72 bp, Homo sapiens
tatctgtagtcaatcagtttatttttgcaggttatttgttattgagttgtaggagttactcagatattttag

SEQ ID NO: 19161 - DNA, 70 bp, Homo sapiens
accttctaggggaattttttttccttttctactcagctaaggccagaggagatgaaagttcttgattcag

SEQ ID NO: 19162 - DNA, 73 bp, Homo sapiens
agacttgagaggtatgtcttactttgcttctatctcccactagagagttcagcatgtagtggtgtactaaaag

SEQ ID NO: 19163 - DNA, 73 bp, Homo sapiens
ttcaatgtcagtagtgtgggccaaaacattaagaaaggtgcaacagacttgagtccatattatttatctaaaa

SEQ ID NO: 19164 - DNA, 71 bp, Homo sapiens
tatttcagcagttctactttcccgtacattttttagaaagcataattcctaaatgattttgaagggaaagt

SEQ ID NO: 19165 - DNA, 70 bp, Homo sapiens
actgctggtcactacattcagatgggtggtgttagccaaaatgtttaatagtgtggtcatagctggatcc

SEQ ID NO: 19166 - DNA, 71 bp, Homo sapiens
ttagtgagtgtcctataaaagggctggagggaactaacttagatcccttttactcttctactcttctgttg

SEQ ID NO: 19167 - DNA, 70 bp, Homo sapiens
cttatcaagatttctttaaaacgctaaggatagttcaggaccttagcaaagtaccaagaaccttatagga

SEQ ID NO: 19168 - DNA, 72 bp, Homo sapiens
ctccagatcccgctagtcggccgcggccttggtcccgcggcgcctcgcctactagtcactggcgacgcggag

SEQ ID NO: 19169 - DNA, 70 bp, Homo sapiens
aaaaaccaagggcaagagcacgtgctatgctgaaccattagcacagagggcatgagttagcaccaaaaca

SEQ ID NO: 19170 - DNA, 71 bp, Homo sapiens
ggcttaactggatacttataacagcaggcaaggctctcaaactagggcctctgcttcgtttccagccttgc

SEQ ID NO: 19171 - DNA, 70 bp, Homo sapiens
ggcatgctcaggaggaactactggtctgtacacaggaggaggcttcttaagtctgtttatgatttctgtc

SEQ ID NO: 19172 - DNA, 72 bp, Homo sapiens
tgctgagggctttgggcttcatcccatgcaccagggtcatgaactcaaatgccccaactctcaggcagataa

SEQ ID NO: 19173 - DNA, 70 bp, Homo sapiens
aaagagcccatagcaagttatcaagactatcagactacttcctgtttcctgaatgtgctgtgcactttta

SEQ ID NO: 19174 - DNA, 71 bp, Homo sapiens
aacagctcacctttgcccatttaagcagtcctacagctttaagactgggatatgattgggcctgagccctt

SEQ ID NO: 19175 - DNA, 73 bp, Homo sapiens
tataactactgatgtgctaggaggtctgtgatgcactgttaagtgcaaaagccaagctgtagagaaacatata

SEQ ID NO: 19176 - DNA, 70 bp, Homo sapiens
gataatgaagagaaacccccggctcctccactgaggatgaatagtaacaaccgggattcttcagcactca

SEQ ID NO: 19177 - DNA, 72 bp, Homo sapiens
tggggcagatagtgagttttattgagtttggagcctgggactctgggatatccagtcagtctttcagtctta

SEQ ID NO: 19178 - DNA, 72 bp, Homo sapiens
atagctccaacgttagcttctgagaagtcctcaggaagcttatcatcatggcaaaaggcgaagtgggagcag

SEQ ID NO: 19179 - DNA, 72 bp, Homo sapiens
agatgtttcttctgccttggaataaagaaaatagtaaaagctgtggctgtggtctagggctgcactttctca

SEQ ID NO: 19180 - DNA, 72 bp, Homo sapiens
atcaccagactgcctgactttcacaaggatcctgtgagaaagttatgctcatcatcattgtatagttttgca

SEQ ID NO: 19181 - DNA, 72 bp, Homo sapiens
acctttctggtagtgccaatgccatttgttcacagatcacattctgaggagccaggtgcacgaaccatcatc

SEQ ID NO: 19182 - DNA, 73 bp, Homo sapiens
gcacgggaagagagagagctcggagagtcagcaaactgcttattttttcttccccctgctttttcctagccat

SEQ ID NO: 19183 - DNA, 72 bp, Homo sapiens
aataataataatagtagtcagcaaagtttgtaaggcttaagtgagctaatccatttaagcatctggcacgga

SEQ ID NO: 19184 - DNA, 73 bp, Homo sapiens
agaccaccttccagctacgatattaatagtttcctgttactgggctttgaaggtccagacaggctatgaagga

SEQ ID NO: 19185 - DNA, 72 bp, Homo sapiens
gctaggctgggtgggccaaattgctcctaggtagccaggaaaataggctaggcagtagagacacagttctgc

SEQ ID NO: 19186 - DNA, 72 bp, Homo sapiens
cagactctaggcctgctacagcaccaggccagacctgtggacccaagttttaggcctcctctctggaatctg

SEQ ID NO: 19187 - DNA, 70 bp, Homo sapiens
ctgtgccttggtggtataaatttgatttcccagagctaaatcaacctggtgcaaacatcaccaaggtcag

SEQ ID NO: 19188 - DNA, 70 bp, Homo sapiens
ttgttgctagggtcagctcgagtcctctgcttaatagagctagtgcagtcagcaccaacatgtgatttcc

SEQ ID NO: 19189 - DNA, 73 bp, Homo sapiens
agccgtgttaatcatttttgattttgcctttatgagggtaaaatcatgacagattgacatggacaattctggg

SEQ ID NO: 19190 - DNA, 73 bp, Homo sapiens
atgaaacggtgcgcctccgcagactctgggctgcgatctgcggtaatccccggtccggacaagaagtgcaacg

SEQ ID NO: 19191 - DNA, 73 bp, Homo sapiens
tttcctcagcatcttatcgtttggtaatttgcatgttcagagcttgcaatggggagagaggagaagtgataat

SEQ ID NO: 19192 - DNA, 72 bp, Homo sapiens
cctatagcatgaatcccaaagatgatttctggtgacatgtcattctattgtgataattgtttcttagttgtg

SEQ ID NO: 19193 - DNA, 72 bp, Homo sapiens
ccttaagtcttttcacccataaagtaggggataatactaatacttgccttatagggttatattgagaattaa

SEQ ID NO: 19194 - DNA, 73 bp, Homo sapiens
gagagaaagaaagaagctacttggccagagctgctgtctgtggtcagatgagcaagttgttctttttctgtac

SEQ ID NO: 19195 - DNA, 70 bp, Homo sapiens
aaaaaaaaatctccccctgagaatctaacaagataaagtactctcagggggttagagtctcaatctgtat

SEQ ID NO: 19196 - DNA, 72 bp, Homo sapiens
caggtgtgacacacttagcttacactcacttggagtcttgctgaaatatcgcacatcatggatccactggaa

SEQ ID NO: 19197 - DNA, 73 bp, Homo sapiens
gtgggccagttttccttaaaagagtttgtcagtggagcatgctgacttagagatgtcaaactcctcagtgccc

SEQ ID NO: 19198 - DNA, 74 bp, Homo sapiens
taggcatagttgtattaagagaaaagttctagtgccttctgtactcccactgctgcacttgactagcctacaaa

SEQ ID NO: 19199 - DNA, 74 bp, Homo sapiens
tatgtagcagcactgctactaggagtgacagggtcactgccaatgactcgtgtttcgccctggcagcagcagcc

SEQ ID NO: 19200 - DNA, 73 bp, Homo sapiens
tgggcctacatcccttttcagtaatcacttatgaaatctatagtcacaagggctgaaaaggtatactaggact

SEQ ID NO: 19201 - DNA, 73 bp, Homo sapiens
gtggcgctccgtgaaattagacgttcagaagtccactgaacttctgattcgcaaacttcccttccagcgtctg

SEQ ID NO: 19202 - DNA, 72 bp, Homo sapiens
aggcagaaagatcgcttgagcccatgagttcaagaccagcctgggcatagcgagaccccgtctcttaaaaaa

SEQ ID NO: 19203 - DNA, 73 bp, Homo sapiens
ctttgcaacgtatttgtgttgatttttaacagccgagaattaacaacacacttacgtttgaaatgcttgtgag

SEQ ID NO: 19204 - DNA, 72 bp, Homo sapiens
tgcttagcagtgccacgtgaccgtttttcattagcaagaatttagtcacatggctatacctaatagctgaga

SEQ ID NO: 19205 - DNA, 70 bp, Homo sapiens
gattgaagtagattaggagtatagtagcagtgagaccaataaagaggcagtactgcaactgtgaccaatt

SEQ ID NO: 19206 - DNA, 71 bp, Homo sapiens
aactgggttttttttctgcctgtctgtgtaactatatatgtgttgtgtatgatatctgcaaaaaagagctc

SEQ ID NO: 19207 - DNA, 74 bp, Homo sapiens
aaaggaaatctggttgctctgtagatatcatactgtagactgtagaggagaaaagacagagaaagagcggggtt

SEQ ID NO: 19208 - DNA, 73 bp, Homo sapiens
cttaggctattatcagactagttggtcatatataacatatgtataacaaattggctgaaatatgtatgtgtgt

SEQ ID NO: 19209 - DNA, 73 bp, Homo sapiens
taatacatgatgggagacaatattttggaataacctgttatgaggtatattcaatacccatgaagtagtatag

SEQ ID NO: 19210 - DNA, 72 bp, Homo sapiens
gaggtcatcctaagcccagtgatactgtgactcttgcagatgcatggagaaaccaccttgatggtcttgtgg

SEQ ID NO: 19211 - DNA, 73 bp, Homo sapiens
catgtaactgtactgaatactgtaggtaactgtttgttatatagtggtgagtatttttgtatataaacatgtc

SEQ ID NO: 19212 - DNA, 72 bp, Homo sapiens
ggtgacagagcgagactccgtctcaaagctcttgtgaaaagttttcagtaacgggtagttgttcaaactgat

SEQ ID NO: 19213 - DNA, 72 bp, Homo sapiens
ggctatccactggctcagggtaggcacagaaatgctgtccaagagtcaagtcctggaattgaacactctaac

SEQ ID NO: 19214 - DNA, 71 bp, Homo sapiens
ttgggccaaaagctacttttaaaagatttaatattgaaatcatatcaagtgtcttttctggtcacagtggt

SEQ ID NO: 19215 - DNA, 74 bp, Homo sapiens
tgagatcatccctcattaattttgcagaaataaattactggtttgtcaaagcaaaattatctttttcctgtctc

SEQ ID NO: 19216 - DNA, 71 bp, Homo sapiens
ccatggttgaaacttctgatctgtagagagtatttacctctcttcctctcacttttctttccctcctatgg

SEQ ID NO: 19217 - DNA, 71 bp, Homo sapiens
tatactggcatgagattcagagttatttcctgaacctgcaataagtgatgttgctcaggcgattgttccca

SEQ ID NO: 19218 - DNA, 70 bp, Homo sapiens
gtcaacatttttctggttctgccttcggagggcagtgtggcagggggaaagtggtggtgggagatgtggg

SEQ ID NO: 19219 - DNA, 71 bp, Homo sapiens
caaggtgtttggtgagggaacagtttttcactacaacgttgagaagggtgcccttagatctacagccttcc

SEQ ID NO: 19220 - DNA, 72 bp, Homo sapiens
tcccggagactcctttggcccagagttgacataagtgtcaacccactgggcttcctggaggtatccagtctg

SEQ ID NO: 19221 - DNA, 72 bp, Homo sapiens
aggaagagtttggattagcttatgtctgaggtcccacctagctttaacattctgagtccatgtttagattag

SEQ ID NO: 19222 - DNA, 73 bp, Homo sapiens
tatgaggcgtatttattgcttgctgagtcagcagggctgaggcacgtgctggtcagctgcccttgggatttgg

SEQ ID NO: 19223 - DNA, 72 bp, Homo sapiens
aaaagcagtgcaaatggaaggagatggtgacaaaatatattgaccccaccctcaccccattatgcttctaga

SEQ ID NO: 19224 - DNA, 73 bp, Homo sapiens
tagttaggaaaaattattcaagaagacctctagtggaggagggctggagaaattttcatataactattttcaa

SEQ ID NO: 19225 - DNA, 70 bp, Homo sapiens
tcaaaaatcaactgggtatatacatgtggttctatttctggattgcctgttctattttgttgatctctgt

SEQ ID NO: 19226 - DNA, 72 bp, Homo sapiens
gccaaggcttggggcttgcaccatctgaagccagggcctgaggtctacattggcccctttcagccatggctg

SEQ ID NO: 19227 - DNA, 71 bp, Homo sapiens
tcctcaaggagctcacagtcagccagacagctaagcaggagttacactacactgtgacaaatgttgaggtg

SEQ ID NO: 19228 - DNA, 71 bp, Homo sapiens
cctttcagcagcaattcatgtgagtttccagatcattacctacttgatgaggggctaggggcagagtagct

SEQ ID NO: 19229 - DNA, 70 bp, Homo sapiens
ccacattagggaggtatcagaggctattgtggctgcaagccaagactctgaatcctgcttccagtgctac

SEQ ID NO: 19230 - DNA, 74 bp, Homo sapiens
cgaggatgtgaatgccaaaggaccattgcaagccatcatagaggctgctgaccacagtgtatgtgtgcattttt

SEQ ID NO: 19231 - DNA, 71 bp, Homo sapiens
tggcctcttaagattccttccagccgtgtgattccatgatttgtggctcaaggtcaggctttaacccagca

SEQ ID NO: 19232 - DNA, 71 bp, Homo sapiens
gtctttctcctccctggctgtctgaggatagacagccatcatgaacgacacggtaactatccaaactacaa

SEQ ID NO: 19233 - DNA, 74 bp, Homo sapiens
gatcagcgaaagaaacactggacttggagtcagaaaatccaagttcaaattctagatctgcatttatgagcttt

SEQ ID NO: 19234 - DNA, 72 bp, Homo sapiens
ttctttctcccttggaggtatgactgtggtgtatattgtgtatgatctattgccttcttttctgggtgcttt

SEQ ID NO: 19235 - DNA, 71 bp, Homo sapiens
agaatgagtaggtcatctctggagcctgtcactttttgtgttttggtgctaatacaattgatcgatactgc

SEQ ID NO: 19236 - DNA, 70 bp, Homo sapiens
tgttggtgtaatatattctatgggtttggacaaatgtttaatgacatgcacccaccagtatagcatcaca

SEQ ID NO: 19237 - DNA, 72 bp, Homo sapiens
ccaagtgagatgaagccagtgctttgagctgggctttgagcacaagtgagcaaacaccaacattctcacact

SEQ ID NO: 19238 - DNA, 71 bp, Homo sapiens
agcaataagaatagtctgactcacagggacatatggcattgattagttggtcatggtgtcccttgaagaga

SEQ ID NO: 19239 - DNA, 74 bp, Homo sapiens
ggaatcaccacgcctggtccctggcttagattttgaatctattatatagtagactgggtttccagtttgataaa

SEQ ID NO: 19240 - DNA, 73 bp, Homo sapiens
aggctgccatgccagacacaacctgatgattctcaaaagagcttttgctttaaagtaggtcttctctgatggt

SEQ ID NO: 19241 - DNA, 72 bp, Homo sapiens
gtagagagcaccagagtcagctaaggggagagctgcgcttcctggttctcccgctggcgccagcggtcctgc

SEQ ID NO: 19242 - DNA, 73 bp, Homo sapiens
aaagggctcttatcagtgtgatgttgatgcccatgcagagcataggaattagcagtctgactgaatatgcgcc

SEQ ID NO: 19243 - DNA, 83 bp, Homo sapiens
agaaataaggcttctgtctactactggagacactggtagtataaaacccagagtctccagtaatggacgggagccttatttct

SEQ ID NO: 19244 - DNA, 70 bp, Homo sapiens
agcaatcctcctgcctcagcctccccaagtgctgggattacaggcataagccattgcgtccagtcctttg

SEQ ID NO: 19245 - DNA, 74 bp, Homo sapiens
gggtatgtctcaggggctttcaatctcggagtctcccacttcgcggatctttcccgccctctcagtatctcctc

SEQ ID NO: 19246 - DNA, 70 bp, Homo sapiens
actttgaattctcttgagaattgagtagatgggccaagaagatgcatctatacatgtggcttaagggaga

SEQ ID NO: 19247 - DNA, 74 bp, Homo sapiens
tagaggcagaatggagctgtttgtgacaataaagataggaatacagacacaggttagagctaatttctctctct

SEQ ID NO: 19248 - DNA, 71 bp, Homo sapiens
tggaactatttgagtggttcaggttgggggccacagccaataaggattggctctattattctggtaggctc

SEQ ID NO: 19249 - DNA, 70 bp, Homo sapiens
aattacctttcccagtgatcttacatttaagctgaggccaccagacaagattggtggaacagatcattac

SEQ ID NO: 19250 - DNA, 72 bp, Homo sapiens
tgtgtgtgtgtgctcactaagatctttatagatggggaggagtaaaacaataactatgggcgcacccaggat

SEQ ID NO: 19251 - DNA, 74 bp, Homo sapiens
ttgcttatttttctctactgtatacttgaggaaatggaaacttcctcagcagtcttctcctgggcactctgagc

SEQ ID NO: 19252 - DNA, 73 bp, Homo sapiens
ggtaacacagaatagtaatcattttaaagggtgactgtagaattatttgttattttgtttgagttatctgaaa

SEQ ID NO: 19253 - DNA, 73 bp, Homo sapiens
tttgtcctatgctgagtaaagaccccactgatgtgtagcagtggtgctttatgttttgccagtcagaggcttt

SEQ ID NO: 19254 - DNA, 72 bp, Homo sapiens
ttcaaattctgccattgaaagccagtgtggtatctggataatggacatgttattttgagaaaaaacattgct

SEQ ID NO: 19255 - DNA, 74 bp, Homo sapiens
ctgcctcctgagactgcaaggttattaacttgcatcaggaaggtggtagagaactgaataaagaaatatccatc

SEQ ID NO: 19256 - DNA, 73 bp, Homo sapiens
gtctccacatctgtcagctgtttcatttcctgtctttgtcatagtagtgtcgtggagaacaaatgggctcatg

SEQ ID NO: 19257 - DNA, 72 bp, Homo sapiens
aattgcaacagctactagatagcacagtttatggggcatctcggccccaagtcttttgtcttataaggtctt

SEQ ID NO: 19258 - DNA, 72 bp, Homo sapiens
ggctcaacccctcaaaccagggagtattttgccttgcttgtcctgggaggttgacctgtttccccccttttc

SEQ ID NO: 19259 - DNA, 74 bp, Homo sapiens
acatagtgtgtcaacagtttttgaacaggataatgatcattatcatagtgatgttcgtaatcagttgttcattg

SEQ ID NO: 19260 - DNA, 70 bp, Homo sapiens
ggccacactatggaacccatcgttcaggtgaagaaaatgaagctgagagaagttaagtgattggcccaag

SEQ ID NO: 19261 - DNA, 73 bp, Homo sapiens
gcatcagtaaaatggagatgataatagtacaaaacttatttggagctgttgtgagaattgaatgaactaatgt

SEQ ID NO: 19262 - DNA, 73 bp, Homo sapiens
cctggaatcagcctatgtgtgtcattgtcaggtaccccagccctgtcttctacatacccaggcatgtctccag

SEQ ID NO: 19263 - DNA, 72 bp, Homo sapiens
atttgtgtgatgttagagaagtgatatcaaaggatccatgtcatcgcatggcactcattcgcacatcctgaa

SEQ ID NO: 19264 - DNA, 70 bp, Homo sapiens
tgttacaccccaatatttaattttgttcccccaaaaggatgggaggaataatgtgcagtataatgaggat

SEQ ID NO: 19265 - DNA, 73 bp, Homo sapiens
gttaaggacatgcccatgacagtcacagaaggtcctgatgatgtatattcaaggtggtcaggctacagcttgg

SEQ ID NO: 19266 - DNA, 72 bp, Homo sapiens
ccagagaaagttataggacagtgttggtacggaagactgtgcttatggcgctaaggcaggggtcggcaaaca

SEQ ID NO: 19267 - DNA, 74 bp, Homo sapiens
atgtttctgctattgtgaatagtgttgtaatattcacaatattacaacattattacaatgtcataatattcact

SEQ ID NO: 19268 - DNA, 73 bp, Homo sapiens
ccatttggatgctgtttgcaatgcactgtaggaactggacaccaaaggtgcaactgtcacagtagctgggtgc

SEQ ID NO: 19269 - DNA, 74 bp, Homo sapiens
gggtacacatgagatgatacatatattaaattacttaactatagtgaccattttactatttatatgtatctcat

SEQ ID NO: 19270 - DNA, 70 bp, Homo sapiens
agtccttagaggaaagcattctcacaggctctttttgcaaggttggcgggtcggggggcgggttctttta

SEQ ID NO: 19271 - DNA, 72 bp, Homo sapiens
gagactggcaccatctctttagccttactcagctaaagggaactgatttaccagtgccaaatgcattaattt

SEQ ID NO: 19272 - DNA, 74 bp, Homo sapiens
atagctggagagatctgtagagatcacctagcctaaaccccttcgtccctaggagtagctgatgtccagacaga

SEQ ID NO: 19273 - DNA, 71 bp, Homo sapiens
atacgaaaatgctgcctaagatgatgcttagaaatatggaaaaaaacagtagtctgcaccaattaaggtag

SEQ ID NO: 19274 - DNA, 72 bp, Homo sapiens
gcctggtgggaggtgattggatcatgggggtagtttgtaatgggttagcaccatcctcctagcactgtttgt

SEQ ID NO: 19275 - DNA, 72 bp, Homo sapiens
tggcaggaatgcaaaatggtgcagccattgtaggaaaaccgtttggtgattcctcaataagtttaacagaat

SEQ ID NO: 19276 - DNA, 72 bp, Homo sapiens
ataatttcatcatttccagagggaacaggtctctcccctgtcagtcaactttggagctaatgagcaatgagt

SEQ ID NO: 19277 - DNA, 74 bp, Homo sapiens
gaagatggttgtacaggggctgtgtgggccttcatgtcttcattcggtcagcgagcctgtgttctgcctccctc

SEQ ID NO: 19278 - DNA, 73 bp, Homo sapiens
gaccacaggggtggcgagcttatcagcatcatgtactgtgccctgaggatgcactcaccactgtgctaagtca

SEQ ID NO: 19279 - DNA, 72 bp, Homo sapiens
tttaagaaaatatcaaagctgaacactttgatagttggaggttcatagaaggtcagctttgatagtagaaga

SEQ ID NO: 19280 - DNA, 74 bp, Homo sapiens
gaatgtaatctatcctgatgaatgtgagcttcagaacaatctatattctgcatttattggatgaagtattacat

SEQ ID NO: 19281 - DNA, 70 bp, Homo sapiens
agtgatcttctaatatgccaggaagcacgctaagtgctgaggagccagcaaacaaagcagacaaggtctc

SEQ ID NO: 19282 - DNA, 73 bp, Homo sapiens
agggaagcagggagatggagcaggggcagcacgtgcagcttcttgccatcagcccagtgctccaactgccatg

SEQ ID NO: 19283 - DNA, 73 bp, Homo sapiens
gcagaggactgagcagggccggttgaggcagttaggtggctgccccccggggccttgcagagctattggacaa

SEQ ID NO: 19284 - DNA, 73 bp, Homo sapiens
agtgcctggtacccactcaatatttgttgaatgaaagctctttaatattcctatcctgggtgcctgtgatcaa

SEQ ID NO: 19285 - DNA, 72 bp, Homo sapiens
ccatggctcattgagtggctggtaaacttgctggacatccattctctggaactggtcagaaactgccttcta

SEQ ID NO: 19286 - DNA, 72 bp, Homo sapiens
gtcacatcacattgccaggtcacgatttatttccccctaggccagctgcagtagcctcagtgatgcgtgggc

SEQ ID NO: 19287 - DNA, 71 bp, Homo sapiens
aaggttagtacaggtatcagaggctattgttgtcaggttatttcaggtagcatgctgaccggggactagct

SEQ ID NO: 19288 - DNA, 71 bp, Homo sapiens
tactccacacttaagaaatgggaatttatattcccttccttataattcttctacaaggggtaattgtctct

SEQ ID NO: 19289 - DNA, 74 bp, Homo sapiens
aaagtcttgaatatcgtacagtactgtgataattcccacagttgaacacctttttagcactgagtttgagggct

SEQ ID NO: 19290 - DNA, 70 bp, Homo sapiens
gggcccaaggcacatgctgtgagcttcctgtgagcccaggctctgctcactgctgtcccgcgtcatgagc

SEQ ID NO: 19291 - DNA, 71 bp, Homo sapiens
gaaggggggttccgagcatgtgcaggagggggtgggggtgccctgcgacctgtgcccagcccagagctcct

SEQ ID NO: 19292 - DNA, 74 bp, Homo sapiens
tggccccagaggggcaggaggggctggcaaggcccgttccagactttgctaaccctgccttcccacaggggctt

SEQ ID NO: 19293 - DNA, 74 bp, Homo sapiens
agagctcttagggtagctactgtgcttgtccttagggaattttagttccatgtggcaagccaaaggattcagag

SEQ ID NO: 19294 - DNA, 70 bp, Homo sapiens
gaatgtgttcccgctgtgctgtgtggctgttttgcagttactgtagacactgtagtctgggctctcatta

SEQ ID NO: 19295 - DNA, 73 bp, Homo sapiens
ctgtgggaggcaagggaggggtcgcccagccgagctgctggtgctcagctggcccctctgcctgcagcctgta

SEQ ID NO: 19296 - DNA, 72 bp, Homo sapiens
gtggcccttgagggggttctgcggcccccagactcacagcctcccttgcgccacaggcctgtgtcctgactg

SEQ ID NO: 19297 - DNA, 73 bp, Homo sapiens
gcatttaaagggctcgctctctccgcagcgcaacctctgctccctgcctcgcctcccgcgcgcctaggtgcct

SEQ ID NO: 19298 - DNA, 73 bp, Homo sapiens
agagcttcagcagcttgcccaaaaccatgcagcaagtgaaaggcagagcttgctgctgcagcaaagactggta

SEQ ID NO: 19299 - DNA, 73 bp, Homo sapiens
cccaacttggccagatagcttatacctatgtcagaagttggaggaggagattgacagctgaggtgtctccaag

SEQ ID NO: 19300 - DNA, 71 bp, Homo sapiens
gttcattgagctttattcacagtggctaagctatggaatccatccaagtgttcactgatggataaatggat

SEQ ID NO: 19301 - DNA, 73 bp, Homo sapiens
acggctatccaatacctccatactgtgcctgtcacatataggcacaatggtcaacagttgcagctgagtgttg

SEQ ID NO: 19302 - DNA, 72 bp, Homo sapiens
cccaccccagcctcccaaagtgcttacattgcagtgtaaaccactgcacctggcctatttctttgaacagaa

SEQ ID NO: 19303 - DNA, 72 bp, Homo sapiens
acaatatgcagtaacttcctttcttggaagattccaggacaaagaggacagtaatgacatctaggttttgca

SEQ ID NO: 19304 - DNA, 71 bp, Homo sapiens
cggttgctatgtggacacctggtgttcaccaatctgtgtggtgggggcccgttaacaggataacctctcat

SEQ ID NO: 19305 - DNA, 73 bp, Homo sapiens
accctgttctcgtgttccagtgggagtactccaatgtgcaagaaacatttgggtgcaaattggggttatccaa

SEQ ID NO: 19306 - DNA, 70 bp, Homo sapiens
aaagaatcatgcaatggattcccataagggtcatcctccatgaactgggaaattttattgtggaaggcat

SEQ ID NO: 19307 - DNA, 71 bp, Homo sapiens
caatacatcgcactcctatttggatcggggtttgaaagctctcaaatctggtgtttgccaggatggccaca

SEQ ID NO: 19308 - DNA, 72 bp, Homo sapiens
tgagttgttgaaagggtctttgagtgatgtaatcatacctgagaccctagaggtgagtgtcaaaatatcatg

SEQ ID NO: 19309 - DNA, 72 bp, Homo sapiens
taagcatatagttctgagctgatcgacagactcatcaccctttaccacctgttgatttacagtacccaatgc

SEQ ID NO: 19310 - DNA, 72 bp, Homo sapiens
gaagtgtcgatgatcaatgtgtcctgcaattcacattaattctcacagctagctgcattcttcatcaacgca

SEQ ID NO: 19311 - DNA, 71 bp, Homo sapiens
gacttaaatgtcccagtctgacccctttgaagagagcagtggttctcccagcatgcagctggagatctgag

SEQ ID NO: 19312 - DNA, 74 bp, Homo sapiens
caagtatttgatagtaggagtctaacacgtggcccagatagccaccaccaggatggaagagttcatgcttctca

SEQ ID NO: 19313 - DNA, 70 bp, Homo sapiens
tcttggaatttgtacccctccatgatggcctttttgttttgagtttgtcaataacccaagtgccaacatg

SEQ ID NO: 19314 - DNA, 72 bp, Homo sapiens
ataactatttatatttttgtgattggctgatttcacttagcacaatgtctcaaagagtttatccctgttata

SEQ ID NO: 19315 - DNA, 74 bp, Homo sapiens
ttagcaattttagagtgtacaattcagtggcatttagtatattctcaatgttgtgcagccaccaccactctcta

SEQ ID NO: 19316 - DNA, 71 bp, Homo sapiens
tttttcccatatgtgcttacggtttaaaagacaaggaaaaaagcatgcattatatagggaaaagtgcaagg

SEQ ID NO: 19317 - DNA, 73 bp, Homo sapiens
aagttgatatctcattgtggctttaatttgcatgttggcattttgaacatgtttgttggcacgttgagcatca

SEQ ID NO: 19318 - DNA, 74 bp, Homo sapiens
ctttctgtcagtttttcaaatgttttccctcttcctgcctccctggtctcaggttggcgatgcatgtgctggtg

SEQ ID NO: 19319 - DNA, 70 bp, Homo sapiens
ggtggaggaggcctgatgggacagcacctcagaacttcctggggagtctggccttgactctagagtaatg

SEQ ID NO: 19320 - DNA, 71 bp, Homo sapiens
ttggaccccaatatcttctggcttgtagtgtttctgctgagaggtccactgtgagtctgatggactcccct

SEQ ID NO: 19321 - DNA, 74 bp, Homo sapiens
aggataagtggtaccaggatcatgaattttttttccaggctcttagggatatagttctgagctgatcaacagcc

SEQ ID NO: 19322 - DNA, 71 bp, Homo sapiens
ggggaggactatagttctgagctgagaactttaaaaatgtttctccagtgataagcatttatattctcctt

SEQ ID NO: 19323 - DNA, 71 bp, Homo sapiens
atgactttgcacaagtctgacaaacacttttgggcctcaggaacagcaccttaagtcagagtgcctgcttt

SEQ ID NO: 19324 - DNA, 72 bp, Homo sapiens
cagtatacaagttgagatagggatcagtcaagggaacctctagaaggaccccttgagcagcgtaggtttgag

SEQ ID NO: 19325 - DNA, 71 bp, Homo sapiens
ccttggtcatggttctgaataagaaaatccttgacggtcttgaacaggaattagtcctctcatcgaccaag

SEQ ID NO: 19326 - DNA, 70 bp, Homo sapiens
agtggacaaatcgtgagaggctttttcccatttatatcattggtggcagttcgccttacagtgtcctggc

SEQ ID NO: 19327 - DNA, 74 bp, Homo sapiens
attatctcagacaatgagagactgttttgtcttggtacattagtgagactacaacatactttgatgcatggtct

SEQ ID NO: 19328 - DNA, 73 bp, Homo sapiens
ggtttttataagcagccaggtcaattcttgaaggctttgctgtttaggaaatttttccctcagatactctaaa

SEQ ID NO: 19329 - DNA, 74 bp, Homo sapiens
acgtgggtggggccaaataagggaataaaagctggccacctgagctagcagtggcaacccggggggttcctccc

SEQ ID NO: 19330 - DNA, 72 bp, Homo sapiens
tgtggatagggtgcaccctgctgctggtgaaggatacagtagctcaagttatggggcatctacagcaagtgg

SEQ ID NO: 19331 - DNA, 70 bp, Homo sapiens
tccagaggttgaaaaactgcctctggcagaggctggctaggtgctcaccagagctgttttctcctcctgg

SEQ ID NO: 19332 - DNA, 73 bp, Homo sapiens
cattccggtgggaccggcccgctccgctgtgctgcgaacctggcacaccgtgatgaatagatactctgaagcc

SEQ ID NO: 19333 - DNA, 71 bp, Homo sapiens
acgcaaacgcacaccaggctggctgaggggctcaagggagtagctgagaaacgggcgggtccctcccgagc

SEQ ID NO: 19334 - DNA, 71 bp, Homo sapiens
cctcagtgggagctgagacggtggggtgggtcctccttgggcgaggcccctgtccaggtcagatggctgtc

SEQ ID NO: 19335 - DNA, 72 bp, Homo sapiens
ggcctcgccgcgcgccgggaccgggggcctcccggggttgcccacgacccacccggcccggctgctgaaccc

SEQ ID NO: 19336 - DNA, 71 bp, Homo sapiens
ttttttggttggtttgtgtttgtagcattccttttccatagaaaacagccaggattatattcctaaaaaaa

SEQ ID NO: 19337 - DNA, 71 bp, Homo sapiens
cacaagaacgagaactttgatccttatataataggcctcagcaaccttgggatgttatactgggaactaat

SEQ ID NO: 19338 - DNA, 71 bp, Homo sapiens
gctatccaatatggtagccactcaccacttgtgactattagcatttgcaatgtggctagtccaaattgaca

SEQ ID NO: 19339 - DNA, 72 bp, Homo sapiens
cccatggaggagtctgcttaatcattatctgtgaccccatagatgtgaggttgtaggttgtttggtttgttt

SEQ ID NO: 19340 - DNA, 73 bp, Homo sapiens
ccctacggccgtcggcggcccggcggcccgagatgttatctgggaagaaggcggcagccgcggcggcggcggc

SEQ ID NO: 19341 - DNA, 71 bp, Homo sapiens
ctccccgtctcgaggcccagcccgtgtctcagcctcccgaggctcagcacggtctccctccatcttagtca

SEQ ID NO: 19342 - DNA, 72 bp, Homo sapiens
ctactctgcctgaagatgaggaggatgaagacatttatgactggttcattcccggctttcggcaccaaaaaa

SEQ ID NO: 19343 - DNA, 70 bp, Homo sapiens
tacctgcgggcgcggccgccgggcgccgctcccggccctcgagggcggcccgggcggcgagggctccggg

SEQ ID NO: 19344 - DNA, 74 bp, Homo sapiens
ggccgggcgtgatgcgccgcgggacccctgtcctggccactggccgccgccgccgccgccgctgagaccccgag

SEQ ID NO: 19345 - DNA, 71 bp, Homo sapiens
agatgcatctcagtatgcccggcacctccaccacacaagggctgtgctggttgctgtgggaatgctgcagg

SEQ ID NO: 19346 - DNA, 70 bp, Homo sapiens
tccccaccctgtgcctcagcccggaggagcccccatcagcaggcagggggtgggcatattctttggtcag

SEQ ID NO: 19347 - DNA, 70 bp, Homo sapiens
ggttccgggaggaggggggctgggtgcacctccccaccctgtgcctcagcccggaagagcccccatcagc

SEQ ID NO: 19348 - DNA, 70 bp, Homo sapiens
ccacatgtttccttgagcctggatcagcccagaatatcccactcctgacaccagttgtttaggaaaaacc

SEQ ID NO: 19349 - DNA, 73 bp, Homo sapiens
gccctcagctgcttgggaggatgggccaagcccaagagggagtccccaggccagaaagcaacagcagagtgaa

SEQ ID NO: 19350 - DNA, 74 bp, Homo sapiens
tatgcctaggtgtagcatttggggctttgtgtgtgtgtgtgtgcgcgcgcgcgtgtgtgtgtatgagggcgaga

SEQ ID NO: 19351 - DNA, 71 bp, Homo sapiens
agtcagcagagggcagaggatgaagggacttcttaatcatgtgaagggacttgtactttatcctcaaggca

SEQ ID NO: 19352 - DNA, 71 bp, Homo sapiens
cagagttagacggatggtgtaggtcgaggtttgtgtaaggccttggaggccattataaggcttttggattt

SEQ ID NO: 19353 - DNA, 72 bp, Homo sapiens
tccctgggcgcgccccggcccgccgcggggctccggggcaaaccctggcctggcggggctccggggcaaacc

SEQ ID NO: 19354 - DNA, 74 bp, Homo sapiens
gtcccagttagtaggtgcagaaatgaggctcagagaggttgcataacccgcccaagctaaggggtctggcaaac

SEQ ID NO: 19355 - DNA, 73 bp, Homo sapiens
gtgctagggtcagcctggggtttgtgttccagctcgaatactctgtagctgagcaacattagtcacattgcac

SEQ ID NO: 19356 - DNA, 73 bp, Homo sapiens
aactgcaagggatctgagattctaccctagttgcaaactaactagttagcctgccatagtttcatagatgctg

SEQ ID NO: 19357 - DNA, 73 bp, Homo sapiens
ctgcttactttttgtttgaatatatttggggtatattctcaaaaatatgttgataatggagtacagaaattct

SEQ ID NO: 19358 - DNA, 70 bp, Homo sapiens
acaaataataccatctggctttgaattgtttacaatctggccagtgggtgcagagcagatatttaatgtt

SEQ ID NO: 19359 - DNA, 74 bp, Homo sapiens
gtccttctttttctctacggtcctaaatattgctttggtatctcttaattactctaggggatcatggaggagga

SEQ ID NO: 19360 - DNA, 73 bp, Homo sapiens
tttgcagatgagctttctccatgccatggggaacatgaatcctagcaactatgatctctcatctcatcctaac

SEQ ID NO: 19361 - DNA, 72 bp, Homo sapiens
ggcgtggaattagacagacctaggtttaagtcctggtgccaggatttataagctggtgacttggggttgctt

SEQ ID NO: 19362 - DNA, 71 bp, Homo sapiens
gctcggcggcccgcctcggggccccgcccactttggccagggtcggagccgcccggagcgggagccggagc

SEQ ID NO: 19363 - DNA, 74 bp, Homo sapiens
gtggccgctagcagctattgttccttagatctctgagcaacatagatgatttaaaggaaatgaagctagatcac

SEQ ID NO: 19364 - DNA, 74 bp, Homo sapiens
ttatcagtgcttgagagctgtgatgcccacctgtttacctgagacatttcaagttactgatcattggaatttaa

SEQ ID NO: 19365 - DNA, 74 bp, Homo sapiens
tgtaagcctgggcttcctaggggcatggtggtcagaattctaacatggtagctggcttctaccagggaatgctc

SEQ ID NO: 19366 - DNA, 74 bp, Homo sapiens
tcatttccaggcaatccacgggcagtaggtaagcacagcttctactcaaattaatgaaaatggtgatgagcaac

SEQ ID NO: 19367 - DNA, 72 bp, Homo sapiens
tggtccaggagccggctcgacgtgtctgagggaggccccggagggggcggggaggtggcccacagaacgcgg

SEQ ID NO: 19368 - DNA, 72 bp, Homo sapiens
aggtctctgctcctggcgaatgcagggcacagcatcatctccgcgtgaaacctgcccagcctctctgggaga

SEQ ID NO: 19369 - DNA, 73 bp, Homo sapiens
aggtgaggcctccccgcccgtgagctccgttctctaaggggaactctcggatcggccccgccgcgaccgccac

SEQ ID NO: 19370 - DNA, 74 bp, Homo sapiens
ccctggaggcgtgggttcgaatcccactcctgacaatatgtgttttccgtccttacttttcctcctgatttgaa

SEQ ID NO: 19371 - DNA, 70 bp, Homo sapiens
gatgggagaaagttcaaaggaactgcagacaggagagtgcagtctgcatctcatcttaggttttcccaga

SEQ ID NO: 19372 - DNA, 73 bp, Homo sapiens
attccacttcacaaatagcctataatttattttttactattgatgaatgtctgggtatttccaatttggagcc

SEQ ID NO: 19373 - DNA, 71 bp, Homo sapiens
gagcagctgggactataagcgtgcgccaccatgccaggctcgtttttgtatttttagtacagatggggttt

SEQ ID NO: 19374 - DNA, 74 bp, Homo sapiens
aggattttctcttcaatatggagccctgtcctggaaggaaactctggtggatcaggtttgagagctcctagaga

SEQ ID NO: 19375 - DNA, 70 bp, Homo sapiens
aactctttaggatttataagagccaaatctgcttaaaattagaattaagcctcatggcctaaagattcac

SEQ ID NO: 19376 - DNA, 70 bp, Homo sapiens
tgtaaaggtgacctggctctcgtggtctgaggtctggcccatgtactctgccagagtctcgtcttctgca

SEQ ID NO: 19377 - DNA, 74 bp, Homo sapiens
tcattttactgtgatgaacttctgagggtaaatgctcaaacatttgagtattctgtgcaaaagaagagtattgt

SEQ ID NO: 19378 - DNA, 70 bp, Homo sapiens
acccgcctcaacctcccaaagtgctgggattacaggcatgagccaccgcacccggccaggacacggtact

SEQ ID NO: 19379 - DNA, 73 bp, Homo sapiens
caatgaaagtatgtagctttatttccttggcagtgagacacattttaaataaactatatgcaagtcactgtaa

SEQ ID NO: 19380 - DNA, 70 bp, Homo sapiens
atccccaccactgggctctccaggcaggaattggatatgcttggactcacagcaatctagagcccagtgc

SEQ ID NO: 19381 - DNA, 73 bp, Homo sapiens
atcgtactgaatgtattccagaaaaacaaggaggagggactcctccgtaacttattctatgaagccagcatca

SEQ ID NO: 19382 - DNA, 72 bp, Homo sapiens
tgaaaccacagctcctctgttaatcggggaaaaccaaactcctctagagggcactgtagcactcaccgaatt

SEQ ID NO: 19383 - DNA, 74 bp, Homo sapiens
agacctcatgaagaggaagaaaaatgagaggtgggtggattcagacccttgtaaagacttcctgtcaatagtcc

SEQ ID NO: 19384 - DNA, 73 bp, Homo sapiens
cggcgctctcaccgccgcggcccgggttcgattcccggtcaggaaagtaagccgttttaaaaactgttgccgc

SEQ ID NO: 19385 - DNA, 73 bp, Homo sapiens
tgcaccaggtctccatccactggggggagttcacctgactcccgaagttcatcgtacaagacagatctgcaga

SEQ ID NO: 19386 - DNA, 73 bp, Homo sapiens
cacctggtgatggacattggggctgtttccagcttttggctatgatgaatcaagttgctgccagtctgcatgt

SEQ ID NO: 19387 - DNA, 71 bp, Homo sapiens
tgtctagtggcaagctgctggccactgaatgcagcactatcctattctctcctggctggctcgccaacttt

SEQ ID NO: 19388 - DNA, 71 bp, Homo sapiens
catatataatattagttgtagaatatatttgacttcctaaatatatatataacttgtgatatatgtgactt

SEQ ID NO: 19389 - DNA, 71 bp, Homo sapiens
ctctctgaagggccctttcctatgaggtggcatggtggaaggagcactggactaggagtcagggggtctag

SEQ ID NO: 19390 - DNA, 72 bp, Homo sapiens
ttctattacaaagtcaaggtctagtgggatgaagacctgcattgccttcaggtctccatgcctcctggtcct

SEQ ID NO: 19391 - DNA, 74 bp, Homo sapiens
ctgggtgctgagacctgagctgggtggtctggcagcacagagttgcctactcactggatagcccacaggcaccc

SEQ ID NO: 19392 - DNA, 70 bp, Homo sapiens
agtcagggactgtcgggccgggccaggccaggccaggagtggtggcggcggcggcgcagggcggggcggt

SEQ ID NO: 19393 - DNA, 70 bp, Homo sapiens
cccgcgcccgccgcgcccgcctcgcccgccgcgcccgcggggcccggggagctgggctggctgtccatgg

SEQ ID NO: 19394 - DNA, 72 bp, Homo sapiens
cctagcagaccaaaggctctggaaatcaaactaacattagaaccagagtccataaggtaaggcgagatgcat

SEQ ID NO: 19395 - DNA, 72 bp, Homo sapiens
ggcatactttccttttcgaatcctgttcgtgacgccaaaaatgttctgtgcgggaaacgcatgaggggagaa

SEQ ID NO: 19396 - DNA, 74 bp, Homo sapiens
tattttcatgacagtggccagagagatgggagacaagtctcaaatctgtctctctcactgactaaaattgaggg

SEQ ID NO: 19397 - DNA, 71 bp, Homo sapiens
cacccccacacagcagagggattgttaacgtatggctcacctggagcatgttttcctccagccacaagcaa

SEQ ID NO: 19398 - DNA, 71 bp, Homo sapiens
agctagtggaggtgatcctatcttatatcagcatttattctgattcttcggtcaccccgaagtctctctca

SEQ ID NO: 19399 - DNA, 70 bp, Homo sapiens
ctcacggggaaggtctgcagcttcactcctgagccagcgagaccacgaaccgggcgggaacaccagaagg

SEQ ID NO: 19400 - DNA, 73 bp, Homo sapiens
cccgggttcctcccagggctatgcctgtctgagcgtcacttgccaatcaaaatcccccagggttgcctctggg

SEQ ID NO: 19401 - DNA, 70 bp, Homo sapiens
ttagcctggcctgtgcaattgtattgcacagaggaatacaatatggcaggaacagaccaatgtaacaggt

SEQ ID NO: 19402 - DNA, 73 bp, Homo sapiens
gtcctacatgatctgagttcagactggagtgatccaggtcggtttctatctactgaacatttctcctagtgcg

SEQ ID NO: 19403 - DNA, 70 bp, Homo sapiens
attaattatgtatttgttctgcacatgtgattaaagatcatggcagcttatacagcataattttagagat

SEQ ID NO: 19404 - DNA, 73 bp, Homo sapiens
tccagtggctcttagtaccttctggcataccaccatgtaaccctaaagtggaagccaagagaaggagtgaaga

SEQ ID NO: 19405 - DNA, 73 bp, Homo sapiens
ttaatgttttcatggatcaggcacagggtatcaccatattgtgccattccaggagggtattcctaacattctg

SEQ ID NO: 19406 - DNA, 71 bp, Homo sapiens
atttcgctacatctcttcagctaaccttggagacaataatagtatggtggatgtagagaaaattgataata

SEQ ID NO: 19407 - DNA, 73 bp, Homo sapiens
aaagagagttgttttgtaaatatagtgttgtaaataaattattctcaagatacactctctcgctgtagctttc

SEQ ID NO: 19408 - DNA, 73 bp, Homo sapiens
tccacagggaagttcactggagttggagtcagaagccatggcacttggcattgcaaacatcacctgggggagc

SEQ ID NO: 19409 - DNA, 71 bp, Homo sapiens
ggaagtgtaaacgtcctttcagatggttctctagagaaccatctctagagaaccatctgaaagactttgga

SEQ ID NO: 19410 - DNA, 90 bp, Homo sapiens
ctcacagctgccagtgtcatttttgtgatctgcagctagtattctcactccagttgcatagtcacaaaagtgatcattggcaggtgtggc

SEQ ID NO: 19411 - DNA, 74 bp, Homo sapiens
gcccgctcccattgtgcggcccggcggcggcggcggcggcggcggcggcggcggaggtgcggagcggagcgcga

SEQ ID NO: 19412 - DNA, 73 bp, Homo sapiens
atcaagagttaggtctccacgtgggttttccattattaggtacatcccaggaaatgttccttaaaacttgata

SEQ ID NO: 19413 - DNA, 70 bp, Homo sapiens
gaatgttttctttttctcattattcaaggtttcaaaaatgaagacaatgagactctggcatgggagggtg

SEQ ID NO: 19414 - DNA, 74 bp, Homo sapiens
ttctttatctggagtcaccccggatggtggcagtgacttcaaaaccagccagtccgaggtccacataagggact

SEQ ID NO: 19415 - DNA, 73 bp, Homo sapiens
agaggaaggcctcaccgccgataacgtagatctccccattgagggccgcgctggcgtggttggtgcggggctt

SEQ ID NO: 19416 - DNA, 73 bp, Homo sapiens
ttcactcaattaacccttataccagtgattctcgcagtgtggcccatggacgagcagcaggagcatcatctgg

SEQ ID NO: 19417 - DNA, 71 bp, Homo sapiens
ccgcgggggcccctgcgctggcggctgcgggctccccgctcaccgcctcgcaggagagactgccggaaaac

SEQ ID NO: 19418 - DNA, 84 bp, Homo sapiens
gtgtgtgtatatgtgtgttgcatgtgtgtatatgtgtgtatatatgtacacatacacatacacgcaacacacatatatacatgc

SEQ ID NO: 19419 - DNA, 74 bp, Homo sapiens
ctgacaattcagaaactatggatgagcaaaaggaatcttcctgttttgttcattttgagactacagaatggcat

SEQ ID NO: 19420 - DNA, 70 bp, Homo sapiens
ggccctgccttttaatactattatattgggtcttaggttctaatatatgaattgtgctggaggagggatg

SEQ ID NO: 19421 - DNA, 70 bp, Homo sapiens
tgtataaccaggtcccttcccgtggatataattcttcccaggcctgttgtgtgagttggtgatgccatca

SEQ ID NO: 19422 - DNA, 72 bp, Homo sapiens
ctggatgatgacaggagggaacgtgaactgggtttagcgtcttcgtattgcctaattttaaaacctttttgt

SEQ ID NO: 19423 - DNA, 70 bp, Homo sapiens
aacagactggtttgggaggggcccaatagctaaatttagctatttccctcatcccacattttgtatgtag

SEQ ID NO: 19424 - DNA, 74 bp, Homo sapiens
tccttttgtccagggaccgctctctcctgcgctcgggggagcgtgcgcgcctccggtcggtggacttggccctg

SEQ ID NO: 19425 - DNA, 70 bp, Homo sapiens
caatgatttcaccccataaacaccaattcttctatcttgttcaggaaatggtgattatggtgcaaaacaa

SEQ ID NO: 19426 - DNA, 73 bp, Homo sapiens
aagacaatcaacagtttttgattttagggatatttcctaaaaaccttaatattggaattatctgtgtgtgaca

SEQ ID NO: 19427 - DNA, 74 bp, Homo sapiens
ttatccagagaaatactggttgtgtgtcttactttgacactgttgttaactctcaatttgtgctttttagggta

SEQ ID NO: 19428 - DNA, 74 bp, Homo sapiens
gacccgctgccgcgctgtgacctttcaccccgcccctcgcgcgccggcgcgccgccgcctcacgcgcagccgca

SEQ ID NO: 19429 - DNA, 74 bp, Homo sapiens
taagtcaatgagatgatatatatataaagtctgtcacggcagaggtgagtatatttactcagtcatttaaaatt

SEQ ID NO: 19430 - DNA, 72 bp, Homo sapiens
tctagtctttgactaaagccaggtgtagaagagtagggagcctattctatctactctcatgtgaaagattct

SEQ ID NO: 19431 - DNA, 78 bp, Homo sapiens
ggaattttgttaaaatgcagaatccatttctgtagctctgagactagacctgaggttgtgcatttctaacaaagtgcc

SEQ ID NO: 19432 - DNA, 73 bp, Homo sapiens
ctgataaaaatttattgtggctgggtgaggtggcacatgcctgtaatcccaggatttataagagctgattcag

SEQ ID NO: 19433 - DNA, 71 bp, Homo sapiens
gggccgactctagtactcggcgcgcgcgccgccgcgtcgccgaccagcctgcggcccccgcatcaatcatt

SEQ ID NO: 19434 - DNA, 71 bp, Homo sapiens
ccccggccgcctgcgcacccggcagcaccatgacaggtaccgccgcgcagcccgccgccgccagccccggg

SEQ ID NO: 19435 - DNA, 70 bp, Homo sapiens
tcattctgcaaggagggcattgataatcttacataattcattgtgtgatttacaagctattttgagatat

SEQ ID NO: 19436 - DNA, 72 bp, Homo sapiens
tgcttggtggctcatggtatgcacacagtggcagctgaggttcattgttgttatcattctgcacttctgcaa

SEQ ID NO: 19437 - DNA, 71 bp, Homo sapiens
ggatttaaggcaagaaagtataggctaactctagtgttttatgcaaatgctatcaggactgccattatcta

SEQ ID NO: 19438 - DNA, 71 bp, Homo sapiens
gtaaacttaggtgagggctaaaagagatgcctcactgttgtgtagtggggattgatgaatacctgggaagt

SEQ ID NO: 19439 - DNA, 73 bp, Homo sapiens
gggcataaggcttaagatcatggttttgaaatcacacagatcaaaattgaactcctagctttcccacttagta

SEQ ID NO: 19440 - DNA, 72 bp, Homo sapiens
cactcaccggccccatcgcggatgtcccagtcgatcacagacgcggaccgcgcggaggccgcacacttgtgg

SEQ ID NO: 19441 - DNA, 73 bp, Homo sapiens
gggccggccgcggggtgcactcaccgcctcgcaggcgcacagcacgcagcgcatcaccccgaatggctcccct

SEQ ID NO: 19442 - DNA, 72 bp, Homo sapiens
gcattacttcacccccctcttaaaggtagagatggggtttatttaatgcaggtactgttacaatacaactga

SEQ ID NO: 19443 - DNA, 72 bp, Homo sapiens
agccctgtgactagctttgactaaaataaatgtggcacaaatgatgctgtgtgatttctgagactaggtcat

SEQ ID NO: 19444 - DNA, 74 bp, Homo sapiens
tttcttatctgtcagaacttatgatgagattctgaaggcactggcagaatttatcaaccttgacattattgata

SEQ ID NO: 19445 - DNA, 74 bp, Homo sapiens
actaaggcccgtgatgagttctctgagggcctcaggagggacatgcaggggacagtcacactggcggtgggagc

SEQ ID NO: 19446 - DNA, 73 bp, Homo sapiens
ttacttagcaccatgctcggcactgtgggagataccccttctccagtctgttgataatttggggaaaagaggc

SEQ ID NO: 19447 - DNA, 71 bp, Homo sapiens
atccccagatttcatatctataaattgaggataattacatttttcctaattttcagagttgggagaatcaa

SEQ ID NO: 19448 - DNA, 74 bp, Homo sapiens
gcatggtccatgtttgctggcttgccaccttctgacttcatgagagttcataccaagggacagttctcagggct

SEQ ID NO: 19449 - DNA, 74 bp, Homo sapiens
atatatatatatatatatatatatatatatatatatatatatatatatatataaactccctttatttttacaac

SEQ ID NO: 19450 - DNA, 72 bp, Homo sapiens
aggatgggccacatctgtagtatttaagggtttagaggaatacggagaatcacatagttccatctcatatta

SEQ ID NO: 19451 - DNA, 71 bp, Homo sapiens
ggagtgcagtggctattcataggcatgatcccactactgatcagcaccggagttttgacctgctctacttc

SEQ ID NO: 19452 - DNA, 73 bp, Homo sapiens
gccaccggagcggcccggcgacgcgctgacagcttcccctgcccttcccgtcggtcgggccgccagccgccgc

SEQ ID NO: 19453 - DNA, 72 bp, Homo sapiens
ctgggatcaacattcaggaagggacaagctattatctcagcactgctttccctgaaggatgaccataatgaa

SEQ ID NO: 19454 - DNA, 73 bp, Homo sapiens
tgctggccatatgaagacatgccttgcttcccctttgccttctgccatggttgtaagtttcctgaggcctcca

SEQ ID NO: 19455 - DNA, 73 bp, Homo sapiens
cggcgaacgctccgcgcggctcccgccgcccgccggggaatgcgcagggccgcggttccgcgcggcgccgacc

SEQ ID NO: 19456 - DNA, 71 bp, Homo sapiens
gatgcttgtgtctaacagctgtccggctcagtcagtgcacagtgctctgaatgtcttggcttttagttcaa

SEQ ID NO: 19457 - DNA, 73 bp, Homo sapiens
ggagcactggacttagagtcagaaggcatggccttttctcttttgtcaatcaatgtgacatttagattttcat

SEQ ID NO: 19458 - DNA, 72 bp, Homo sapiens
tgcaggtgtttagcagctgggtgcccaagtgtgcactgtttcagcttgactttttattatacaagtgcatgc

SEQ ID NO: 19459 - DNA, 71 bp, Homo sapiens
gaaggaaacaggtgagctcccaccgccacccatgggaaacccagcgcagcggcccccggcgcgccaccgtc

SEQ ID NO: 19460 - DNA, 71 bp, Homo sapiens
tttatcacaatcgagcttaggtctgaaacattgcagagacacaggcaatgtttgtaagacaaatgaggaag

SEQ ID NO: 19461 - DNA, 73 bp, Homo sapiens
ttaaggctgagacggcacttcctagagatcctattacatctgaactctgagattaggaccaggacagctgcag

SEQ ID NO: 19462 - DNA, 73 bp, Homo sapiens
cagggagggaggagggaggtgggtaggatgccaggaaccgcctgctccacagcctggggaaggagggaagagt

SEQ ID NO: 19463 - DNA, 72 bp, Homo sapiens
cttccttcttggggttacatgaaaatggatctctgtggtgcagctagggctccacccctacagaaaggaata

SEQ ID NO: 19464 - DNA, 73 bp, Homo sapiens
ccagtagagccagagcagcaatggcttggagacgtgctggtcatcctatagccagcaaatcaagttcctcact

SEQ ID NO: 19465 - DNA, 74 bp, Homo sapiens
agtttgatcctgtgggctgatgatgaaagatggtctgaactcacagcatcactaggtcacttacatgaaagttt

SEQ ID NO: 19466 - DNA, 72 bp, Homo sapiens
aggataggcaacgaaagtgcagagttgattcaacagagtctgcagtttaaaagcttctacgtttaccttagt

SEQ ID NO: 19467 - DNA, 72 bp, Homo sapiens
ccgtttatgtgtcccttgtgagatcagaaatgtttctccacttacaggtggataacctgcagtgggaatgaa

SEQ ID NO: 19468 - DNA, 74 bp, Homo sapiens
tgagcacatcagctcaaaaatgatgaaactgttctgaatgacagtcagttggagcttaaagccacacacatttg

SEQ ID NO: 19469 - DNA, 73 bp, Homo sapiens
ccacatgctgcaaactcaaatacctacagccgggtcatgttcaaactttgctgttttttgtttgtttgtttgt

SEQ ID NO: 19470 - DNA, 74 bp, Homo sapiens
acagccagaggttcagtttcgttacagacttactgtgtggtaacattacatactgagagacggagtaggaaagg

SEQ ID NO: 19471 - DNA, 73 bp, Homo sapiens
agtaatgtggtattacgtattatgagtcatctagagatgagctaaagtatatgggtggctgtgtacaggtttt

SEQ ID NO: 19472 - DNA, 73 bp, Homo sapiens
tttttcagggagggagcacaatgatgattttctgagtgtgtgaatgtaagcatgttttctcgttggtgactca

SEQ ID NO: 19473 - DNA, 71 bp, Homo sapiens
tgtaccaattcggctcagtctaatcccttttgtgatcattcgtaggctaggcttagggttaggataatgat

SEQ ID NO: 19474 - DNA, 74 bp, Homo sapiens
gttaagagaggattaaattctaacatatgaatgttggaaggataccaacattcaggcgatagccactcatgata

SEQ ID NO: 19475 - DNA, 72 bp, Homo sapiens
gttgacttctcttggggtgatcagccacgtgaccctagccacccgcctcctttacactacgccccaggatcc

SEQ ID NO: 19476 - DNA, 70 bp, Homo sapiens
gccccaccattccacttcctttctgtgcaatgcctgagaaagctcacaagaaaggctgggtattttcttc

SEQ ID NO: 19477 - DNA, 74 bp, Homo sapiens
tttgtactatatcctttttaggaggtcatgaatgatttcagcattaccttgggaattagtttaggactgtaaag

SEQ ID NO: 19478 - DNA, 72 bp, Homo sapiens
tgtgtttgtgtgtgcgcgcgcgcgcgtgtgttgtgcggcgcgcgggcgagcgcgtgtgtgcgcgcgagagct

SEQ ID NO: 19479 - DNA, 71 bp, Homo sapiens
gagaacctcccatcttcctactcttctcagagtttctgtagacctggccagagaagtgaggaaatgagagc

SEQ ID NO: 19480 - DNA, 72 bp, Homo sapiens
gcagccggtgggaggggaaacgcggccgcccaagagccccgggccggtcgcgccgcccttgtccccggagtg

SEQ ID NO: 19481 - DNA, 72 bp, Homo sapiens
gcacacagccccttcactcttcccggcccatgcaccagggagaggacacgaggtggagtggcctggcccctc

SEQ ID NO: 19482 - DNA, 70 bp, Homo sapiens
ctatgacattctggataaggcaaaacttggagttaggaagagcagtggttgccatggtttagggtagaga

SEQ ID NO: 19483 - DNA, 72 bp, Homo sapiens
gatcagaagattccaggttcgactcctggctggctcggtgtaagcagggtcgttttacaactttctgactcc

SEQ ID NO: 19484 - DNA, 74 bp, Homo sapiens
tatcagatgggatatcctgactttgtcttccaggaagaagcctggttgttccaacctgatcagactttttctct

SEQ ID NO: 19485 - DNA, 73 bp, Homo sapiens
tgcctccccgactcaccccttaggttgccagatcatacacccgccctgggaagggggcatcaggtaccggggc

SEQ ID NO: 19486 - DNA, 74 bp, Homo sapiens
cacctctcactatgtcccttcagcttctatctttgtatggcctgttctttcttaggttatgattgtagagtgat

SEQ ID NO: 19487 - DNA, 71 bp, Homo sapiens
gctctctcaggaagtcccatctccaggtgaaggggagaacatcacatcaagggatcagcccacaggacaaa

SEQ ID NO: 19488 - DNA, 70 bp, Homo sapiens
tccccaaaaattcacatattgaagccctattccaatatgatggtatttggagatgggacctgtgatattg

SEQ ID NO: 19489 - DNA, 72 bp, Homo sapiens
tttggatgggtgtagaattaaaacaggatgctatgaattgtgatcgtgtgatccatcccccatttgctatgc

SEQ ID NO: 19490 - DNA, 72 bp, Homo sapiens
tctgcaacaactaaggactgcaaaaccctactttgcatcaactgaacacaattagttgcggcaataaaaata

SEQ ID NO: 19491 - DNA, 72 bp, Homo sapiens
ctctgcgcagagctgcggcgcgccgggcccgggtcccccacccgcagcgccccgccgggcccggcctggcgg

SEQ ID NO: 19492 - DNA, 74 bp, Homo sapiens
ggtatggaggtgaagagagtttataggcccctgtcacgaatgagggaagcacgggaaagcactctgcccatttc

SEQ ID NO: 19493 - DNA, 71 bp, Homo sapiens
agtgaggtcaatgatgagcacctccagcagcttcattgctggaagatgctgacgagcagaactgggacctg

SEQ ID NO: 19494 - DNA, 72 bp, Homo sapiens
tctcattgttcaattcccacctatgagtgagaacacgtggtgtttgctgaacgcgcccgatctcgtccaaat

SEQ ID NO: 19495 - DNA, 71 bp, Homo sapiens
ctggctggtgggaagaagttccagttgcggctccatgtgagctccaaggatttcgcctctaatcctttaga

SEQ ID NO: 19496 - DNA, 73 bp, Homo sapiens
tggatgaaatgaagaagaggagctggcattcccatggtccagagccccgcctctaaccctcattctctgctca

SEQ ID NO: 19497 - DNA, 70 bp, Homo sapiens
gggtggtgacggcccccggcgggagcccggcgagacggcggccgccgcggggcccgaggacacggaccct

SEQ ID NO: 19498 - DNA, 73 bp, Homo sapiens
cctgggacagggtgatctgagatgcctggttctttggctatcagaaattaaaacaaagcaagctatcgtaagg

SEQ ID NO: 19499 - DNA, 70 bp, Homo sapiens
cctgtgtaagcaggaaatgaaaaccaaggttgttttgtaagctgcctacaattttaaggtgtgctttaca

SEQ ID NO: 19500 - DNA, 70 bp, Homo sapiens
gcttgcctatttcataaatattgatgaatacctgttgaggtcaggtgctgtgttggggactgggaatccc

SEQ ID NO: 19501 - DNA, 74 bp, Homo sapiens
gcggcgccgacgagccctgcgccctccgcggccgcccggcgcgagctcccgggcggggcgctgtccagcgcgca

SEQ ID NO: 19502 - DNA, 71 bp, Homo sapiens
tctgtgagtgacaggttaactctaaatcaacacctcttcatttggagtttcctcctgtctgaattttaatt

SEQ ID NO: 19503 - DNA, 73 bp, Homo sapiens
ccagagggagatttgacatgcaagttccttggcagcggcaagccaaggaatgccaggagctaacacaagctgg

SEQ ID NO: 19504 - DNA, 74 bp, Homo sapiens
gccagcagtcagccggccggagacagagacttcacgactcccagtctcctcctcgccgcggccgccgcctcctc

SEQ ID NO: 19505 - DNA, 74 bp, Homo sapiens
ctccgtcccggcgtctccaaaactgaatgagcgagcggcgcgtagggcgcgcggcggcggcggcggcggcggcg

SEQ ID NO: 19506 - DNA, 72 bp, Homo sapiens
ggccaatcgcagcaaatcaatgggtttgagcaacactacgtttgctaatataaaattgtgtttgggcggaac

SEQ ID NO: 19507 - DNA, 74 bp, Homo sapiens
aggacaagacaaattacagattgtctcagagaaaacaaatgagttactctctcggacaagctgtaggtcctacc

SEQ ID NO: 19508 - DNA, 74 bp, Homo sapiens
gatgtgcagtaacttggccaacttcacacccagctgctaagtgggagaacttggatctgaacccagggaatgag

SEQ ID NO: 19509 - DNA, 70 bp, Homo sapiens
ccgaagcgccctgcggacccgcagcctgggccgccccgaacctgacggccccgcgggggtcggacgcggg

SEQ ID NO: 19510 - DNA, 74 bp, Homo sapiens
ggtcaacaaatgctccaaaaatgatgcccctttagacgggcatctgccacactctaaaaatcgtcataacaaaa

SEQ ID NO: 19511 - DNA, 72 bp, Homo sapiens
cgcggggcccgtccgctcctccagccgctgcctcccaggcggcgctcgccggcgcggcggcaaagactgaga

SEQ ID NO: 19512 - DNA, 74 bp, Homo sapiens
ggtccactctattctacagcataattttagcactgaattttgcataagtataagggagataaagtgaggccccc

SEQ ID NO: 19513 - DNA, 73 bp, Homo sapiens
ggtccctcagcgccggcttgttgcccagggcacacaggtagcaccagggtgggttcactgtggctcctactct

SEQ ID NO: 19514 - DNA, 70 bp, Homo sapiens
aaccaagtcagaggaggagaagaaataggggggatagtggttctcacacagatccaggtgctatttcttc

SEQ ID NO: 19515 - DNA, 72 bp, Homo sapiens
ctcatccttccccattccctgtagctcttctcttgcgtaattagcccatagggattgtagccacagtccagg

SEQ ID NO: 19516 - DNA, 74 bp, Homo sapiens
gggactgcatcttccgacttgtccacagcagatgaggacagtgagaattaagttagatccgagactgcgaagag

SEQ ID NO: 19517 - DNA, 73 bp, Homo sapiens
tcctgtgtctgctgggatccttttgatgttgaagcgtcttggagtagacaatagaggattttcatatggtgga

SEQ ID NO: 19518 - DNA, 73 bp, Homo sapiens
tcatgtcactcacctggccagagaactttgggagtatcccaatggctcctgcatgcctcttggtacacacatg

SEQ ID NO: 19519 - DNA, 74 bp, Homo sapiens
cgcttcacgaggaaatttgagactagctcaagctttggtaaacccgcgtatgaattgtctggagatgcctgggg

SEQ ID NO: 19520 - DNA, 71 bp, Homo sapiens
attcacatgggatatcagtgaaatacaaaacctggctaaatttaaccagctaacaaccatgtgaatgaaga

SEQ ID NO: 19521 - DNA, 72 bp, Homo sapiens
gcaatccccccgtgtcagcctcccaaagtgctccatattttttgtttgggttttaagtgggaggtgagggga

SEQ ID NO: 19522 - DNA, 74 bp, Homo sapiens
tgatcctgaagtgcggaaggataagttaaatggcttaatagatcctggcagcttcggaaaggactaatggctca

SEQ ID NO: 19523 - DNA, 70 bp, Homo sapiens
aggagataagtcgtaacatggtaagcgtactggaaagtgcacttggacgaaccaaggtgtagcttaacat

SEQ ID NO: 19524 - DNA, 74 bp, Homo sapiens
ttcctgttccatgatacttcttgctcttttgttaagagaacgttggaacaatttcaattgaacactggaaccac

SEQ ID NO: 19525 - DNA, 74 bp, Homo sapiens
cgacacggggcgggggcgcctcgggcgcgctggctgggggcccgcggggcgccgctccgcagtggaagggggca

SEQ ID NO: 19526 - DNA, 71 bp, Homo sapiens
ttaaaactgaaaaggcttatgacaaggtagttgccttgtttatctgaattataaaactgagcccaatttca

SEQ ID NO: 19527 - DNA, 72 bp, Homo sapiens
atgtcatgaaatgacactggacttggagccagaaggcccagggtcaagttcaagttgcaagattccacctgc

SEQ ID NO: 19528 - DNA, 74 bp, Homo sapiens
agggctggctctgctgggtgatctgggctgtgtcccaccactctgtccatatgatgactcccgtttctgaaccc

SEQ ID NO: 19529 - DNA, 74 bp, Homo sapiens
cgtcccctccggctgggttagccgccccgccgcctccgccgcccccgtcgccgccgccgccagccgcccccgcc

SEQ ID NO: 19530 - DNA, 74 bp, Homo sapiens
cccagcgccactcatggggggcccaagtccttctgatcgaggtgggaaatgtggcgtacggaaaactggatatt

SEQ ID NO: 19531 - DNA, 73 bp, Homo sapiens
aaagcgggagcaacccaggtctccatccacacacaaagggatcagcaaaatgtgggatacatggacagcgagc

SEQ ID NO: 19532 - DNA, 70 bp, Homo sapiens
ggccccttctgctcgaggccccgccccgcccccacgggcccctcctctccagggccccacccccctctcc

SEQ ID NO: 19533 - DNA, 72 bp, Homo sapiens
aaattaaatgaagagccagcaaattagtgaaattgtacagatgtgtgataactgacttcagtcactgagctg

SEQ ID NO: 19534 - DNA, 72 bp, Homo sapiens
cctcattctgttgcccaggtagtagtgcagtggcggtatctcggctcactgcaactccaacctcctggactc

SEQ ID NO: 19535 - DNA, 72 bp, Homo sapiens
ttcccctccctgtgtccaagcgttcaattctcatctatgagtgagaacatggggtatttggttttctgtcct

SEQ ID NO: 19536 - DNA, 73 bp, Homo sapiens
ccccttatgatactgagtcttaagcattgttgatggaagcaaggggcatggagagtgttacagtgttacctta

SEQ ID NO: 19537 - DNA, 71 bp, Homo sapiens
tgcatcttagaagctctatgaatttatatgcttacataaaaagcattagttaatagtagagatgttactgc

SEQ ID NO: 19538 - DNA, 71 bp, Homo sapiens
gaaatacagacaatgccagtgacagctgcccactccataatgatgtggacctgacttgcttttgttggtta

SEQ ID NO: 19539 - DNA, 74 bp, Homo sapiens
aggttgtcctctccattattaaagtctcctatcattttggtggtggtctctattcctccctttatttttattta

SEQ ID NO: 19540 - DNA, 71 bp, Homo sapiens
gagaaatggagggcagcgcaggtgggccggcactgctgggagacccgacgcaccctcagcagctgctggcc

SEQ ID NO: 19541 - DNA, 74 bp, Homo sapiens
tggtgggagtgggagagaattgtggctggaaatctgaagttcagtgtgtaggtttccacttgagtttttagtac

SEQ ID NO: 19542 - DNA, 73 bp, Homo sapiens
ggtcacccccgccccttctccattcaacgccgcgcggggcggggcagggcgcgcggggcggggcggggcgggg

SEQ ID NO: 19543 - DNA, 73 bp, Homo sapiens
gaacaggagttgcttccatgttttagctattgtgaataacactactgtgaacatgggtataccctcatgttct

SEQ ID NO: 19544 - DNA, 74 bp, Homo sapiens
cagcggcggcggcggcggcgcgcggggggtgagtacgaactcggggacgccccctccctagcttcctgctgctc

SEQ ID NO: 19545 - DNA, 74 bp, Homo sapiens
gtcattggatatccacgggaggggggtaggggggataaaccttatacagaaattaacccaaaatggatcagttg

SEQ ID NO: 19546 - DNA, 74 bp, Homo sapiens
agcagggagctttgtgcccctctcgaggcagagcccagagcccggggctctttttacaggcagagcttagaacc

SEQ ID NO: 19547 - DNA, 74 bp, Homo sapiens
gcagccaggtgccgagcgcggggccccacctccgaaggcggaggaggggccgcgggcggtgacgcgccgagggc

SEQ ID NO: 19548 - DNA, 70 bp, Homo sapiens
cccgccccctccccgtgggagcgcccctcatccggagctcggcttcgggtttctccagcggctgcccctc

SEQ ID NO: 19549 - DNA, 70 bp, Homo sapiens
ttcgcccagctcatcctcgcaccactgcgcctgcgcggcgcgcgcgccggccgagcccctccgtggttca

SEQ ID NO: 19550 - DNA, 73 bp, Homo sapiens
gcatggctcccgcctggaaaggaaagcagagaaaaacctctcccatccccagttataaaacggcgggtcagca

SEQ ID NO: 19551 - DNA, 74 bp, Homo sapiens
tcggcttcctgtgatgagactgaggcctcgcgctgctgattgagcagcccagaagtgagtgtgcgtctttctca

SEQ ID NO: 19552 - DNA, 71 bp, Homo sapiens
ggcagggccggctcacggccccgcagggctcggcccctgcacacggcagcgctgccccagccacccgcccc

SEQ ID NO: 19553 - DNA, 73 bp, Homo sapiens
ctcaatgaaagcgatccctttctgatttgacagtcaaggggtggaagggactctaaaatactctccagtgagg

SEQ ID NO: 19554 - DNA, 73 bp, Homo sapiens
acatttattttctgcattctccctggcaactacctgtccctggagaggaattgaaaaacctaggcagctgtag

SEQ ID NO: 19555 - DNA, 70 bp, Homo sapiens
tgctttacacgcagaaggtcctgggttcaagccccagtggaaccatggtgtggtctgttgttttcctgcc

SEQ ID NO: 19556 - DNA, 74 bp, Homo sapiens
caggagcagtgagaagccacccgcagtctttaagcagagcagtgatgtgagctgagctctttctccagcctggg

SEQ ID NO: 19557 - DNA, 72 bp, Homo sapiens
acatgagcatggaggaaattccatgtgaggacacagcaagaaggcagctgtctgcaagcaaggaaaagagcc

SEQ ID NO: 19558 - DNA, 70 bp, Homo sapiens
tagattaatggggctcagaggtgcaggaactggaatttggggaattaaatgagaccctagtatgtttaga

SEQ ID NO: 19559 - DNA, 74 bp, Homo sapiens
agtttccccacgcctagccctttaaaaaaaatagacatgaggtcttactatgttgccctggctggtctaaactc

SEQ ID NO: 19560 - DNA, 71 bp, Homo sapiens
catgggcgggccaggggaatccggctaaggggctcttcagatgtggggatgacccggcaacagcacctgcg

SEQ ID NO: 19561 - DNA, 71 bp, Homo sapiens
ccttttttccatttcctaatgatgtccacagttgaagtgcaaactgactacagctgagtatttaagtggaa

SEQ ID NO: 19562 - DNA, 72 bp, Homo sapiens
tccacattggctgcaaaggtcatgagctgctttcctgcaaatgcatctccatctgggattgaatgtcctttg

SEQ ID NO: 19563 - DNA, 73 bp, Homo sapiens
accatgctgatgatgaaagattctgaggctatagccccacttgtttgaggacgcagccaggaattgtgcatgt

SEQ ID NO: 19564 - DNA, 73 bp, Homo sapiens
aatagctataaaacgtggtatactgtctcttaagtgctatatgagtggcagggtaatttgggtagtcttagaa

SEQ ID NO: 19565 - DNA, 74 bp, Homo sapiens
atcctactgaaactattccaaaaaattgaagaggagaggctcctccctaacttattttaggaagccaacatcag

SEQ ID NO: 19566 - DNA, 70 bp, Homo sapiens
tgggggtaaggccagcctgagcctgaatctaagcacaccgggcaatttacttgaccactctgaccctcag

SEQ ID NO: 19567 - DNA, 72 bp, Homo sapiens
aggtcccccagctgcggcgggcggcccttctcatgttgagcaaagtgtgagtgtgaggaaggtacaggcgca

SEQ ID NO: 19568 - DNA, 71 bp, Homo sapiens
acaaattaactgtccaatcagagaattggggtgacctgcagctaatgcagcgcctgaagaggagagcacct

SEQ ID NO: 19569 - DNA, 71 bp, Homo sapiens
ttgtgcagatcccagacgagcccccaaacatgttgtgggatatttggggtgttgcttttctggccagaaac

SEQ ID NO: 19570 - DNA, 73 bp, Homo sapiens
gtttttatgtggttttgaaatcggggtaatactggcctcagaggaagagttgaaggtgttcctctcttttcag

SEQ ID NO: 19571 - DNA, 72 bp, Homo sapiens
agcccagaccccaggggccgggcatcccacagctctcctcactgagcccctgggcctatccgcccacgccca

SEQ ID NO: 19572 - DNA, 73 bp, Homo sapiens
aaagttatttttacccactttggaatgccagttcggaacagcctctggcatcttggaaggcactgtacaggta

SEQ ID NO: 19573 - DNA, 74 bp, Homo sapiens
atcctcaggacctctggttagccaggatgttgccagcagtgggaacaggtgttgtcttcttgggttcaaggtta

SEQ ID NO: 19574 - DNA, 74 bp, Homo sapiens
aaggctgtaccctatcaatagactaatgtcattatcactggaatgggttcattattgcaggggtgagctttccc

SEQ ID NO: 19575 - DNA, 70 bp, Homo sapiens
tttgggcatctgcagagggcgaggaactggtcacggcgccgggtgggcttgcagctgtgacgcttatgtg

SEQ ID NO: 19576 - DNA, 71 bp, Homo sapiens
agtgggactgagtggggtagaggggaggcgaaaggctcctgggacccgcgatcccccctcagccccctcag

SEQ ID NO: 19577 - DNA, 72 bp, Homo sapiens
catgggttcagttgagatgccaggattttataaagcctgtgattctgagagtcctttgttctcaagcctgtg

SEQ ID NO: 19578 - DNA, 73 bp, Homo sapiens
ccccagcgctcctgtcttggcggatctttcccgcaaaggggtgaggccggccttcccatttgacagctgggaa

SEQ ID NO: 19579 - DNA, 72 bp, Homo sapiens
cacgtctgtatcatttacttacatgttgtccgtagctgctttgcactacaatagcagagttgagtagttaca

SEQ ID NO: 19580 - DNA, 70 bp, Homo sapiens
agtatgcatctgagagtaatcagcatagagtttgtataaccgcagcattgagaacagatgcattcacctg

SEQ ID NO: 19581 - DNA, 72 bp, Homo sapiens
gacccagtgtatccaactcatgtgctcaagccatgtggacttgccacagcatcaccttgggaatacttgcaa

SEQ ID NO: 19582 - DNA, 71 bp, Homo sapiens
aaactgtatgtctgttggaattgcatatgtgcaattgcagtcctaatacaattacacttatgaaatggata

SEQ ID NO: 19583 - DNA, 74 bp, Homo sapiens
gcctcccagtgctgggctatatctatcgagtgtccagcgtgagcagtgatgagatctggctctgagccgagggc

SEQ ID NO: 19584 - DNA, 74 bp, Homo sapiens
cacccaattaaaacacctaattatagggtaggctggagccaggaggtgggctctgttggtggccctgaagccgg

SEQ ID NO: 19585 - DNA, 74 bp, Homo sapiens
acctcggtccactccagaacaccactgtcctacttaactgttaaagtaaagagttttgataactgaagtggaca

SEQ ID NO: 19586 - DNA, 71 bp, Homo sapiens
cgcagccgcccgcgctcacctggcccggacacgggctccgccacgcggtgatggaagctgagcctagagag

SEQ ID NO: 19587 - DNA, 70 bp, Homo sapiens
ggcctcccacccccgcgcccggcttccaccatgacggtgatgtctggggagaacgtggacgaggcttcgg

SEQ ID NO: 19588 - DNA, 74 bp, Homo sapiens
caagcctcaacacattgaggtgactcaccacacaacctcacgggggctggaatcgggtcatatactcacaggct

SEQ ID NO: 19589 - DNA, 71 bp, Homo sapiens
tggagtgcagtggctattcacaggcgatccaactactgatcagcaccggagttatgacctgctctgcttcc

SEQ ID NO: 19590 - DNA, 72 bp, Homo sapiens
gacgcccggccttccctgaggagggggcgcggctccggccgggcacgcgcagtcgggcccgggggcgggggc

SEQ ID NO: 19591 - DNA, 73 bp, Homo sapiens
aattgctcaggaaaaatctggtgaaatgggaccactggcggccaaatacctgccccacccccagcaccgcagt

SEQ ID NO: 19592 - DNA, 73 bp, Homo sapiens
atgaccttgaaccacagcatagaacattgagcctagactttgagggtcccgagtgcgtaccatgtggggaaag

SEQ ID NO: 19593 - DNA, 74 bp, Homo sapiens
aagcatggtgtttattgagtacttacatattgaggcattccactcttggaagccagccgcagtgctttaaagga

SEQ ID NO: 19594 - DNA, 73 bp, Homo sapiens
tagggtatctggcagaagaaatttctaagtggcaaagcattcaacatgtgacctgagtgcttctaacagcata

SEQ ID NO: 19595 - DNA, 73 bp, Homo sapiens
atttcatggcagaggagattgatgagtacctgggtataggctgcaatctcatagtctggattgctgatttgaa

SEQ ID NO: 19596 - DNA, 74 bp, Homo sapiens
accaatatggtcgctatagtgtttggttcacaaacgaacatgtaaactctagtgcacagcataattttgagtca

SEQ ID NO: 19597 - DNA, 74 bp, Homo sapiens
tgctatccctggagctactgtaggctgtctatgagggagagggtgtttcctctatattaaccagcatgagttcc

SEQ ID NO: 19598 - DNA, 74 bp, Homo sapiens
tggcttctcctccccacgccctgcccactggcccctccagtttccaggttgtgatgtctctgaaccttggggcc

SEQ ID NO: 19599 - DNA, 73 bp, Homo sapiens
gctgcctaaggaaggctgaagggctgcgtggcactcggagaggctaccaccttggaggctgctggcaggcgga

SEQ ID NO: 19600 - DNA, 73 bp, Homo sapiens
catgatagccagaccagggaggaatcgcttttctccataattggaaataccaccgagagctaatttctcccca

SEQ ID NO: 19601 - DNA, 74 bp, Homo sapiens
accgcgcccggcccttcttttttatttttgagacagagtcttgctctgtcacccaggctggagtgcagtaagtg

SEQ ID NO: 19602 - DNA, 71 bp, Homo sapiens
ctggggtgggcgcgcgccgcggccggtccgcaccctggactggagcccgggccggggagccccctccccag

SEQ ID NO: 19603 - DNA, 74 bp, Homo sapiens
ctggtgaaaaagtcacttcttccatttttttgaatttgctttagtagaggaggactttttcctaaagatgtatc

SEQ ID NO: 19604 - DNA, 74 bp, Homo sapiens
cacgcgcgccccgcacccgccccccgtgcggcccccggctcggggcggcggcggcggcgggggccgggggcgcg

SEQ ID NO: 19605 - DNA, 72 bp, Homo sapiens
ttaaagtttttgaagaaactctatggcctaattcctctaggcatgagttctttatatgtaaaataattttaa

SEQ ID NO: 19606 - DNA, 72 bp, Homo sapiens
acaatgtatagtcatcagatcaaggatattagcatatctgtcatctgaaatattgatcattttttgtgttgg

SEQ ID NO: 19607 - DNA, 70 bp, Homo sapiens
ccgggcgcgcgcggggcgggggcggcgcgcgcgcggggagcgtgtgggccgggcgggcgcggcggggaaa

SEQ ID NO: 19608 - DNA, 74 bp, Homo sapiens
acaaaaataggcagcaggctggacttggctggtggaccatacttttcccactcctgttctatagtccagagaga

SEQ ID NO: 19609 - DNA, 71 bp, Homo sapiens
accaggataccacagtacatcaagaagaacaggtgttggggaccagcctcatcaccacccatagggtatcc

SEQ ID NO: 19610 - DNA, 74 bp, Homo sapiens
tctcttcccttggatagcttgggcttcctcacagcctgataactgaattccaagggttagtattctgagacaca

SEQ ID NO: 19611 - DNA, 74 bp, Homo sapiens
aacaggtgaggcttttgggagatgaggccatgtgggcctcatgaatgggataagctcccttataaaaaaggctt

SEQ ID NO: 19612 - DNA, 74 bp, Homo sapiens
aaataatattgttgaacctgatggtatttgtactttctgaactaagcagatattatcttttaatatttatctta

SEQ ID NO: 19613 - DNA, 74 bp, Homo sapiens
atggccttcagattcttctttggtgattaattttccctggttgatgagatttctgacagggagctgaaggcaat

SEQ ID NO: 19614 - DNA, 71 bp, Homo sapiens
ttattttggccagagatcatggaggaaaatcatattttcaaaatatgggtgcaacaataggccctggccca

SEQ ID NO: 19615 - DNA, 74 bp, Homo sapiens
taaacaatattgataaatcaagttttattttttaaactctctttaaaaaatctatctagtacttgattttcaat

SEQ ID NO: 19616 - DNA, 72 bp, Homo sapiens
atacaatgccaggatggaaggaagccaaataaagaatggagattccccacaccagcctttctgattttgtaa

SEQ ID NO: 19617 - DNA, 73 bp, Homo sapiens
gtgtgtgggatagtagtgtgcatgtgggcatttgctatttgattacttgcaggctctatattaaattactaat

SEQ ID NO: 19618 - DNA, 73 bp, Homo sapiens
gggtggcttgagggcactgcggagcttgcacatgtgagctgagtgcccacacatgtgtgctcaaggcccttcc

SEQ ID NO: 19619 - DNA, 71 bp, Homo sapiens
tagctggaaatcaggggtgaaattatttgccaaggccagaatgtataacaaatgcccctgggagccgagga

SEQ ID NO: 19620 - DNA, 74 bp, Homo sapiens
ccttttcctctgggtggcagtgatgattggcctgagcctgttatgagatgcttcattcccagcctcccttgcag

SEQ ID NO: 19621 - DNA, 74 bp, Homo sapiens
cgggggccgcaagcggtggcggcggcggcgggggcggcgccggctcccgcagctccatcgacagccaggccagc

SEQ ID NO: 19622 - DNA, 74 bp, Homo sapiens
taaagggtggaggttggaaaggtctggcgagagccacagcctggccttgcaggagccagctccgacctgtgacc

SEQ ID NO: 19623 - DNA, 74 bp, Homo sapiens
ggttttggctgagctgagaaccactgtgctaactggggacacagtgattggcagctctacaaaaaccatgctcc

SEQ ID NO: 19624 - DNA, 72 bp, Homo sapiens
aaaatcatattaatatattttttttgtagctccacagttgcttgaagccctgaaaactggggttacataaga

SEQ ID NO: 19625 - DNA, 72 bp, Homo sapiens
gaattatgttagctaggagaatctggaaaaagtaagaacttttattctaagaatcaccagctgatattcttt

SEQ ID NO: 19626 - DNA, 72 bp, Homo sapiens
attgaaggtccccttcgtaacttgccctatgagatccagattgatgagatcaaaggtaataactagggagat

SEQ ID NO: 19627 - DNA, 74 bp, Homo sapiens
agtttggcggcgcgggtcggcggcgggagaacgaaatgacggaacccggaagtcgtggtggccatagcccgtcg

SEQ ID NO: 19628 - DNA, 71 bp, Homo sapiens
tttttttcacttggtgctgatgaggtcaacataagtactagttctgcaaattgtaaacctcactaggggat

SEQ ID NO: 19629 - DNA, 70 bp, Homo sapiens
agcaaaatgacataatgacttggcttcagagtccaagctctagctacctagttttagtgttgtgatgtct

SEQ ID NO: 19630 - DNA, 74 bp, Homo sapiens
ctctcaggttctgtgctgcgagcggcgcgagcctctggcagcgggctcggcctttgctcgcagcactcggcgct

SEQ ID NO: 19631 - DNA, 74 bp, Homo sapiens
gccacattaataaaggtcaaaataaacaggtaaaattaatcttttttgtttgtttgtttgagatagggtctcac

SEQ ID NO: 19632 - DNA, 74 bp, Homo sapiens
ggttacagggaagagcaccggactgggagtcagaaggcttgagcctttgtcccagcagtgccaccacatcgctc

SEQ ID NO: 19633 - DNA, 70 bp, Homo sapiens
ctcacctcagccccacaaagtgctgggattgcaagcgtgagccaccacgttcaatctccacattttttgc

SEQ ID NO: 19634 - DNA, 74 bp, Homo sapiens
gaaaagtggatagttgaatgttttcgtcaataatcttggtctttatctttggttatcttcgactgcgtgttcac

SEQ ID NO: 19635 - DNA, 74 bp, Homo sapiens
tcttgcatcaagactatgttgtcttagttaccctagcttctaatagttcttggtgtttgttatgatatgtcttt

SEQ ID NO: 19636 - DNA, 72 bp, Homo sapiens
ttcagcttcgcaagatgaaagttctggagactggttgcataaccacctgaatgtacttagcactactgaact

SEQ ID NO: 19637 - DNA, 73 bp, Homo sapiens
gatatccatgattatctagacacggttcttgtgacctaccttttaagaagcattgtacatttgatacatggta

SEQ ID NO: 19638 - DNA, 74 bp, Homo sapiens
ccaaggtgctgggattagaggcatgggccaccacacccggccagcttttaaataaaaaatgtaataaaaagttt

SEQ ID NO: 19639 - DNA, 74 bp, Homo sapiens
ggcgccgcggcgggcggctgcgaggagcggccggcgggcggcggcggccggcgggcggcgatggcggcggcgga

SEQ ID NO: 19640 - DNA, 73 bp, Homo sapiens
tttccacatgatgaaacttcggctcacttcttggtgcctgcctaattgtccagattatcacgggattatttct

SEQ ID NO: 19641 - DNA, 73 bp, Homo sapiens
ccatatgggaggccgcggcgggcagatcactcgagaccagcctggccaacatattgaaaccccgtctccacta

SEQ ID NO: 19642 - DNA, 74 bp, Homo sapiens
cagaggctgccctgcagatgctgtcctggacctgtcagcaccacagacacaggtggctctgctgcgcctgtaac

SEQ ID NO: 19643 - DNA, 71 bp, Homo sapiens
gtgtcgatgaagaacgcagctagctgtgagaactaatgtgaattgcaggacagattgatcatcgacacttc

SEQ ID NO: 19644 - DNA, 71 bp, Homo sapiens
gccttagagccatggttttatgtgtctgtcttcccaacatggaggaagttcctgaaggctggaaattacat

SEQ ID NO: 19645 - DNA, 73 bp, Homo sapiens
caccacctccagcaagactctagaagtcacttgccaaagggcagccagtgagggtcttgtaacagggaaggac

SEQ ID NO: 19646 - DNA, 70 bp, Homo sapiens
caagttaaaggttcactgcttctccatgacccaagtcctggatttgcggaagccattttcacaaaagata

SEQ ID NO: 19647 - DNA, 72 bp, Homo sapiens
gcccaaagtcaatactagcccaagccaaaagccaaatctggctcccatggataggtttctggccctgacttt

SEQ ID NO: 19648 - DNA, 74 bp, Homo sapiens
ccacgatttagctgcactttctttggccttggctttctccagaggctccaatgatgccaggctgaggatgtggt

SEQ ID NO: 19649 - DNA, 72 bp, Homo sapiens
aagggccgatgatttttcccaaggtgagtcaggtttggaatcccacttctgacaccacatatgtcaaaatca

SEQ ID NO: 19650 - DNA, 71 bp, Homo sapiens
atctttctaatggttctgttatctggaaagactcaaagcaggattccctctgtaacaagtggagagagcgc

SEQ ID NO: 19651 - DNA, 73 bp, Homo sapiens
attatgcaggcattagaaagtggtgatttcaatgtggtggcattctccatatgagagacacgctgtagggctt

SEQ ID NO: 19652 - DNA, 74 bp, Homo sapiens
gggggcgcgggccggccccagtcagcgggcggcggcgggcggcggcggcgggcggcggggaccgggccggggcc

SEQ ID NO: 19653 - DNA, 70 bp, Homo sapiens
gttggagcttcaggagtgcagagatgagatgatgagtcattcccccccaccccccgccccccgaagtttc

SEQ ID NO: 19654 - DNA, 74 bp, Homo sapiens
ttttctattattattattttgtgtgtgggggataaggtctcgttctgtcacgcaggctggagtgcagtggtgca

SEQ ID NO: 19655 - DNA, 74 bp, Homo sapiens
aggtgggtagtgtccgtgccgggtgcctgcggggaatgggagtggcaaccccgggctgatcactactgctctcc

SEQ ID NO: 19656 - DNA, 74 bp, Homo sapiens
ggagctggccccgcgcgcgggggagggctaccaggctgggaaggagcgcgaagggctgggggcggagccaatgg

SEQ ID NO: 19657 - DNA, 74 bp, Homo sapiens
tagcagcttaagacaataaacatgttatcctgtagtttctgtgggccaggaactcaggaatggtgtaggttggt

SEQ ID NO: 19658 - DNA, 74 bp, Homo sapiens
ctgtctagtaaacaggagatcctgggttcgaatcccagcggtgcctgagttagcggggagtgatatattattgc

SEQ ID NO: 19659 - DNA, 74 bp, Homo sapiens
ctgcagaagtgacctggtgctagaaatctgaaactagcattccaccgggatgacaatccataatctcctcatgc

SEQ ID NO: 19660 - DNA, 71 bp, Homo sapiens
catagggtgctctggggccagcgtttcacaatgctatcgcgtgcacaccccccagattaaaataccaaatg

SEQ ID NO: 19661 - DNA, 71 bp, Homo sapiens
agagccttgctgcttcaaagtgtggttcgcagaccagcagcatcagcagcccctgagagcttgttagaaat

SEQ ID NO: 19662 - DNA, 74 bp, Homo sapiens
ctgggattacaggcaggctccacgttgcccagctaattaaaaaaaattttcgcccggcactgtggctcacgcct

SEQ ID NO: 19663 - DNA, 74 bp, Homo sapiens
gtgccgcaggctggagcgggcgtcgcggccgggggcggtgccgcctaggggcgggcgaagggcgggccggggcg

SEQ ID NO: 19664 - DNA, 74 bp, Homo sapiens
catcatagtagcctcacttttaatcaaacccagtcctggaagtagaaggaaggtcaggagctgacacatgcaga

SEQ ID NO: 19665 - DNA, 72 bp, Homo sapiens
caggttcccctagaacctgagcagcattagccagcttgccggcaggcttgtcaatgagcagtcaggggctcc

SEQ ID NO: 19666 - DNA, 74 bp, Homo sapiens
ccgggtagggtctgtctcctggcatcacatctccccctgctacctgccatgatgctagactcctgagcagaacc

SEQ ID NO: 19667 - DNA, 70 bp, Homo sapiens
ccagcttgttctgccagcctcccactgggtaccttccagcttgccagcattggactgtagcaccatggcc

SEQ ID NO: 19668 - DNA, 72 bp, Homo sapiens
tttcccaaaagagacctttgaaggccctaaacatgaagtactacgaagatgtctttgtgcgggctatttcaa

SEQ ID NO: 19669 - DNA, 72 bp, Homo sapiens
attcctgatggaaactgttgttttttgtgctctaccttatgtctgtggaatgtaacaggacatgtatcaggt

SEQ ID NO: 19670 - DNA, 74 bp, Homo sapiens
tggggtggagagaacactagacttggagtcagaaggctacagtcctgacagtttcacctgtcatccctgcttca

SEQ ID NO: 19671 - DNA, 72 bp, Homo sapiens
ccgcccccgcctcctcgccccccccggcccggggcgctggtgctggggggggccggcggcggcggcggcggc

SEQ ID NO: 19672 - DNA, 70 bp, Homo sapiens
cagtgggcggacgccaggagctcacggaggcggcaccgctcccgaagtaacggagcccggagggcgccca

SEQ ID NO: 19673 - DNA, 71 bp, Homo sapiens
ggcccgcgccaccggagccccgcggagccgccgccgccgccggggacggagcccaggtgagcgcggcagtc

SEQ ID NO: 19674 - DNA, 72 bp, Homo sapiens
ttgggaggctacaccttctgtccttaaaagctttacagaaggcctggcttcccgaccttcgccccaggtacc

SEQ ID NO: 19675 - DNA, 73 bp, Homo sapiens
ccccatcaccccgctactgagacttggccagagaaacctcccctcccccaccaagagatgccaggggcagggg

SEQ ID NO: 19676 - DNA, 72 bp, Homo sapiens
tgtgttactcttctacatttggatttttggttcttatgacaggttatatttgaccaaacttggtcttgagga

SEQ ID NO: 19677 - DNA, 75 bp, Homo sapiens
gtcagaggggggatgtgcatgctggttggggtgggctgcctgtggaccaatcagcgtgcacttccccaccctgaa

SEQ ID NO: 19678 - DNA, 72 bp, Homo sapiens
ccggctccgccgcccggccccgcgtccgcgacccccggagcagaccccggagccggcgagccgggcgggggc

SEQ ID NO: 19679 - DNA, 73 bp, Homo sapiens
acaccagacgagaccaagctgagggaagaatctcagagctcaaagaccagttctttgaattaattcagtcaga

SEQ ID NO: 19680 - DNA, 72 bp, Homo sapiens
catggccttttttttctagctgcctctgctaaacattaagtacattaacaggcatggtagaggcagataaga

SEQ ID NO: 19681 - DNA, 70 bp, Homo sapiens
aaagacatcaggtcaaagttgtttagaaattcttcaaagagagtttgaagcattggactgtaaaatccaa

SEQ ID NO: 19682 - DNA, 72 bp, Homo sapiens
cacatatttattctggataataatagtctcaagtatgcttccacttggggagaaaaaaatgtatgtgtatat

SEQ ID NO: 19683 - DNA, 72 bp, Homo sapiens
gtttgttgttgttttgggtttttgtttgtttgattttgtagacagagagtaaaaaatgacaaacagagtcta

SEQ ID NO: 19684 - DNA, 70 bp, Homo sapiens
tggagctactactatcatcatttctaattagctagtgtaataatagtgctcctgcagatggcttagggca

SEQ ID NO: 19685 - DNA, 73 bp, Homo sapiens
aattagaagatatttgcccattatttttagcagccctcgttgctattgaaatttcttgtgctcttctcattct

SEQ ID NO: 19686 - DNA, 70 bp, Homo sapiens
ggttaagggctgaagagggcagagcaatccagaaaatgagccctgggaacatgtacctcattgagttttg

SEQ ID NO: 19687 - DNA, 74 bp, Homo sapiens
tccggctgcccgggctgtggcgccaacgcctcggacggcccagtcccttcgccgcgggccgtggacgcctggct

SEQ ID NO: 19688 - DNA, 70 bp, Homo sapiens
cacgtcctcggttgccctcggccgaccccttcccccactcgccggcccgaagcggggacccggggagacc

SEQ ID NO: 19689 - DNA, 73 bp, Homo sapiens
cctgggcacagtggggggcttcccctgctcctttcacccttggtgacctctgaccttggcctcccagagcggg

SEQ ID NO: 19690 - DNA, 70 bp, Homo sapiens
agtctccccagctgtaccgcaggagggatgttccccaactaggcaggccggtgatgacgctgagcgcttg

SEQ ID NO: 19691 - DNA, 72 bp, Homo sapiens
gctccagccccgatttcaaggcaaaggagacagtctctgctcctggctggctcgccaagaaatgtgggacac

SEQ ID NO: 19692 - DNA, 71 bp, Homo sapiens
tgttattattattattattattattgagacagtatatcagtctgttgcccaggctggagtacagtagcacg

SEQ ID NO: 19693 - DNA, 71 bp, Homo sapiens
ctttatccaaattaaacccaagaacagggtgctggggtcggtatcacacatcatttggtgatcgggagaca

SEQ ID NO: 19694 - DNA, 70 bp, Homo sapiens
aaaagattgcccagctcctcccagcggtgcctccacctcacgccccagtgctgccgggcccaatttctga

SEQ ID NO: 19695 - DNA, 74 bp, Homo sapiens
tagccacacccctactcagtcctaaaagcctcacaaaacatgagatcttatgatatactgaggctgaggccaac

SEQ ID NO: 19696 - DNA, 74 bp, Homo sapiens
tagcctagtacctggcacatagtaaatgctgtgtcaatgttaaccatttactgttgctactattactagttaaa

SEQ ID NO: 19697 - DNA, 71 bp, Homo sapiens
caactctgcactacagaactttgaatcaagaagtcttggcttggttcttgagtttggggttttgttttgca

SEQ ID NO: 19698 - DNA, 73 bp, Homo sapiens
tgcggccgtggccgtggcgggaggagccggaagccccgcccccggggaggggccgtcctgcaggtgagggcgc

SEQ ID NO: 19699 - DNA, 70 bp, Homo sapiens
aattacaaatccagttggtcaaaataggccatttcctatgtgtgacctattcgtggtatgccaactggac

SEQ ID NO: 19700 - DNA, 74 bp, Homo sapiens
tgtactataggctgactcagtcataagttagggctacccctatgatgatataaagctgaggggaacctgatgga

SEQ ID NO: 19701 - DNA, 74 bp, Homo sapiens
tgattgttggctatatataagataagattatagtctttttctaggactatacgattacttgtaagtattagtta

SEQ ID NO: 19702 - DNA, 74 bp, Homo sapiens
attcccttatcagagatcatatttaatttgaggtctgttgaagtttatcagactggttcagaatatggtctcta

SEQ ID NO: 19703 - DNA, 74 bp, Homo sapiens
agtatatatatgagatggtatatatatgagatctcatatatatatatgtgaggtatatgtgtgtgtgtgtatat

SEQ ID NO: 19704 - DNA, 74 bp, Homo sapiens
ggtcagggtcgcaggggccggcggcgggcgccgcggggccggtgggagccggcggggcgctggcgtcctgcgcg

SEQ ID NO: 19705 - DNA, 73 bp, Homo sapiens
ctcttggcctcacatgatccacctgccttagtctcccaacccaaagttccggattacaggcgtgagccatggg

SEQ ID NO: 19706 - DNA, 74 bp, Homo sapiens
gtgcctcagctactgccacaagaacatgcccagcctagcctgctggtcctgggaggaggagggggcagagctga

SEQ ID NO: 19707 - DNA, 72 bp, Homo sapiens
cagcctggctccagcccataaccatagatcctcctaaccactgggtagccaaggctctttagccaatgattc

SEQ ID NO: 19708 - DNA, 70 bp, Homo sapiens
tccttatgtgggtgtactacaatttattttatccattcacctgttgaagggtatttggcttgtctcccgt

SEQ ID NO: 19709 - DNA, 73 bp, Homo sapiens
cccctgctccccctcctcccccctcccctgctccccctcccagccggctgaggcgggcagggccgggcggggc

SEQ ID NO: 19710 - DNA, 72 bp, Homo sapiens
tccgccctcggccgcgccgccgccgccacttcctgtgcgcggcgatcccacagttccgccggcgcgcgcggg

SEQ ID NO: 19711 - DNA, 71 bp, Homo sapiens
ggttagagattcttaacaacttttaaagagctattaacatagctcaggctacttgaagctggccctaaagg

SEQ ID NO: 19712 - DNA, 74 bp, Homo sapiens
ctcctggactcaccaggggcaggcagcataggccaccataggcaggcaggcaggcaggacgggggatccatcac

SEQ ID NO: 19713 - DNA, 71 bp, Homo sapiens
gccgccgtctccgccccgcctccctggaattcggatcctgcccggagggggcgggcggggccgcgcgctct

SEQ ID NO: 19714 - DNA, 72 bp, Homo sapiens
ctgaggatgtacccagtcagccaggcctggagggtctccagggtcctggaggcgggagagatatgtgcgggg

SEQ ID NO: 19715 - DNA, 72 bp, Homo sapiens
cctgcacagtgtccggctcatcctaggaacgcaactgatgttaagctgaatgatgagggctctgagaagcat

SEQ ID NO: 19716 - DNA, 74 bp, Homo sapiens
cattcacctcttagatcctgctgatgacttctgaaggaccctagggccaccaggcagggaagggctccaaggtg

SEQ ID NO: 19717 - DNA, 74 bp, Homo sapiens
ttgtgcccagcacagggcaggctctcagcaaacacttgggcgggtgagcaggcgaatgaatgaatgaagaaagg

SEQ ID NO: 19718 - DNA, 73 bp, Homo sapiens
acaagtttaataagctcccttccccccacccccaaaaaagagaggaggggctatcagagattaaatgaaactg

SEQ ID NO: 19719 - DNA, 72 bp, Homo sapiens
ccaattagctgagcatgatggtacacgcccagggtcccagtactttgggaggctgaggtgggaggatcactg

SEQ ID NO: 19720 - DNA, 70 bp, Homo sapiens
aaaatcagcaatctgtactagtcaggtcttgctgaacgaagcccctttctgatttgtcatgcatgcttga

SEQ ID NO: 19721 - DNA, 73 bp, Homo sapiens
tcatgcccagcggatattttttatttttatttttttttgagatggggtttcactctgctggagtacagtggtg

SEQ ID NO: 19722 - DNA, 74 bp, Homo sapiens
cgaggcccgaggggccggcggcggcggcggcggcggcggcggcggcggcggcggcggcggcggcgggggcttcc

SEQ ID NO: 19723 - DNA, 72 bp, Homo sapiens
cctggaaagcaggatatcatgactgggtgccgcacccctgggtctccaggtcctaagataagagccaggagt

SEQ ID NO: 19724 - DNA, 73 bp, Homo sapiens
ttcctgcacgcagggccgccaaggcaatgggcggggtaccacagccgagccttgtctccctgcaggtgttcgg

SEQ ID NO: 19725 - DNA, 74 bp, Homo sapiens
cagagctatgatttgctgtttccttttgcagcaaaatgccactgtcctctcccacattttctcgtatgctgata

SEQ ID NO: 19726 - DNA, 74 bp, Homo sapiens
tagtggggaaatctggcagcacagacaggccctttgctttgggcttggtggaggttgggtagagctgggctggg

SEQ ID NO: 19727 - DNA, 73 bp, Homo sapiens
cagggcaggtctcacagctgaacagggaggcctccttaacaactgtttcagcactgactggttaaatattaaa

SEQ ID NO: 19728 - DNA, 74 bp, Homo sapiens
gattgtccgtaaaggattttattcctccttcgcttacgaagcttagtttggctggatgtgaaattctgggttga

SEQ ID NO: 19729 - DNA, 74 bp, Homo sapiens
ttggtttctatatttgcattttcattcagtgatgtcataagatttcaacatgagatgcatatatatcctattaa

SEQ ID NO: 19730 - DNA, 70 bp, Homo sapiens
acagcagttttggaccttgcctgaaccaaagggaagcccagtgctctgaaggggagtcccaggccaggca

SEQ ID NO: 19731 - DNA, 69 bp, Homo sapiens
aggtcctcaataagtatttgttgaaagaataaataaaccaacaagtcttatttgagcacctgttatgtg

SEQ ID NO: 19732 - DNA, 71 bp, Homo sapiens
cctcacatggcaaaagggacagaagggcaaaagggcctagctagttccctcagccctttcacaaggcactg

SEQ ID NO: 19733 - DNA, 71 bp, Homo sapiens
ccctcacaacaaacatgtgccactgagtattttactgaatcagtggctcaggttcgttgcaaggattaagg

SEQ ID NO: 19734 - DNA, 71 bp, Homo sapiens
tttaactgttacaatccaggccaactctgggtcatcctgatcatccagatctggtttgacttttgtgaaag

SEQ ID NO: 19735 - DNA, 74 bp, Homo sapiens
cgggttagtgcaaggttgctgtgatgttaacctgagcagcttcagtgaaataaggtacttatacctagaactca

SEQ ID NO: 19736 - DNA, 74 bp, Homo sapiens
ctcctaatggggccagtgatgacctcagacctgaggccccactttggggctactgaaggtgccccctccttgtt

SEQ ID NO: 19737 - DNA, 72 bp, Homo sapiens
taaatttgaatttcaggtaaacaatgaatagttttttagtctgtcgttgcttaccagaagttcaaatttatc

SEQ ID NO: 19738 - DNA, 73 bp, Homo sapiens
cattactgttgctgaatccagagagcagcatgagttcctgaaatgcagttcaatggtgttcagcagacggtgg

SEQ ID NO: 19739 - DNA, 74 bp, Homo sapiens
ccactaaagcaggattcagactacaatatagctgctaagtgctgtgttgtcgttccccctgcttaaaataaagt

SEQ ID NO: 19740 - DNA, 70 bp, Homo sapiens
tgtgtttttcttaactggtaatgtagattatcattatttatcattaccagctttggggggttcagagttt

SEQ ID NO: 19741 - DNA, 70 bp, Homo sapiens
tcttgatcccaccgctgccaaaaggggtaaggattcaccccttgctaccttttcagaatgtggaccatga

SEQ ID NO: 19742 - DNA, 76 bp, Homo sapiens; identical to SEQ ID NO: 15488

SEQ ID NO: 19743 - DNA, 74 bp, Homo sapiens
atggaagttctctataggaagccatagcactcctaatgtttggtgctatgttttcctgaggagatataaaacgt

SEQ ID NO: 19744 - DNA, 74 bp, Homo sapiens
acaaggggctccaactgtggggggtctgtttccgcagaccgctgactttcctcacacggggcaccaattgaggt

SEQ ID NO: 19745 - DNA, 74 bp, Homo sapiens
tgttctgcatccactgatagaccttgaacaatttactgttgttcttttggtttgcactaggatgcaaaagaaag

SEQ ID NO: 19746 - DNA, 72 bp, Homo sapiens
ttgtgactgttcctggtattgattgcatttgttagttgtacagtgcaaccatagacagtcacacacattaaa

SEQ ID NO: 19747 - DNA, 80 bp, Homo sapiens
agcctcctaaatgaaaaggtagatagaacaggtcttgtttgcaaaataaattcaagacctacttatctaccaacagcaat

SEQ ID NO: 19748 - DNA, 80 bp, Homo sapiens; identical to SEQ ID NO: 19747

SEQ ID NO: 19749 - DNA, 73 bp, Homo sapiens
cttgcacctgtatcacacctgtgtgttacacctgtcactcctgtgtgtcactcttgtgtgttgcagatgtggg

SEQ ID NO: 19750 - DNA, 71 bp, Homo sapiens
tcccaaaaccatctttggaaaaagcacaggtctcagatcctcctgtgacctgtgctttttcccggttggat

SEQ ID NO: 19751 - DNA, 74 bp, Homo sapiens
tcctggggtggggccctggaggtgtcctggaaaaaacgggacacctccctgtcctccaggagctcaccctaagt

SEQ ID NO: 19752 - DNA, 73 bp, Homo sapiens
taaggcttggctgatgaatactgactgtattttccttgagcatgtctggaacagtgtttatgtgttttccttg

SEQ ID NO: 19753 - DNA, 74 bp, Homo sapiens
tctcctgcccggcctcggaaccagcttttctctcttacgatgaaggctgatgccgagagcgggctgtgggcgga

SEQ ID NO: 19754 - DNA, 73 bp, Homo sapiens
gggttcctcccagggctttgcctgtctgagcgtcgcttgccgatcagtagtccccgggggtgcctccgggctc

SEQ ID NO: 19755 - DNA, 20 bp, Homo sapiens
gcgaacaaagccccgggacg

SEQ ID NO: 19756 - DNA, 20 bp, Homo sapiens
ccgtcgggcctgggggaggt

SEQ ID NO: 19757 - DNA, 23 bp, Homo sapiens
gggccagactgccgagggtcccg

SEQ ID NO: 19758 - DNA, 22 bp, Homo sapiens
cagcactgtccggtaagatgct

SEQ ID NO: 19759 - DNA, 23 bp, Homo sapiens
catcgttaccagacagtgttaga

SEQ ID NO: 19760 - DNA, 21 bp, Homo sapiens
gtcttaccagacatggttaga

SEQ ID NO: 19761 - DNA, 21 bp, Homo sapiens
ctggcctgtctcctgcccagg

SEQ ID NO: 19762 - DNA, 22 bp, Homo sapiens
atccctacctctgctctccagg

SEQ ID NO: 19763 - DNA, 22 bp, Homo sapiens
tcacctaccctcccccgccaga

SEQ ID NO: 19764 - DNA, 20 bp, Homo sapiens
gggcggtcgggcgggggcgc

SEQ ID NO: 19765 - DNA, 20 bp, Homo sapiens
cgccctccgtgctgcgtccc

SEQ ID NO: 19766 - DNA, 22 bp, Homo sapiens
tggctgtgggcccgtgggcgcc

SEQ ID NO: 19767 - DNA, 21 bp, Homo sapiens
cgaccccgcgttccccgcaga

SEQ ID NO: 19768 - DNA, 21 bp, Homo sapiens
gcagccggtcctgggtccaca

SEQ ID NO: 19769 - DNA, 22 bp, Homo sapiens
aggctgctacccgccaggtgtc

SEQ ID NO: 19770 - DNA, 23 bp, Homo sapiens
cggccgccagaccccgggcgcac

SEQ ID NO: 19771 - DNA, 22 bp, Homo sapiens
ccgtccactcgccatgcccagc

SEQ ID NO: 19772 - DNA, 22 bp, Homo sapiens
gctggacctggccgccgagggt

SEQ ID NO: 19773 - DNA, 24 bp, Homo sapiens
gggtcgggggcggtggggggcccg

SEQ ID NO: 19774 - DNA, 20 bp, Homo sapiens
cggcggcggcgcgccgcgcg

SEQ ID NO: 19775 - DNA, 21 bp, Homo sapiens
gctgctggtgcccgagctcta

SEQ ID NO: 19776 - DNA, 21 bp, Homo sapiens
cccaccctacctctgcatcct

SEQ ID NO: 19777 - DNA, 21 bp, Homo sapiens
gggccccggggtgggtggtgg

SEQ ID NO: 19778 - DNA, 23 bp, Homo sapiens
gtggccaggtaggctgtggctgc

SEQ ID NO: 19779 - DNA, 23 bp, Homo sapiens
cgctttcccacgcccggcagcca

SEQ ID NO: 19780 - DNA, 24 bp, Homo sapiens
ctggcttccctgctgtgagcctgt

SEQ ID NO: 19781 - DNA, 20 bp, Homo sapiens
attggcgcagcaggcggagc

SEQ ID NO: 19782 - DNA, 20 bp, Homo sapiens
cgcgggagcgccgcgtgggg

SEQ ID NO: 19783 - DNA, 22 bp, Homo sapiens
gctggcggcggcggtgcgctgg

SEQ ID NO: 19784 - DNA, 24 bp, Homo sapiens
tcacctgtgcatggtttccttcct

SEQ ID NO: 19785 - DNA, 22 bp, Homo sapiens
tccctgtcactgccgcagcagc

SEQ ID NO: 19786 - DNA, 22 bp, Homo sapiens
tccaatcacacttcgttgcctg

SEQ ID NO: 19787 - DNA, 22 bp, Homo sapiens
atggcgggctgcgcggcgcggg

SEQ ID NO: 19788 - DNA, 22 bp, Homo sapiens
ggcctgcgctcggcccgggggc

SEQ ID NO: 19789 - DNA, 22 bp, Homo sapiens
aggcggggctcggggtggggcc

SEQ ID NO: 19790 - DNA, 23 bp, Homo sapiens
cccacccccaccatcctcccagg

SEQ ID NO: 19791 - DNA, 21 bp, Homo sapiens
catctgcttttctggggctgg

SEQ ID NO: 19792 - DNA, 20 bp, Homo sapiens
tgctggccgccgccagcccc

SEQ ID NO: 19793 - DNA, 23 bp, Homo sapiens
cagggtcgcgggaggacgctgga

SEQ ID NO: 19794 - DNA, 22 bp, Homo sapiens
gcacttacctgctgtcatcaga

SEQ ID NO: 19795 - DNA, 22 bp, Homo sapiens
atgacagcagataagtgccagt

SEQ ID NO: 19796 - DNA, 22 bp, Homo sapiens
ccagggcctggtccctcctccc

SEQ ID NO: 19797 - DNA, 21 bp, Homo sapiens
cgccgtccagcgcggctcggg

SEQ ID NO: 19798 - DNA, 22 bp, Homo sapiens
tgctacaaatcgcgtctgtgat

SEQ ID NO: 19799 - DNA, 23 bp, Homo sapiens
tctgtgttttggacatctccact

SEQ ID NO: 19800 - DNA, 22 bp, Homo sapiens
cacatggaactgcagggcaggc

SEQ ID NO: 19801 - DNA, 22 bp, Homo sapiens
tcgccctgtgtttccaggcctg

SEQ ID NO: 19802 - DNA, 21 bp, Homo sapiens
tcactcctgcccacacccctc

SEQ ID NO: 19803 - DNA, 23 bp, Homo sapiens
ggagtttcgcgagggccgaagcg

SEQ ID NO: 19804 - DNA, 24 bp, Homo sapiens
gggagcgggcgggcgggcgcggcc

SEQ ID NO: 19805 - DNA, 20 bp, Homo sapiens
cgcgcgggtcgtggggcagg

SEQ ID NO: 19806 - DNA, 24 bp, Homo sapiens
gggttgggagaagcagtccggggc

SEQ ID NO: 19807 - DNA, 21 bp, Homo sapiens
gggctgcgcttgggtccgtcg

SEQ ID NO: 19808 - DNA, 20 bp, Homo sapiens
accgcccgggaaggaggaag

SEQ ID NO: 19809 - DNA, 22 bp, Homo sapiens
ctccctccggagggcgcccggg

SEQ ID NO: 19810 - DNA, 22 bp, Homo sapiens
tcaggctccgtcccctccctcc

SEQ ID NO: 19811 - DNA, 21 bp, Homo sapiens
gcagcaagtacccacccacct

SEQ ID NO: 19812 - DNA, 20 bp, Homo sapiens
aggaagggctcccggccccg

SEQ ID NO: 19813 - DNA, 23 bp, Homo sapiens
accccatgctgacttggagaacc

SEQ ID NO: 19814 - DNA, 24 bp, Homo sapiens
cgggccgcggtggagcgagggccc

SEQ ID NO: 19815 - DNA, 22 bp, Homo sapiens
ggcggggcggcggcggcggtgg

SEQ ID NO: 19816 - DNA, 20 bp, Homo sapiens
aggccctctgcacccacgca

SEQ ID NO: 19817 - DNA, 24 bp, Homo sapiens
gactacaggcggggaaggaacgct

SEQ ID NO: 19818 - DNA, 20 bp, Homo sapiens
cgcgcccggctcgcctcgcg

SEQ ID NO: 19819 - DNA, 20 bp, Homo sapiens
gtttgagtggaggaagatgg

SEQ ID NO: 19820 - DNA, 24 bp, Homo sapiens
tccacctcctggcatcactccagc

SEQ ID NO: 19821 - DNA, 22 bp, Homo sapiens
gctgcctctccaaccctgcagg

SEQ ID NO: 19822 - DNA, 24 bp, Homo sapiens
acttcctcctctgccctccccaaa

SEQ ID NO: 19823 - DNA, 22 bp, Homo sapiens
gagcagcatgtgcaaaggttca

SEQ ID NO: 19824 - DNA, 23 bp, Homo sapiens
caggagctgcttgcaccctagga

SEQ ID NO: 19825 - DNA, 20 bp, Homo sapiens
cggcggcggcggagcgcggg

SEQ ID NO: 19826 - DNA, 20 bp, Homo sapiens
cactgacgccgggaccggga

SEQ ID NO: 19827 - DNA, 20 bp, Homo sapiens
ggcggcggcccggcgcgggg

SEQ ID NO: 19828 - DNA, 21 bp, Homo sapiens
actccaacaatccacctgcct

SEQ ID NO: 19829 - DNA, 21 bp, Homo sapiens
aggcaggtggattgttggagt

SEQ ID NO: 19830 - DNA, 21 bp, Homo sapiens
gaggaaggaagggaagcccca

SEQ ID NO: 19831 - DNA, 22 bp, Homo sapiens
ccgttgcccgctcgcgtccatc

SEQ ID NO: 19832 - DNA, 21 bp, Homo sapiens
taatgtagttgccactaggag

SEQ ID NO: 19833 - DNA, 22 bp, Homo sapiens
ctaaagagaagtcaatgcatga

SEQ ID NO: 19834 - DNA, 24 bp, Homo sapiens
accgcagccctttctgtgcccacc

SEQ ID NO: 19835 - DNA, 22 bp, Homo sapiens
cggggggcgaggcccgcggagg

SEQ ID NO: 19836 - DNA, 20 bp, Homo sapiens
gagtgcggtcggcagtagag

SEQ ID NO: 19837 - DNA, 23 bp, Homo sapiens
gacccctaccctgaagccaccca

SEQ ID NO: 19838 - DNA, 20 bp, Homo sapiens
gccggtgccccgggtccccg

SEQ ID NO: 19839 - DNA, 22 bp, Homo sapiens
gctgcagtgaaccgaaccgtga

SEQ ID NO: 19840 - DNA, 23 bp, Homo sapiens
aaggagaaggtcgggttgtagaa

SEQ ID NO: 19841 - DNA, 22 bp, Homo sapiens
tcgggctgtaggcagggccaag

SEQ ID NO: 19842 - DNA, 20 bp, Homo sapiens
ggtcccattgaatcccaaca

SEQ ID NO: 19843 - DNA, 22 bp, Homo sapiens
cggcggcggcgggagggggcgc

SEQ ID NO: 19844 - DNA, 20 bp, Homo sapiens
cgggagtcgtcggaggtgtg

SEQ ID NO: 19845 - DNA, 23 bp, Homo sapiens
ggcagcaaggaaggcaggggtcc

SEQ ID NO: 19846 - DNA, 22 bp, Homo sapiens
tggagctggaccaggaggagct

SEQ ID NO: 19847 - DNA, 23 bp, Homo sapiens
cgcggtgtcgcctagctccagcg

SEQ ID NO: 19848 - DNA, 23 bp, Homo sapiens
ggccggcgggtcggtgagcgcgg

SEQ ID NO: 19849 - DNA, 23 bp, Homo sapiens
ccggctctagcctcccgctgttc

SEQ ID NO: 19850 - DNA, 22 bp, Homo sapiens
taagcatgagctatcacacaca

SEQ ID NO: 19851 - DNA, 23 bp, Homo sapiens
tttgtagctgtacactaagggaa

SEQ ID NO: 19852 - DNA, 23 bp, Homo sapiens
ccgcaccgcggcgcccgcgcagg

SEQ ID NO: 19853 - DNA, 21 bp, Homo sapiens
gagtcggagccggagcctgag

SEQ ID NO: 19854 - DNA, 24 bp, Homo sapiens
acctccacccagtttcaggcctgg

SEQ ID NO: 19855 - DNA, 22 bp, Homo sapiens
ccttcttctcccccaccccagc

SEQ ID NO: 19856 - DNA, 20 bp, Homo sapiens
gacgcggcgcctgcgcgggc

SEQ ID NO: 19857 - DNA, 21 bp, Homo sapiens
gcgcgatcggccgggctgtaa

SEQ ID NO: 19858 - DNA, 23 bp, Homo sapiens
ggtgcgcaggcgccgtggccgga

SEQ ID NO: 19859 - DNA, 22 bp, Homo sapiens
tgtcactagaatctggaataga

SEQ ID NO: 19860 - DNA, 22 bp, Homo sapiens
cgtacatgcatgtgtgtgtgca

SEQ ID NO: 19861 - DNA, 20 bp, Homo sapiens
gggatggggcgcgaagcggg

SEQ ID NO: 19862 - DNA, 24 bp, Homo sapiens
caagctcggggctggcctccgcca

SEQ ID NO: 19863 - DNA, 23 bp, Homo sapiens
ccgcacccacgcctggaccgcgg

SEQ ID NO: 19864 - DNA, 24 bp, Homo sapiens
cggagtcgcagcgcggtcacactg

SEQ ID NO: 19865 - DNA, 20 bp, Homo sapiens
cggggcaggtgctgtgagca

SEQ ID NO: 19866 - DNA, 21 bp, Homo sapiens
cgagcccggccaaaaatgttt

SEQ ID NO: 19867 - DNA, 21 bp, Homo sapiens
gcgcccatgtaacccggtccg

SEQ ID NO: 19868 - DNA, 21 bp, Homo sapiens
atcccagtccagctctctgct

SEQ ID NO: 19869 - DNA, 20 bp, Homo sapiens
gagtcgtcggacacttctga

SEQ ID NO: 19870 - DNA, 23 bp, Homo sapiens
catctctccaggggcctatcacc

SEQ ID NO: 19871 - DNA, 22 bp, Homo sapiens
ccggccgcaggggtcatgcgct

SEQ ID NO: 19872 - DNA, 23 bp, Homo sapiens
atgcccttgtacacaacacacgt

SEQ ID NO: 19873 - DNA, 22 bp, Homo sapiens
tcgcccctgcgctgcgcggacc

SEQ ID NO: 19874 - DNA, 21 bp, Homo sapiens
aacccaccgcacccccctcag

SEQ ID NO: 19875 - DNA, 23 bp, Homo sapiens
cgggcggcgggcggcggggcggg

SEQ ID NO: 19876 - DNA, 24 bp, Homo sapiens
aactcaggcccctggtcccacagg

SEQ ID NO: 19877 - DNA, 22 bp, Homo sapiens
ctgtgacctgggccccagttct

SEQ ID NO: 19878 - DNA, 22 bp, Homo sapiens
ttggaggctctctcagctgaca

SEQ ID NO: 19879 - DNA, 23 bp, Homo sapiens
tcatgagagttgtgtgagaaccg

SEQ ID NO: 19880 - DNA, 22 bp, Homo sapiens
ccgccctctgtacctccccaga

SEQ ID NO: 19881 - DNA, 20 bp, Homo sapiens
cgcgtttgtagctccggccc

SEQ ID NO: 19882 - DNA, 22 bp, Homo sapiens
tctgtccgtccccatcctcagg

SEQ ID NO: 19883 - DNA, 20 bp, Homo sapiens
cccgcggtacctcccgcact

SEQ ID NO: 19884 - DNA, 24 bp, Homo sapiens
tccttggggtaactccagcctggc

SEQ ID NO: 19885 - DNA, 20 bp, Homo sapiens
gggggcctcacgagccccgg

SEQ ID NO: 19886 - DNA, 21 bp, Homo sapiens
tgagggtatagctgtcccaga

SEQ ID NO: 19887 - DNA, 21 bp, Homo sapiens
gagcttgagggcagttggtgc

SEQ ID NO: 19888 - DNA, 20 bp, Homo sapiens
gctgtcccccctcccggcgc

SEQ ID NO: 19889 - DNA, 23 bp, Homo sapiens
gggcgttgcccagggctggtgtt

SEQ ID NO: 19890 - DNA, 22 bp, Homo sapiens
cccgtccatccgtccgtccgtg

SEQ ID NO: 19891 - DNA, 22 bp, Homo sapiens
aacctccctgcacagtccacct

SEQ ID NO: 19892 - DNA, 23 bp, Homo sapiens
cggggccgcggcggcgggggatc

SEQ ID NO: 19893 - DNA, 21 bp, Homo sapiens
ccacagcgcgcccgggacctg

SEQ ID NO: 19894 - DNA, 22 bp, Homo sapiens
aacttcaattacttttgcatcg

SEQ ID NO: 19895 - DNA, 22 bp, Homo sapiens
gcccttcttgatgctcttgatt

SEQ ID NO: 19896 - DNA, 22 bp, Homo sapiens
atcctcccagcctggcctgagt

SEQ ID NO: 19897 - DNA, 22 bp, Homo sapiens
agcctcccagtctggcctgagt

SEQ ID NO: 19898 - DNA, 22 bp, Homo sapiens
actcaggccaggctgggaggat

SEQ ID NO: 19899 - DNA, 22 bp, Homo sapiens
tgagagttgtgaaatatttgtg

SEQ ID NO: 19900 - DNA, 22 bp, Homo sapiens
cccccttctcccctcctccagt

SEQ ID NO: 19901 - DNA, 22 bp, Homo sapiens
tccctactatgttccaggcact

SEQ ID NO: 19902 - DNA, 24 bp, Homo sapiens
ctggcggaggccgcgagggaggga

SEQ ID NO: 19903 - DNA, 22 bp, Homo sapiens
ccatccagctcatcgctcgcat

SEQ ID NO: 19904 - DNA, 23 bp, Homo sapiens
ccagcgcctagcgcctgccttca

SEQ ID NO: 19905 - DNA, 22 bp, Homo sapiens
aagctatagtaggctatacatc

SEQ ID NO: 19906 - DNA, 22 bp, Homo sapiens
ttctacaaattcacccctcaca

SEQ ID NO: 19907 - DNA, 24 bp, Homo sapiens
cccaggggcggcggcggcccagcc

SEQ ID NO: 19908 - DNA, 23 bp, Homo sapiens
tgagtcaggcaacctgtgtttga

SEQ ID NO: 19909 - DNA, 22 bp, Homo sapiens
ctagctgctgctgggcgtttac

SEQ ID NO: 19910 - DNA, 22 bp, Homo sapiens
tcacaccaccgtgtccaccatt

SEQ ID NO: 19911 - DNA, 21 bp, Homo sapiens
ttgagttactttgccttatcc

SEQ ID NO: 19912 - DNA, 22 bp, Homo sapiens
agactgggtagtttataaaggt

SEQ ID NO: 19913 - DNA, 23 bp, Homo sapiens
tgagcccgcagcctccggcagcc

SEQ ID NO: 19914 - DNA, 21 bp, Homo sapiens
gctacaactctgaaatcagaa

SEQ ID NO: 19915 - DNA, 21 bp, Homo sapiens
ggcgtagctccccgggcccga

SEQ ID NO: 19916 - DNA, 23 bp, Homo sapiens
cccctcagtccaccagagcccgg

SEQ ID NO: 19917 - DNA, 21 bp, Homo sapiens
ttcgctccccacagacccaga

SEQ ID NO: 19918 - DNA, 22 bp, Homo sapiens
cttggcaccattaaaaagtaca

SEQ ID NO: 19919 - DNA, 21 bp, Homo sapiens
gtagcacccagttggacccag

SEQ ID NO: 19920 - DNA, 20 bp, Homo sapiens
ccgcggcggccgtcgcgccc

SEQ ID NO: 19921 - DNA, 23 bp, Homo sapiens
tggcgagtcctgcgtccttgtcc

SEQ ID NO: 19922 - DNA, 23 bp, Homo sapiens
aggcacggcagccgcagcccggc

SEQ ID NO: 19923 - DNA, 24 bp, Homo sapiens
acgggtattcttgggtggataata

SEQ ID NO: 19924 - DNA, 23 bp, Homo sapiens
ctttacagctgatgtggtgacag

SEQ ID NO: 19925 - DNA, 21 bp, Homo sapiens
actactacatacatatgccta

SEQ ID NO: 19926 - DNA, 21 bp, Homo sapiens
tactacatacatatgcctaca

SEQ ID NO: 19927 - DNA, 23 bp, Homo sapiens
gggttcagtgcggactcctccct

SEQ ID NO: 19928 - DNA, 22 bp, Homo sapiens
aggagtccgcactgaaccctgg

SEQ ID NO: 19929 - DNA, 20 bp, Homo sapiens
ctgtgctctgggggctgtgc

SEQ ID NO: 19930 - DNA, 22 bp, Homo sapiens
gcccccctatccttgacctccg

SEQ ID NO: 19931 - DNA, 21 bp, Homo sapiens
tctgtcttctttcctgggcct

SEQ ID NO: 19932 - DNA, 22 bp, Homo sapiens
tccgggtagaagacatgtcact

SEQ ID NO: 19933 - DNA, 21 bp, Homo sapiens
ccctcgaagccagttccttgc

SEQ ID NO: 19934 - DNA, 24 bp, Homo sapiens
gccctcccgcccagcgcggcaacc

SEQ ID NO: 19935 - DNA, 22 bp, Homo sapiens
cgtggtcttcggggagagagcg

SEQ ID NO: 19936 - DNA, 20 bp, Homo sapiens
agtagcaacgctttagactg

SEQ ID NO: 19937 - DNA, 22 bp, Homo sapiens
ttggaatgcagagctcctaaga

SEQ ID NO: 19938 - DNA, 22 bp, Homo sapiens
cactgaattccatttgtggact

SEQ ID NO: 19939 - DNA, 22 bp, Homo sapiens
ttccttgaccatccttatcaga

SEQ ID NO: 19940 - DNA, 22 bp, Homo sapiens
tgtcagtcccagttgatgtttt

SEQ ID NO: 19941 - DNA, 22 bp, Homo sapiens
tagagctccgatcccatccacc

SEQ ID NO: 19942 - DNA, 23 bp, Homo sapiens
tcctcctcgtcggcctcttcggc

SEQ ID NO: 19943 - DNA, 23 bp, Homo sapiens
caagccccccgtccaccctcacg

SEQ ID NO: 19944 - DNA, 22 bp, Homo sapiens
aaccctatgatgaatggttcct

SEQ ID NO: 19945 - DNA, 23 bp, Homo sapiens
ttaggaaggcagaacaagacaga

SEQ ID NO: 19946 - DNA, 20 bp, Homo sapiens
gccaatggaacccgggagcg

SEQ ID NO: 19947 - DNA, 20 bp, Homo sapiens
cccgcacacagcccgacgtc

SEQ ID NO: 19948 - DNA, 20 bp, Homo sapiens
gtgggggagaggctgtcagc

SEQ ID NO: 19949 - DNA, 24 bp, Homo sapiens
agctgcccgccgcggggccccagg

SEQ ID NO: 19950 - DNA, 23 bp, Homo sapiens
tcacccctgcttcctctgccaga

SEQ ID NO: 19951 - DNA, 22 bp, Homo sapiens
tccccctgcccccagggcaacc

SEQ ID NO: 19952 - DNA, 21 bp, Homo sapiens
actaaatgtcaaacatattct

SEQ ID NO: 19953 - DNA, 22 bp, Homo sapiens
tcccggcccgccggccccggag

SEQ ID NO: 19954 - DNA, 23 bp, Homo sapiens
tgccccttccctctcggtgtggc

SEQ ID NO: 19955 - DNA, 20 bp, Homo sapiens
tggggagggacgcagggcgc

SEQ ID NO: 19956 - DNA, 20 bp, Homo sapiens
tgcccacagtgcccgcccat

SEQ ID NO: 19957 - DNA, 22 bp, Homo sapiens
cttccttgccaccctccccagc

SEQ ID NO: 19958 - DNA, 23 bp, Homo sapiens
acactgcaccgcgtcccgtccct

SEQ ID NO: 19959 - DNA, 23 bp, Homo sapiens
agccggagctcggggagcggagc

SEQ ID NO: 19960 - DNA, 22 bp, Homo sapiens
tcctcctactttgttgccaaat

SEQ ID NO: 19961 - DNA, 21 bp, Homo sapiens
actcggttgcgggaggggtca

SEQ ID NO: 19962 - DNA, 23 bp, Homo sapiens
agcctctgcagctccccggcccc

SEQ ID NO: 19963 - DNA, 23 bp, Homo sapiens
tccgctcccggggggctctaatg

SEQ ID NO: 19964 - DNA, 23 bp, Homo sapiens
ttccccggagtggggagttggcc

SEQ ID NO: 19965 - DNA, 23 bp, Homo sapiens
gtgcccgcgcgtccgccacgagg

SEQ ID NO: 19966 - DNA, 20 bp, Homo sapiens
acgcgcaaacttgggctcgc

SEQ ID NO: 19967 - DNA, 21 bp, Homo sapiens
gcccgcggtcggtgggtgccc

SEQ ID NO: 19968 - DNA, 22 bp, Homo sapiens
gcgtcctctctgtggaaaacaa

SEQ ID NO: 19969 - DNA, 22 bp, Homo sapiens
gcacccggtgggggcagcggcg

SEQ ID NO: 19970 - DNA, 23 bp, Homo sapiens
tgcccgttcccggcctctccctg

SEQ ID NO: 19971 - DNA, 23 bp, Homo sapiens
tcagtagacactttgatttttaa

SEQ ID NO: 19972 - DNA, 22 bp, Homo sapiens
cccgatctccttttttcctagt

SEQ ID NO: 19973 - DNA, 24 bp, Homo sapiens
gcgcaccgcgcggctgtacttgta

SEQ ID NO: 19974 - DNA, 21 bp, Homo sapiens
ctctgcttaattaaaaccagg

SEQ ID NO: 19975 - DNA, 23 bp, Homo sapiens
ctaggaggggccaggagccggcc

SEQ ID NO: 19976 - DNA, 21 bp, Homo sapiens
taactatagtctgtgataact

SEQ ID NO: 19977 - DNA, 22 bp, Homo sapiens
ctggctctgctcctcggcgcgc

SEQ ID NO: 19978 - DNA, 20 bp, Homo sapiens
cgggcctgggtagccgtgcc

SEQ ID NO: 19979 - DNA, 20 bp, Homo sapiens
aggcgcggcttccggccggt

SEQ ID NO: 19980 - DNA, 22 bp, Homo sapiens
tagagctgaattactttccaga

SEQ ID NO: 19981 - DNA, 22 bp, Homo sapiens
cgcgggtccgcgcgcgcactgc

SEQ ID NO: 19982 - DNA, 22 bp, Homo sapiens
tatgacatcactggaaccccgt

SEQ ID NO: 19983 - DNA, 21 bp, Homo sapiens
tgcccagatccgtggcctatt

SEQ ID NO: 19984 - DNA, 24 bp, Homo sapiens
gtgcttacaggctccctgccgagt

SEQ ID NO: 19985 - DNA, 22 bp, Homo sapiens
tcccaaggggtgagactacaga

SEQ ID NO: 19986 - DNA, 22 bp, Homo sapiens
cgggtaggcgtctgcgctcggt

SEQ ID NO: 19987 - DNA, 21 bp, Homo sapiens
cggaacgggaagaaggagctg

SEQ ID NO: 19988 - DNA, 22 bp, Homo sapiens
gtccatttcaagttaactctgt

SEQ ID NO: 19989 - DNA, 22 bp, Homo sapiens
cgcgctcgcgggggctctgaga

SEQ ID NO: 19990 - DNA, 24 bp, Homo sapiens
gccgcccctgacgaagtgactccc

SEQ ID NO: 19991 - DNA, 23 bp, Homo sapiens
cagcgccgaggatgaggaggtgc

SEQ ID NO: 19992 - DNA, 23 bp, Homo sapiens
agcaaagcagtgcaggtggtaga

SEQ ID NO: 19993 - DNA, 22 bp, Homo sapiens
tagctgcatgccaggggctaga

SEQ ID NO: 19994 - DNA, 22 bp, Homo sapiens
cctctcctaacctcgctctcgc

SEQ ID NO: 19995 - DNA, 22 bp, Homo sapiens
agagtcgagagtgggagaagag

SEQ ID NO: 19996 - DNA, 20 bp, Homo sapiens
agacccgctccccgcgcggg

SEQ ID NO: 19997 - DNA, 24 bp, Homo sapiens
cttgcccggtgttggggtctggtc

SEQ ID NO: 19998 - DNA, 23 bp, Homo sapiens
ggtcgcgcgtggaggtcggtcgc

SEQ ID NO: 19999 - DNA, 24 bp, Homo sapiens
cggggcggcgcggcgggaggtggc

SEQ ID NO: 20000 - DNA, 20 bp, Homo sapiens
tcagccacactcagctctaa

SEQ ID NO: 20001 - DNA, 22 bp, Homo sapiens
agcacttcattcttgctgtcct

SEQ ID NO: 20002 - DNA, 23 bp, Homo sapiens
ggcttgctgtctgtccagtctgc

SEQ ID NO: 20003 - DNA, 23 bp, Homo sapiens
ccggcttggtcctgcggtccctt

SEQ ID NO: 20004 - DNA, 22 bp, Homo sapiens
taggttatacaacataatgtgt

SEQ ID NO: 20005 - DNA, 22 bp, Homo sapiens
agctacaggtgagatcaggttt

SEQ ID NO: 20006 - DNA, 22 bp, Homo sapiens
aggaaggcaggagggggagatg

SEQ ID NO: 20007 - DNA, 20 bp, Homo sapiens
gatccacagagtactccacc

SEQ ID NO: 20008 - DNA, 20 bp, Homo sapiens
cgcgagatcccgagggggcg

SEQ ID NO: 20009 - DNA, 24 bp, Homo sapiens
gggcgaggagggggtgggtaatgg

SEQ ID NO: 20010 - DNA, 23 bp, Homo sapiens
tctccctcaggggcaggtggtgg

SEQ ID NO: 20011 - DNA, 23 bp, Homo sapiens
aagataaaggtgctgaagtctct

SEQ ID NO: 20012 - DNA, 21 bp, Homo sapiens
cagcggctgcgcatctcgggc

SEQ ID NO: 20013 - DNA, 20 bp, Homo sapiens
gcgtcctcagcggcggcaaa

SEQ ID NO: 20014 - DNA, 22 bp, Homo sapiens
tctcggaggctgactctgctca

SEQ ID NO: 20015 - DNA, 22 bp, Homo sapiens
gggaggggccccgagcgccgcg

SEQ ID NO: 20016 - DNA, 20 bp, Homo sapiens
acacctgatatgatttagat

SEQ ID NO: 20017 - DNA, 21 bp, Homo sapiens
tttggccttttatgttcttga

SEQ ID NO: 20018 - DNA, 22 bp, Homo sapiens
ccagtggagatgctgttacttt

SEQ ID NO: 20019 - DNA, 23 bp, Homo sapiens
cctgcggccccagcgcccctcgc

SEQ ID NO: 20020 - DNA, 20 bp, Homo sapiens
cttctaatgctcttgttgag

SEQ ID NO: 20021 - DNA, 21 bp, Homo sapiens
gccccggactgaagtgcggtc

SEQ ID NO: 20022 - DNA, 23 bp, Homo sapiens
cctccctgccgccgccgctccac

SEQ ID NO: 20023 - DNA, 23 bp, Homo sapiens
cctctggggatccgcgcgcctct

SEQ ID NO: 20024 - DNA, 24 bp, Homo sapiens
gcgttgtgggagccgcggccacgc

SEQ ID NO: 20025 - DNA, 21 bp, Homo sapiens
acatgtttagtgatacaatcc

SEQ ID NO: 20026 - DNA, 22 bp, Homo sapiens
cgcccagtcccgccgcagctcc

SEQ ID NO: 20027 - DNA, 22 bp, Homo sapiens
tcagccaccactgggcgttcac

SEQ ID NO: 20028 - DNA, 20 bp, Homo sapiens
tgccctgaccccaggcccca

SEQ ID NO: 20029 - DNA, 24 bp, Homo sapiens
atgccaaggctcaagtgaggggaa

SEQ ID NO: 20030 - DNA, 21 bp, Homo sapiens
gtcgtgtaccgggtcccgtag

SEQ ID NO: 20031 - DNA, 21 bp, Homo sapiens
ccaactcaacctcaaaacggc

SEQ ID NO: 20032 - DNA, 22 bp, Homo sapiens
tgaggttgagttcgtcagggtt

SEQ ID NO: 20033 - DNA, 22 bp, Homo sapiens
tccagagactggagctgacttg

SEQ ID NO: 20034 - DNA, 23 bp, Homo sapiens
tggccgctgacgctggcgctgga

SEQ ID NO: 20035 - DNA, 21 bp, Homo sapiens
tcgctctgccctccacccatc

SEQ ID NO: 20036 - DNA, 23 bp, Homo sapiens
gggttggtcttgatggggccaca

SEQ ID NO: 20037 - DNA, 23 bp, Homo sapiens
agaccccagcaaggcaaacctga

SEQ ID NO: 20038 - DNA, 20 bp, Homo sapiens
ctgagcgcgatgcgcggaga

SEQ ID NO: 20039 - DNA, 22 bp, Homo sapiens
tcccgcaccgtcctgccccata

SEQ ID NO: 20040 - DNA, 20 bp, Homo sapiens
gcggcggcggcgggggtggg

SEQ ID NO: 20041 - DNA, 24 bp, Homo sapiens
agtgggcgggagcagaccaggtgc

SEQ ID NO: 20042 - DNA, 22 bp, Homo sapiens
tcctcccgggctgcgcctcgct

SEQ ID NO: 20043 - DNA, 21 bp, Homo sapiens
gttactacgctgaatagcgta

SEQ ID NO: 20044 - DNA, 23 bp, Homo sapiens
cgtgagaaagtgaaaggagcccg

SEQ ID NO: 20045 - DNA, 22 bp, Homo sapiens
ctcagctgggtcgtcttctgtg

SEQ ID NO: 20046 - DNA, 22 bp, Homo sapiens
gggctttgtgggtcagccacgt

SEQ ID NO: 20047 - DNA, 21 bp, Homo sapiens
cgccccaaccggcagctggcg

SEQ ID NO: 20048 - DNA, 20 bp, Homo sapiens
gcgagccctctggtgccgga

SEQ ID NO: 20049 - DNA, 24 bp, Homo sapiens
ccaccccgtgtgtgtcctctgccc

SEQ ID NO: 20050 - DNA, 22 bp, Homo sapiens
cgcgaggagccgccgagacctc

SEQ ID NO: 20051 - DNA, 20 bp, Homo sapiens
cctcgcgccccgcgcgcgcg

SEQ ID NO: 20052 - DNA, 23 bp, Homo sapiens
cggccctgagcgcaggcggcccc

SEQ ID NO: 20053 - DNA, 21 bp, Homo sapiens
accccttcggctgctgggcca

SEQ ID NO: 20054 - DNA, 23 bp, Homo sapiens
tgtgcgtttgtgtgcgcccctgg

SEQ ID NO: 20055 - DNA, 20 bp, Homo sapiens
cggccgagccctgcactgcg

SEQ ID NO: 20056 - DNA, 21 bp, Homo sapiens
cccggtctctcttccccgctg

SEQ ID NO: 20057 - DNA, 22 bp, Homo sapiens
ttaagtggcctgaatttgtaga

SEQ ID NO: 20058 - DNA, 21 bp, Homo sapiens
tacagatctgggtctcttaga

SEQ ID NO: 20059 - DNA, 23 bp, Homo sapiens
cggcgagaggcatgggcacgtgg

SEQ ID NO: 20060 - DNA, 20 bp, Homo sapiens
ccggccagaggaggagctcg

SEQ ID NO: 20061 - DNA, 20 bp, Homo sapiens
agccaactaggatcgatgtc

SEQ ID NO: 20062 - DNA, 23 bp, Homo sapiens
cctcccactgcagagcctgggga

SEQ ID NO: 20063 - DNA, 21 bp, Homo sapiens
tgcactaagtatatgccaagc

SEQ ID NO: 20064 - DNA, 22 bp, Homo sapiens
gcgcagcttcctcctctgcagt

SEQ ID NO: 20065 - DNA, 21 bp, Homo sapiens
tgcaattaatatgtaatatgc

SEQ ID NO: 20066 - DNA, 21 bp, Homo sapiens
ccgcgcgcgggtcgggccgcg

SEQ ID NO: 20067 - DNA, 20 bp, Homo sapiens
cggcggcggccgccgcgggg

SEQ ID NO: 20068 - DNA, 24 bp, Homo sapiens
cgcggcggggcgcggggggtgtgg

SEQ ID NO: 20069 - DNA, 21 bp, Homo sapiens
cgcccgccggggcgcgccggc

SEQ ID NO: 20070 - DNA, 24 bp, Homo sapiens
ggccctccccaggtgtctgagcag

SEQ ID NO: 20071 - DNA, 22 bp, Homo sapiens
ccgcgaggccggcggggcgggg

SEQ ID NO: 20072 - DNA, 24 bp, Homo sapiens
ccgtccgtccgtccgtccgtcctc

SEQ ID NO: 20073 - DNA, 24 bp, Homo sapiens
gcgggcagcgcgggatcgtccggc

SEQ ID NO: 20074 - DNA, 20 bp, Homo sapiens
tcccgccggcgggcccgggg

SEQ ID NO: 20075 - DNA, 20 bp, Homo sapiens
gctggacgaggcgccggcgc

SEQ ID NO: 20076 - DNA, 22 bp, Homo sapiens
cactgaatcgatgacggctggc

SEQ ID NO: 20077 - DNA, 22 bp, Homo sapiens
atctcaacattttgtcttgtgg

SEQ ID NO: 20078 - DNA, 22 bp, Homo sapiens
tgccgagcccgctggctcccga

SEQ ID NO: 20079 - DNA, 22 bp, Homo sapiens
acccaatgaagcaatggagaca

SEQ ID NO: 20080 - DNA, 21 bp, Homo sapiens
ctgggctggcgcgggcgggag

SEQ ID NO: 20081 - DNA, 24 bp, Homo sapiens
tccgctccgctctggactgcgcgc

SEQ ID NO: 20082 - DNA, 22 bp, Homo sapiens
cctgagcagtccggaggccgag

SEQ ID NO: 20083 - DNA, 23 bp, Homo sapiens
gagcggcacagcctcccaccctc

SEQ ID NO: 20084 - DNA, 22 bp, Homo sapiens
tccctggccgcgccgcaccgcg

SEQ ID NO: 20085 - DNA, 22 bp, Homo sapiens
cccgcaccgcggcggcggcagg

SEQ ID NO: 20086 - DNA, 23 bp, Homo sapiens
caggcgcggactccacacccagc

SEQ ID NO: 20087 - DNA, 22 bp, Homo sapiens
tccggtcgcggtctccgcacta

SEQ ID NO: 20088 - DNA, 24 bp, Homo sapiens
cgcgccgggatcccggccgccctc

SEQ ID NO: 20089 - DNA, 23 bp, Homo sapiens
cctcggcgctgcttcccgccaaa

SEQ ID NO: 20090 - DNA, 22 bp, Homo sapiens
agagcggctgccactcgcctct

SEQ ID NO: 20091 - DNA, 23 bp, Homo sapiens
cggcgcgggaggcgcccagcgag

SEQ ID NO: 20092 - DNA, 21 bp, Homo sapiens
ccagcgcgctcccgagcggac

SEQ ID NO: 20093 - DNA, 20 bp, Homo sapiens
accagtggtgggaggaggct

SEQ ID NO: 20094 - DNA, 20 bp, Homo sapiens
cagtgccttccgtgaagttg

SEQ ID NO: 20095 - DNA, 24 bp, Homo sapiens
agggagcctctgttggggctggaa

SEQ ID NO: 20096 - DNA, 22 bp, Homo sapiens
tctcctgggcctgagcatccac

SEQ ID NO: 20097 - DNA, 22 bp, Homo sapiens
tgtctgttccctgtctctctag

SEQ ID NO: 20098 - DNA, 23 bp, Homo sapiens
ccagagacagggtgcagctacag

SEQ ID NO: 20099 - DNA, 21 bp, Homo sapiens
cagctcgtgcaggtgcggtcc

SEQ ID NO: 20100 - DNA, 21 bp, Homo sapiens
ctcgcgcggttagagctcttg

SEQ ID NO: 20101 - DNA, 22 bp, Homo sapiens
cagaaaccagaattacttttgc

SEQ ID NO: 20102 - DNA, 24 bp, Homo sapiens
tgtcagtttgtcaaattctttcac

SEQ ID NO: 20103 - DNA, 21 bp, Homo sapiens
tggctcagttcaccaggagaa

SEQ ID NO: 20104 - DNA, 21 bp, Homo sapiens
cgtccgtgtcgctctcgctgg

SEQ ID NO: 20105 - DNA, 23 bp, Homo sapiens
tgagcctgggcacaggggtcacc

SEQ ID NO: 20106 - DNA, 23 bp, Homo sapiens
agccttctttgctcatgctctag

SEQ ID NO: 20107 - DNA, 22 bp, Homo sapiens
tttgtggacatggcaccaagtg

SEQ ID NO: 20108 - DNA, 22 bp, Homo sapiens
cccctccaacctgggtgacaga

SEQ ID NO: 20109 - DNA, 24 bp, Homo sapiens
gccgccggagcaggggcgccgcgc

SEQ ID NO: 20110 - DNA, 20 bp, Homo sapiens
gcggctgatgcgttgcggtg

SEQ ID NO: 20111 - DNA, 22 bp, Homo sapiens
tggaccacgaagggaagcccac

SEQ ID NO: 20112 - DNA, 24 bp, Homo sapiens
tggctgttcccctggtggttgcat

SEQ ID NO: 20113 - DNA, 24 bp, Homo sapiens
tgccgctgctgttgctcctgaggc

SEQ ID NO: 20114 - DNA, 21 bp, Homo sapiens
tctcagtcgtcatttttaagt

SEQ ID NO: 20115 - DNA, 20 bp, Homo sapiens
cccccgcccctcgcggtggg

SEQ ID NO: 20116 - DNA, 23 bp, Homo sapiens
ctgacctcacctctggcctcagc

SEQ ID NO: 20117 - DNA, 20 bp, Homo sapiens
ccatggtgagtccaggggtg

SEQ ID NO: 20118 - DNA, 22 bp, Homo sapiens
cggctagggcgccggagccgca

SEQ ID NO: 20119 - DNA, 20 bp, Homo sapiens
gcggcgacagtaagtgcggg

SEQ ID NO: 20120 - DNA, 22 bp, Homo sapiens
tggacacctggagtcctggcct

SEQ ID NO: 20121 - DNA, 23 bp, Homo sapiens
tcccccggatctgcccctccaga

SEQ ID NO: 20122 - DNA, 20 bp, Homo sapiens
ccctccctccccgccccgcg

SEQ ID NO: 20123 - DNA, 22 bp, Homo sapiens
cggcggcgcgtggggagcagcg

SEQ ID NO: 20124 - DNA, 20 bp, Homo sapiens
ggggcggggctggagggcac

SEQ ID NO: 20125 - DNA, 22 bp, Homo sapiens
tttccgggccgacccccactct

SEQ ID NO: 20126 - DNA, 24 bp, Homo sapiens
cccggctggacacgcagcggctcg

SEQ ID NO: 20127 - DNA, 21 bp, Homo sapiens
cccagccctgctccctgtggc

SEQ ID NO: 20128 - DNA, 23 bp, Homo sapiens
cccgctcgctccgcgctgcccgc

SEQ ID NO: 20129 - DNA, 22 bp, Homo sapiens
ctgaccggactggccctgctcc

SEQ ID NO: 20130 - DNA, 22 bp, Homo sapiens
ctggggcagccgcgcccgcgga

SEQ ID NO: 20131 - DNA, 22 bp, Homo sapiens
acctgaaagtgatctgtgatcc

SEQ ID NO: 20132 - DNA, 22 bp, Homo sapiens
tttctgaaagtgatctgtgatc

SEQ ID NO: 20133 - DNA, 23 bp, Homo sapiens
ttggtgtctgactttgcttagca

SEQ ID NO: 20134 - DNA, 21 bp, Homo sapiens
tgtgctaagtgaagtcagaca

SEQ ID NO: 20135 - DNA, 22 bp, Homo sapiens
caagatcgtctgtgaactcagg

SEQ ID NO: 20136 - DNA, 23 bp, Homo sapiens
tatcatgttgtctttatgagcat

SEQ ID NO: 20137 - DNA, 24 bp, Homo sapiens
cgcggccagcccgccctgcgtctc

SEQ ID NO: 20138 - DNA, 24 bp, Homo sapiens
aaagattctgagcaataacctatt

SEQ ID NO: 20139 - DNA, 22 bp, Homo sapiens
agattgattgatggctctgtgg

SEQ ID NO: 20140 - DNA, 22 bp, Homo sapiens
ggcacacagattaggaaacaga

SEQ ID NO: 20141 - DNA, 22 bp, Homo sapiens
cggcccccgctcccggatcccc

SEQ ID NO: 20142 - DNA, 23 bp, Homo sapiens
agcttctttacagtgttgccttg

SEQ ID NO: 20143 - DNA, 23 bp, Homo sapiens
ccgcctggcgccccggggtcaca

SEQ ID NO: 20144 - DNA, 23 bp, Homo sapiens
ccacagagccggcgcgctcccgc

SEQ ID NO: 20145 - DNA, 21 bp, Homo sapiens
gcggcagcagcagcgccagcc

SEQ ID NO: 20146 - DNA, 20 bp, Homo sapiens
gccggagcgcggcggagcca

SEQ ID NO: 20147 - DNA, 22 bp, Homo sapiens
ttctcagttgtctcaagttaga

SEQ ID NO: 20148 - DNA, 22 bp, Homo sapiens
tcgtcgcccgccacagccgcgc

SEQ ID NO: 20149 - DNA, 21 bp, Homo sapiens
atagatctggattggaaccca

SEQ ID NO: 20150 - DNA, 20 bp, Homo sapiens
gccccgtccgccccccgcct

SEQ ID NO: 20151 - DNA, 23 bp, Homo sapiens
cggggctgggcgggcgccgcggc

SEQ ID NO: 20152 - DNA, 23 bp, Homo sapiens
tagcccaggaccggccctcgggc

SEQ ID NO: 20153 - DNA, 20 bp, Homo sapiens
tcagcaaggttgaagaatac

SEQ ID NO: 20154 - DNA, 20 bp, Homo sapiens
tccccctcccaccccgtcac

SEQ ID NO: 20155 - DNA, 20 bp, Homo sapiens
cctgccacgcgggaggcctc

SEQ ID NO: 20156 - DNA, 21 bp, Homo sapiens
ggggcggggagcgggcgggcg

SEQ ID NO: 20157 - DNA, 21 bp, Homo sapiens
gctgctcatctgctcctacct

SEQ ID NO: 20158 - DNA, 21 bp, Homo sapiens
tttctaccacagctctttgtt

SEQ ID NO: 20159 - DNA, 24 bp, Homo sapiens
tgcccaccccggctccgcctcccc

SEQ ID NO: 20160 - DNA, 24 bp, Homo sapiens
cctgaccctgctcttgctctcagg

SEQ ID NO: 20161 - DNA, 22 bp, Homo sapiens
ggtcccaggtgggtcgggcgcg

SEQ ID NO: 20162 - DNA, 23 bp, Homo sapiens
ctcaccctgctttcatccccaga

SEQ ID NO: 20163 - DNA, 20 bp, Homo sapiens
tgcggcggcttcagctcagg

SEQ ID NO: 20164 - DNA, 24 bp, Homo sapiens
aggaggaggaggagggactcggcg

SEQ ID NO: 20165 - DNA, 21 bp, Homo sapiens
ggccgccggcgtccgacgggc

SEQ ID NO: 20166 - DNA, 22 bp, Homo sapiens
cggcgcactaggatcgggccgg

SEQ ID NO: 20167 - DNA, 22 bp, Homo sapiens
catgcaaagaattgggaggtga

SEQ ID NO: 20168 - DNA, 22 bp, Homo sapiens
gatgcaaagaattgggaggtga

SEQ ID NO: 20169 - DNA, 23 bp, Homo sapiens
agatgagggcaacaccctaggaa

SEQ ID NO: 20170 - DNA, 21 bp, Homo sapiens
agaagcactagtctatgacca

SEQ ID NO: 20171 - DNA, 22 bp, Homo sapiens
cacaatgaggattgactctaac

SEQ ID NO: 20172 - DNA, 22 bp, Homo sapiens
cctccgcctatccccgctgacc

SEQ ID NO: 20173 - DNA, 20 bp, Homo sapiens
ccgcgcttcgctgagggact

SEQ ID NO: 20174 - DNA, 22 bp, Homo sapiens
caaagaccctcagggagtaagc

SEQ ID NO: 20175 - DNA, 21 bp, Homo sapiens
ccactccctgagggtcctaag

SEQ ID NO: 20176 - DNA, 23 bp, Homo sapiens
tacacacatatatacgcacacac

SEQ ID NO: 20177 - DNA, 22 bp, Homo sapiens
aacacctcagaaaagggacaga

SEQ ID NO: 20178 - DNA, 23 bp, Homo sapiens
tcaccgcggtcttttcctcccac

SEQ ID NO: 20179 - DNA, 21 bp, Homo sapiens
agactggccagagatctttag

SEQ ID NO: 20180 - DNA, 23 bp, Homo sapiens
acttcggctgtctgcctctggca

SEQ ID NO: 20181 - DNA, 21 bp, Homo sapiens
tcctccgtgacagactgcaga

SEQ ID NO: 20182 - DNA, 24 bp, Homo sapiens
cgcccggcctgtgtggtgctcaga

SEQ ID NO: 20183 - DNA, 21 bp, Homo sapiens
gccgctcgccccgacccagcc

SEQ ID NO: 20184 - DNA, 22 bp, Homo sapiens
tgagctctctgcactcccaggc

SEQ ID NO: 20185 - DNA, 23 bp, Homo sapiens
tgagccggctgagcaggaagcgg

SEQ ID NO: 20186 - DNA, 22 bp, Homo sapiens
tgtgatgctcagttgtgtgtag

SEQ ID NO: 20187 - DNA, 22 bp, Homo sapiens
acaactgagcatcacagcctga

SEQ ID NO: 20188 - DNA, 22 bp, Homo sapiens
aggctatgatcctcagttgtgt

SEQ ID NO: 20189 - DNA, 23 bp, Homo sapiens
gaaagtaatggtgggttttgcct

SEQ ID NO: 20190 - DNA, 22 bp, Homo sapiens
gagccacgggagggagtgtgtg

SEQ ID NO: 20191 - DNA, 22 bp, Homo sapiens
ctgtaacctactcttgtaccca

SEQ ID NO: 20192 - DNA, 20 bp, Homo sapiens
ggcaacgtggctgggtctaa

SEQ ID NO: 20193 - DNA, 22 bp, Homo sapiens
tcgccagtgagtttcggtgcgg

SEQ ID NO: 20194 - DNA, 22 bp, Homo sapiens
gtctccccgcgtcccccgcagc

SEQ ID NO: 20195 - DNA, 23 bp, Homo sapiens
agaggcccaggctctggaagacc

SEQ ID NO: 20196 - DNA, 22 bp, Homo sapiens
ttgattctcatagattcataac

SEQ ID NO: 20197 - DNA, 22 bp, Homo sapiens
agggcggcggcggcggcggctc

SEQ ID NO: 20198 - DNA, 23 bp, Homo sapiens
gtcctcaattcccaggctgggag

SEQ ID NO: 20199 - DNA, 24 bp, Homo sapiens
gtgagcgcggcggggctcgggaga

SEQ ID NO: 20200 - DNA, 21 bp, Homo sapiens
gcctggcaccacggggacgct

SEQ ID NO: 20201 - DNA, 22 bp, Homo sapiens
tctcggccctgtctcctccagc

SEQ ID NO: 20202 - DNA, 22 bp, Homo sapiens
cgccctgtgcttcctccccagg

SEQ ID NO: 20203 - DNA, 20 bp, Homo sapiens
gccatgagattgaccccgcg

SEQ ID NO: 20204 - DNA, 22 bp, Homo sapiens
ctcacagctggcgctgaccgct

SEQ ID NO: 20205 - DNA, 23 bp, Homo sapiens
tggtcagtgcctcctgtgttggc

SEQ ID NO: 20206 - DNA, 20 bp, Homo sapiens
ggggcggcggcgggaccgaa

SEQ ID NO: 20207 - DNA, 24 bp, Homo sapiens
gccccagcgtagcacccacccccc

SEQ ID NO: 20208 - DNA, 21 bp, Homo sapiens
ctgaggggcaggaggtgggag

SEQ ID NO: 20209 - DNA, 21 bp, Homo sapiens
ctgaccctggcgcccacagac

SEQ ID NO: 20210 - DNA, 23 bp, Homo sapiens
tgtacgtgtgtatgcgtgtgtgt

SEQ ID NO: 20211 - DNA, 21 bp, Homo sapiens
tgccctgcgcccgcaacccga

SEQ ID NO: 20212 - DNA, 23 bp, Homo sapiens
gtgcccagaggatcacggagcca

SEQ ID NO: 20213 - DNA, 23 bp, Homo sapiens
gtggctccttgcacctgtggctg

SEQ ID NO: 20214 - DNA, 20 bp, Homo sapiens
tccactgccgtgttgccagc

SEQ ID NO: 20215 - DNA, 22 bp, Homo sapiens
tgcttgtggacaaggacggcga

SEQ ID NO: 20216 - DNA, 23 bp, Homo sapiens
tcagggggcctgtctgccccagg

SEQ ID NO: 20217 - DNA, 20 bp, Homo sapiens
gccgccatgatcatccctgt

SEQ ID NO: 20218 - DNA, 20 bp, Homo sapiens
tcccggggccgagcctcgct

SEQ ID NO: 20219 - DNA, 23 bp, Homo sapiens
tcccccggagccgcggccccacc

SEQ ID NO: 20220 - DNA, 20 bp, Homo sapiens
gcccgcgggggcgccccggc

SEQ ID NO: 20221 - DNA, 24 bp, Homo sapiens
ttcagtgtctggtgagggtccctt

SEQ ID NO: 20222 - DNA, 22 bp, Homo sapiens
ggcactgaccacgtcactggat

SEQ ID NO: 20223 - DNA, 22 bp, Homo sapiens
tgaggacccccagtgcccacag

SEQ ID NO: 20224 - DNA, 22 bp, Homo sapiens
cactgactttctgggtgaacca

SEQ ID NO: 20225 - DNA, 23 bp, Homo sapiens
ctggctcacgccgctgcctcaga

SEQ ID NO: 20226 - DNA, 22 bp, Homo sapiens
cgagggctggcggggagaagca

SEQ ID NO: 20227 - DNA, 20 bp, Homo sapiens
gccccgacggggagccaaga

SEQ ID NO: 20228 - DNA, 22 bp, Homo sapiens
aatccccaagctttctgggagc

SEQ ID NO: 20229 - DNA, 23 bp, Homo sapiens
gccgcgggtgtctccctcccagg

SEQ ID NO: 20230 - DNA, 21 bp, Homo sapiens
cgatggcacctgcccggatgc

SEQ ID NO: 20231 - DNA, 22 bp, Homo sapiens
tgtggcttacagtttatggggc

SEQ ID NO: 20232 - DNA, 22 bp, Homo sapiens
tgcgctcggagctttgacttga

SEQ ID NO: 20233 - DNA, 21 bp, Homo sapiens
cggcgccgcggccgcgcgggg

SEQ ID NO: 20234 - DNA, 20 bp, Homo sapiens
cgcgccgtcgggcccggctc

SEQ ID NO: 20235 - DNA, 20 bp, Homo sapiens
cgcgcgtccttcctccgcgc

SEQ ID NO: 20236 - DNA, 21 bp, Homo sapiens
cagctcgctggtggtgctgag

SEQ ID NO: 20237 - DNA, 20 bp, Homo sapiens
gcgaagggccgggaggctgg

SEQ ID NO: 20238 - DNA, 20 bp, Homo sapiens
ccggccccgcccgccccccg

SEQ ID NO: 20239 - DNA, 24 bp, Homo sapiens
tgcgactcgctggccctggcgtct

SEQ ID NO: 20240 - DNA, 21 bp, Homo sapiens
cggcctggacgcacccccctc

SEQ ID NO: 20241 - DNA, 22 bp, Homo sapiens
ccggctccaggtcctcggcttc

SEQ ID NO: 20242 - DNA, 20 bp, Homo sapiens
gtggcccgcggggcccgatc

SEQ ID NO: 20243 - DNA, 23 bp, Homo sapiens
tgctgcaaaggtaattgcgatct

SEQ ID NO: 20244 - DNA, 21 bp, Homo sapiens
gacggaggtgcctgtttaccc

SEQ ID NO: 20245 - DNA, 23 bp, Homo sapiens
tggctcggactgtggcggcttcg

SEQ ID NO: 20246 - DNA, 23 bp, Homo sapiens
tgttggtttgctgggcgcagtgg

SEQ ID NO: 20247 - DNA, 22 bp, Homo sapiens
aggcaaatggataggataacac

SEQ ID NO: 20248 - DNA, 21 bp, Homo sapiens
gccatcgactgatgaatagat

SEQ ID NO: 20249 - DNA, 21 bp, Homo sapiens
atttgttgcccatttagccaa

SEQ ID NO: 20250 - DNA, 22 bp, Homo sapiens
agctaaatgtgtgctgggacat

SEQ ID NO: 20251 - DNA, 23 bp, Homo sapiens
accacttccaatgccccatcccc

SEQ ID NO: 20252 - DNA, 24 bp, Homo sapiens
cccctcctccgcgccggccccaac

SEQ ID NO: 20253 - DNA, 21 bp, Homo sapiens
gcgtcaggaatgggccccaat

SEQ ID NO: 20254 - DNA, 23 bp, Homo sapiens
gccacccccgttcccggcagcct

SEQ ID NO: 20255 - DNA, 20 bp, Homo sapiens
ggcggcgggggcccggtccc

SEQ ID NO: 20256 - DNA, 21 bp, Homo sapiens
agttggtgcaccttccagaca

SEQ ID NO: 20257 - DNA, 21 bp, Homo sapiens
tctgactctccgcctctcccc

SEQ ID NO: 20258 - DNA, 22 bp, Homo sapiens
gcgtcccgacccggccccggag

SEQ ID NO: 20259 - DNA, 20 bp, Homo sapiens
agtcatggcggcgactgtgg

SEQ ID NO: 20260 - DNA, 23 bp, Homo sapiens
cggcggcggcagcggcttcccgg

SEQ ID NO: 20261 - DNA, 22 bp, Homo sapiens
tgccatgcctcctgccctcagc

SEQ ID NO: 20262 - DNA, 21 bp, Homo sapiens
tagcaccagggtcccgtggtg

SEQ ID NO: 20263 - DNA, 23 bp, Homo sapiens
cggcgccgcgctggggagcgact

SEQ ID NO: 20264 - DNA, 24 bp, Homo sapiens
attcctgctgtctgcttctcaggg

SEQ ID NO: 20265 - DNA, 23 bp, Homo sapiens
tactgagttgcagtagggtatca

SEQ ID NO: 20266 - DNA, 21 bp, Homo sapiens
cggcacgcggcgcctcgggtt

SEQ ID NO: 20267 - DNA, 20 bp, Homo sapiens
tggcggacgcggccagtcag

SEQ ID NO: 20268 - DNA, 22 bp, Homo sapiens
aggaggtagagatggaggatga

SEQ ID NO: 20269 - DNA, 21 bp, Homo sapiens
tcctccaccacctcctcctgc

SEQ ID NO: 20270 - DNA, 23 bp, Homo sapiens
tgggcctttgtttttaccaagtt

SEQ ID NO: 20271 - DNA, 22 bp, Homo sapiens
tgatgatgaagatggtgaacat

SEQ ID NO: 20272 - DNA, 23 bp, Homo sapiens
gcagctgtgtcccgccggaggaa

SEQ ID NO: 20273 - DNA, 24 bp, Homo sapiens
tcgcacctccagttccgccccacc

SEQ ID NO: 20274 - DNA, 23 bp, Homo sapiens
catgctcaaatctgtctccccaa

SEQ ID NO: 20275 - DNA, 21 bp, Homo sapiens
ccgccccccttccccgcagct

SEQ ID NO: 20276 - DNA, 23 bp, Homo sapiens
gagctcgggagcggggaccggta

SEQ ID NO: 20277 - DNA, 24 bp, Homo sapiens
cgcaactcttccctccggcccagg

SEQ ID NO: 20278 - DNA, 23 bp, Homo sapiens
gtgaggccgcggggatcgccggg

SEQ ID NO: 20279 - DNA, 23 bp, Homo sapiens
aatggcgcgatctcctctcacct

SEQ ID NO: 20280 - DNA, 23 bp, Homo sapiens
gttgctggtcggcctgaaagtaa

SEQ ID NO: 20281 - DNA, 24 bp, Homo sapiens
tccccctcacccctctcgcccagg

SEQ ID NO: 20282 - DNA, 24 bp, Homo sapiens
ctgactcgtccatgcctgcccagc

SEQ ID NO: 20283 - DNA, 24 bp, Homo sapiens
gggacgggccctcaggctccggca

SEQ ID NO: 20284 - DNA, 20 bp, Homo sapiens
gccgccgagtgaggggacgc

SEQ ID NO: 20285 - DNA, 23 bp, Homo sapiens
gcacccctcttgctcctaccagc

SEQ ID NO: 20286 - DNA, 22 bp, Homo sapiens
ccccggggagcggccgcccggt

SEQ ID NO: 20287 - DNA, 23 bp, Homo sapiens
aggccactcctcatgcccccagt

SEQ ID NO: 20288 - DNA, 23 bp, Homo sapiens
tggagggtgaggagtggctatca

SEQ ID NO: 20289 - DNA, 24 bp, Homo sapiens
tctggcccgggatggtgcaacccg

SEQ ID NO: 20290 - DNA, 23 bp, Homo sapiens
ctgtatagactgggggcccacta

SEQ ID NO: 20291 - DNA, 23 bp, Homo sapiens
ccactgcctgctcccctgccagt

SEQ ID NO: 20292 - DNA, 22 bp, Homo sapiens
ccatctgtgaccccacctctag

SEQ ID NO: 20293 - DNA, 24 bp, Homo sapiens
cagatccccgcgcggccccagacc

SEQ ID NO: 20294 - DNA, 21 bp, Homo sapiens
gggctgggctgtgcgcctgcg

SEQ ID NO: 20295 - DNA, 24 bp, Homo sapiens
catcagcacctttgtcctcccagg

SEQ ID NO: 20296 - DNA, 24 bp, Homo sapiens
ggaaatggggccgcctggcccagc

SEQ ID NO: 20297 - DNA, 22 bp, Homo sapiens
cttgggcagcagcggcagccat

SEQ ID NO: 20298 - DNA, 20 bp, Homo sapiens
cttagcgggagcccgagtgc

SEQ ID NO: 20299 - DNA, 22 bp, Homo sapiens
cgtggaacgctccgcaccccaa

SEQ ID NO: 20300 - DNA, 21 bp, Homo sapiens
ctgcccccgcgccggggccac

SEQ ID NO: 20301 - DNA, 22 bp, Homo sapiens
cgcagctggaaacccagcccct

SEQ ID NO: 20302 - DNA, 24 bp, Homo sapiens
tgagctcagggcctggcccccttc

SEQ ID NO: 20303 - DNA, 22 bp, Homo sapiens
ctgggggaggaggaagaggaga

SEQ ID NO: 20304 - DNA, 22 bp, Homo sapiens
tcctgcctgaccctgtcccacc

SEQ ID NO: 20305 - DNA, 23 bp, Homo sapiens
actacggctcccggcagcccccg

SEQ ID NO: 20306 - DNA, 23 bp, Homo sapiens
acccctccccccgcggccggtgt

SEQ ID NO: 20307 - DNA, 24 bp, Homo sapiens
tgagcacagtggggccccggctgg

SEQ ID NO: 20308 - DNA, 20 bp, Homo sapiens
tgcgccccgggcgggtcctc

SEQ ID NO: 20309 - DNA, 22 bp, Homo sapiens
caacccctggctccctctccca

SEQ ID NO: 20310 - DNA, 22 bp, Homo sapiens
gccgcctgcggccccagcagct

SEQ ID NO: 20311 - DNA, 22 bp, Homo sapiens
agggtattcctgcagcagccag

SEQ ID NO: 20312 - DNA, 23 bp, Homo sapiens
tggggctcagtcggctgctgcgg

SEQ ID NO: 20313 - DNA, 21 bp, Homo sapiens
cctgttgggacagtcagttgg

SEQ ID NO: 20314 - DNA, 22 bp, Homo sapiens
taccctgactgtccctctgtag

SEQ ID NO: 20315 - DNA, 22 bp, Homo sapiens
cgcgccgcccggaagccaccgc

SEQ ID NO: 20316 - DNA, 22 bp, Homo sapiens
tataaaatgggggtagtaagac

SEQ ID NO: 20317 - DNA, 20 bp, Homo sapiens
ccttaccagctcccacccct

SEQ ID NO: 20318 - DNA, 22 bp, Homo sapiens
tgggttcctcatctccccccag

SEQ ID NO: 20319 - DNA, 22 bp, Homo sapiens
ccctcgccctagccagggctgc

SEQ ID NO: 20320 - DNA, 23 bp, Homo sapiens
cccgcgaagccccgcttgcccgc

SEQ ID NO: 20321 - DNA, 24 bp, Homo sapiens
tccaggttgccgcctccccaggtc

SEQ ID NO: 20322 - DNA, 20 bp, Homo sapiens
tcctggctcccccggcacgc

SEQ ID NO: 20323 - DNA, 21 bp, Homo sapiens
cagcctcccccaccaccccag

SEQ ID NO: 20324 - DNA, 22 bp, Homo sapiens
gagcagtggtgagggcgggggc

SEQ ID NO: 20325 - DNA, 20 bp, Homo sapiens
ccctccccaccccggcgggg

SEQ ID NO: 20326 - DNA, 23 bp, Homo sapiens
tgcccagccccgtggccgccagc

SEQ ID NO: 20327 - DNA, 22 bp, Homo sapiens
ccgttttgcttgaagtcgcagt

SEQ ID NO: 20328 - DNA, 22 bp, Homo sapiens
aggtcacattgtatccacctta

SEQ ID NO: 20329 - DNA, 23 bp, Homo sapiens
tcccccggcgcctctctgccagg

SEQ ID NO: 20330 - DNA, 22 bp, Homo sapiens
actggacggcttgaacgcgcct

SEQ ID NO: 20331 - DNA, 21 bp, Homo sapiens
acggtggacttagctctgagg

SEQ ID NO: 20332 - DNA, 22 bp, Homo sapiens
tgagggctgagtttgcacagtg

SEQ ID NO: 20333 - DNA, 24 bp, Homo sapiens
gctcctcctctgagctggtggtct

SEQ ID NO: 20334 - DNA, 22 bp, Homo sapiens
tggcacagcttcctctttctct

SEQ ID NO: 20335 - DNA, 22 bp, Homo sapiens
cggcggcgcgttgggcgcagcc

SEQ ID NO: 20336 - DNA, 23 bp, Homo sapiens
ctgcagcccccagctcaggctcc

SEQ ID NO: 20337 - DNA, 20 bp, Homo sapiens
cctcatctgtctgttgggct

SEQ ID NO: 20338 - DNA, 23 bp, Homo sapiens
gcttagatctccctctctccctt

SEQ ID NO: 20339 - DNA, 22 bp, Homo sapiens
ccctccagctcagcccaggaaa

SEQ ID NO: 20340 - DNA, 21 bp, Homo sapiens
cgccgcgccggggagggggag

SEQ ID NO: 20341 - DNA, 21 bp, Homo sapiens
tacccagagccggagcccgca

SEQ ID NO: 20342 - DNA, 24 bp, Homo sapiens
cgcgcgcgcccgctcccccgcccc

SEQ ID NO: 20343 - DNA, 23 bp, Homo sapiens
cggcgcgggggggcgccacgcag

SEQ ID NO: 20344 - DNA, 24 bp, Homo sapiens
gtcgcacgcacgcccgcctcggcg

SEQ ID NO: 20345 - DNA, 22 bp, Homo sapiens
attactatttaccccatacaca

SEQ ID NO: 20346 - DNA, 23 bp, Homo sapiens
cggggcaggcatgggagccgcgc

SEQ ID NO: 20347 - DNA, 22 bp, Homo sapiens
actgcgagagacaagcgcgagg

SEQ ID NO: 20348 - DNA, 22 bp, Homo sapiens
ttcgaggctacagtgagatgtg

SEQ ID NO: 20349 - DNA, 22 bp, Homo sapiens
ccacctgcacccgcagctcgcg

SEQ ID NO: 20350 - DNA, 23 bp, Homo sapiens
ggaagatgggggcgggtggaaca

SEQ ID NO: 20351 - DNA, 21 bp, Homo sapiens
aactgctcttctctaatttaa

SEQ ID NO: 20352 - DNA, 23 bp, Homo sapiens
ccagcgggccccggcgccccaga

SEQ ID NO: 20353 - DNA, 22 bp, Homo sapiens
cgcaggctccctttcccgcccg

SEQ ID NO: 20354 - DNA, 24 bp, Homo sapiens
agtggcggctgcagaaagcgtgga

SEQ ID NO: 20355 - DNA, 21 bp, Homo sapiens
tgcggagctgcagcaggacga

SEQ ID NO: 20356 - DNA, 23 bp, Homo sapiens
cccgcgggccgcctgctgcctcc

SEQ ID NO: 20357 - DNA, 23 bp, Homo sapiens
tccgccctcctcagtgagccaga

SEQ ID NO: 20358 - DNA, 23 bp, Homo sapiens
gctcggggagacatcggggatga

SEQ ID NO: 20359 - DNA, 21 bp, Homo sapiens
tccatggtacttcctgcccct

SEQ ID NO: 20360 - DNA, 22 bp, Homo sapiens
tggcaggaagtaccatggagat

SEQ ID NO: 20361 - DNA, 22 bp, Homo sapiens
acaacagcctcgttcttcctgc

SEQ ID NO: 20362 - DNA, 21 bp, Homo sapiens
cagtcctctctctgccccaga

SEQ ID NO: 20363 - DNA, 20 bp, Homo sapiens
tccggtagggttcgggcctt

SEQ ID NO: 20364 - DNA, 22 bp, Homo sapiens
gatttccacaggtcggacgcct

SEQ ID NO: 20365 - DNA, 20 bp, Homo sapiens
cccgcctgcgcggccctggc

SEQ ID NO: 20366 - DNA, 21 bp, Homo sapiens
tctcccggcgcagggccggct

SEQ ID NO: 20367 - DNA, 21 bp, Homo sapiens
cctcccggaccagggcttcca

SEQ ID NO: 20368 - DNA, 20 bp, Homo sapiens
aagggatggggagcagtccg

SEQ ID NO: 20369 - DNA, 22 bp, Homo sapiens
ccctggggcaaacgatgccagc

SEQ ID NO: 20370 - DNA, 22 bp, Homo sapiens
gcggcggcggaccacctccagg

SEQ ID NO: 20371 - DNA, 23 bp, Homo sapiens
ctgccgcccggagctctctgcga

SEQ ID NO: 20372 - DNA, 22 bp, Homo sapiens
aggagcagccttctctggggaa

SEQ ID NO: 20373 - DNA, 22 bp, Homo sapiens
tgaagtatcaaagcacagttga

SEQ ID NO: 20374 - DNA, 22 bp, Homo sapiens
attcctttttctcttcctcaga

SEQ ID NO: 20375 - DNA, 22 bp, Homo sapiens
tcagggagaaagaagggttatt

SEQ ID NO: 20376 - DNA, 23 bp, Homo sapiens
cgcggacggcgggaccctgcggc

SEQ ID NO: 20377 - DNA, 21 bp, Homo sapiens
ggggccccggcggtgggggca

SEQ ID NO: 20378 - DNA, 23 bp, Homo sapiens
ccctggtggcctctgctgaatgg

SEQ ID NO: 20379 - DNA, 20 bp, Homo sapiens
gcagaggagctggggccggc

SEQ ID NO: 20380 - DNA, 23 bp, Homo sapiens
aagcctttgtgtccccttctcct

SEQ ID NO: 20381 - DNA, 22 bp, Homo sapiens
ctgctccctgcttaatgtgtgt

SEQ ID NO: 20382 - DNA, 22 bp, Homo sapiens
ggagggggcgggctccggcggg

SEQ ID NO: 20383 - DNA, 21 bp, Homo sapiens
attcccagtccagtgcaagag

SEQ ID NO: 20384 - DNA, 21 bp, Homo sapiens
tttgcactggactgggaatga

SEQ ID NO: 20385 - DNA, 21 bp, Homo sapiens
cttgcactggactgggaatga

SEQ ID NO: 20386 - DNA, 22 bp, Homo sapiens
tgtgtagggcatggctcagact

SEQ ID NO: 20387 - DNA, 23 bp, Homo sapiens
cctgagccaagttctccactcca

SEQ ID NO: 20388 - DNA, 21 bp, Homo sapiens
aggcacttggagttctttgcc

SEQ ID NO: 20389 - DNA, 23 bp, Homo sapiens
tgggcaaagaactccaagtgcct

SEQ ID NO: 20390 - DNA, 21 bp, Homo sapiens
gagagctccgactgcagctgc

SEQ ID NO: 20391 - DNA, 23 bp, Homo sapiens
tctcggggaatgcagagcccact

SEQ ID NO: 20392 - DNA, 22 bp, Homo sapiens
tctgagatctctatgaggaggc

SEQ ID NO: 20393 - DNA, 22 bp, Homo sapiens
gcctcctcatagagatctcaga

SEQ ID NO: 20394 - DNA, 22 bp, Homo sapiens
tctgagatctctatgaggagtc

SEQ ID NO: 20395 - DNA, 22 bp, Homo sapiens
cgggccccgagcgcgccgcaga

SEQ ID NO: 20396 - DNA, 23 bp, Homo sapiens
gcctcggcggggtgggctcgaca

SEQ ID NO: 20397 - DNA, 24 bp, Homo sapiens
gaggaccccccctgcctggccttc

SEQ ID NO: 20398 - DNA, 20 bp, Homo sapiens
gaccctgactggaggtcaga

SEQ ID NO: 20399 - DNA, 23 bp, Homo sapiens
gagcccggggacggggcacgggg

SEQ ID NO: 20400 - DNA, 24 bp, Homo sapiens
ctcaccggcccgcgtccccgcagc

SEQ ID NO: 20401 - DNA, 23 bp, Homo sapiens
tccctcctccctggggaaaatct

SEQ ID NO: 20402 - DNA, 22 bp, Homo sapiens
ctgccttctcccatgcctcagc

SEQ ID NO: 20403 - DNA, 20 bp, Homo sapiens
gctggtcggcggcagctctg

SEQ ID NO: 20404 - DNA, 22 bp, Homo sapiens
cagccccagaactgggaccacc

SEQ ID NO: 20405 - DNA, 24 bp, Homo sapiens
cctgaggtttgactgccccccacc

SEQ ID NO: 20406 - DNA, 22 bp, Homo sapiens
gaacagcaaggttgtgaggaca

SEQ ID NO: 20407 - DNA, 21 bp, Homo sapiens
acgcaggtgtcagatccgctc

SEQ ID NO: 20408 - DNA, 23 bp, Homo sapiens
agaccgtgtgtgggttgcggtgc

SEQ ID NO: 20409 - DNA, 22 bp, Homo sapiens
actcagcaacccacacacggtc

SEQ ID NO: 20410 - DNA, 22 bp, Homo sapiens
atgcatgctgggcttgtaacct

SEQ ID NO: 20411 - DNA, 22 bp, Homo sapiens
cgcggccccacgcggccccgct

SEQ ID NO: 20412 - DNA, 21 bp, Homo sapiens
ccgccgcgctcgggcccgtct

SEQ ID NO: 20413 - DNA, 21 bp, Homo sapiens
tgcagcatagggcagttagga

SEQ ID NO: 20414 - DNA, 22 bp, Homo sapiens
acctccttccttttacagatga

SEQ ID NO: 20415 - DNA, 21 bp, Homo sapiens
ggcgcctaagccccgacctcc

SEQ ID NO: 20416 - DNA, 22 bp, Homo sapiens
agccccgccggagcgcccgaga

SEQ ID NO: 20417 - DNA, 21 bp, Homo sapiens
tctcccacaaagttgcagtca

SEQ ID NO: 20418 - DNA, 22 bp, Homo sapiens
gggggccggaccctgccggggc

SEQ ID NO: 20419 - DNA, 22 bp, Homo sapiens
gcgaccggctggccctgccagc

SEQ ID NO: 20420 - DNA, 23 bp, Homo sapiens
ctgagccggccgcgggcgcgacc

SEQ ID NO: 20421 - DNA, 22 bp, Homo sapiens
tcctgaacccacgcagccctgt

SEQ ID NO: 20422 - DNA, 22 bp, Homo sapiens
gaggcttcagacgctgcagcga

SEQ ID NO: 20423 - DNA, 22 bp, Homo sapiens
ccggggaggtggagaagctcgc

SEQ ID NO: 20424 - DNA, 20 bp, Homo sapiens
gcgcccccggcagcagcacc

SEQ ID NO: 20425 - DNA, 22 bp, Homo sapiens
tgagagctgctggcaggtgggc

SEQ ID NO: 20426 - DNA, 23 bp, Homo sapiens
catgtcacttcctctctgatggc

SEQ ID NO: 20427 - DNA, 23 bp, Homo sapiens
ccatgcacctctaggccgcctgc

SEQ ID NO: 20428 - DNA, 24 bp, Homo sapiens
gtcggagcccgcctctcgccgccc

SEQ ID NO: 20429 - DNA, 23 bp, Homo sapiens
aggcctctcctcggcctgctcct

SEQ ID NO: 20430 - DNA, 22 bp, Homo sapiens
acccagggctccccgcgccgcc

SEQ ID NO: 20431 - DNA, 23 bp, Homo sapiens
acagtcttcctctgttacctagg

SEQ ID NO: 20432 - DNA, 23 bp, Homo sapiens
caaatctccggaccacttagtct

SEQ ID NO: 20433 - DNA, 20 bp, Homo sapiens
ccccgccccgcccgccgggg

SEQ ID NO: 20434 - DNA, 22 bp, Homo sapiens
cctgatggcacaggcggtgtac

SEQ ID NO: 20435 - DNA, 21 bp, Homo sapiens
ttgttgaactagggcaggatc

SEQ ID NO: 20436 - DNA, 22 bp, Homo sapiens
atctgcccttccaccctacagc

SEQ ID NO: 20437 - DNA, 24 bp, Homo sapiens
gagggcggaccaggcaggcggttg

SEQ ID NO: 20438 - DNA, 20 bp, Homo sapiens
ggcgcccacccccgcaaagg

SEQ ID NO: 20439 - DNA, 22 bp, Homo sapiens
gggcagtgtctacacctaggtc

SEQ ID NO: 20440 - DNA, 22 bp, Homo sapiens
cagctgctctctgtgctccaga

SEQ ID NO: 20441 - DNA, 23 bp, Homo sapiens
ttcctgtcctttttccagagggt

SEQ ID NO: 20442 - DNA, 21 bp, Homo sapiens
cccttgtgtcctcctcactcc

SEQ ID NO: 20443 - DNA, 24 bp, Homo sapiens
cctcttggcaccctccccccagga

SEQ ID NO: 20444 - DNA, 23 bp, Homo sapiens
gtgggcccgggcggcgggcggag

SEQ ID NO: 20445 - DNA, 22 bp, Homo sapiens
ttggtgataggagtctgtgatt

SEQ ID NO: 20446 - DNA, 24 bp, Homo sapiens
aaagcaaatgttgggtgaacggct

SEQ ID NO: 20447 - DNA, 24 bp, Homo sapiens
gcagaagccggccctcagcctccc

SEQ ID NO: 20448 - DNA, 22 bp, Homo sapiens
caaaaacgcaattactttagca

SEQ ID NO: 20449 - DNA, 22 bp, Homo sapiens
ttcggtcctcgcagcgcttcca

SEQ ID NO: 20450 - DNA, 22 bp, Homo sapiens
tctgctctggttatgtagaggc

SEQ ID NO: 20451 - DNA, 23 bp, Homo sapiens
agcgcccagtgccctggcccgga

SEQ ID NO: 20452 - DNA, 23 bp, Homo sapiens
tgccacacctcttctccctacct

SEQ ID NO: 20453 - DNA, 20 bp, Homo sapiens
agcggcggcggcggctctgg

SEQ ID NO: 20454 - DNA, 23 bp, Homo sapiens
cctggacttaccatttgaaggtg

SEQ ID NO: 20455 - DNA, 21 bp, Homo sapiens
tcaggagacaagcaggtttac

SEQ ID NO: 20456 - DNA, 24 bp, Homo sapiens
cggctccgcagagcggcacacagg

SEQ ID NO: 20457 - DNA, 22 bp, Homo sapiens
ttaacctactagagtcactgtg

SEQ ID NO: 20458 - DNA, 20 bp, Homo sapiens
ccgcccggtgaggaagcccg

SEQ ID NO: 20459 - DNA, 20 bp, Homo sapiens
cccagcgtgggatgaccgtg

SEQ ID NO: 20460 - DNA, 20 bp, Homo sapiens
cggccgccccctcgcggtag

SEQ ID NO: 20461 - DNA, 21 bp, Homo sapiens
gcgccgtcggcgggccgtgcc

SEQ ID NO: 20462 - DNA, 20 bp, Homo sapiens
ctgccccgggtgatgcagcc

SEQ ID NO: 20463 - DNA, 20 bp, Homo sapiens
tggttttgtttgggtttgtt

SEQ ID NO: 20464 - DNA, 21 bp, Homo sapiens
gcagtgtttcctactctatgg

SEQ ID NO: 20465 - DNA, 23 bp, Homo sapiens
gtccagtttcttccttggcttct

SEQ ID NO: 20466 - DNA, 21 bp, Homo sapiens
tgtagggatggaagccatgaa

SEQ ID NO: 20467 - DNA, 22 bp, Homo sapiens
accgaggggtcttccaggaact

SEQ ID NO: 20468 - DNA, 23 bp, Homo sapiens
caagctccgcgcctctcccgccc

SEQ ID NO: 20469 - DNA, 21 bp, Homo sapiens
ccgcgggcagtggagagacgc

SEQ ID NO: 20470 - DNA, 21 bp, Homo sapiens
ccgcccggtcactgcttcctt

SEQ ID NO: 20471 - DNA, 22 bp, Homo sapiens
gctgtgggacctctggccttga

SEQ ID NO: 20472 - DNA, 22 bp, Homo sapiens
ccacccatactgcagcaaaagt

SEQ ID NO: 20473 - DNA, 23 bp, Homo sapiens
agggccggggcggtggggctggg

SEQ ID NO: 20474 - DNA, 22 bp, Homo sapiens
atggtctggcaaacaaaaatca

SEQ ID NO: 20475 - DNA, 23 bp, Homo sapiens
taatgacactcagggcacagtgg

SEQ ID NO: 20476 - DNA, 22 bp, Homo sapiens
cagggccgggaactgggagccg

SEQ ID NO: 20477 - DNA, 21 bp, Homo sapiens
acttacacacatttgcattgc

SEQ ID NO: 20478 - DNA, 20 bp, Homo sapiens
attaaaggagccaagtgtgg

SEQ ID NO: 20479 - DNA, 23 bp, Homo sapiens
taggcgggcgcgatggcccggga

SEQ ID NO: 20480 - DNA, 22 bp, Homo sapiens
catcctctgccccctccccagg

SEQ ID NO: 20481 - DNA, 21 bp, Homo sapiens
tctaccaaccctgtgcatgac

SEQ ID NO: 20482 - DNA, 22 bp, Homo sapiens
aacggcttcggaggggcgagaa

SEQ ID NO: 20483 - DNA, 21 bp, Homo sapiens
cccgctctcccgaagctgttc

SEQ ID NO: 20484 - DNA, 23 bp, Homo sapiens
cggcggcggcggcgactacggac

SEQ ID NO: 20485 - DNA, 21 bp, Homo sapiens
ctccctctcttcctggcccca

SEQ ID NO: 20486 - DNA, 23 bp, Homo sapiens
gctggccaggaacttttgggatg

SEQ ID NO: 20487 - DNA, 22 bp, Homo sapiens
atcaccaataatgggacactaa

SEQ ID NO: 20488 - DNA, 21 bp, Homo sapiens
tgccagctgcagtgaccctgc

SEQ ID NO: 20489 - DNA, 23 bp, Homo sapiens
tgcggctctgccctgtccccagg

SEQ ID NO: 20490 - DNA, 20 bp, Homo sapiens
ccccctgggcctatccgcct

SEQ ID NO: 20491 - DNA, 23 bp, Homo sapiens
ttgggaagaattctgatattggt

SEQ ID NO: 20492 - DNA, 21 bp, Homo sapiens
tgtggaaggagcagttccggg

SEQ ID NO: 20493 - DNA, 23 bp, Homo sapiens
ttgccggcgcctgacgcgcgcgg

SEQ ID NO: 20494 - DNA, 23 bp, Homo sapiens
tctctcgccaggcgtcctcgtgg

SEQ ID NO: 20495 - DNA, 23 bp, Homo sapiens
ggacgagcgcggcggcgagggcg

SEQ ID NO: 20496 - DNA, 23 bp, Homo sapiens
ccaactcaaccccttaccccagg

SEQ ID NO: 20497 - DNA, 22 bp, Homo sapiens
ggagctattgcggccgtgggtg

SEQ ID NO: 20498 - DNA, 23 bp, Homo sapiens
tgccgtccttccctgtgcccagg

SEQ ID NO: 20499 - DNA, 23 bp, Homo sapiens
acccagggtaccctctcgttgca

SEQ ID NO: 20500 - DNA, 20 bp, Homo sapiens
acagcgagaggcagctctgg

SEQ ID NO: 20501 - DNA, 23 bp, Homo sapiens
cgaccgtgagcctcaggaacacc

SEQ ID NO: 20502 - DNA, 23 bp, Homo sapiens
gagaggcgacctccagcccccac

SEQ ID NO: 20503 - DNA, 23 bp, Homo sapiens
acttgcaaggcccaggtgaggag

SEQ ID NO: 20504 - DNA, 22 bp, Homo sapiens
ggcccagccgcgacgggctcga

SEQ ID NO: 20505 - DNA, 24 bp, Homo sapiens
gcagccctgcccggctgggcccgc

SEQ ID NO: 20506 - DNA, 23 bp, Homo sapiens
tctcctcctcctcaacctcatcc

SEQ ID NO: 20507 - DNA, 22 bp, Homo sapiens
ctatcccggcacttttaggaga

SEQ ID NO: 20508 - DNA, 22 bp, Homo sapiens
accccaggaatcccctcccagg

SEQ ID NO: 20509 - DNA, 22 bp, Homo sapiens
ccgtcctcactgaccccgcagt

SEQ ID NO: 20510 - DNA, 23 bp, Homo sapiens
cggcgcggcccgagccgccgaca

SEQ ID NO: 20511 - DNA, 22 bp, Homo sapiens
cgctgcagtctggagccccata

SEQ ID NO: 20512 - DNA, 22 bp, Homo sapiens
aatgaggtattcagggctgaga

SEQ ID NO: 20513 - DNA, 22 bp, Homo sapiens
tgagagccccttggaatgttga

SEQ ID NO: 20514 - DNA, 24 bp, Homo sapiens
cacgggggctttgctgggtcagcc

SEQ ID NO: 20515 - DNA, 20 bp, Homo sapiens
agcaaggcgccccgccgaca

SEQ ID NO: 20516 - DNA, 24 bp, Homo sapiens
cgtcgcagccgggatttgggtcgc

SEQ ID NO: 20517 - DNA, 22 bp, Homo sapiens
tctggtttcaatgggtacgatt

SEQ ID NO: 20518 - DNA, 24 bp, Homo sapiens
ccgcggggcaggcggggagcaagg

SEQ ID NO: 20519 - DNA, 22 bp, Homo sapiens
cccgcgtccccgccccccggcc

SEQ ID NO: 20520 - DNA, 23 bp, Homo sapiens
cacgccactgtgccttgcttaaa

SEQ ID NO: 20521 - DNA, 20 bp, Homo sapiens
tcctcggcgcgcggcgcggg

SEQ ID NO: 20522 - DNA, 22 bp, Homo sapiens
gtctcaggctctgaggcccggg

SEQ ID NO: 20523 - DNA, 22 bp, Homo sapiens
tcctccgtccgcctctcagagc

SEQ ID NO: 20524 - DNA, 22 bp, Homo sapiens
tcctgacgcttctctcccgcag

SEQ ID NO: 20525 - DNA, 24 bp, Homo sapiens
gcccgcgccttccccgccgccccc

SEQ ID NO: 20526 - DNA, 22 bp, Homo sapiens
gcgcgggcatcttggcggcctc

SEQ ID NO: 20527 - DNA, 24 bp, Homo sapiens
gcgaggccgcctccagggaggaca

SEQ ID NO: 20528 - DNA, 22 bp, Homo sapiens
tcgccgaccaggtagggcacca

SEQ ID NO: 20529 - DNA, 22 bp, Homo sapiens
taggtctttaacacaacttgac

SEQ ID NO: 20530 - DNA, 20 bp, Homo sapiens
cagggccgtcgcagccgctg

SEQ ID NO: 20531 - DNA, 21 bp, Homo sapiens
tgcccgcttccgctcgctccc

SEQ ID NO: 20532 - DNA, 21 bp, Homo sapiens
gagcagccctgacccgtgggg

SEQ ID NO: 20533 - DNA, 22 bp, Homo sapiens
cgcagccgccacccggcctggc

SEQ ID NO: 20534 - DNA, 21 bp, Homo sapiens
gcagggccgctgaccgaccga

SEQ ID NO: 20535 - DNA, 22 bp, Homo sapiens
tcagcctcccagaacagggaag

SEQ ID NO: 20536 - DNA, 22 bp, Homo sapiens
tgcctgtttggggaagctggtc

SEQ ID NO: 20537 - DNA, 24 bp, Homo sapiens
cgtcttctccgcctgcgccgccgc

SEQ ID NO: 20538 - DNA, 24 bp, Homo sapiens
tctacctgatataaccccaactga

SEQ ID NO: 20539 - DNA, 24 bp, Homo sapiens
cgcggcggggcgcgggcataaagg

SEQ ID NO: 20540 - DNA, 21 bp, Homo sapiens
cgcgcgcgtccggcacggagc

SEQ ID NO: 20541 - DNA, 22 bp, Homo sapiens
ttgatatttacttaaatcctga

SEQ ID NO: 20542 - DNA, 21 bp, Homo sapiens
ggggccgaggtatccaggagt

SEQ ID NO: 20543 - DNA, 22 bp, Homo sapiens
ttctaccttctggaagatgcct

SEQ ID NO: 20544 - DNA, 22 bp, Homo sapiens
agccacgattacatttgcacca

SEQ ID NO: 20545 - DNA, 23 bp, Homo sapiens
tgccccagtggtacctgacagca

SEQ ID NO: 20546 - DNA, 22 bp, Homo sapiens
cgtgccccctggctctggtgcc

SEQ ID NO: 20547 - DNA, 23 bp, Homo sapiens
caatccagtctgatgcctgtgca

SEQ ID NO: 20548 - DNA, 21 bp, Homo sapiens
cactgggcaccaagtctgtgt

SEQ ID NO: 20549 - DNA, 22 bp, Homo sapiens
gttcatagatttcgtgtgtgtg

SEQ ID NO: 20550 - DNA, 23 bp, Homo sapiens
gccacttaccaacccgcctggga

SEQ ID NO: 20551 - DNA, 22 bp, Homo sapiens
tggctcttaggacccgcgtcgc

SEQ ID NO: 20552 - DNA, 23 bp, Homo sapiens
caagccggtgctgggcgccgcga

SEQ ID NO: 20553 - DNA, 22 bp, Homo sapiens
tttcagtttgtaccattgtttg

SEQ ID NO: 20554 - DNA, 22 bp, Homo sapiens
ctcgcggtggttccgggctggt

SEQ ID NO: 20555 - DNA, 22 bp, Homo sapiens
cctgcccctccgccgttacctg

SEQ ID NO: 20556 - DNA, 20 bp, Homo sapiens
tgaggtagtagttgtcctac

SEQ ID NO: 20557 - DNA, 23 bp, Homo sapiens
accggtaagtttgatattcatgc

SEQ ID NO: 20558 - DNA, 22 bp, Homo sapiens
tgtcccagtttccacgtatcac

SEQ ID NO: 20559 - DNA, 24 bp, Homo sapiens
tcccggatctccgtgtcccgctct

SEQ ID NO: 20560 - DNA, 20 bp, Homo sapiens
tttgtttgcagtcctctgtt

SEQ ID NO: 20561 - DNA, 22 bp, Homo sapiens
caaatcagactcctccaatcct

SEQ ID NO: 20562 - DNA, 24 bp, Homo sapiens
cggctgggagccgaggcgtcggtg

SEQ ID NO: 20563 - DNA, 23 bp, Homo sapiens
cagtagatgcggaagttagcaga

SEQ ID NO: 20564 - DNA, 22 bp, Homo sapiens
tgctgacatctatctcctggac

SEQ ID NO: 20565 - DNA, 24 bp, Homo sapiens
gctaaaggatattttgggttcaga

SEQ ID NO: 20566 - DNA, 21 bp, Homo sapiens
aacccctatgttaccagacga

SEQ ID NO: 20567 - DNA, 23 bp, Homo sapiens
tcgccgttggcagcagcagcagc

SEQ ID NO: 20568 - DNA, 22 bp, Homo sapiens
cgcagttacttttgcaacaacc

SEQ ID NO: 20569 - DNA, 23 bp, Homo sapiens
tctggggccctgggcagacctcc

SEQ ID NO: 20570 - DNA, 22 bp, Homo sapiens
accagggctccgcgctccgcac

SEQ ID NO: 20571 - DNA, 22 bp, Homo sapiens
ccattgctttccatgtagacct

SEQ ID NO: 20572 - DNA, 23 bp, Homo sapiens
gtcctctaggccagcgagccccg

SEQ ID NO: 20573 - DNA, 22 bp, Homo sapiens
ccccctctccccctctcccacc

SEQ ID NO: 20574 - DNA, 22 bp, Homo sapiens
ggggagagagaaggggcggggc

SEQ ID NO: 20575 - DNA, 20 bp, Homo sapiens
cccgatgcggaggcgggtcc

SEQ ID NO: 20576 - DNA, 22 bp, Homo sapiens
gacagaccttagaggagccagg

SEQ ID NO: 20577 - DNA, 20 bp, Homo sapiens
tggcccggcgtcgcctctgc

SEQ ID NO: 20578 - DNA, 23 bp, Homo sapiens
gccccgcgctccgcaccgcgccc

SEQ ID NO: 20579 - DNA, 21 bp, Homo sapiens
cagcgcctccctcccgccgct

SEQ ID NO: 20580 - DNA, 21 bp, Homo sapiens
cccggggccctccctccagag

SEQ ID NO: 20581 - DNA, 23 bp, Homo sapiens
ctcctcctgctcggcctgagctg

SEQ ID NO: 20582 - DNA, 24 bp, Homo sapiens
tgggcaggagatgccgtggacccc

SEQ ID NO: 20583 - DNA, 22 bp, Homo sapiens
ttctccactagggcaccagaca

SEQ ID NO: 20584 - DNA, 23 bp, Homo sapiens
gtctgtggggaccagaggctggt

SEQ ID NO: 20585 - DNA, 21 bp, Homo sapiens
acagcacttacttttgcacca

SEQ ID NO: 20586 - DNA, 23 bp, Homo sapiens
tgtcctaccttcctctctccagc

SEQ ID NO: 20587 - DNA, 22 bp, Homo sapiens
tgcgcgggtgggggggcggggc

SEQ ID NO: 20588 - DNA, 23 bp, Homo sapiens
ggtcgagggtgacccgggggacg

SEQ ID NO: 20589 - DNA, 22 bp, Homo sapiens
tcctcctctgtctccccccagg

SEQ ID NO: 20590 - DNA, 23 bp, Homo sapiens
tctatgagagtaccgtttccctt

SEQ ID NO: 20591 - DNA, 23 bp, Homo sapiens
tccttccccaccctcgcccgact

SEQ ID NO: 20592 - DNA, 21 bp, Homo sapiens
tggcgcgctctgagggaggag

SEQ ID NO: 20593 - DNA, 22 bp, Homo sapiens
ccagcatccgcatcacctccat

SEQ ID NO: 20594 - DNA, 22 bp, Homo sapiens
ccccggggcccggcggcgactt

SEQ ID NO: 20595 - DNA, 21 bp, Homo sapiens
cttgagaatcggaaggcccag

SEQ ID NO: 20596 - DNA, 23 bp, Homo sapiens
ctcgcgtccccgctccctcctcc

SEQ ID NO: 20597 - DNA, 22 bp, Homo sapiens
gtgcccagcctggtttgccttc

SEQ ID NO: 20598 - DNA, 22 bp, Homo sapiens
ctacagaactctgtagagtgct

SEQ ID NO: 20599 - DNA, 24 bp, Homo sapiens
cgcagcgggccgggcgggccagga

SEQ ID NO: 20600 - DNA, 22 bp, Homo sapiens
atcagcattgtgacttgcatga

SEQ ID NO: 20601 - DNA, 23 bp, Homo sapiens
tggcccccgcggctgccctcgct

SEQ ID NO: 20602 - DNA, 23 bp, Homo sapiens
accgcttccctgcagtgccccga

SEQ ID NO: 20603 - DNA, 23 bp, Homo sapiens
gacgctggctcgctccctccctc

SEQ ID NO: 20604 - DNA, 22 bp, Homo sapiens
tccattccctttgttaggtcct

SEQ ID NO: 20605 - DNA, 23 bp, Homo sapiens
catatgaaatgagccagcacaga

SEQ ID NO: 20606 - DNA, 22 bp, Homo sapiens
cgctgctctagctgccgtcagt

SEQ ID NO: 20607 - DNA, 21 bp, Homo sapiens
ccgcggcgcgccgggcccggg

SEQ ID NO: 20608 - DNA, 20 bp, Homo sapiens
cccttctggagtgtagctgc

SEQ ID NO: 20609 - DNA, 23 bp, Homo sapiens
ttaaccagcttgtcactctgtgc

SEQ ID NO: 20610 - DNA, 23 bp, Homo sapiens
tctctggtctggaagattcctca

SEQ ID NO: 20611 - DNA, 20 bp, Homo sapiens
cccggccggcgccggcagtc

SEQ ID NO: 20612 - DNA, 23 bp, Homo sapiens
gtgcagaggtgaaatatggggtt

SEQ ID NO: 20613 - DNA, 20 bp, Homo sapiens
agactccggagggtagagcg

SEQ ID NO: 20614 - DNA, 23 bp, Homo sapiens
ctatgttgcccatggctggtgtt

SEQ ID NO: 20615 - DNA, 24 bp, Homo sapiens
ggtgcttggttcgaggtggccgtt

SEQ ID NO: 20616 - DNA, 23 bp, Homo sapiens
gagccgagccgagccgagcgggc

SEQ ID NO: 20617 - DNA, 23 bp, Homo sapiens
tccccaccctccgcttcctctgc

SEQ ID NO: 20618 - DNA, 23 bp, Homo sapiens
tcagagagatgccgccttgctcc

SEQ ID NO: 20619 - DNA, 22 bp, Homo sapiens
tgtccgcctctccctgtgccgt

SEQ ID NO: 20620 - DNA, 22 bp, Homo sapiens
gactatagaactttccccctca

SEQ ID NO: 20621 - DNA, 24 bp, Homo sapiens
agggggaaagttctatagtcctga

SEQ ID NO: 20622 - DNA, 21 bp, Homo sapiens
ctcggctggctgtggcccgcg

SEQ ID NO: 20623 - DNA, 23 bp, Homo sapiens
gccgaggggaggagggcgcccgg

SEQ ID NO: 20624 - DNA, 22 bp, Homo sapiens
ttggttggaccttggggctgga

SEQ ID NO: 20625 - DNA, 20 bp, Homo sapiens
gtgcctcaaacatgaaaact

SEQ ID NO: 20626 - DNA, 22 bp, Homo sapiens
accgccctggcctgtagaagct

SEQ ID NO: 20627 - DNA, 21 bp, Homo sapiens
cgggttgcgggtaggactgga

SEQ ID NO: 20628 - DNA, 21 bp, Homo sapiens
ctgggctctcaggggaggtga

SEQ ID NO: 20629 - DNA, 23 bp, Homo sapiens
tggccgatacttcctgcccacga

SEQ ID NO: 20630 - DNA, 24 bp, Homo sapiens
ctgcacagtggctccctggggatg

SEQ ID NO: 20631 - DNA, 22 bp, Homo sapiens
gggcgcgggcggccggccatga

SEQ ID NO: 20632 - DNA, 23 bp, Homo sapiens
cagccggagcaggagcgccgaga

SEQ ID NO: 20633 - DNA, 22 bp, Homo sapiens
ccaccctgctacgcactcccta

SEQ ID NO: 20634 - DNA, 20 bp, Homo sapiens
agtgcgtagcagggtggagt

SEQ ID NO: 20635 - DNA, 23 bp, Homo sapiens
tgcgcgcccgaccgggcccaacc

SEQ ID NO: 20636 - DNA, 23 bp, Homo sapiens
cctgcctcgctctcccaaagtgt

SEQ ID NO: 20637 - DNA, 22 bp, Homo sapiens
tgtatctgcatgtgtgttatgt

SEQ ID NO: 20638 - DNA, 24 bp, Homo sapiens
gcaggagccggggttccggccgcg

SEQ ID NO: 20639 - DNA, 22 bp, Homo sapiens
agctgctcatgccccaggtagc

SEQ ID NO: 20640 - DNA, 22 bp, Homo sapiens
tccggagttgtaagtgttgaca

SEQ ID NO: 20641 - DNA, 24 bp, Homo sapiens
agccagcctagagccccagcggga

SEQ ID NO: 20642 - DNA, 22 bp, Homo sapiens
tactgggatatttggagcttct

SEQ ID NO: 20643 - DNA, 22 bp, Homo sapiens
agagctccagatatcccagtat

SEQ ID NO: 20644 - DNA, 24 bp, Homo sapiens
gccagggcccgcaggaggggaagc

SEQ ID NO: 20645 - DNA, 22 bp, Homo sapiens
tgtcactcctctcccttctccc

SEQ ID NO: 20646 - DNA, 21 bp, Homo sapiens
actcaggtggtgcaaggaagg

SEQ ID NO: 20647 - DNA, 22 bp, Homo sapiens
tggctctgggatctgttggaca

SEQ ID NO: 20648 - DNA, 21 bp, Homo sapiens
ccccagtttgcctgggactga

SEQ ID NO: 20649 - DNA, 22 bp, Homo sapiens
accagctgtcgtttctccctta

SEQ ID NO: 20650 - DNA, 23 bp, Homo sapiens
cttcactgcatactccagcctgg

SEQ ID NO: 20651 - DNA, 23 bp, Homo sapiens
cttgctctgctctcccttgtact

SEQ ID NO: 20652 - DNA, 22 bp, Homo sapiens
tgcagaggagacaaagcaagcc

SEQ ID NO: 20653 - DNA, 22 bp, Homo sapiens
cccgctccccccgggcccgcgg

SEQ ID NO: 20654 - DNA, 22 bp, Homo sapiens
cagcagcagcctgcaccccgcc

SEQ ID NO: 20655 - DNA, 24 bp, Homo sapiens
ctgcctcttccctctgccatcagc

SEQ ID NO: 20656 - DNA, 20 bp, Homo sapiens
cgctccatccctctctggca

SEQ ID NO: 20657 - DNA, 23 bp, Homo sapiens
agccccgccaacgacctcccgcg

SEQ ID NO: 20658 - DNA, 22 bp, Homo sapiens
gggcctgatgtggtgctggggc

SEQ ID NO: 20659 - DNA, 20 bp, Homo sapiens
ggggcacaagacagagaagc

SEQ ID NO: 20660 - DNA, 23 bp, Homo sapiens
aagttgcccgtgtttttttcgct

SEQ ID NO: 20661 - DNA, 21 bp, Homo sapiens
tcggtggacctcagaacatgt

SEQ ID NO: 20662 - DNA, 20 bp, Homo sapiens
taacctttggtacttggaga

SEQ ID NO: 20663 - DNA, 22 bp, Homo sapiens
ggttgtccatggtgtgttcatt

SEQ ID NO: 20664 - DNA, 22 bp, Homo sapiens
agcggacggtccggcttccggc

SEQ ID NO: 20665 - DNA, 21 bp, Homo sapiens
cacgcccgggcgtgggggcct

SEQ ID NO: 20666 - DNA, 23 bp, Homo sapiens
gggtgcatggtaaacacgtgctg

SEQ ID NO: 20667 - DNA, 23 bp, Homo sapiens
gccgtgtttaccatgtcactgct

SEQ ID NO: 20668 - DNA, 21 bp, Homo sapiens
cgcggccggatcgcagggcgg

SEQ ID NO: 20669 - DNA, 23 bp, Homo sapiens
ccaacgggcgctcctgaccacca

SEQ ID NO: 20670 - DNA, 22 bp, Homo sapiens
ctcttgcttccaagatgaccga

SEQ ID NO: 20671 - DNA, 24 bp, Homo sapiens
ttagttcccactggctgtgtaacc

SEQ ID NO: 20672 - DNA, 22 bp, Homo sapiens
ccgcgctgctggaaatcgtgga

SEQ ID NO: 20673 - DNA, 24 bp, Homo sapiens
agaccgacctcaaccccgacaacc

SEQ ID NO: 20674 - DNA, 24 bp, Homo sapiens
ccctagcatccctggactcccacc

SEQ ID NO: 20675 - DNA, 22 bp, Homo sapiens
tccgactccgcagccgcgatga

SEQ ID NO: 20676 - DNA, 21 bp, Homo sapiens
aggctgtcgggctggggctga

SEQ ID NO: 20677 - DNA, 22 bp, Homo sapiens
gggatgggcccttgtctgaggc

SEQ ID NO: 20678 - DNA, 22 bp, Homo sapiens
agtggttcttaacagttcaaca

SEQ ID NO: 20679 - DNA, 22 bp, Homo sapiens
ctgggcttgtggggacccctgg

SEQ ID NO: 20680 - DNA, 21 bp, Homo sapiens
tgaccccgccctccccacaga

SEQ ID NO: 20681 - DNA, 23 bp, Homo sapiens
tgggggccctgggcaggggtaag

SEQ ID NO: 20682 - DNA, 20 bp, Homo sapiens
gggtgtgaggggggtttagg

SEQ ID NO: 20683 - DNA, 20 bp, Homo sapiens
tccgtcccggggctgatgag

SEQ ID NO: 20684 - DNA, 21 bp, Homo sapiens
tctccgcgccccggccccgcg

SEQ ID NO: 20685 - DNA, 23 bp, Homo sapiens
ggctccgggcgctgcccgcgcgg

SEQ ID NO: 20686 - DNA, 23 bp, Homo sapiens
gacgcagggaggtggcaaggagg

SEQ ID NO: 20687 - DNA, 24 bp, Homo sapiens
tggctgagctgagaaccactgtgc

SEQ ID NO: 20688 - DNA, 22 bp, Homo sapiens
ccagctggtgtgccaattcccc

SEQ ID NO: 20689 - DNA, 24 bp, Homo sapiens
cgcgggtgggggcggcgcgccgcg

SEQ ID NO: 20690 - DNA, 22 bp, Homo sapiens
tgagttgccggcgccggctgag

SEQ ID NO: 20691 - DNA, 23 bp, Homo sapiens
tctccgcctcccgcgcgccccgc

SEQ ID NO: 20692 - DNA, 22 bp, Homo sapiens
tctccagggaggggtcagacgt

SEQ ID NO: 20693 - DNA, 22 bp, Homo sapiens
ttcactgcctccgaagcgagcg

SEQ ID NO: 20694 - DNA, 24 bp, Homo sapiens
gccgccgcagcccgcggtgaccga

SEQ ID NO: 20695 - DNA, 23 bp, Homo sapiens
ctgacctgtcttcactaaactct

SEQ ID NO: 20696 - DNA, 22 bp, Homo sapiens
gacctgtcttcattaaactctt

SEQ ID NO: 20697 - DNA, 23 bp, Homo sapiens
tacaatgtaagaagtcactcact

SEQ ID NO: 20698 - DNA, 21 bp, Homo sapiens
tccgcgccgggagctagctcc

SEQ ID NO: 20699 - DNA, 22 bp, Homo sapiens
ggggtggggtcggtggggctgg

SEQ ID NO: 20700 - DNA, 23 bp, Homo sapiens
gcccagcctctccaggccgaaag

SEQ ID NO: 20701 - DNA, 22 bp, Homo sapiens
ccacggggagagcacagccacc

SEQ ID NO: 20702 - DNA, 23 bp, Homo sapiens
cgcacgggcccggccctcccacg

SEQ ID NO: 20703 - DNA, 20 bp, Homo sapiens
gatcacctcaggccaaacgt

SEQ ID NO: 20704 - DNA, 20 bp, Homo sapiens
tagcaggcagcagtggggtg

SEQ ID NO: 20705 - DNA, 24 bp, Homo sapiens
ccccagctggaggccttctcccca

SEQ ID NO: 20706 - DNA, 23 bp, Homo sapiens
gaacagctgggcttccctccttc

SEQ ID NO: 20707 - DNA, 23 bp, Homo sapiens
aagctgacactttgaaaacatgc

SEQ ID NO: 20708 - DNA, 22 bp, Homo sapiens
gctcctgccagggtccttaggt

SEQ ID NO: 20709 - DNA, 22 bp, Homo sapiens
tcagtccagtcatctcccttca

SEQ ID NO: 20710 - DNA, 22 bp, Homo sapiens
acatcctacttccctgtcctca

SEQ ID NO: 20711 - DNA, 23 bp, Homo sapiens
tccgggaccccagagggagtcgt

SEQ ID NO: 20712 - DNA, 22 bp, Homo sapiens
tggaaacatttctgcacaaact

SEQ ID NO: 20713 - DNA, 23 bp, Homo sapiens
agccgccattgtcgcgctcggag

SEQ ID NO: 20714 - DNA, 24 bp, Homo sapiens
ttgctgtgatgatgttctgagctc

SEQ ID NO: 20715 - DNA, 23 bp, Homo sapiens
cgcgccgctcacgtggtccgtcc

SEQ ID NO: 20716 - DNA, 22 bp, Homo sapiens
tgtgaccctagaataattactc

SEQ ID NO: 20717 - DNA, 24 bp, Homo sapiens
ggaaccgagcctcggcttgcggcc

SEQ ID NO: 20718 - DNA, 21 bp, Homo sapiens
cgcgaacctggcgttcccagt

SEQ ID NO: 20719 - DNA, 22 bp, Homo sapiens
gaccggaccggagggcgggcga

SEQ ID NO: 20720 - DNA, 22 bp, Homo sapiens
caggcccgcgccaccgcccggg

SEQ ID NO: 20721 - DNA, 23 bp, Homo sapiens
ttctacagccctgagggacacta

SEQ ID NO: 20722 - DNA, 22 bp, Homo sapiens
tagcagtatagtcttagagtta

SEQ ID NO: 20723 - DNA, 21 bp, Homo sapiens
gtagaaagccccggggacaag

SEQ ID NO: 20724 - DNA, 24 bp, Homo sapiens
cggcggcggggccgggagcgagcg

SEQ ID NO: 20725 - DNA, 22 bp, Homo sapiens
ctcggcctttgctcgcagcact

SEQ ID NO: 20726 - DNA, 23 bp, Homo sapiens
tcatccccagaaaggacttggtg

SEQ ID NO: 20727 - DNA, 23 bp, Homo sapiens
ccttccccgcaaagcacacgacc

SEQ ID NO: 20728 - DNA, 24 bp, Homo sapiens
ttggttggtgctgtcattggaggc

SEQ ID NO: 20729 - DNA, 22 bp, Homo sapiens
atcacttaatgtttcctctagt

SEQ ID NO: 20730 - DNA, 21 bp, Homo sapiens
ctgagcagggcgcccggctgc

SEQ ID NO: 20731 - DNA, 22 bp, Homo sapiens
cctccgacacccgcagcaactt

SEQ ID NO: 20732 - DNA, 21 bp, Homo sapiens
cctcccacccacagggcgagt

SEQ ID NO: 20733 - DNA, 22 bp, Homo sapiens
gtgcaatgtctgcagcgcgcgc

SEQ ID NO: 20734 - DNA, 24 bp, Homo sapiens
ctggccctgcgggcagagcacagc

SEQ ID NO: 20735 - DNA, 23 bp, Homo sapiens
ccctaccggctctaccgcgcaca

SEQ ID NO: 20736 - DNA, 20 bp, Homo sapiens
tcagcttctatattaccgca

SEQ ID NO: 20737 - DNA, 23 bp, Homo sapiens
gcaccggccgggcggggcggaga

SEQ ID NO: 20738 - DNA, 24 bp, Homo sapiens
ggcaggcggcggtccccggcaggg

SEQ ID NO: 20739 - DNA, 24 bp, Homo sapiens
ccgccgacctccggtgcagcctct

SEQ ID NO: 20740 - DNA, 22 bp, Homo sapiens
ctgcgcccgctcgccggcctca

SEQ ID NO: 20741 - DNA, 20 bp, Homo sapiens
cggggcctgccgcggtcgcc

SEQ ID NO: 20742 - DNA, 23 bp, Homo sapiens
ttccgttccccatttcgattgca

SEQ ID NO: 20743 - DNA, 22 bp, Homo sapiens
ccctgagggtgagtgcctcctt

SEQ ID NO: 20744 - DNA, 21 bp, Homo sapiens
gaggcactgactctcagggct

SEQ ID NO: 20745 - DNA, 23 bp, Homo sapiens
ctgggcccgcccgcccgctgggg

SEQ ID NO: 20746 - DNA, 21 bp, Homo sapiens
gttctcccaacgtaaacccag

SEQ ID NO: 20747 - DNA, 20 bp, Homo sapiens
tgggcttacgttgggagaac

SEQ ID NO: 20748 - DNA, 21 bp, Homo sapiens
aggcagtcactcaatatagct

SEQ ID NO: 20749 - DNA, 22 bp, Homo sapiens
tttgttatttctgtattcaaga

SEQ ID NO: 20750 - DNA, 23 bp, Homo sapiens
actgcttgagcccaggactacat

SEQ ID NO: 20751 - DNA, 22 bp, Homo sapiens
ctagtcctaaccaagcatgtct

SEQ ID NO: 20752 - DNA, 22 bp, Homo sapiens
cggcaggaggaggacggggaag

SEQ ID NO: 20753 - DNA, 23 bp, Homo sapiens
acacacacacaacatgcacatgc

SEQ ID NO: 20754 - DNA, 21 bp, Homo sapiens
acctgagatccccatctgacc

SEQ ID NO: 20755 - DNA, 24 bp, Homo sapiens
tggaccgatcctgactgaggcaga

SEQ ID NO: 20756 - DNA, 24 bp, Homo sapiens
agcgcaccgcgcgcccgcgtccct

SEQ ID NO: 20757 - DNA, 21 bp, Homo sapiens
gccccgccgcgcgccgggcag

SEQ ID NO: 20758 - DNA, 24 bp, Homo sapiens
cctccagccctgctgctccccagt

SEQ ID NO: 20759 - DNA, 23 bp, Homo sapiens
tggcctgccctcacctgtctagg

SEQ ID NO: 20760 - DNA, 20 bp, Homo sapiens
atcgcgcggatgccagaacg

SEQ ID NO: 20761 - DNA, 20 bp, Homo sapiens
tgggccaccgcgcgcagggg

SEQ ID NO: 20762 - DNA, 23 bp, Homo sapiens
ccgctgggcgagcgccgcagcga

SEQ ID NO: 20763 - DNA, 24 bp, Homo sapiens
gcggcggcggcggcggtgggtcct

SEQ ID NO: 20764 - DNA, 21 bp, Homo sapiens
tctaaggtgagcgctggcagg

SEQ ID NO: 20765 - DNA, 22 bp, Homo sapiens
ccttatcacttttccagcccag

SEQ ID NO: 20766 - DNA, 21 bp, Homo sapiens
ccgcgccgctgggggctctga

SEQ ID NO: 20767 - DNA, 23 bp, Homo sapiens
agctcatccatagttgtcactgt

SEQ ID NO: 20768 - DNA, 22 bp, Homo sapiens
gacaactatggatgagctctca

SEQ ID NO: 20769 - DNA, 23 bp, Homo sapiens
agctcatccatagttgtcactga

SEQ ID NO: 20770 - DNA, 22 bp, Homo sapiens
ccaggctgcagggccgggcccc

SEQ ID NO: 20771 - DNA, 23 bp, Homo sapiens
ggagcagcagcggtgaaggccct

SEQ ID NO: 20772 - DNA, 20 bp, Homo sapiens
ccaacatgcttcccaaaggt

SEQ ID NO: 20773 - DNA, 22 bp, Homo sapiens
atctgcattttaattcacatgc

SEQ ID NO: 20774 - DNA, 22 bp, Homo sapiens
gccgcttgcgggtgagctctgc

SEQ ID NO: 20775 - DNA, 21 bp, Homo sapiens
cttggcaggagctgtagctac

SEQ ID NO: 20776 - DNA, 24 bp, Homo sapiens
ctctgccgggtcgcgccggacgac

SEQ ID NO: 20777 - DNA, 22 bp, Homo sapiens
gccgctgggggtttggggcggc

SEQ ID NO: 20778 - DNA, 21 bp, Homo sapiens
cagctgtaaaatacctcttgc

SEQ ID NO: 20779 - DNA, 24 bp, Homo sapiens
attgcgagtcaccgagtttcccgc

SEQ ID NO: 20780 - DNA, 23 bp, Homo sapiens
ggcggcgtgggcgcggtgatgca

SEQ ID NO: 20781 - DNA, 22 bp, Homo sapiens
tgaaaggggccgccttatctga

SEQ ID NO: 20782 - DNA, 22 bp, Homo sapiens
cagggagccccaagcaggcgca

SEQ ID NO: 20783 - DNA, 21 bp, Homo sapiens
ctttcactacttctctgacag

SEQ ID NO: 20784 - DNA, 21 bp, Homo sapiens
ccggcccgggtccgagccgcg

SEQ ID NO: 20785 - DNA, 24 bp, Homo sapiens
ttagtctagcacctggtcaattca

SEQ ID NO: 20786 - DNA, 22 bp, Homo sapiens
aactgatctcggagttaaggcg

SEQ ID NO: 20787 - DNA, 22 bp, Homo sapiens
cacgcgccgcgtcaccgggccg

SEQ ID NO: 20788 - DNA, 24 bp, Homo sapiens
tcacgcttcttgcccaggtggtct

SEQ ID NO: 20789 - DNA, 22 bp, Homo sapiens
cgctcggcgtcggtgcctgagg

SEQ ID NO: 20790 - DNA, 23 bp, Homo sapiens
cggcctcgtactcgcgcgtgcac

SEQ ID NO: 20791 - DNA, 22 bp, Homo sapiens
ccgccggcctcgccccgcagcc

SEQ ID NO: 20792 - DNA, 21 bp, Homo sapiens
gatgccctcgccctccctagt

SEQ ID NO: 20793 - DNA, 22 bp, Homo sapiens
ctcgggtgagtggggccgcgcg

SEQ ID NO: 20794 - DNA, 22 bp, Homo sapiens
cccggcagcctcgggccacact

SEQ ID NO: 20795 - DNA, 21 bp, Homo sapiens
ttggggtagatccgggtcctg

SEQ ID NO: 20796 - DNA, 22 bp, Homo sapiens
agggtgacggcatggtcccagg

SEQ ID NO: 20797 - DNA, 23 bp, Homo sapiens
gagcctggccgggggccggggtc

SEQ ID NO: 20798 - DNA, 21 bp, Homo sapiens
tcgggctgcggggctccggct

SEQ ID NO: 20799 - DNA, 22 bp, Homo sapiens
ccgctggtccctgccttccagc

SEQ ID NO: 20800 - DNA, 21 bp, Homo sapiens
accccggcgcgcggcgggcgg

SEQ ID NO: 20801 - DNA, 21 bp, Homo sapiens
gagccaccatgccccgtgaga

SEQ ID NO: 20802 - DNA, 23 bp, Homo sapiens
tcttctggggcccagaggctgga

SEQ ID NO: 20803 - DNA, 21 bp, Homo sapiens
cgcgcggagcgggctccggag

SEQ ID NO: 20804 - DNA, 21 bp, Homo sapiens
cccggccccgcgccaggcgca

SEQ ID NO: 20805 - DNA, 22 bp, Homo sapiens
ccaccgccatcccctcctcagg

SEQ ID NO: 20806 - DNA, 22 bp, Homo sapiens
gcctggccacacctcctccagc

SEQ ID NO: 20807 - DNA, 22 bp, Homo sapiens
tccctgaggccctgtctgtgtc

SEQ ID NO: 20808 - DNA, 23 bp, Homo sapiens
gagccggccgcctgccttccagg

SEQ ID NO: 20809 - DNA, 20 bp, Homo sapiens
gccggcttcgctagggtgag

SEQ ID NO: 20810 - DNA, 20 bp, Homo sapiens
gacagctctcccacccctcc

SEQ ID NO: 20811 - DNA, 23 bp, Homo sapiens
ctccctgtgccctcccctgcaga

SEQ ID NO: 20812 - DNA, 22 bp, Homo sapiens
cgacctcggccctgcccttgca

SEQ ID NO: 20813 - DNA, 24 bp, Homo sapiens
cggacggaggtagaggccagggca

SEQ ID NO: 20814 - DNA, 21 bp, Homo sapiens
cggctagagcggtggccctga

SEQ ID NO: 20815 - DNA, 21 bp, Homo sapiens
gtcgcgcttccggcggcgtcc

SEQ ID NO: 20816 - DNA, 22 bp, Homo sapiens
gcctggtggtgctcggggtagc

SEQ ID NO: 20817 - DNA, 22 bp, Homo sapiens
cgccacccctctccggcagggc

SEQ ID NO: 20818 - DNA, 21 bp, Homo sapiens
tgcttccgcggggatttctga

SEQ ID NO: 20819 - DNA, 21 bp, Homo sapiens
accccgaccaggacacgccca

SEQ ID NO: 20820 - DNA, 24 bp, Homo sapiens
cctgactgcgcccttggcccccag

SEQ ID NO: 20821 - DNA, 23 bp, Homo sapiens
gggcggcggcggccggcgggcgg

SEQ ID NO: 20822 - DNA, 21 bp, Homo sapiens
ctgggcagccccgtgtgttga

SEQ ID NO: 20823 - DNA, 22 bp, Homo sapiens
tggagctatgcacaggccgtgg

SEQ ID NO: 20824 - DNA, 23 bp, Homo sapiens
tcatcagccgggagaagcggggc

SEQ ID NO: 20825 - DNA, 24 bp, Homo sapiens
ggctgaggcgggcggaccggcgag

SEQ ID NO: 20826 - DNA, 23 bp, Homo sapiens
gacgtggccgctcacgctccaga

SEQ ID NO: 20827 - DNA, 22 bp, Homo sapiens
aggagaagtggcaggtcacgct

SEQ ID NO: 20828 - DNA, 22 bp, Homo sapiens
aggcgatccagatccagaacgc

SEQ ID NO: 20829 - DNA, 24 bp, Homo sapiens
cgggtcggggtggcggcggcggcc

SEQ ID NO: 20830 - DNA, 23 bp, Homo sapiens
cccagccaggccccaccaggaat

SEQ ID NO: 20831 - DNA, 22 bp, Homo sapiens
ctggtcccccgcgccgctctgc

SEQ ID NO: 20832 - DNA, 22 bp, Homo sapiens
tcggggaccgagcctgaagcct

SEQ ID NO: 20833 - DNA, 23 bp, Homo sapiens
catgtgtctgtgtctgcccagcc

SEQ ID NO: 20834 - DNA, 20 bp, Homo sapiens
cgcgcccctcctcctcgccc

SEQ ID NO: 20835 - DNA, 20 bp, Homo sapiens
gtgcctggggactccgtgtg

SEQ ID NO: 20836 - DNA, 23 bp, Homo sapiens
tggtgactctgctccttcccagg

SEQ ID NO: 20837 - DNA, 22 bp, Homo sapiens
cgaccgccgggtctgtcccgca

SEQ ID NO: 20838 - DNA, 23 bp, Homo sapiens
caggttggggcccaggaatctgc

SEQ ID NO: 20839 - DNA, 22 bp, Homo sapiens
cccggtgcccgcacgcgtgcgt

SEQ ID NO: 20840 - DNA, 22 bp, Homo sapiens
tctcagtggtgacctttggggc

SEQ ID NO: 20841 - DNA, 23 bp, Homo sapiens
ccggagcatgcgcgagagccgcc

SEQ ID NO: 20842 - DNA, 21 bp, Homo sapiens
gacgccggggcgcggggacca

SEQ ID NO: 20843 - DNA, 22 bp, Homo sapiens
agcttgtcggatgtgcagattt

SEQ ID NO: 20844 - DNA, 24 bp, Homo sapiens
ccgcctccctgggcctgcctgggc

SEQ ID NO: 20845 - DNA, 20 bp, Homo sapiens
tttctgcgaccaatcagact

SEQ ID NO: 20846 - DNA, 21 bp, Homo sapiens
ccatgctgagaatcgctgttc

SEQ ID NO: 20847 - DNA, 20 bp, Homo sapiens
gcggaggaggaggaggacgg

SEQ ID NO: 20848 - DNA, 21 bp, Homo sapiens
ctgtctcttttctctttaggt

SEQ ID NO: 20849 - DNA, 23 bp, Homo sapiens
attggtggctagatttggggtgc

SEQ ID NO: 20850 - DNA, 21 bp, Homo sapiens
cttgggaactcttaatatgtc

SEQ ID NO: 20851 - DNA, 20 bp, Homo sapiens
gtactgacgctcatgctcag

SEQ ID NO: 20852 - DNA, 22 bp, Homo sapiens
ggactgggtgagggtgttggtt

SEQ ID NO: 20853 - DNA, 20 bp, Homo sapiens
cgggtcggtgtagaaaatgg

SEQ ID NO: 20854 - DNA, 21 bp, Homo sapiens
tacatcggttgagaatgtcct

SEQ ID NO: 20855 - DNA, 22 bp, Homo sapiens
tcccggggccgctggccacctc

SEQ ID NO: 20856 - DNA, 20 bp, Homo sapiens
tctccgcgacccggccctgg

SEQ ID NO: 20857 - DNA, 23 bp, Homo sapiens
tctctttctttccttcccacaga

SEQ ID NO: 20858 - DNA, 21 bp, Homo sapiens
cccggacggaggatgggggga

SEQ ID NO: 20859 - DNA, 21 bp, Homo sapiens
ccccgcctctctcggccccgc

SEQ ID NO: 20860 - DNA, 24 bp, Homo sapiens
agcccaaagcacttggctgccctg

SEQ ID NO: 20861 - DNA, 21 bp, Homo sapiens
tgtcccctatcgatcctgtcc

SEQ ID NO: 20862 - DNA, 20 bp, Homo sapiens
ccccggcggccgagcccctc

SEQ ID NO: 20863 - DNA, 20 bp, Homo sapiens
caaccctggtgagctccaag

SEQ ID NO: 20864 - DNA, 24 bp, Homo sapiens
tcctctgtcctctccctttcccag

SEQ ID NO: 20865 - DNA, 23 bp, Homo sapiens
ccttcccctctgtttcctgtatc

SEQ ID NO: 20866 - DNA, 23 bp, Homo sapiens
cgaggccccatggcgccgccccc

SEQ ID NO: 20867 - DNA, 20 bp, Homo sapiens
cggcggctccagggacctgg

SEQ ID NO: 20868 - DNA, 22 bp, Homo sapiens
ggagcagcggcgccgccgaggt

SEQ ID NO: 20869 - DNA, 23 bp, Homo sapiens
tgtctgccatcctgccccacagc

SEQ ID NO: 20870 - DNA, 22 bp, Homo sapiens
cgcgaggctgtcggcgcgcgcc

SEQ ID NO: 20871 - DNA, 21 bp, Homo sapiens
agccaggcctctcctgcccca

SEQ ID NO: 20872 - DNA, 24 bp, Homo sapiens
cccccgggcagcagctggcccagg

SEQ ID NO: 20873 - DNA, 24 bp, Homo sapiens
cctcctgtcctgtccccctgccca

SEQ ID NO: 20874 - DNA, 20 bp, Homo sapiens
gggccgttcgggctggctcc

SEQ ID NO: 20875 - DNA, 21 bp, Homo sapiens
tgtccggctgggtggcttggc

SEQ ID NO: 20876 - DNA, 20 bp, Homo sapiens
gcggtgggcccgcgggggag

SEQ ID NO: 20877 - DNA, 23 bp, Homo sapiens
cgtcccggtcgccgcggttcgcc

SEQ ID NO: 20878 - DNA, 21 bp, Homo sapiens
ctgaaaccacaattgctttgc

SEQ ID NO: 20879 - DNA, 20 bp, Homo sapiens
gggggccggcggcggcgacg

SEQ ID NO: 20880 - DNA, 20 bp, Homo sapiens
cgccgccgtccccagcgctg

SEQ ID NO: 20881 - DNA, 22 bp, Homo sapiens
gggagcccggccggcgccggcg

SEQ ID NO: 20882 - DNA, 23 bp, Homo sapiens
cccagccccacatcttccagtga

SEQ ID NO: 20883 - DNA, 22 bp, Homo sapiens
actggcaaaagggtttagaact

SEQ ID NO: 20884 - DNA, 21 bp, Homo sapiens
cttccccgtcccgcgcgaggt

SEQ ID NO: 20885 - DNA, 22 bp, Homo sapiens
atgagtacgggatctctgtaga

SEQ ID NO: 20886 - DNA, 22 bp, Homo sapiens
actcgcgcgctgcgctggcctc

SEQ ID NO: 20887 - DNA, 21 bp, Homo sapiens
ttcccacactggcccaccagg

SEQ ID NO: 20888 - DNA, 20 bp, Homo sapiens
cttgttgatgtgctgcgcct

SEQ ID NO: 20889 - DNA, 23 bp, Homo sapiens
agcgcagggcagcaatgacgtcc

SEQ ID NO: 20890 - DNA, 22 bp, Homo sapiens
cccctccccgaggcccgcggcg

SEQ ID NO: 20891 - DNA, 23 bp, Homo sapiens
gtctggttggggggaaggctggc

SEQ ID NO: 20892 - DNA, 24 bp, Homo sapiens
ctgagcccctcctgcccccccact

SEQ ID NO: 20893 - DNA, 20 bp, Homo sapiens
gagcggcgtcaatcccacca

SEQ ID NO: 20894 - DNA, 21 bp, Homo sapiens
acctctgagccccggactccg

SEQ ID NO: 20895 - DNA, 23 bp, Homo sapiens
tgcggtccctccctctcctcagg

SEQ ID NO: 20896 - DNA, 21 bp, Homo sapiens
tggggctccaggcctgggtgc

SEQ ID NO: 20897 - DNA, 23 bp, Homo sapiens
acccagctgagccgctcacccag

SEQ ID NO: 20898 - DNA, 20 bp, Homo sapiens
cgctgtttctatcatggccg

SEQ ID NO: 20899 - DNA, 23 bp, Homo sapiens
aacagcagcaacatgggcctcgc

SEQ ID NO: 20900 - DNA, 20 bp, Homo sapiens
gccacggcaggtagcgagcg

SEQ ID NO: 20901 - DNA, 22 bp, Homo sapiens
aagcgcagtgctgcacaccacc

SEQ ID NO: 20902 - DNA, 22 bp, Homo sapiens
tccggacagccttccccccagt

SEQ ID NO: 20903 - DNA, 20 bp, Homo sapiens
gggcccggaggtgggactgg

SEQ ID NO: 20904 - DNA, 24 bp, Homo sapiens
atgttgggatgaggggagggtcga

SEQ ID NO: 20905 - DNA, 22 bp, Homo sapiens
tggaagggattgaagactttga

SEQ ID NO: 20906 - DNA, 20 bp, Homo sapiens
gccgggagcggcgggggcgg

SEQ ID NO: 20907 - DNA, 22 bp, Homo sapiens
gcaagaacttccattgtacatt

SEQ ID NO: 20908 - DNA, 20 bp, Homo sapiens
tccacagtggctaaaccttt

SEQ ID NO: 20909 - DNA, 21 bp, Homo sapiens
ggtcccgggtgcgcagcctgc

SEQ ID NO: 20910 - DNA, 21 bp, Homo sapiens
acttttgcagtttttgccagt

SEQ ID NO: 20911 - DNA, 24 bp, Homo sapiens
cgggcggcggcggcgggcggcggg

SEQ ID NO: 20912 - DNA, 21 bp, Homo sapiens
atcccagggccagtctccact

SEQ ID NO: 20913 - DNA, 21 bp, Homo sapiens
ctcccatagctgtgcttcagt

SEQ ID NO: 20914 - DNA, 20 bp, Homo sapiens
tgaggttcagccaggaggag

SEQ ID NO: 20915 - DNA, 20 bp, Homo sapiens
cccgggaatccggcccggct

SEQ ID NO: 20916 - DNA, 22 bp, Homo sapiens
gcacacacgtccattccctact

SEQ ID NO: 20917 - DNA, 23 bp, Homo sapiens
ccgccccccggccccgcgccccc

SEQ ID NO: 20918 - DNA, 21 bp, Homo sapiens
cagcatgagggctgtggatgc

SEQ ID NO: 20919 - DNA, 21 bp, Homo sapiens
aggaattggctgggtgttgtg

SEQ ID NO: 20920 - DNA, 21 bp, Homo sapiens
aggttcggtcttggagctccg

SEQ ID NO: 20921 - DNA, 22 bp, Homo sapiens
tcaaggggcagttaaagggagt

SEQ ID NO: 20922 - DNA, 21 bp, Homo sapiens
tcacgtctgcggctgtcacgt

SEQ ID NO: 20923 - DNA, 24 bp, Homo sapiens
agcgccctcgcagtggccgcctgc

SEQ ID NO: 20924 - DNA, 22 bp, Homo sapiens
acctccagccacagctcccagt

SEQ ID NO: 20925 - DNA, 23 bp, Homo sapiens
gggagagggggccgggggcgcgg

SEQ ID NO: 20926 - DNA, 23 bp, Homo sapiens
tcaccgggcgacctgcggccctg

SEQ ID NO: 20927 - DNA, 21 bp, Homo sapiens
ggtgagggtgtctgagcccac

SEQ ID NO: 20928 - DNA, 23 bp, Homo sapiens
tcggccgtgatgcctcacaccca

SEQ ID NO: 20929 - DNA, 21 bp, Homo sapiens
cggctgccccctgacccttgc

SEQ ID NO: 20930 - DNA, 24 bp, Homo sapiens
ccgagcccggccaggcccaccttc

SEQ ID NO: 20931 - DNA, 23 bp, Homo sapiens
tctcccagcacagccccctgacc

SEQ ID NO: 20932 - DNA, 20 bp, Homo sapiens
gcctgcgatgtagtcgatgc

SEQ ID NO: 20933 - DNA, 23 bp, Homo sapiens
tggcccctctgcccccacccaga

SEQ ID NO: 20934 - DNA, 23 bp, Homo sapiens
tgcccccgtgatcctgcacgtgg

SEQ ID NO: 20935 - DNA, 22 bp, Homo sapiens
cgctgtcttctggcgccgcacc

SEQ ID NO: 20936 - DNA, 24 bp, Homo sapiens
gcctatggtgcggggaggtagtag

SEQ ID NO: 20937 - DNA, 22 bp, Homo sapiens
acgtcgttaccaccgctgggtc

SEQ ID NO: 20938 - DNA, 24 bp, Homo sapiens
tcagcagacgtctggccgcagtga

SEQ ID NO: 20939 - DNA, 23 bp, Homo sapiens
ggggacagacaggtagcgccgtc

SEQ ID NO: 20940 - DNA, 24 bp, Homo sapiens
ctggagagaaaggcagtcagagga

SEQ ID NO: 20941 - DNA, 24 bp, Homo sapiens
gcagccccttcatcggggaccccc

SEQ ID NO: 20942 - DNA, 22 bp, Homo sapiens
tcaaagttgctaaaaccacgca

SEQ ID NO: 20943 - DNA, 24 bp, Homo sapiens
ccctaagccttatagcaacaccgt

SEQ ID NO: 20944 - DNA, 21 bp, Homo sapiens
gggactggcagccgggactga

SEQ ID NO: 20945 - DNA, 22 bp, Homo sapiens
ttggagagtgggcagcagagac

SEQ ID NO: 20946 - DNA, 23 bp, Homo sapiens
caagctcaagttgggcaccccac

SEQ ID NO: 20947 - DNA, 21 bp, Homo sapiens
ctgctgtgaagctgaaaccgg

SEQ ID NO: 20948 - DNA, 20 bp, Homo sapiens
cggagggggaggcccgcggc

SEQ ID NO: 20949 - DNA, 22 bp, Homo sapiens
taggcagcgactcccagacaga

SEQ ID NO: 20950 - DNA, 22 bp, Homo sapiens
caaccccgggctgatcactact

SEQ ID NO: 20951 - DNA, 21 bp, Homo sapiens
cacgacgaagacgcacaggca

SEQ ID NO: 20952 - DNA, 23 bp, Homo sapiens
ccccgcccccggagccccgccca

SEQ ID NO: 20953 - DNA, 23 bp, Homo sapiens
tcagggcctgctcccaccccgca

SEQ ID NO: 20954 - DNA, 23 bp, Homo sapiens
agggcgcagttccgggcgcgtct

SEQ ID NO: 20955 - DNA, 24 bp, Homo sapiens
agcgcccgggcccgcccctgagcc

SEQ ID NO: 20956 - DNA, 20 bp, Homo sapiens
cgccgcggagcccggcgggc

SEQ ID NO: 20957 - DNA, 24 bp, Homo sapiens
tggtgtcttgctctgtcaaccaga

SEQ ID NO: 20958 - DNA, 24 bp, Homo sapiens
ggacgcccgctcccgccaccatgg

SEQ ID NO: 20959 - DNA, 23 bp, Homo sapiens
tcctccgcgtccccgcccgccag

SEQ ID NO: 20960 - DNA, 22 bp, Homo sapiens
gaggcagtggcgggggaaggca

SEQ ID NO: 20961 - DNA, 24 bp, Homo sapiens
agcagcggctccagcagctccagg

SEQ ID NO: 20962 - DNA, 22 bp, Homo sapiens
ccccggggtgcagcctgctcag

SEQ ID NO: 20963 - DNA, 23 bp, Homo sapiens
accccggtgttttccccgccagc

SEQ ID NO: 20964 - DNA, 23 bp, Homo sapiens
ctaccctcctctctgcccctagt

SEQ ID NO: 20965 - DNA, 24 bp, Homo sapiens
cagggcaacccttcccttcccagg

SEQ ID NO: 20966 - DNA, 20 bp, Homo sapiens
cgcgcgggcgggagggcgca

SEQ ID NO: 20967 - DNA, 20 bp, Homo sapiens
ccccggggagccaggcggcg

SEQ ID NO: 20968 - DNA, 24 bp, Homo sapiens
tcctgtgctgtgggccgaagctgg

SEQ ID NO: 20969 - DNA, 22 bp, Homo sapiens
ccgtcggcccacagcctcctcc

SEQ ID NO: 20970 - DNA, 23 bp, Homo sapiens
tcggtccctaaccccctccggac

SEQ ID NO: 20971 - DNA, 23 bp, Homo sapiens
cccacacgctcgcgcccaccccc

SEQ ID NO: 20972 - DNA, 21 bp, Homo sapiens
tgactcacgctcccccacccc

SEQ ID NO: 20973 - DNA, 23 bp, Homo sapiens
gagttagcggggagtgatatatt

SEQ ID NO: 20974 - DNA, 23 bp, Homo sapiens
cctttcccaaagcctccgtgccc

SEQ ID NO: 20975 - DNA, 20 bp, Homo sapiens
cccagccctcccggggccca

SEQ ID NO: 20976 - DNA, 22 bp, Homo sapiens
cctcttctcatctccccacaga

SEQ ID NO: 20977 - DNA, 23 bp, Homo sapiens
caggcctggctgggctccctgga

SEQ ID NO: 20978 - DNA, 20 bp, Homo sapiens
ttgataagctgtggaaagca

SEQ ID NO: 20979 - DNA, 20 bp, Homo sapiens
ccccgaggcctccctccctc

SEQ ID NO: 20980 - DNA, 21 bp, Homo sapiens
aggtgcaggtgccgccatccc

SEQ ID NO: 20981 - DNA, 22 bp, Homo sapiens
tagaggcgtgagccagcgcacc

SEQ ID NO: 20982 - DNA, 20 bp, Homo sapiens
gcggtctagggctgggggcg

SEQ ID NO: 20983 - DNA, 23 bp, Homo sapiens
cctggttctgccagctcccctga

SEQ ID NO: 20984 - DNA, 20 bp, Homo sapiens
cctgtgccaagctgccccct

SEQ ID NO: 20985 - DNA, 23 bp, Homo sapiens
aggcggcgcgcatctctgggcct

SEQ ID NO: 20986 - DNA, 23 bp, Homo sapiens
caatgcaacagcaatgcaccgcg

SEQ ID NO: 20987 - DNA, 22 bp, Homo sapiens
tttctgcaacacagcaaccaga

SEQ ID NO: 20988 - DNA, 24 bp, Homo sapiens
tgtcccggcccggagccgccaagg

SEQ ID NO: 20989 - DNA, 22 bp, Homo sapiens
tcccggtgacggcgagcgtggg

SEQ ID NO: 20990 - DNA, 24 bp, Homo sapiens
ctgcgaacacccccacccctgcac

SEQ ID NO: 20991 - DNA, 23 bp, Homo sapiens
tgacttcttattctttcctgtgt

SEQ ID NO: 20992 - DNA, 22 bp, Homo sapiens
cgggaaagaataagaagccata

SEQ ID NO: 20993 - DNA, 21 bp, Homo sapiens
cggctgaggcccgcaagcgca

SEQ ID NO: 20994 - DNA, 21 bp, Homo sapiens
tcgggctctggccgggacacc

SEQ ID NO: 20995 - DNA, 21 bp, Homo sapiens
agcctgggagacacactagca

SEQ ID NO: 20996 - DNA, 20 bp, Homo sapiens
actctgagatttcacaggct

SEQ ID NO: 20997 - DNA, 21 bp, Homo sapiens
ccccgctcgcccgtgccggcc

SEQ ID NO: 20998 - DNA, 21 bp, Homo sapiens
cgaggcgcgggctgtggggcc

SEQ ID NO: 20999 - DNA, 22 bp, Homo sapiens
tgggtctaggggtgggaactgg

SEQ ID NO: 21000 - DNA, 22 bp, Homo sapiens
agccgccacactccctcgcagg

SEQ ID NO: 21001 - DNA, 22 bp, Homo sapiens
tctgatgctgctctggctccgt

SEQ ID NO: 21002 - DNA, 23 bp, Homo sapiens
cctcctccgccttcgccccaact

SEQ ID NO: 21003 - DNA, 20 bp, Homo sapiens
aggccaggatgcggagttgt

SEQ ID NO: 21004 - DNA, 21 bp, Homo sapiens
cccggtgcagtcgggaacccg

SEQ ID NO: 21005 - DNA, 20 bp, Homo sapiens
caccgggtctagcattggga

SEQ ID NO: 21006 - DNA, 23 bp, Homo sapiens
acgctcattcatttatgtccaca

SEQ ID NO: 21007 - DNA, 22 bp, Homo sapiens
tagagataacagtttatgaaaa

SEQ ID NO: 21008 - DNA, 20 bp, Homo sapiens
gctcagaatcgcgactaagg

SEQ ID NO: 21009 - DNA, 20 bp, Homo sapiens
cgcgaccgcccccgggtgcc

SEQ ID NO: 21010 - DNA, 24 bp, Homo sapiens
cctggcccggccttcgcggcccct

SEQ ID NO: 21011 - DNA, 24 bp, Homo sapiens
cgaccggcggctctttggcgcgga

SEQ ID NO: 21012 - DNA, 22 bp, Homo sapiens
tggcgggccggcgggcgggcag

SEQ ID NO: 21013 - DNA, 20 bp, Homo sapiens
gccgtgcggtgtggtccggg

SEQ ID NO: 21014 - DNA, 22 bp, Homo sapiens
actccttctcacccctgtggct

SEQ ID NO: 21015 - DNA, 21 bp, Homo sapiens
acccggggaggggggcgggca

SEQ ID NO: 21016 - DNA, 22 bp, Homo sapiens
ccagccccacgcgtccccatgc

SEQ ID NO: 21017 - DNA, 21 bp, Homo sapiens
ctgcaccagcccccgtcccga

SEQ ID NO: 21018 - DNA, 23 bp, Homo sapiens
tgcagattcctaggccccaccca

SEQ ID NO: 21019 - DNA, 20 bp, Homo sapiens
cccccgcgggggcccgctgg

SEQ ID NO: 21020 - DNA, 22 bp, Homo sapiens
agctgcacctgaggccgggggt

SEQ ID NO: 21021 - DNA, 23 bp, Homo sapiens
ctctgggctgagccttgctgctt

SEQ ID NO: 21022 - DNA, 21 bp, Homo sapiens
tatgaggggcggaggagaggg

SEQ ID NO: 21023 - DNA, 21 bp, Homo sapiens
gcgctgcacgccagtctcgcc

SEQ ID NO: 21024 - DNA, 20 bp, Homo sapiens
ctgctcgggctgtgatagga

SEQ ID NO: 21025 - DNA, 23 bp, Homo sapiens
tgacccccgtctttctctctagc

SEQ ID NO: 21026 - DNA, 22 bp, Homo sapiens
gcctcgccgccgcctctgctgc

SEQ ID NO: 21027 - DNA, 20 bp, Homo sapiens
cgtggaggccgcggctgagg

SEQ ID NO: 21028 - DNA, 24 bp, Homo sapiens
gggcccgcccagcgccgcagcccg

SEQ ID NO: 21029 - DNA, 23 bp, Homo sapiens
tggagccaggctgagaaggggtg

SEQ ID NO: 21030 - DNA, 21 bp, Homo sapiens
cccgaagaggttgggccggtg

SEQ ID NO: 21031 - DNA, 20 bp, Homo sapiens
gccggcgggagggggcccgc

SEQ ID NO: 21032 - DNA, 20 bp, Homo sapiens
gggggccggcggcggcgcag

SEQ ID NO: 21033 - DNA, 20 bp, Homo sapiens
cggggcatgggccgagctga

SEQ ID NO: 21034 - DNA, 21 bp, Homo sapiens
tctgggccggggcggcgcgct

SEQ ID NO: 21035 - DNA, 20 bp, Homo sapiens
tccgtcccgtactcaccccg

SEQ ID NO: 21036 - DNA, 24 bp, Homo sapiens
gtgactccacatcctttctcaccc

SEQ ID NO: 21037 - DNA, 21 bp, Homo sapiens
cgggggaagaggaagggcggg

SEQ ID NO: 21038 - DNA, 23 bp, Homo sapiens
cggccggggagaactgcgcctgc

SEQ ID NO: 21039 - DNA, 21 bp, Homo sapiens
ggcgcagcgctcaccggcccc

SEQ ID NO: 21040 - DNA, 22 bp, Homo sapiens
gcggcggcggcggggggtgtgc

SEQ ID NO: 21041 - DNA, 20 bp, Homo sapiens
ccgctccctcccacagcctg

SEQ ID NO: 21042 - DNA, 20 bp, Homo sapiens
ctttggggattctaagagtt

SEQ ID NO: 21043 - DNA, 22 bp, Homo sapiens
agtgtttgcgcagggaggcccc

SEQ ID NO: 21044 - DNA, 24 bp, Homo sapiens
ccaggcatggtgttgcacacccgc

SEQ ID NO: 21045 - DNA, 23 bp, Homo sapiens
cccctcacctgcccctccccaca

SEQ ID NO: 21046 - DNA, 22 bp, Homo sapiens
tgcgcccctaaccgcccgggta

SEQ ID NO: 21047 - DNA, 22 bp, Homo sapiens
tgagcctctgctcccggcctaa

SEQ ID NO: 21048 - DNA, 24 bp, Homo sapiens
tcagcctccttccctgtcctccct

SEQ ID NO: 21049 - DNA, 22 bp, Homo sapiens
ccttgcgcggtggctcacacct

SEQ ID NO: 21050 - DNA, 22 bp, Homo sapiens
cctgagccaccatgctgagcct

SEQ ID NO: 21051 - DNA, 23 bp, Homo sapiens
aagctccagtttacaagacaccc

SEQ ID NO: 21052 - DNA, 24 bp, Homo sapiens
gcccgcgggccccgccgcgccgcc

SEQ ID NO: 21053 - DNA, 23 bp, Homo sapiens
acatgcgccctcggcttctggca

SEQ ID NO: 21054 - DNA, 24 bp, Homo sapiens
cgggggcagagagcctggggcgcc

SEQ ID NO: 21055 - DNA, 24 bp, Homo sapiens
cgcgccggggtggagcggcccttc

SEQ ID NO: 21056 - DNA, 21 bp, Homo sapiens
agtgggatttccgagtagcat

SEQ ID NO: 21057 - DNA, 22 bp, Homo sapiens
gggaagcagcagcgtagggcca

SEQ ID NO: 21058 - DNA, 21 bp, Homo sapiens
ccgccgcccgcggccgctttt

SEQ ID NO: 21059 - DNA, 23 bp, Homo sapiens
accctttctcttgcctttctcag

SEQ ID NO: 21060 - DNA, 23 bp, Homo sapiens
tctcccactttcctccccctaga

SEQ ID NO: 21061 - DNA, 23 bp, Homo sapiens
ccgggcccggccgcccgccctgt

SEQ ID NO: 21062 - DNA, 22 bp, Homo sapiens
tggctcctgcccgccctccgtc

SEQ ID NO: 21063 - DNA, 23 bp, Homo sapiens
ctggcggggtcctagcgccgatc

SEQ ID NO: 21064 - DNA, 22 bp, Homo sapiens
acaacaacattaaaccacccga

SEQ ID NO: 21065 - DNA, 22 bp, Homo sapiens
cccgacagggaggtggccgggc

SEQ ID NO: 21066 - DNA, 23 bp, Homo sapiens
gcgactgcctccctgctgtgagc

SEQ ID NO: 21067 - DNA, 23 bp, Homo sapiens
ccttctcctcctctccctcccta

SEQ ID NO: 21068 - DNA, 22 bp, Homo sapiens
tgcccgggctcccgccctcagc

SEQ ID NO: 21069 - DNA, 22 bp, Homo sapiens
ccccaccctccatctccctcag

SEQ ID NO: 21070 - DNA, 20 bp, Homo sapiens
ggctgggcgcgcgccccgcg

SEQ ID NO: 21071 - DNA, 20 bp, Homo sapiens
cggcaccggtgggagctagg

SEQ ID NO: 21072 - DNA, 23 bp, Homo sapiens
gggttcgaggggccggtggccgc

SEQ ID NO: 21073 - DNA, 24 bp, Homo sapiens
agaaggagcgaagctctggcccgg

SEQ ID NO: 21074 - DNA, 22 bp, Homo sapiens
aggcccaagctcatatccctgc

SEQ ID NO: 21075 - DNA, 21 bp, Homo sapiens
cttcagcctgggtgataaggg

SEQ ID NO: 21076 - DNA, 20 bp, Homo sapiens
cccgcctccagctcgcggcc

SEQ ID NO: 21077 - DNA, 22 bp, Homo sapiens
atagcctctcttccctggattg

SEQ ID NO: 21078 - DNA, 20 bp, Homo sapiens
cggcgtccccccccgcgggg

SEQ ID NO: 21079 - DNA, 21 bp, Homo sapiens
ttccagacccaagtgaaccta

SEQ ID NO: 21080 - DNA, 24 bp, Homo sapiens
cggacccggagggatgcggagtgg

SEQ ID NO: 21081 - DNA, 23 bp, Homo sapiens
ctcgcggagggagcccaagggcg

SEQ ID NO: 21082 - DNA, 20 bp, Homo sapiens
agcgtcccagcagataaatg

SEQ ID NO: 21083 - DNA, 22 bp, Homo sapiens
aacgtggccaatgtgatctgga

SEQ ID NO: 21084 - DNA, 21 bp, Homo sapiens
cgttcggcgggtggggtccga

SEQ ID NO: 21085 - DNA, 21 bp, Homo sapiens
cgcgcgagccgcccgcccggc

SEQ ID NO: 21086 - DNA, 21 bp, Homo sapiens
ggttgctgggcgcgctgctcc

SEQ ID NO: 21087 - DNA, 23 bp, Homo sapiens
gccccgacctgaccccggccctc

SEQ ID NO: 21088 - DNA, 23 bp, Homo sapiens
gcgcccgcgccctcctcgtaccc

SEQ ID NO: 21089 - DNA, 24 bp, Homo sapiens
tgctgctggggctggcactcagga

SEQ ID NO: 21090 - DNA, 22 bp, Homo sapiens
cctgcaggttccgggaggtcag

SEQ ID NO: 21091 - DNA, 23 bp, Homo sapiens
ctgtcggccgcctggacttcccg

SEQ ID NO: 21092 - DNA, 21 bp, Homo sapiens
cgccgcaggttgacgtagagc

SEQ ID NO: 21093 - DNA, 23 bp, Homo sapiens
tacatccataaacacaatcttca

SEQ ID NO: 21094 - DNA, 20 bp, Homo sapiens
ggggcgagaaggggcggggc

SEQ ID NO: 21095 - DNA, 23 bp, Homo sapiens
ccaaccccccacctcaagtctgt

SEQ ID NO: 21096 - DNA, 21 bp, Homo sapiens
cggctccgggacccgcaaagt

SEQ ID NO: 21097 - DNA, 22 bp, Homo sapiens
cccgccctcagagctgggcctc

SEQ ID NO: 21098 - DNA, 22 bp, Homo sapiens
tctgaccactgcatccccttcc

SEQ ID NO: 21099 - DNA, 23 bp, Homo sapiens
cagactgggcctgggctggggtg

SEQ ID NO: 21100 - DNA, 22 bp, Homo sapiens
gccgcgcggggcggggattggt

SEQ ID NO: 21101 - DNA, 22 bp, Homo sapiens
ttcccagccatggcttcgcgct

SEQ ID NO: 21102 - DNA, 23 bp, Homo sapiens
ctcctctgctctgccctctccaa

SEQ ID NO: 21103 - DNA, 22 bp, Homo sapiens
agcccaagggcgctcggactcc

SEQ ID NO: 21104 - DNA, 22 bp, Homo sapiens
cccgcagtgaaggttgcccgag

SEQ ID NO: 21105 - DNA, 23 bp, Homo sapiens
atccggtccgtacaaactctgca

SEQ ID NO: 21106 - DNA, 23 bp, Homo sapiens
gtgcccagtcctgtgggagatac

SEQ ID NO: 21107 - DNA, 23 bp, Homo sapiens
acccctccccactcctcgccagg

SEQ ID NO: 21108 - DNA, 22 bp, Homo sapiens
cggctccggctgctgacttcct

SEQ ID NO: 21109 - DNA, 22 bp, Homo sapiens
tagcagcacggcggcgccaagc

SEQ ID NO: 21110 - DNA, 23 bp, Homo sapiens
aggccctcgcctgcttgcccaca

SEQ ID NO: 21111 - DNA, 21 bp, Homo sapiens
aggccggagggaagatggcgg

SEQ ID NO: 21112 - DNA, 21 bp, Homo sapiens
gcctggttgggagaaggggtg

SEQ ID NO: 21113 - DNA, 21 bp, Homo sapiens
ccggtcccggggccgcggtag

SEQ ID NO: 21114 - DNA, 23 bp, Homo sapiens
agcggcggcagcagcggtgagcg

SEQ ID NO: 21115 - DNA, 23 bp, Homo sapiens
tgaacccgagaggaagagattgc

SEQ ID NO: 21116 - DNA, 22 bp, Homo sapiens
cacgcctgctttctaagcagct

SEQ ID NO: 21117 - DNA, 22 bp, Homo sapiens
tggggacccagctgctgaagtt

SEQ ID NO: 21118 - DNA, 22 bp, Homo sapiens
caggccccaagtccccactcca

SEQ ID NO: 21119 - DNA, 20 bp, Homo sapiens
tgcctctctccccactctgc

SEQ ID NO: 21120 - DNA, 23 bp, Homo sapiens
acagtagtctgcagtggtgtgca

SEQ ID NO: 21121 - DNA, 23 bp, Homo sapiens
ccgacagcccctctcccgcaggg

SEQ ID NO: 21122 - DNA, 22 bp, Homo sapiens
tgcacaggcctggagctcctca

SEQ ID NO: 21123 - DNA, 24 bp, Homo sapiens
gagcttagaagggcctgtctggag

SEQ ID NO: 21124 - DNA, 22 bp, Homo sapiens
cctgtcaccacccccgtccagg

SEQ ID NO: 21125 - DNA, 24 bp, Homo sapiens
aagcagcgcctgtcgcaactcgcc

SEQ ID NO: 21126 - DNA, 21 bp, Homo sapiens
agagttgctgccgctgctgtc

SEQ ID NO: 21127 - DNA, 20 bp, Homo sapiens
ggctccgacttggactccct

SEQ ID NO: 21128 - DNA, 22 bp, Homo sapiens
taagatctccaagtggaacaga

SEQ ID NO: 21129 - DNA, 21 bp, Homo sapiens
ggagcccgcgcctcgccggcg

SEQ ID NO: 21130 - DNA, 23 bp, Homo sapiens
ctgtcacggtaggagctctcccg

SEQ ID NO: 21131 - DNA, 22 bp, Homo sapiens
ctccccatccagccgggtctca

SEQ ID NO: 21132 - DNA, 23 bp, Homo sapiens
tccgtcccggccgttagcccagc

SEQ ID NO: 21133 - DNA, 22 bp, Homo sapiens
agcctctcccttcctcccctcc

SEQ ID NO: 21134 - DNA, 24 bp, Homo sapiens
ccggcgccctgtgttgtgctccgc

SEQ ID NO: 21135 - DNA, 24 bp, Homo sapiens
tctgcagccgcgccggccgccagc

SEQ ID NO: 21136 - DNA, 21 bp, Homo sapiens
gggctaggatacagtgggccc

SEQ ID NO: 21137 - DNA, 21 bp, Homo sapiens
cctgctcatatcctggactgt

SEQ ID NO: 21138 - DNA, 20 bp, Homo sapiens
cgcggcgcgcccctgtgtcg

SEQ ID NO: 21139 - DNA, 24 bp, Homo sapiens
gcgggccgctcgcggagccacagc

SEQ ID NO: 21140 - DNA, 23 bp, Homo sapiens
acaggcatctcatgcggctgaag

SEQ ID NO: 21141 - DNA, 20 bp, Homo sapiens
gccggcccctcggggcagag

SEQ ID NO: 21142 - DNA, 24 bp, Homo sapiens
gccctcagcgtggccgcccgcaga

SEQ ID NO: 21143 - DNA, 22 bp, Homo sapiens
tcagcgggaggaagggtcagtg

SEQ ID NO: 21144 - DNA, 20 bp, Homo sapiens
ccctagctggctctgcggct

SEQ ID NO: 21145 - DNA, 20 bp, Homo sapiens
cccccccagccccgtccgcc

SEQ ID NO: 21146 - DNA, 22 bp, Homo sapiens
gagccgcactggtgtccccaca

SEQ ID NO: 21147 - DNA, 20 bp, Homo sapiens
acaggacaagggcagcccca

SEQ ID NO: 21148 - DNA, 22 bp, Homo sapiens
actgggctggttttgtccttga

SEQ ID NO: 21149 - DNA, 24 bp, Homo sapiens
cccgtgcggggttggggctcgtgg

SEQ ID NO: 21150 - DNA, 21 bp, Homo sapiens
gccgcagtggcagcaggggag

SEQ ID NO: 21151 - DNA, 23 bp, Homo sapiens
gcgccgccgcccccccccgcggg

SEQ ID NO: 21152 - DNA, 20 bp, Homo sapiens
cgcgccagacccggaaagcg

SEQ ID NO: 21153 - DNA, 23 bp, Homo sapiens
acctcctccaggcgggcctggct

SEQ ID NO: 21154 - DNA, 23 bp, Homo sapiens
acaccccacttgccctgctgacc

SEQ ID NO: 21155 - DNA, 23 bp, Homo sapiens
tgcctactggaggggacagtgca

SEQ ID NO: 21156 - DNA, 20 bp, Homo sapiens
cggcggcggcgcgccgggtc

SEQ ID NO: 21157 - DNA, 22 bp, Homo sapiens
cgctcgggtcccgccgacagga

SEQ ID NO: 21158 - DNA, 22 bp, Homo sapiens
aaccgagaggtggttactgtag

SEQ ID NO: 21159 - DNA, 20 bp, Homo sapiens
tccggggctggacgcgcatc

SEQ ID NO: 21160 - DNA, 22 bp, Homo sapiens
agcccctgcagcagctgggaaa

SEQ ID NO: 21161 - DNA, 23 bp, Homo sapiens
gcccttgggatgctggccgctga

SEQ ID NO: 21162 - DNA, 21 bp, Homo sapiens
gccgcgcgtgctcccgcccct

SEQ ID NO: 21163 - DNA, 24 bp, Homo sapiens
acccgcgggcggcggggccggggg

SEQ ID NO: 21164 - DNA, 24 bp, Homo sapiens
atcagcgtgcacttccccaccctg

SEQ ID NO: 21165 - DNA, 23 bp, Homo sapiens
ccgggccgccgcctctgcgctca

SEQ ID NO: 21166 - DNA, 22 bp, Homo sapiens
tctcagggtggctgggcccatc

SEQ ID NO: 21167 - DNA, 23 bp, Homo sapiens
tcaacgtgcactgggccgggtgt

SEQ ID NO: 21168 - DNA, 23 bp, Homo sapiens
cggcggcgggggcgggcccgggg

SEQ ID NO: 21169 - DNA, 20 bp, Homo sapiens
ccgtcggcctcggaggctcc

SEQ ID NO: 21170 - DNA, 23 bp, Homo sapiens
ggagtcaacactgggccactgtg

SEQ ID NO: 21171 - DNA, 20 bp, Homo sapiens
gagcaagagcccggggcgtg

SEQ ID NO: 21172 - DNA, 22 bp, Homo sapiens
tccgccctccgccacctcgagc

SEQ ID NO: 21173 - DNA, 22 bp, Homo sapiens
gcggcggcgctggtcgcgggtc

SEQ ID NO: 21174 - DNA, 21 bp, Homo sapiens
cgcaccgggcgcagcagctga

SEQ ID NO: 21175 - DNA, 22 bp, Homo sapiens
tcataagccttttggccactag

SEQ ID NO: 21176 - DNA, 22 bp, Homo sapiens
cataagccctctgaccactagg

SEQ ID NO: 21177 - DNA, 22 bp, Homo sapiens
ccgagcggggagcaaggcctgc

SEQ ID NO: 21178 - DNA, 22 bp, Homo sapiens
tggccgcccccgctcgcaccgc

SEQ ID NO: 21179 - DNA, 23 bp, Homo sapiens
ctccccgagcccgctcgccggcc

SEQ ID NO: 21180 - DNA, 24 bp, Homo sapiens
tgcgcggagggcgaaagtggccgg

SEQ ID NO: 21181 - DNA, 22 bp, Homo sapiens
cttccgaagggacgggcggcgg

SEQ ID NO: 21182 - DNA, 23 bp, Homo sapiens
ccagcgccgccgcggcaccggtg

SEQ ID NO: 21183 - DNA, 21 bp, Homo sapiens
tggttttctattgctgcccta

SEQ ID NO: 21184 - DNA, 23 bp, Homo sapiens
cccggccgcccgggcccccggcc

SEQ ID NO: 21185 - DNA, 21 bp, Homo sapiens
ggtccgtctctcactggcgcg

SEQ ID NO: 21186 - DNA, 21 bp, Homo sapiens
acctcacagcgggcctcgcgg

SEQ ID NO: 21187 - DNA, 24 bp, Homo sapiens
cgcagcgccagcgctctccccgga

SEQ ID NO: 21188 - DNA, 23 bp, Homo sapiens
ggcccagtccctgctgtcatgcc

SEQ ID NO: 21189 - DNA, 22 bp, Homo sapiens
gcgagcccgggtgggagaagca

SEQ ID NO: 21190 - DNA, 22 bp, Homo sapiens
ccggacggaggcggagctctgg

SEQ ID NO: 21191 - DNA, 21 bp, Homo sapiens
acatacttctttatgtaccca

SEQ ID NO: 21192 - DNA, 22 bp, Homo sapiens
agtccttaaaaacatgttgtgc

SEQ ID NO: 21193 - DNA, 21 bp, Homo sapiens
agccttctgttatgagttact

SEQ ID NO: 21194 - DNA, 22 bp, Homo sapiens
ctgcgcctggcgaccgcgatgc

SEQ ID NO: 21195 - DNA, 24 bp, Homo sapiens
cgcgggtttcgttttcggcaccta

SEQ ID NO: 21196 - DNA, 22 bp, Homo sapiens
agttcaccccactgatgagtct

SEQ ID NO: 21197 - DNA, 23 bp, Homo sapiens
atcccattgccagggattaattt

SEQ ID NO: 21198 - DNA, 23 bp, Homo sapiens
ggcctgggggcggggcgggaaga

SEQ ID NO: 21199 - DNA, 23 bp, Homo sapiens
tccccacctccctttgcctacgg

SEQ ID NO: 21200 - DNA, 23 bp, Homo sapiens
gggcggagagggagaggcccgcg

SEQ ID NO: 21201 - DNA, 20 bp, Homo sapiens
tctcccctccatcggtaccc

SEQ ID NO: 21202 - DNA, 24 bp, Homo sapiens
cgcgggagggcgcgtcgggccggg

SEQ ID NO: 21203 - DNA, 20 bp, Homo sapiens
gcgggcctgcgcctccctcg

SEQ ID NO: 21204 - DNA, 22 bp, Homo sapiens
attggactgctgatggcctgtc

SEQ ID NO: 21205 - DNA, 24 bp, Homo sapiens
cccgctgagcgcgacctgcccgga

SEQ ID NO: 21206 - DNA, 21 bp, Homo sapiens
gccacacatgcagggctacac

SEQ ID NO: 21207 - DNA, 20 bp, Homo sapiens
aaactaactgctcccttgtc

SEQ ID NO: 21208 - DNA, 23 bp, Homo sapiens
gatggagcgcgtcttgcgagcgt

SEQ ID NO: 21209 - DNA, 22 bp, Homo sapiens
aaaaccatctggacgcagggac

SEQ ID NO: 21210 - DNA, 24 bp, Homo sapiens
aacgctgcgacctagatgtattct

SEQ ID NO: 21211 - DNA, 20 bp, Homo sapiens
ggctcttggccaccaaacaa

SEQ ID NO: 21212 - DNA, 23 bp, Homo sapiens
ccgccccgccgctcccggcgccc

SEQ ID NO: 21213 - DNA, 21 bp, Homo sapiens
cccggcgcctgagcggactga

SEQ ID NO: 21214 - DNA, 21 bp, Homo sapiens
ctcctgacccctccccgcagg

SEQ ID NO: 21215 - DNA, 21 bp, Homo sapiens
gcttgatgaagggtccttggg

SEQ ID NO: 21216 - DNA, 21 bp, Homo sapiens
atgcgggcttggggcgggcgg

SEQ ID NO: 21217 - DNA, 21 bp, Homo sapiens
cgcagaggaggaggcaggcgg

SEQ ID NO: 21218 - DNA, 21 bp, Homo sapiens
agcggttggaggttgtaggac

SEQ ID NO: 21219 - DNA, 24 bp, Homo sapiens
tcacccggcccctcgtgccccagg

SEQ ID NO: 21220 - DNA, 22 bp, Homo sapiens
gccctgtgagctcccctccctt

SEQ ID NO: 21221 - DNA, 23 bp, Homo sapiens
cccccatccgctgtccccgcagg

SEQ ID NO: 21222 - DNA, 23 bp, Homo sapiens
ctgacctgcactctctccccagg

SEQ ID NO: 21223 - DNA, 23 bp, Homo sapiens
cccgccgagtacgcagctttcgc

SEQ ID NO: 21224 - DNA, 21 bp, Homo sapiens
cgcgcggggcggggggcggcg

SEQ ID NO: 21225 - DNA, 22 bp, Homo sapiens
cagcagcggcctggtggggatt

SEQ ID NO: 21226 - DNA, 24 bp, Homo sapiens
gagccccctccagaaaggccgtgt

SEQ ID NO: 21227 - DNA, 21 bp, Homo sapiens
gggcctgtgtcgggcgtgggg

SEQ ID NO: 21228 - DNA, 22 bp, Homo sapiens
cttccccaccttgtctgcctcc

SEQ ID NO: 21229 - DNA, 24 bp, Homo sapiens
cccttgttcccccactcctgcaga

SEQ ID NO: 21230 - DNA, 22 bp, Homo sapiens
cccgccgccctgtgcccgcagt

SEQ ID NO: 21231 - DNA, 23 bp, Homo sapiens
ctcacggcccgtctcgccccagc

SEQ ID NO: 21232 - DNA, 24 bp, Homo sapiens
tccccacccccgggctcccgcagg

SEQ ID NO: 21233 - DNA, 21 bp, Homo sapiens
gctctgtggggctctggccgc

SEQ ID NO: 21234 - DNA, 21 bp, Homo sapiens
taaactacactcagctcgtcg

SEQ ID NO: 21235 - DNA, 23 bp, Homo sapiens
cctccccctttccaccccagtga

SEQ ID NO: 21236 - DNA, 22 bp, Homo sapiens
accctggcagcgggcggattgc

SEQ ID NO: 21237 - DNA, 23 bp, Homo sapiens
cccagcctgcccggccccctacc

SEQ ID NO: 21238 - DNA, 23 bp, Homo sapiens
ttggggctggaggtatccacaca

SEQ ID NO: 21239 - DNA, 20 bp, Homo sapiens
cccgctctccagcctgcgcc

SEQ ID NO: 21240 - DNA, 21 bp, Homo sapiens
ctgacccaccccggtcactga

SEQ ID NO: 21241 - DNA, 20 bp, Homo sapiens
cccagcctcatctcagcact

SEQ ID NO: 21242 - DNA, 22 bp, Homo sapiens
cctgtgttctgtggaccccaca

SEQ ID NO: 21243 - DNA, 23 bp, Homo sapiens
cgacagcttgatggtgcgcacgc

SEQ ID NO: 21244 - DNA, 23 bp, Homo sapiens
ctgccggacggcgactgcggcct

SEQ ID NO: 21245 - DNA, 23 bp, Homo sapiens
gcggccggcgcgctcattcacct

SEQ ID NO: 21246 - DNA, 22 bp, Homo sapiens
accctcctcctgcctgaccccc

SEQ ID NO: 21247 - DNA, 23 bp, Homo sapiens
cgggattggaatcccgactgtgg

SEQ ID NO: 21248 - DNA, 21 bp, Homo sapiens
ctccccatctccctccccctc

SEQ ID NO: 21249 - DNA, 24 bp, Homo sapiens
gcccgtgcccgcccggccgcctct

SEQ ID NO: 21250 - DNA, 24 bp, Homo sapiens
cgtgcgtctgtcctccgccgcaga

SEQ ID NO: 21251 - DNA, 23 bp, Homo sapiens
tggcccaggtagaggggtccgcg

SEQ ID NO: 21252 - DNA, 24 bp, Homo sapiens
agcgaccctgcggcgcgcccggag

SEQ ID NO: 21253 - DNA, 23 bp, Homo sapiens
gaccctggggcaggaaggccaca

SEQ ID NO: 21254 - DNA, 21 bp, Homo sapiens
gtccgcagtggaagggcacca

SEQ ID NO: 21255 - DNA, 22 bp, Homo sapiens
cccctccctcctcccgtgagcg

SEQ ID NO: 21256 - DNA, 23 bp, Homo sapiens
ccacccggccgtgtccctgcaga

SEQ ID NO: 21257 - DNA, 22 bp, Homo sapiens
cgcgcgagatccgcccctttgt

SEQ ID NO: 21258 - DNA, 22 bp, Homo sapiens
ggaccaacgcgggttctggggt

SEQ ID NO: 21259 - DNA, 22 bp, Homo sapiens
tcctggagctgggcagatggga

SEQ ID NO: 21260 - DNA, 23 bp, Homo sapiens
gcctgagaggtgagtgaggggca

SEQ ID NO: 21261 - DNA, 23 bp, Homo sapiens
ccccgggacatggtgagtgtggc

SEQ ID NO: 21262 - DNA, 23 bp, Homo sapiens
ctcccgtcctgcgccgccctcgc

SEQ ID NO: 21263 - DNA, 22 bp, Homo sapiens
agtgtccgaggcctccacccac

SEQ ID NO: 21264 - DNA, 22 bp, Homo sapiens
tgagctgggcaggggcgggggt

SEQ ID NO: 21265 - DNA, 21 bp, Homo sapiens
cccagggctccgcctctgctg

SEQ ID NO: 21266 - DNA, 22 bp, Homo sapiens
ttgcctctcccgtccctgtagt

SEQ ID NO: 21267 - DNA, 21 bp, Homo sapiens
cgtggcccgaggggcagagct

SEQ ID NO: 21268 - DNA, 23 bp, Homo sapiens
tgaccccggctctgcgtcccagg

SEQ ID NO: 21269 - DNA, 22 bp, Homo sapiens
gccaccatatccagcctagcat

SEQ ID NO: 21270 - DNA, 22 bp, Homo sapiens
ctgagcctcctcccaccccagc

SEQ ID NO: 21271 - DNA, 20 bp, Homo sapiens
cgggcggcgggcggtggggc

SEQ ID NO: 21272 - DNA, 22 bp, Homo sapiens
cgccccgtgccccgtccacagg

SEQ ID NO: 21273 - DNA, 20 bp, Homo sapiens
cggtcccggcttccggctgc

SEQ ID NO: 21274 - DNA, 23 bp, Homo sapiens
tcgtagtccctccgccgtttgca

SEQ ID NO: 21275 - DNA, 20 bp, Homo sapiens
gagctgaccaggtgtgcagg

SEQ ID NO: 21276 - DNA, 23 bp, Homo sapiens
gggccggcggcggcggcgcctct

SEQ ID NO: 21277 - DNA, 22 bp, Homo sapiens
cacgggggctgagagcagaacc

SEQ ID NO: 21278 - DNA, 22 bp, Homo sapiens
tccctgacccctaacccctgca

SEQ ID NO: 21279 - DNA, 22 bp, Homo sapiens
caacaagtcacagccggcctca

SEQ ID NO: 21280 - DNA, 20 bp, Homo sapiens
ccccccactgctgggccggc

SEQ ID NO: 21281 - DNA, 21 bp, Homo sapiens
tcgctgcgcgccgcgctccgg

SEQ ID NO: 21282 - DNA, 23 bp, Homo sapiens
tctgaccccgctgtgcacccaca

SEQ ID NO: 21283 - DNA, 22 bp, Homo sapiens
ccatcaggtggtcacggagcca

SEQ ID NO: 21284 - DNA, 24 bp, Homo sapiens
gagccgagaactggagcccgagct

SEQ ID NO: 21285 - DNA, 22 bp, Homo sapiens
tgggcttgagtgatactcctgc

SEQ ID NO: 21286 - DNA, 22 bp, Homo sapiens
ccacccccgccgcctgcgcagg

SEQ ID NO: 21287 - DNA, 23 bp, Homo sapiens
ccacacctcgctcttccctcaga

SEQ ID NO: 21288 - DNA, 22 bp, Homo sapiens
tatctgctgttgtcccctcagg

SEQ ID NO: 21289 - DNA, 20 bp, Homo sapiens
gaggccgcacagcaggaacc

SEQ ID NO: 21290 - DNA, 23 bp, Homo sapiens
ccctccccttctctgcccacagt

SEQ ID NO: 21291 - DNA, 22 bp, Homo sapiens
tctgtcgcccaccgcctgtcca

SEQ ID NO: 21292 - DNA, 22 bp, Homo sapiens
cccactcctgcctcaccccagc

SEQ ID NO: 21293 - DNA, 22 bp, Homo sapiens
cttctgtcccctcctcgcccag

SEQ ID NO: 21294 - DNA, 23 bp, Homo sapiens
ccaaccctccctctcctcccagc

SEQ ID NO: 21295 - DNA, 23 bp, Homo sapiens
tgcacgggtccgccctgagcgct

SEQ ID NO: 21296 - DNA, 21 bp, Homo sapiens
atcccgccggaagcgccagga

SEQ ID NO: 21297 - DNA, 22 bp, Homo sapiens
gaagaaggagggctggggcggt

SEQ ID NO: 21298 - DNA, 21 bp, Homo sapiens
cgcggcccctcctctgagagc

SEQ ID NO: 21299 - DNA, 20 bp, Homo sapiens
cggctgggagaagcgcatga

SEQ ID NO: 21300 - DNA, 22 bp, Homo sapiens
tccgccgaggctcagcgcgcag

SEQ ID NO: 21301 - DNA, 23 bp, Homo sapiens
cccccctctgtccctcgtcccag

SEQ ID NO: 21302 - DNA, 23 bp, Homo sapiens
ccacctctccatttctcccaggc

SEQ ID NO: 21303 - DNA, 22 bp, Homo sapiens
ggccgcatcccggagctgcaac

SEQ ID NO: 21304 - DNA, 22 bp, Homo sapiens
aggctccgtttttccgctcgtc

SEQ ID NO: 21305 - DNA, 22 bp, Homo sapiens
gacagggccctgacctcctcaa

SEQ ID NO: 21306 - DNA, 23 bp, Homo sapiens
ccccggggccaaatgcctgaggt

SEQ ID NO: 21307 - DNA, 21 bp, Homo sapiens
agaccctacccaaccccacgc

SEQ ID NO: 21308 - DNA, 23 bp, Homo sapiens
taagctgcgcgctttcccccagg

SEQ ID NO: 21309 - DNA, 20 bp, Homo sapiens
ctgaccggtctctgtcctca

SEQ ID NO: 21310 - DNA, 23 bp, Homo sapiens
gcgaccccagggcgccactgcca

SEQ ID NO: 21311 - DNA, 21 bp, Homo sapiens
cccaaggtgtctccgccgcag

SEQ ID NO: 21312 - DNA, 21 bp, Homo sapiens
gcggggcccggcgcttcgtcc

SEQ ID NO: 21313 - DNA, 21 bp, Homo sapiens
cttcggcgctcttcccccaga

SEQ ID NO: 21314 - DNA, 20 bp, Homo sapiens
attcgtactgtctgatgggg

SEQ ID NO: 21315 - DNA, 20 bp, Homo sapiens
tcaagtgatggagagcaata

SEQ ID NO: 21316 - DNA, 23 bp, Homo sapiens
gccccgggggaaggagcccggcc

SEQ ID NO: 21317 - DNA, 22 bp, Homo sapiens
gcgggaagggtgggactcctgg

SEQ ID NO: 21318 - DNA, 23 bp, Homo sapiens
gccgagacttggagtgcgcaggc

SEQ ID NO: 21319 - DNA, 22 bp, Homo sapiens
gtcctcgctctctccccctgca

SEQ ID NO: 21320 - DNA, 23 bp, Homo sapiens
aggcccttgcatcctcccccagt

SEQ ID NO: 21321 - DNA, 22 bp, Homo sapiens
tccaggaaagtcgggcaggtcg

SEQ ID NO: 21322 - DNA, 21 bp, Homo sapiens
tgtcacagcccactctccctc

SEQ ID NO: 21323 - DNA, 22 bp, Homo sapiens
gccggccgccgcgctcccgccc

SEQ ID NO: 21324 - DNA, 22 bp, Homo sapiens
accacagctgcatgctaccacc

SEQ ID NO: 21325 - DNA, 24 bp, Homo sapiens
ggccccctttcccctctctctgca

SEQ ID NO: 21326 - DNA, 24 bp, Homo sapiens
aacccggccctccttgtccacagg

SEQ ID NO: 21327 - DNA, 24 bp, Homo sapiens
cccgcccctccgcgcccccccccc

SEQ ID NO: 21328 - DNA, 21 bp, Homo sapiens
gtcctagcagtgtcactgcgt

SEQ ID NO: 21329 - DNA, 20 bp, Homo sapiens
gccggcggctcggggccccc

SEQ ID NO: 21330 - DNA, 20 bp, Homo sapiens
ggggggaagggcacctagct

SEQ ID NO: 21331 - DNA, 23 bp, Homo sapiens
cggccagtgagtggggtggagcg

SEQ ID NO: 21332 - DNA, 23 bp, Homo sapiens
cctctccatcccaggccctgtca

SEQ ID NO: 21333 - DNA, 23 bp, Homo sapiens
gggtgtgggcagtgggcgggcca

SEQ ID NO: 21334 - DNA, 21 bp, Homo sapiens
tctccgtctccatccccagct

SEQ ID NO: 21335 - DNA, 23 bp, Homo sapiens
ggccccctcccccacggtccaga

SEQ ID NO: 21336 - DNA, 23 bp, Homo sapiens
cgaggccgggctgcactgcgaga

SEQ ID NO: 21337 - DNA, 21 bp, Homo sapiens
tagggcccagcaaaggggtgg

SEQ ID NO: 21338 - DNA, 22 bp, Homo sapiens
gagcaggccggagcgggccgcg

SEQ ID NO: 21339 - DNA, 20 bp, Homo sapiens
gcggcgcgtcggacgaggag

SEQ ID NO: 21340 - DNA, 22 bp, Homo sapiens
ggttgaggggcctgaaggcttt

SEQ ID NO: 21341 - DNA, 24 bp, Homo sapiens
tgacctcaggtgatccgcccgtaa

SEQ ID NO: 21342 - DNA, 24 bp, Homo sapiens
gtggcggcggcggcgggggtgggg

SEQ ID NO: 21343 - DNA, 24 bp, Homo sapiens
ctactgtcactctctcgtccccca

SEQ ID NO: 21344 - DNA, 22 bp, Homo sapiens
ccgagatgagggcagtatgtgg

SEQ ID NO: 21345 - DNA, 22 bp, Homo sapiens
cccgtgcgcctctgcgcctccg

SEQ ID NO: 21346 - DNA, 22 bp, Homo sapiens
tgggcctttctgtctctgcagg

SEQ ID NO: 21347 - DNA, 23 bp, Homo sapiens
cctggcactgagagggctctctt

SEQ ID NO: 21348 - DNA, 22 bp, Homo sapiens
cacctggtttgatgccatcatt

SEQ ID NO: 21349 - DNA, 21 bp, Homo sapiens
attgatggcatcgaaccaggt

SEQ ID NO: 21350 - DNA, 23 bp, Homo sapiens
aatgatggcatcaaaccaggtgc

SEQ ID NO: 21351 - DNA, 23 bp, Homo sapiens
tccctgccgggggtgccacacag

SEQ ID NO: 21352 - DNA, 21 bp, Homo sapiens
tgtggcatccacccagggtgg

SEQ ID NO: 21353 - DNA, 21 bp, Homo sapiens
ggctcccgggggcacctgcat

SEQ ID NO: 21354 - DNA, 21 bp, Homo sapiens
ccccggcgggggcgcgcgggc

SEQ ID NO: 21355 - DNA, 22 bp, Homo sapiens
gcccgctgagttggccgcagcc

SEQ ID NO: 21356 - DNA, 23 bp, Homo sapiens
gcgcggggtcggtggcggtggcg

SEQ ID NO: 21357 - DNA, 24 bp, Homo sapiens
cgggccggcgggagggacgggggc

SEQ ID NO: 21358 - DNA, 22 bp, Homo sapiens
cagcctcctctctgccacccct

SEQ ID NO: 21359 - DNA, 22 bp, Homo sapiens
cagcctggcttcgcgcctccgt

SEQ ID NO: 21360 - DNA, 23 bp, Homo sapiens
cggagcctgaggttgctgtgagc

SEQ ID NO: 21361 - DNA, 23 bp, Homo sapiens
tggctggaggagctggggtgtca

SEQ ID NO: 21362 - DNA, 22 bp, Homo sapiens
tcttggcctcaccctctctagc

SEQ ID NO: 21363 - DNA, 24 bp, Homo sapiens
tcccttatggttccttcctccagg

SEQ ID NO: 21364 - DNA, 22 bp, Homo sapiens
tgtacacacacaaccgttacct

SEQ ID NO: 21365 - DNA, 21 bp, Homo sapiens
cctcctccctcatcttgcaga

SEQ ID NO: 21366 - DNA, 23 bp, Homo sapiens
cggcggcggcggcgcgcgcagca

SEQ ID NO: 21367 - DNA, 22 bp, Homo sapiens
ctgccgccacctgctcactcag

SEQ ID NO: 21368 - DNA, 24 bp, Homo sapiens
tcacagctgcccttgtccccagat

SEQ ID NO: 21369 - DNA, 24 bp, Homo sapiens
tgctgactgcccgccttgcccaca

SEQ ID NO: 21370 - DNA, 23 bp, Homo sapiens
agcgggtcaggcagggccagtca

SEQ ID NO: 21371 - DNA, 22 bp, Homo sapiens
gcgctgtccgccgccgctgcct

SEQ ID NO: 21372 - DNA, 23 bp, Homo sapiens
cggcggagcctacggtccctgca

SEQ ID NO: 21373 - DNA, 21 bp, Homo sapiens
ccagccgtgccccctgtcccg

SEQ ID NO: 21374 - DNA, 23 bp, Homo sapiens
cccgccgcccccccggggccggg

SEQ ID NO: 21375 - DNA, 24 bp, Homo sapiens
tgcctccccgtgtctgcctgtgtc

SEQ ID NO: 21376 - DNA, 23 bp, Homo sapiens
ctgcagtgttcagtgactgtgaa

SEQ ID NO: 21377 - DNA, 24 bp, Homo sapiens
actcagtctcttcccctctctgcc

SEQ ID NO: 21378 - DNA, 21 bp, Homo sapiens
gtcaggattgttgctgggccc

SEQ ID NO: 21379 - DNA, 24 bp, Homo sapiens
cctcagaaacgcacctgttcctgt

SEQ ID NO: 21380 - DNA, 21 bp, Homo sapiens
cggggcgcgctcgggcggcgg

SEQ ID NO: 21381 - DNA, 22 bp, Homo sapiens
tcactactgtctccaccccaca

SEQ ID NO: 21382 - DNA, 23 bp, Homo sapiens
acccttggtcccctcggtcgccg

SEQ ID NO: 21383 - DNA, 22 bp, Homo sapiens
tctgctcctggctggctcgcca

SEQ ID NO: 21384 - DNA, 20 bp, Homo sapiens
cgcacggggtcggcagcagg

SEQ ID NO: 21385 - DNA, 21 bp, Homo sapiens
catgttgactctcctacctgg

SEQ ID NO: 21386 - DNA, 20 bp, Homo sapiens
taggtaggatagtcaacatg

SEQ ID NO: 21387 - DNA, 22 bp, Homo sapiens
cagagggctgaggactagactg

SEQ ID NO: 21388 - DNA, 23 bp, Homo sapiens
acagcctgggtgtgacagtgtga

SEQ ID NO: 21389 - DNA, 20 bp, Homo sapiens
gggctgtagccgagggttcc

SEQ ID NO: 21390 - DNA, 22 bp, Homo sapiens
tcgacgtcgcggacctgcggga

SEQ ID NO: 21391 - DNA, 20 bp, Homo sapiens
acccttgccctcgggcctgc

SEQ ID NO: 21392 - DNA, 23 bp, Homo sapiens
acctggacggcaggctggagccc

SEQ ID NO: 21393 - DNA, 23 bp, Homo sapiens
tgagggacgccgcgggggcttcc

SEQ ID NO: 21394 - DNA, 23 bp, Homo sapiens
ccctgccttcctctctccgcagc

SEQ ID NO: 21395 - DNA, 20 bp, Homo sapiens
cgccccgcgccctctcgctc

SEQ ID NO: 21396 - DNA, 20 bp, Homo sapiens
gccaggcagaccgtggagta

SEQ ID NO: 21397 - DNA, 20 bp, Homo sapiens
gccatgttgggtctgaagcg

SEQ ID NO: 21398 - DNA, 23 bp, Homo sapiens
gccgcgatggcgctgttggccgg

SEQ ID NO: 21399 - DNA, 22 bp, Homo sapiens
tccctcctgtgcccctggcagc

SEQ ID NO: 21400 - DNA, 23 bp, Homo sapiens
gtgccccgaccctcctcggcccc

SEQ ID NO: 21401 - DNA, 21 bp, Homo sapiens
tctgccctcctactccccagg

SEQ ID NO: 21402 - DNA, 20 bp, Homo sapiens
cagccctccctttccccgcc

SEQ ID NO: 21403 - DNA, 22 bp, Homo sapiens
ctggctctgctgtctccccagg

SEQ ID NO: 21404 - DNA, 21 bp, Homo sapiens
cagggcccttgtcacctgcat

SEQ ID NO: 21405 - DNA, 23 bp, Homo sapiens
agggaggcccgcaaggacacagc

SEQ ID NO: 21406 - DNA, 21 bp, Homo sapiens
tgaccctccctgctcccctgg

SEQ ID NO: 21407 - DNA, 24 bp, Homo sapiens
agggcggcggcggcggcggcgggg

SEQ ID NO: 21408 - DNA, 24 bp, Homo sapiens
tttactgttgctactattactagt

SEQ ID NO: 21409 - DNA, 23 bp, Homo sapiens
cgggcgctcgccctccgcctcct

SEQ ID NO: 21410 - DNA, 21 bp, Homo sapiens
gcggcagagcgggcggcgcag

SEQ ID NO: 21411 - DNA, 24 bp, Homo sapiens
tgcgcccagctcgccctgcctagc

SEQ ID NO: 21412 - DNA, 22 bp, Homo sapiens
acagtcccattcctccactctg

SEQ ID NO: 21413 - DNA, 23 bp, Homo sapiens
caagactgacaacgccggcgacc

SEQ ID NO: 21414 - DNA, 22 bp, Homo sapiens
tggagcagaggcagcagccgga

SEQ ID NO: 21415 - DNA, 24 bp, Homo sapiens
caagctcacgcccctccccgcagg

SEQ ID NO: 21416 - DNA, 22 bp, Homo sapiens
ctaccgacccctctcgacctgc

SEQ ID NO: 21417 - DNA, 22 bp, Homo sapiens
ctggaacatggcagagggcata

SEQ ID NO: 21418 - DNA, 20 bp, Homo sapiens
ccctccccgggggcgcgggc

SEQ ID NO: 21419 - DNA, 22 bp, Homo sapiens
ccccaccccttcctcctgcagc

SEQ ID NO: 21420 - DNA, 22 bp, Homo sapiens
tgactgtcctatgtctttcctt

SEQ ID NO: 21421 - DNA, 20 bp, Homo sapiens
ggggccgtcaggcggggata

SEQ ID NO: 21422 - DNA, 23 bp, Homo sapiens
tctgtcctgccctgcttcccagt

SEQ ID NO: 21423 - DNA, 23 bp, Homo sapiens
tcccctcttccctgtcctccagt

SEQ ID NO: 21424 - DNA, 22 bp, Homo sapiens
tgcacgcgaccatagagccttc

SEQ ID NO: 21425 - DNA, 21 bp, Homo sapiens
cgctcagcccattcccctgca

SEQ ID NO: 21426 - DNA, 24 bp, Homo sapiens
tggccctcacacatgcctccccca

SEQ ID NO: 21427 - DNA, 20 bp, Homo sapiens
ctcacccctcccacccttca

SEQ ID NO: 21428 - DNA, 23 bp, Homo sapiens
gggttgggaaggtgatgggggaa

SEQ ID NO: 21429 - DNA, 24 bp, Homo sapiens
acgcgcggctcggcccgcctcccg

SEQ ID NO: 21430 - DNA, 20 bp, Homo sapiens
cccgctccccccgggcccaa

SEQ ID NO: 21431 - DNA, 24 bp, Homo sapiens
tccctctgtgctcacctcccagcc

SEQ ID NO: 21432 - DNA, 21 bp, Homo sapiens
gcacctgtgagtgagcgcctc

SEQ ID NO: 21433 - DNA, 22 bp, Homo sapiens
aatccatccccatcccctcagc

SEQ ID NO: 21434 - DNA, 22 bp, Homo sapiens
actcccgcaggcgtttcgctgg

SEQ ID NO: 21435 - DNA, 23 bp, Homo sapiens
ggtacggggccgggccagggtgc

SEQ ID NO: 21436 - DNA, 23 bp, Homo sapiens
gtgagcgctgctgagcgggaggt

SEQ ID NO: 21437 - DNA, 22 bp, Homo sapiens
tctgggcgaggaggggatggag

SEQ ID NO: 21438 - DNA, 23 bp, Homo sapiens
accgtggctcgcgctgtccccgg

SEQ ID NO: 21439 - DNA, 23 bp, Homo sapiens
gacgccctcaccctgccctcaga

SEQ ID NO: 21440 - DNA, 21 bp, Homo sapiens
ggcggcagcgggtgaggccgg

SEQ ID NO: 21441 - DNA, 24 bp, Homo sapiens
ccaacccagcagtccttccctcag

SEQ ID NO: 21442 - DNA, 21 bp, Homo sapiens
cggcaggaggaggtggaggag

SEQ ID NO: 21443 - DNA, 20 bp, Homo sapiens
tcctcggcggcctagtccct

SEQ ID NO: 21444 - DNA, 23 bp, Homo sapiens
gagccctgatccggatgctgggg

SEQ ID NO: 21445 - DNA, 24 bp, Homo sapiens
ggaggagtcggatggtgaggggga

SEQ ID NO: 21446 - DNA, 24 bp, Homo sapiens
tccttcgagaccggttcaagagct

SEQ ID NO: 21447 - DNA, 24 bp, Homo sapiens
cgcgtccaggtgggaggttagtgt

SEQ ID NO: 21448 - DNA, 23 bp, Homo sapiens
tctgtccaccttgcttcttcagg

SEQ ID NO: 21449 - DNA, 21 bp, Homo sapiens
ccagtgttggaggtgaggagg

SEQ ID NO: 21450 - DNA, 20 bp, Homo sapiens
acagagttgcgcttgctgcc

SEQ ID NO: 21451 - DNA, 21 bp, Homo sapiens
tctccctcccctgctcccagc

SEQ ID NO: 21452 - DNA, 23 bp, Homo sapiens
ccgtgagcgcagaggaggaggag

SEQ ID NO: 21453 - DNA, 21 bp, Homo sapiens
ggcgcccaggggggcggggag

SEQ ID NO: 21454 - DNA, 20 bp, Homo sapiens
aggtgatgggggcaggggat

SEQ ID NO: 21455 - DNA, 23 bp, Homo sapiens
ctggcgggcggggcctcgggtgg

SEQ ID NO: 21456 - DNA, 22 bp, Homo sapiens
tcacccctcgttgctgttgctc

SEQ ID NO: 21457 - DNA, 24 bp, Homo sapiens
agcctgaccccatgtccccccagg

SEQ ID NO: 21458 - DNA, 21 bp, Homo sapiens
tggcggcggcggggactcggg

SEQ ID NO: 21459 - DNA, 20 bp, Homo sapiens
cgcgctctcccccctccccg

SEQ ID NO: 21460 - DNA, 21 bp, Homo sapiens
gcgcgcggcgctcgctcccta

SEQ ID NO: 21461 - DNA, 24 bp, Homo sapiens
ttcctaccccgaggcccccagctg

SEQ ID NO: 21462 - DNA, 22 bp, Homo sapiens
cttccccttcctccccaccttg

SEQ ID NO: 21463 - DNA, 23 bp, Homo sapiens
aggatcgagccatgggctaccgg

SEQ ID NO: 21464 - DNA, 21 bp, Homo sapiens
tttacaagcctctgagcccca

SEQ ID NO: 21465 - DNA, 21 bp, Homo sapiens
ctgagctagaatacaagtagt

SEQ ID NO: 21466 - DNA, 21 bp, Homo sapiens
ccactacgccctgatgtccct

SEQ ID NO: 21467 - DNA, 23 bp, Homo sapiens
ctccagagggaagcgctttctgt

SEQ ID NO: 21468 - DNA, 24 bp, Homo sapiens
cccgtctgaccgtccccgcccagg

SEQ ID NO: 21469 - DNA, 22 bp, Homo sapiens
agtggcgggagcggcccctcgg

SEQ ID NO: 21470 - DNA, 22 bp, Homo sapiens
ccggggcaacacattgagactc

SEQ ID NO: 21471 - DNA, 22 bp, Homo sapiens
tctccctcctcctccgctcagc

SEQ ID NO: 21472 - DNA, 24 bp, Homo sapiens
gtggctgagagccctaagaagaag

SEQ ID NO: 21473 - DNA, 22 bp, Homo sapiens
cgcgctcctcccctgccccagc

SEQ ID NO: 21474 - DNA, 21 bp, Homo sapiens
agcgccgcgcccgcaccgtcc

SEQ ID NO: 21475 - DNA, 23 bp, Homo sapiens
cctaacctccgcacccccacagg

SEQ ID NO: 21476 - DNA, 23 bp, Homo sapiens
ggggctggggcgggcgggcgggg

SEQ ID NO: 21477 - DNA, 20 bp, Homo sapiens
ccccggggagccccgcgggg

SEQ ID NO: 21478 - DNA, 23 bp, Homo sapiens
tgcacctgtgcctccccttcccc

SEQ ID NO: 21479 - DNA, 23 bp, Homo sapiens
ctcccgccccccccttatccccc

SEQ ID NO: 21480 - DNA, 24 bp, Homo sapiens
cggcggggcggcggagccgtcggc

SEQ ID NO: 21481 - DNA, 22 bp, Homo sapiens
acagcgtctgcacctgctcact

SEQ ID NO: 21482 - DNA, 21 bp, Homo sapiens
cctgcctcatcacaattgccc

SEQ ID NO: 21483 - DNA, 22 bp, Homo sapiens
actccgctaacccaggtccgca

SEQ ID NO: 21484 - DNA, 20 bp, Homo sapiens
ccctggatgacagtgccacc

SEQ ID NO: 21485 - DNA, 24 bp, Homo sapiens
atgaggcccgcagcatccgcgacc

SEQ ID NO: 21486 - DNA, 24 bp, Homo sapiens
ctgtcccctggtctcctccgcagc

SEQ ID NO: 21487 - DNA, 24 bp, Homo sapiens
gggagcggggctgaagccctgggc

SEQ ID NO: 21488 - DNA, 23 bp, Homo sapiens
gcagggagtggaggaggaggtga

SEQ ID NO: 21489 - DNA, 20 bp, Homo sapiens
cccggcaccccgcagccagt

SEQ ID NO: 21490 - DNA, 22 bp, Homo sapiens
aactgcctgaagtcaaccaaca

SEQ ID NO: 21491 - DNA, 23 bp, Homo sapiens
tcactcacacgcgtctccccgca

SEQ ID NO: 21492 - DNA, 22 bp, Homo sapiens
ccccatgggaatcaggtcgagg

SEQ ID NO: 21493 - DNA, 22 bp, Homo sapiens
acatggagttcaggtgaggatt

SEQ ID NO: 21494 - DNA, 22 bp, Homo sapiens
aatcctcactttgaatccatgt

SEQ ID NO: 21495 - DNA, 23 bp, Homo sapiens
tggtcgtccttgcgggcccgggc

SEQ ID NO: 21496 - DNA, 24 bp, Homo sapiens
gctgctgagcgctcgctcccgcgt

SEQ ID NO: 21497 - DNA, 20 bp, Homo sapiens
tcctggggctgcagccggtc

SEQ ID NO: 21498 - DNA, 23 bp, Homo sapiens
cgtgactgcgcgccccgcccgga

SEQ ID NO: 21499 - DNA, 23 bp, Homo sapiens
cggcggccaggacctgggtctcc

SEQ ID NO: 21500 - DNA, 20 bp, Homo sapiens
gcccgcgagctccgacagtg

SEQ ID NO: 21501 - DNA, 22 bp, Homo sapiens
atcctgtgtcctccatgtattc

SEQ ID NO: 21502 - DNA, 22 bp, Homo sapiens
cgcatgtgaagccacaggatga

SEQ ID NO: 21503 - DNA, 21 bp, Homo sapiens
cctagaatggggattgtgggg

SEQ ID NO: 21504 - DNA, 23 bp, Homo sapiens
ttttgtgtcttttgcctttttaa

SEQ ID NO: 21505 - DNA, 23 bp, Homo sapiens
cggcggcggcggcggcggccccg

SEQ ID NO: 21506 - DNA, 22 bp, Homo sapiens
tggctggcccgtggggcgagga

SEQ ID NO: 21507 - DNA, 23 bp, Homo sapiens
gccgtcccacgggccagccccgc

SEQ ID NO: 21508 - DNA, 23 bp, Homo sapiens
ccctgggcgagcgccgcacccgg

SEQ ID NO: 21509 - DNA, 22 bp, Homo sapiens
aaagctataagatctctgtgtc

SEQ ID NO: 21510 - DNA, 23 bp, Homo sapiens
taccagctgctaccaccgctgcc

SEQ ID NO: 21511 - DNA, 22 bp, Homo sapiens
tcagccaccgcaccaggccagt

SEQ ID NO: 21512 - DNA, 22 bp, Homo sapiens
acgtagctatccaccactcagc

SEQ ID NO: 21513 - DNA, 23 bp, Homo sapiens
tcttctctaccagcactgcatga

SEQ ID NO: 21514 - DNA, 23 bp, Homo sapiens
cacgtgaaaccctgtctcttaaa

SEQ ID NO: 21515 - DNA, 24 bp, Homo sapiens
ccggagggcggggggccggggcgc

SEQ ID NO: 21516 - DNA, 23 bp, Homo sapiens
accgtcgtggccgtggccaacgt

SEQ ID NO: 21517 - DNA, 23 bp, Homo sapiens
gcgcgagggcagcaaccgcacca

SEQ ID NO: 21518 - DNA, 20 bp, Homo sapiens
aaaccagcagttacttttgc

SEQ ID NO: 21519 - DNA, 23 bp, Homo sapiens
ctgccctctctgatggagaccag

SEQ ID NO: 21520 - DNA, 22 bp, Homo sapiens
atgtttgtactccggccgctgc

SEQ ID NO: 21521 - DNA, 21 bp, Homo sapiens
tggccaaagtacaaacatttg

SEQ ID NO: 21522 - DNA, 22 bp, Homo sapiens
accccatctcccaccacacatg

SEQ ID NO: 21523 - DNA, 20 bp, Homo sapiens
ccccggtgccgtacagcaga

SEQ ID NO: 21524 - DNA, 22 bp, Homo sapiens
tcgtcggcctcgtgcgccaaca

SEQ ID NO: 21525 - DNA, 22 bp, Homo sapiens
caacagaaacctctaaacccga

SEQ ID NO: 21526 - DNA, 22 bp, Homo sapiens
tttggtgcatatttactttagg

SEQ ID NO: 21527 - DNA, 23 bp, Homo sapiens
ttggtgcagaagtaattgtagtt

SEQ ID NO: 21528 - DNA, 20 bp, Homo sapiens
ccctgaccaccagtatagca

SEQ ID NO: 21529 - DNA, 21 bp, Homo sapiens
cccgccgcgcccccctccacc

SEQ ID NO: 21530 - DNA, 22 bp, Homo sapiens
cggcgcgaccgctctcggcttt

SEQ ID NO: 21531 - DNA, 21 bp, Homo sapiens
catcagttcctaatgcattgc

SEQ ID NO: 21532 - DNA, 20 bp, Homo sapiens
gcgcgagtttgatcggggcg

SEQ ID NO: 21533 - DNA, 21 bp, Homo sapiens
ccccgggttgccaggggccgc

SEQ ID NO: 21534 - DNA, 23 bp, Homo sapiens
tgcccaggatggagtgcagtgaa

SEQ ID NO: 21535 - DNA, 22 bp, Homo sapiens
gaggagagagggagcaggctga

SEQ ID NO: 21536 - DNA, 24 bp, Homo sapiens
tgagcaacacagtgagactccttt

SEQ ID NO: 21537 - DNA, 23 bp, Homo sapiens
ccgcggccgcccctgctcctgct

SEQ ID NO: 21538 - DNA, 22 bp, Homo sapiens
ccagcctcagtctctgtatcct

SEQ ID NO: 21539 - DNA, 22 bp, Homo sapiens
gccgcggggcccctcgggcggc

SEQ ID NO: 21540 - DNA, 23 bp, Homo sapiens
catttgccttctctttccccagg

SEQ ID NO: 21541 - DNA, 22 bp, Homo sapiens
agaggagggtggagcaagtggt

SEQ ID NO: 21542 - DNA, 23 bp, Homo sapiens
tgacattcacactctgcccctgc

SEQ ID NO: 21543 - DNA, 22 bp, Homo sapiens
ggggtggggtcggtgggggtgc

SEQ ID NO: 21544 - DNA, 23 bp, Homo sapiens
gcaccgtcgtcctgtcgtccgcg

SEQ ID NO: 21545 - DNA, 20 bp, Homo sapiens
ccccgcggggtctcgccagc

SEQ ID NO: 21546 - DNA, 23 bp, Homo sapiens
gtgctgacgcggctggcagagca

SEQ ID NO: 21547 - DNA, 23 bp, Homo sapiens
gccgcctctccgagctcttgtga

SEQ ID NO: 21548 - DNA, 22 bp, Homo sapiens
tccctctcagcttctctcctgc

SEQ ID NO: 21549 - DNA, 22 bp, Homo sapiens
tggctattctagcagtgaagtt

SEQ ID NO: 21550 - DNA, 22 bp, Homo sapiens
ccagaactgcagttacttttgc

SEQ ID NO: 21551 - DNA, 23 bp, Homo sapiens
aagggtttgggtctgagctgtat

SEQ ID NO: 21552 - DNA, 20 bp, Homo sapiens
gccgttgatctccaggggca

SEQ ID NO: 21553 - DNA, 22 bp, Homo sapiens
cggcccaggatggggcgtcgcg

SEQ ID NO: 21554 - DNA, 21 bp, Homo sapiens
gcctggggacgcggggccgag

SEQ ID NO: 21555 - DNA, 23 bp, Homo sapiens
atgttcagttctacatgggatat

SEQ ID NO: 21556 - DNA, 22 bp, Homo sapiens
cctctccgccacctccaccgcg

SEQ ID NO: 21557 - DNA, 23 bp, Homo sapiens
aggggcagggcaggcataagtgg

SEQ ID NO: 21558 - DNA, 22 bp, Homo sapiens
acttctgcctgtcctgcccaaa

SEQ ID NO: 21559 - DNA, 21 bp, Homo sapiens
gccagtgacagcaagcagtgc

SEQ ID NO: 21560 - DNA, 22 bp, Homo sapiens
ttgcagatgaaaatatctaggt

SEQ ID NO: 21561 - DNA, 23 bp, Homo sapiens
gttcctcgcactgcctcctccga

SEQ ID NO: 21562 - DNA, 24 bp, Homo sapiens
gcctccctccaagcccgccccaaa

SEQ ID NO: 21563 - DNA, 20 bp, Homo sapiens
ccctccgggtgtccagcagc

SEQ ID NO: 21564 - DNA, 22 bp, Homo sapiens
cgaaaaccgcaattgcctttgc

SEQ ID NO: 21565 - DNA, 24 bp, Homo sapiens
cgccgccgtcccggtcctcccgcc

SEQ ID NO: 21566 - DNA, 21 bp, Homo sapiens
tgcccctctctcatgtccagg

SEQ ID NO: 21567 - DNA, 22 bp, Homo sapiens
ctccgccggcagccgcgggagc

SEQ ID NO: 21568 - DNA, 21 bp, Homo sapiens
gggacaaacaaagactttaca

SEQ ID NO: 21569 - DNA, 21 bp, Homo sapiens
tgtgcagtaggtatacaacag

SEQ ID NO: 21570 - DNA, 21 bp, Homo sapiens
gcggcggcggcggcgggaccg

SEQ ID NO: 21571 - DNA, 21 bp, Homo sapiens
tctgagcctccttgtcgcctg

SEQ ID NO: 21572 - DNA, 20 bp, Homo sapiens
cggccgggctgtggtccccg

SEQ ID NO: 21573 - DNA, 22 bp, Homo sapiens
tcagactacctaaatgagcact

SEQ ID NO: 21574 - DNA, 24 bp, Homo sapiens
agcggcctctcgtcgccctgcacg

SEQ ID NO: 21575 - DNA, 20 bp, Homo sapiens
cttgtaaggtagaaagcact

SEQ ID NO: 21576 - DNA, 22 bp, Homo sapiens
gggtcggcgcggcggcggcagc

SEQ ID NO: 21577 - DNA, 21 bp, Homo sapiens
gcccgggaagcagaaggaacg

SEQ ID NO: 21578 - DNA, 21 bp, Homo sapiens
agggccctgcagtgacggcgc

SEQ ID NO: 21579 - DNA, 24 bp, Homo sapiens
ttcgggctcccctcgggcagaggc

SEQ ID NO: 21580 - DNA, 24 bp, Homo sapiens
cctccccgcgcccccggcccggca

SEQ ID NO: 21581 - DNA, 23 bp, Homo sapiens
actgccggtccccaaccccaaga

SEQ ID NO: 21582 - DNA, 20 bp, Homo sapiens
gggcccggacgcagccacgc

SEQ ID NO: 21583 - DNA, 24 bp, Homo sapiens
ctctgggtccgtctcgtcgcgtcc

SEQ ID NO: 21584 - DNA, 22 bp, Homo sapiens
ccgacctcccccgcggccgcga

SEQ ID NO: 21585 - DNA, 24 bp, Homo sapiens
ggagtgttgcagtcgtacattcgc

SEQ ID NO: 21586 - DNA, 22 bp, Homo sapiens
cgcggccatagctgactgtgcc

SEQ ID NO: 21587 - DNA, 21 bp, Homo sapiens
ccgcccccggggagcccggat

SEQ ID NO: 21588 - DNA, 23 bp, Homo sapiens
accgagccctcgggacctcctga

SEQ ID NO: 21589 - DNA, 24 bp, Homo sapiens
accagaaggtccagggtccaggca

SEQ ID NO: 21590 - DNA, 22 bp, Homo sapiens
tgaggacaacagtaatacccca

SEQ ID NO: 21591 - DNA, 24 bp, Homo sapiens
cggcggcggcggcgactccgggcg

SEQ ID NO: 21592 - DNA, 22 bp, Homo sapiens
ctggcggctccgggtcgtggcg

SEQ ID NO: 21593 - DNA, 24 bp, Homo sapiens
cccggagtcgcctggaagcgtccg

SEQ ID NO: 21594 - DNA, 20 bp, Homo sapiens
accggccgccgccggcgagt

SEQ ID NO: 21595 - DNA, 22 bp, Homo sapiens
ggcgacaggccgagagttcgtc

SEQ ID NO: 21596 - DNA, 21 bp, Homo sapiens
cggccgctgggcgcagcgttc

SEQ ID NO: 21597 - DNA, 21 bp, Homo sapiens
ggcgggcggcggggcggggct

SEQ ID NO: 21598 - DNA, 22 bp, Homo sapiens
ctcatcccctgctgtcaggtcc

SEQ ID NO: 21599 - DNA, 20 bp, Homo sapiens
cgtggtcgcaggtgctgcct

SEQ ID NO: 21600 - DNA, 24 bp, Homo sapiens
ccagctgcaggagtacctggcgca

SEQ ID NO: 21601 - DNA, 22 bp, Homo sapiens
cccagcggcgagggcgcgaggt

SEQ ID NO: 21602 - DNA, 21 bp, Homo sapiens
gacctatgcagtgaggtctat

SEQ ID NO: 21603 - DNA, 22 bp, Homo sapiens
atgctcccatgaccatggcagg

SEQ ID NO: 21604 - DNA, 24 bp, Homo sapiens
tgacagccacctttccccgccagt

SEQ ID NO: 21605 - DNA, 22 bp, Homo sapiens
cagggcccgtgcgcgttccaga

SEQ ID NO: 21606 - DNA, 20 bp, Homo sapiens
ggccggtcggggggcggccc

SEQ ID NO: 21607 - DNA, 23 bp, Homo sapiens
cccgccccttccccctccccctg

SEQ ID NO: 21608 - DNA, 21 bp, Homo sapiens
tccctcaggtgcccgaggtcg

SEQ ID NO: 21609 - DNA, 21 bp, Homo sapiens
caggcatgacaacctcatact

SEQ ID NO: 21610 - DNA, 22 bp, Homo sapiens
ccctgcgaacccccagcaccat

SEQ ID NO: 21611 - DNA, 21 bp, Homo sapiens
gcgcttgggaagccgccaccg

SEQ ID NO: 21612 - DNA, 23 bp, Homo sapiens
ttctggtcggactggggaagaag

SEQ ID NO: 21613 - DNA, 23 bp, Homo sapiens
tactgagttgtgaaatactgtgg

SEQ ID NO: 21614 - DNA, 23 bp, Homo sapiens
agcagctggatacagaaatgctc

SEQ ID NO: 21615 - DNA, 23 bp, Homo sapiens
cagccccagcccgcgcctcgcgg

SEQ ID NO: 21616 - DNA, 21 bp, Homo sapiens
actgaggaaggaggtggagga

SEQ ID NO: 21617 - DNA, 21 bp, Homo sapiens
atctacttacactcagaatgc

SEQ ID NO: 21618 - DNA, 22 bp, Homo sapiens
tgaagtcccaggcaaaccagga

SEQ ID NO: 21619 - DNA, 21 bp, Homo sapiens
tggtccctttccgtgtaaact

SEQ ID NO: 21620 - DNA, 21 bp, Homo sapiens
tcactagatttggggattgac

SEQ ID NO: 21621 - DNA, 20 bp, Homo sapiens
cggcacagctgacgggtgcg

SEQ ID NO: 21622 - DNA, 20 bp, Homo sapiens
ggggtcggccccgcctggcc

SEQ ID NO: 21623 - DNA, 22 bp, Homo sapiens
gccgcgagccttcgagagcagc

SEQ ID NO: 21624 - DNA, 20 bp, Homo sapiens
tcgcgcccagaccgtgcggg

SEQ ID NO: 21625 - DNA, 21 bp, Homo sapiens
aggtgcgtggtcgtggcgcga

SEQ ID NO: 21626 - DNA, 20 bp, Homo sapiens
gccgcggcggccgtcggggg

SEQ ID NO: 21627 - DNA, 23 bp, Homo sapiens
tcgccaccatcccccaccccagg

SEQ ID NO: 21628 - DNA, 23 bp, Homo sapiens
ccattcttctttttctctctaga

SEQ ID NO: 21629 - DNA, 24 bp, Homo sapiens
tgcgcattagattctcagaggagc

SEQ ID NO: 21630 - DNA, 24 bp, Homo sapiens
atcccccacccgcgccggggctga

SEQ ID NO: 21631 - DNA, 22 bp, Homo sapiens
tcgccacctctaaccagtgaca

SEQ ID NO: 21632 - DNA, 21 bp, Homo sapiens
acgcgggagggagagcagtgt

SEQ ID NO: 21633 - DNA, 22 bp, Homo sapiens
atacacctgatcccatgagaag

SEQ ID NO: 21634 - DNA, 24 bp, Homo sapiens
cttgtcaaactctttaaaaattcc

SEQ ID NO: 21635 - DNA, 20 bp, Homo sapiens
ccacagatagcagatccaca

SEQ ID NO: 21636 - DNA, 24 bp, Homo sapiens
gaggctgaagcatggaggttgcag

SEQ ID NO: 21637 - DNA, 21 bp, Homo sapiens
gccgcggggaccagccgcgct

SEQ ID NO: 21638 - DNA, 23 bp, Homo sapiens
gtataggcctttagatcatctga

SEQ ID NO: 21639 - DNA, 21 bp, Homo sapiens
acaccagcttcctcttgttgc

SEQ ID NO: 21640 - DNA, 22 bp, Homo sapiens
tctcccccaaaggtatgcagag

SEQ ID NO: 21641 - DNA, 21 bp, Homo sapiens
ggaagtgctgccagcacgggg

SEQ ID NO: 21642 - DNA, 24 bp, Homo sapiens
ccgggcggcaccgcgaggcccact

SEQ ID NO: 21643 - DNA, 22 bp, Homo sapiens
ccgccgccgggcgggggcgggg

SEQ ID NO: 21644 - DNA, 22 bp, Homo sapiens
tgaaagatgacacgtgttgact

SEQ ID NO: 21645 - DNA, 22 bp, Homo sapiens
tgaaagatgacatgttgactga

SEQ ID NO: 21646 - DNA, 22 bp, Homo sapiens
tgtcatctttcatatagaagtt

SEQ ID NO: 21647 - DNA, 21 bp, Homo sapiens
gttcatgtattgcctcccagt

SEQ ID NO: 21648 - DNA, 22 bp, Homo sapiens
cgcgggccacgcgcggcggcga

SEQ ID NO: 21649 - DNA, 22 bp, Homo sapiens
tgcctcagaggtggctctcaca

SEQ ID NO: 21650 - DNA, 23 bp, Homo sapiens
tttggcttttcaggaagcccttc

SEQ ID NO: 21651 - DNA, 21 bp, Homo sapiens
tcggcacttaaaatccatacc

SEQ ID NO: 21652 - DNA, 21 bp, Homo sapiens
gccccgtgccccgagcccgga

SEQ ID NO: 21653 - DNA, 23 bp, Homo sapiens
gagctggcgcgagtgtcgccacg

SEQ ID NO: 21654 - DNA, 21 bp, Homo sapiens
cgcgaggcggtgccggggagg

SEQ ID NO: 21655 - DNA, 23 bp, Homo sapiens
accccgcctccgcctgggcacgg

SEQ ID NO: 21656 - DNA, 20 bp, Homo sapiens
gccgtgagtccgctgtggtc

SEQ ID NO: 21657 - DNA, 21 bp, Homo sapiens
agaccgcggcagggttccgtc

SEQ ID NO: 21658 - DNA, 21 bp, Homo sapiens
taccagggtagatacagatgt

SEQ ID NO: 21659 - DNA, 21 bp, Homo sapiens
cccgcctcccagtccgcctag

SEQ ID NO: 21660 - DNA, 23 bp, Homo sapiens
agcccctccctccaccaacagcc

SEQ ID NO: 21661 - DNA, 23 bp, Homo sapiens
gcgacgagcccctcgcacaaacc

SEQ ID NO: 21662 - DNA, 22 bp, Homo sapiens
gtcatttttgtgatctgcagct

SEQ ID NO: 21663 - DNA, 23 bp, Homo sapiens
cctctagtagctcctctcccgcc

SEQ ID NO: 21664 - DNA, 20 bp, Homo sapiens
gggaatcgaggcgcggctcc

SEQ ID NO: 21665 - DNA, 23 bp, Homo sapiens
ccttctctacccatcccaccaca

SEQ ID NO: 21666 - DNA, 22 bp, Homo sapiens
cttgagccctccctctctcatc

SEQ ID NO: 21667 - DNA, 20 bp, Homo sapiens
cgctgccatcgccggggtcc

SEQ ID NO: 21668 - DNA, 21 bp, Homo sapiens
agcctgacagcctcgcttcca

SEQ ID NO: 21669 - DNA, 22 bp, Homo sapiens
acaatataagattctgtcccct

SEQ ID NO: 21670 - DNA, 23 bp, Homo sapiens
gcggagaggggcgggcgcggggc

SEQ ID NO: 21671 - DNA, 22 bp, Homo sapiens
gcatcctgcagtgcctgggagc

SEQ ID NO: 21672 - DNA, 21 bp, Homo sapiens
tgcagaccgcgtgcgccggca

SEQ ID NO: 21673 - DNA, 22 bp, Homo sapiens
ttatttcaaaggacagctggaa

SEQ ID NO: 21674 - DNA, 23 bp, Homo sapiens
aggcagtgcccgaaggccagaga

SEQ ID NO: 21675 - DNA, 22 bp, Homo sapiens
tgcccacgttatctgcccttgc

SEQ ID NO: 21676 - DNA, 23 bp, Homo sapiens
tgtgtctccatttccccttcagc

SEQ ID NO: 21677 - DNA, 21 bp, Homo sapiens
cgcctagtgctgcacgacccc

SEQ ID NO: 21678 - DNA, 24 bp, Homo sapiens
gcctggcacagcggcggcagcgcg

SEQ ID NO: 21679 - DNA, 20 bp, Homo sapiens
ggcctgatgctgctgctgtg

SEQ ID NO: 21680 - DNA, 23 bp, Homo sapiens
agagcagagcagagccctggagc

SEQ ID NO: 21681 - DNA, 23 bp, Homo sapiens
cccggcccccagtgacgcccagg

SEQ ID NO: 21682 - DNA, 21 bp, Homo sapiens
cccgccgaggcgggggcccag

SEQ ID NO: 21683 - DNA, 23 bp, Homo sapiens
cgagctggctgatggtaccctgc

SEQ ID NO: 21684 - DNA, 24 bp, Homo sapiens
cacctgtcatggacatgcacctcc

SEQ ID NO: 21685 - DNA, 21 bp, Homo sapiens
gcccgtggacggtcaccttgt

SEQ ID NO: 21686 - DNA, 23 bp, Homo sapiens
aggccccgtgcagcccgcgccgc

SEQ ID NO: 21687 - DNA, 21 bp, Homo sapiens
tcaccgcccttcccgcccgcg

SEQ ID NO: 21688 - DNA, 21 bp, Homo sapiens
tccccgccgctccccgtcccc

SEQ ID NO: 21689 - DNA, 22 bp, Homo sapiens
tcccagaggggagaagtttcca

SEQ ID NO: 21690 - DNA, 23 bp, Homo sapiens
gcccactgggggcagacctggca

SEQ ID NO: 21691 - DNA, 22 bp, Homo sapiens
cgcatgctgtccagtggacaga

SEQ ID NO: 21692 - DNA, 22 bp, Homo sapiens
agtcctctgggtggttatgagc

SEQ ID NO: 21693 - DNA, 21 bp, Homo sapiens
gtttgaagtggttggggggct

SEQ ID NO: 21694 - DNA, 22 bp, Homo sapiens
agctccaggcagtcagctccac

SEQ ID NO: 21695 - DNA, 20 bp, Homo sapiens
cgggcggcggcggccggctc

SEQ ID NO: 21696 - DNA, 24 bp, Homo sapiens
ccccgggctagggcacacgcttcc

SEQ ID NO: 21697 - DNA, 24 bp, Homo sapiens
tccggaccctggtcttcccgacgc

SEQ ID NO: 21698 - DNA, 24 bp, Homo sapiens
gcaccaacggtggaggtacgggcg

SEQ ID NO: 21699 - DNA, 22 bp, Homo sapiens
tgcgtcaacgtctcccgccagc

SEQ ID NO: 21700 - DNA, 22 bp, Homo sapiens
ccagccctgacctgccccctgc

SEQ ID NO: 21701 - DNA, 22 bp, Homo sapiens
ccgggggcggcggagcccaggg

SEQ ID NO: 21702 - DNA, 24 bp, Homo sapiens
cgcgggacgcggagcccccgacgg

SEQ ID NO: 21703 - DNA, 21 bp, Homo sapiens
ggagcttctgcaggggctagc

SEQ ID NO: 21704 - DNA, 20 bp, Homo sapiens
ctgcttgcgactgcggaggc

SEQ ID NO: 21705 - DNA, 22 bp, Homo sapiens
cgggcccgctgcgggcgcctgc

SEQ ID NO: 21706 - DNA, 22 bp, Homo sapiens
ggcatggggtcgtgtcgtggga

SEQ ID NO: 21707 - DNA, 23 bp, Homo sapiens
tggcccaggggtcgctgacaggt

SEQ ID NO: 21708 - DNA, 22 bp, Homo sapiens
tcggcggctctgggcctgcggc

SEQ ID NO: 21709 - DNA, 21 bp, Homo sapiens
cgcgcgcgcgtccgcgggatc

SEQ ID NO: 21710 - DNA, 22 bp, Homo sapiens
tgcctggcgcagtggctctgcc

SEQ ID NO: 21711 - DNA, 21 bp, Homo sapiens
ccgggcagcagggcagcgtca

SEQ ID NO: 21712 - DNA, 23 bp, Homo sapiens
cgccctgcgagcccggcgcctgc

SEQ ID NO: 21713 - DNA, 22 bp, Homo sapiens
gctgttggtccacgccgcccgt

SEQ ID NO: 21714 - DNA, 24 bp, Homo sapiens
cgaggcagggtgaaactggcacgg

SEQ ID NO: 21715 - DNA, 21 bp, Homo sapiens
ctctgcagctgcgcgggcggg

SEQ ID NO: 21716 - DNA, 20 bp, Homo sapiens
gcgctgagccgcctgggcgc

SEQ ID NO: 21717 - DNA, 22 bp, Homo sapiens
gtagcctttcctgctccagcct

SEQ ID NO: 21718 - DNA, 21 bp, Homo sapiens
gaagttccaggagagggaggt

SEQ ID NO: 21719 - DNA, 22 bp, Homo sapiens
ccgccgggagccgggaagctag

SEQ ID NO: 21720 - DNA, 22 bp, Homo sapiens
cagcccccctcggagaagctca

SEQ ID NO: 21721 - DNA, 23 bp, Homo sapiens
gagcgctggcgaggcacggacgg

SEQ ID NO: 21722 - DNA, 22 bp, Homo sapiens
tgctgagggcccacttcttggt

SEQ ID NO: 21723 - DNA, 20 bp, Homo sapiens
tcttgtgggacagaaactga

SEQ ID NO: 21724 - DNA, 23 bp, Homo sapiens
ggttgtcgggatccgcggcagca

SEQ ID NO: 21725 - DNA, 20 bp, Homo sapiens
ctgaggatacttaactatgg

SEQ ID NO: 21726 - DNA, 23 bp, Homo sapiens
tccctgtgtgcagtccttcaacc

SEQ ID NO: 21727 - DNA, 20 bp, Homo sapiens
gcgggcggtcgggcggcggc

SEQ ID NO: 21728 - DNA, 22 bp, Homo sapiens
agcctcagctttgccagatcct

SEQ ID NO: 21729 - DNA, 20 bp, Homo sapiens
gagtccggcccagggcaggt

SEQ ID NO: 21730 - DNA, 22 bp, Homo sapiens
tgctggtcaggccccatgttgg

SEQ ID NO: 21731 - DNA, 21 bp, Homo sapiens
gtcgcgccgtgcccgggcccg

SEQ ID NO: 21732 - DNA, 23 bp, Homo sapiens
tccctgttctctgtgtttgcagc

SEQ ID NO: 21733 - DNA, 20 bp, Homo sapiens
ccggcggtacgggggtggtg

SEQ ID NO: 21734 - DNA, 22 bp, Homo sapiens
tggccgagcgcggctcgtcgcc

SEQ ID NO: 21735 - DNA, 22 bp, Homo sapiens
agcgagggttccgccggccacc

SEQ ID NO: 21736 - DNA, 21 bp, Homo sapiens
ccccgcgccgccccgcggggg

SEQ ID NO: 21737 - DNA, 23 bp, Homo sapiens
cgccggccttgaccccgcccacc

SEQ ID NO: 21738 - DNA, 22 bp, Homo sapiens
cccgggggcggcggtccgggtg

SEQ ID NO: 21739 - DNA, 22 bp, Homo sapiens
tccccctccccctccgcggccg

SEQ ID NO: 21740 - DNA, 22 bp, Homo sapiens
tccaactgtcaatgggtctaac

SEQ ID NO: 21741 - DNA, 20 bp, Homo sapiens
cccgccgaggagcagccgcg

SEQ ID NO: 21742 - DNA, 23 bp, Homo sapiens
tctgcagccctggagccccctgt

SEQ ID NO: 21743 - DNA, 24 bp, Homo sapiens
tggagggaccagggtttccagaga

SEQ ID NO: 21744 - DNA, 24 bp, Homo sapiens
ggggccggcggcgggcgccgcggg

SEQ ID NO: 21745 - DNA, 24 bp, Homo sapiens
gcggcggcggcggcgcgggcccat

SEQ ID NO: 21746 - DNA, 22 bp, Homo sapiens
cgccggagccgacccgagccga

SEQ ID NO: 21747 - DNA, 20 bp, Homo sapiens
caaccccacctcggccccca

SEQ ID NO: 21748 - DNA, 24 bp, Homo sapiens
gcctgagggacggaggccgggata

SEQ ID NO: 21749 - DNA, 24 bp, Homo sapiens
ctcgcgcggggggtaattcggggt

SEQ ID NO: 21750 - DNA, 20 bp, Homo sapiens
ggcggcggcgggggtgtccc

SEQ ID NO: 21751 - DNA, 22 bp, Homo sapiens
tggcgcccgacgcgcggccagc

SEQ ID NO: 21752 - DNA, 22 bp, Homo sapiens
accacagatgggagccaccaca

SEQ ID NO: 21753 - DNA, 21 bp, Homo sapiens
tgtggtggctcgcatctgtgg

SEQ ID NO: 21754 - DNA, 22 bp, Homo sapiens
accacagatgcgagccaccaca

SEQ ID NO: 21755 - DNA, 22 bp, Homo sapiens
ccgccgggtgaggagttgcgcg

SEQ ID NO: 21756 - DNA, 22 bp, Homo sapiens
tgggcgggcggggcagggggtg

SEQ ID NO: 21757 - DNA, 24 bp, Homo sapiens
gcagcgactggcatctgagttccc

SEQ ID NO: 21758 - DNA, 23 bp, Homo sapiens
cggagggcggcggcggcggcggc

SEQ ID NO: 21759 - DNA, 20 bp, Homo sapiens
agagctactcggagcaccgt

SEQ ID NO: 21760 - DNA, 22 bp, Homo sapiens
aagcgcgggcgggcggcgggcg

SEQ ID NO: 21761 - DNA, 23 bp, Homo sapiens
tccccgcacccgcaccgcggtta

SEQ ID NO: 21762 - DNA, 24 bp, Homo sapiens
cagccaccgtgcctggcctagagt

SEQ ID NO: 21763 - DNA, 21 bp, Homo sapiens
gggcccgcccgccttgggtcg

SEQ ID NO: 21764 - DNA, 24 bp, Homo sapiens
ccaccgccccgggatctccttgcg

SEQ ID NO: 21765 - DNA, 24 bp, Homo sapiens
ccgggcagggagtgcgggtcggtt

SEQ ID NO: 21766 - DNA, 21 bp, Homo sapiens
acaactaatctgactgggttt

SEQ ID NO: 21767 - DNA, 21 bp, Homo sapiens
actcaaccctgtcacctaggc

SEQ ID NO: 21768 - DNA, 20 bp, Homo sapiens
cctgttgctcctggggcccg

SEQ ID NO: 21769 - DNA, 20 bp, Homo sapiens
ggaagtagccgcaggcatgg

SEQ ID NO: 21770 - DNA, 24 bp, Homo sapiens
gacccactgtctgtgccttccagg

SEQ ID NO: 21771 - DNA, 21 bp, Homo sapiens
gccgccattgcctcgtgcccg

SEQ ID NO: 21772 - DNA, 23 bp, Homo sapiens
ccccccagcctctgggagtgcgc

SEQ ID NO: 21773 - DNA, 23 bp, Homo sapiens
ctcctacggtatgtcctagatga

SEQ ID NO: 21774 - DNA, 20 bp, Homo sapiens
cgcccgccgcgccgggagcc

SEQ ID NO: 21775 - DNA, 24 bp, Homo sapiens
cgcctcagttgccctcagccctca

SEQ ID NO: 21776 - DNA, 23 bp, Homo sapiens
ggctagagcccgacggggcccgg

SEQ ID NO: 21777 - DNA, 22 bp, Homo sapiens
ggcggcgcaacagcgggactgc

SEQ ID NO: 21778 - DNA, 23 bp, Homo sapiens
gggacgtcgagcgaagcgaggcc

SEQ ID NO: 21779 - DNA, 24 bp, Homo sapiens
tcggcgggcggcggcggcggcggg

SEQ ID NO: 21780 - DNA, 22 bp, Homo sapiens
ccagttctcaattcaactcaga

SEQ ID NO: 21781 - DNA, 22 bp, Homo sapiens
ggagctgaactgctaactggaa

SEQ ID NO: 21782 - DNA, 22 bp, Homo sapiens
acccccaaggattgtaagctct

SEQ ID NO: 21783 - DNA, 22 bp, Homo sapiens
agcttacaatccttgggggtca

SEQ ID NO: 21784 - DNA, 20 bp, Homo sapiens
acccccagagattgcacgct

SEQ ID NO: 21785 - DNA, 22 bp, Homo sapiens
ccgggagtcttggggcgcctgc

SEQ ID NO: 21786 - DNA, 22 bp, Homo sapiens
acagagcctgtccctctcatga

SEQ ID NO: 21787 - DNA, 22 bp, Homo sapiens
ctctggacctgctctcccctgg

SEQ ID NO: 21788 - DNA, 22 bp, Homo sapiens
cccgccgcgccgggctccgtcc

SEQ ID NO: 21789 - DNA, 22 bp, Homo sapiens
gtcgggatcggctggggcgtca

SEQ ID NO: 21790 - DNA, 22 bp, Homo sapiens
tcccgcagctcctgctctggtc

SEQ ID NO: 21791 - DNA, 22 bp, Homo sapiens
cctcatttcacctgcgctgtgg

SEQ ID NO: 21792 - DNA, 21 bp, Homo sapiens
gaggagtacccggaccggatc

SEQ ID NO: 21793 - DNA, 22 bp, Homo sapiens
ctccgggatgggcactctgctc

SEQ ID NO: 21794 - DNA, 22 bp, Homo sapiens
tcgctctttgtctcggctcgct

SEQ ID NO: 21795 - DNA, 23 bp, Homo sapiens
gcgcccagggcctccgccactcc

SEQ ID NO: 21796 - DNA, 21 bp, Homo sapiens
gagccccagtcgcgcgcccct

SEQ ID NO: 21797 - DNA, 20 bp, Homo sapiens
gagtcgcggcggaaggagcc

SEQ ID NO: 21798 - DNA, 23 bp, Homo sapiens
cagcaagccgctcggagcccagc

SEQ ID NO: 21799 - DNA, 22 bp, Homo sapiens
aaggcccgcctttgtggctgct

SEQ ID NO: 21800 - DNA, 21 bp, Homo sapiens
gccccgggcgggtgcgcggct

SEQ ID NO: 21801 - DNA, 23 bp, Homo sapiens
acatacttctttatatgcccata

SEQ ID NO: 21802 - DNA, 21 bp, Homo sapiens
ccccccactgctgggcgcgcc

SEQ ID NO: 21803 - DNA, 23 bp, Homo sapiens
gcggcggccgggagtcggaggca

SEQ ID NO: 21804 - DNA, 21 bp, Homo sapiens
ccgcggcgttcggggaaatgg

SEQ ID NO: 21805 - DNA, 22 bp, Homo sapiens
tggggccatgctgtcctgagcc

SEQ ID NO: 21806 - DNA, 21 bp, Homo sapiens
tcggggttcccgcgcccttct

SEQ ID NO: 21807 - DNA, 24 bp, Homo sapiens
ctctgacccctttgggaacctcca

SEQ ID NO: 21808 - DNA, 22 bp, Homo sapiens
caccttcctgccctcaggctgc

SEQ ID NO: 21809 - DNA, 22 bp, Homo sapiens
gggggcgggctccaggaggggc

SEQ ID NO: 21810 - DNA, 22 bp, Homo sapiens
aggggcttccttgggaccagtg

SEQ ID NO: 21811 - DNA, 23 bp, Homo sapiens
gcgccgccggccgggaccccagt

SEQ ID NO: 21812 - DNA, 21 bp, Homo sapiens
ccgcccccggagcccgcgccg

SEQ ID NO: 21813 - DNA, 24 bp, Homo sapiens
cggagtcctcaccctgcaccccac

SEQ ID NO: 21814 - DNA, 23 bp, Homo sapiens
ccgatgctcaccctgtccccagc

SEQ ID NO: 21815 - DNA, 21 bp, Homo sapiens
gtatgcgtgcacgtatgcata

SEQ ID NO: 21816 - DNA, 22 bp, Homo sapiens
cttcgaggatctgcaggccgcc

SEQ ID NO: 21817 - DNA, 21 bp, Homo sapiens
ctcccgaagctcccgcccagc

SEQ ID NO: 21818 - DNA, 23 bp, Homo sapiens
ctgcctgcgtccgcccgccccgc

SEQ ID NO: 21819 - DNA, 24 bp, Homo sapiens
ccccccgagcggctcaccggcttc

SEQ ID NO: 21820 - DNA, 24 bp, Homo sapiens
ccccgcgcgtgtgtcccggctgcg

SEQ ID NO: 21821 - DNA, 22 bp, Homo sapiens
cccgttcggcgcgcgcgtgcgc

SEQ ID NO: 21822 - DNA, 20 bp, Homo sapiens
gtcgcggtcccccgtcccgg

SEQ ID NO: 21823 - DNA, 20 bp, Homo sapiens
cccgggtcggggggtggggc

SEQ ID NO: 21824 - DNA, 22 bp, Homo sapiens
gggccccgggccctcgaccggg

SEQ ID NO: 21825 - DNA, 22 bp, Homo sapiens
cgcccgccggcggggctcggag

SEQ ID NO: 21826 - DNA, 22 bp, Homo sapiens
gcaccgcggtccgcctctcgct

SEQ ID NO: 21827 - DNA, 20 bp, Homo sapiens
gggggcgggtggttggggcg

SEQ ID NO: 21828 - DNA, 20 bp, Homo sapiens
ccggggaggtggagcgggag

SEQ ID NO: 21829 - DNA, 22 bp, Homo sapiens
gtcccctctctcccttccccaa

SEQ ID NO: 21830 - DNA, 22 bp, Homo sapiens
gaatgtatcacctggacttatc

SEQ ID NO: 21831 - DNA, 22 bp, Homo sapiens
tggctcggccgtcccgccggcc

SEQ ID NO: 21832 - DNA, 22 bp, Homo sapiens
acattctccccgatctcgatct

SEQ ID NO: 21833 - DNA, 22 bp, Homo sapiens
gttcgcagtgccgggagcccgc

SEQ ID NO: 21834 - DNA, 22 bp, Homo sapiens
gataatggacccacaaccagga

SEQ ID NO: 21835 - DNA, 22 bp, Homo sapiens
attccggactgtgagcggctgt

SEQ ID NO: 21836 - DNA, 20 bp, Homo sapiens
agaggccccccagggccgcg

SEQ ID NO: 21837 - DNA, 22 bp, Homo sapiens
ttagcatctggcactatggact

SEQ ID NO: 21838 - DNA, 22 bp, Homo sapiens
aactcgatgcaattcactttgt

SEQ ID NO: 21839 - DNA, 21 bp, Homo sapiens
cccgccccccgcccggcgggc

SEQ ID NO: 21840 - DNA, 22 bp, Homo sapiens
ttgcatgaaactctgagcaaga

SEQ ID NO: 21841 - DNA, 23 bp, Homo sapiens
agttcttgctcagagtttcacgg

SEQ ID NO: 21842 - DNA, 22 bp, Homo sapiens
gccctctgcctcccaaccttcc

SEQ ID NO: 21843 - DNA, 22 bp, Homo sapiens
gcgcctgagaagaggggacgcc

SEQ ID NO: 21844 - DNA, 23 bp, Homo sapiens
gcgcgacgccgggtggcccagca

SEQ ID NO: 21845 - DNA, 21 bp, Homo sapiens
tctggtggaactctgagaatt

SEQ ID NO: 21846 - DNA, 20 bp, Homo sapiens
ggagccgcgcgccgaacgga

SEQ ID NO: 21847 - DNA, 24 bp, Homo sapiens
acattgccagctcccagccccacc

SEQ ID NO: 21848 - DNA, 20 bp, Homo sapiens
gccggagcagtaggcacccg

SEQ ID NO: 21849 - DNA, 23 bp, Homo sapiens
agcagcactgctgtcctagccac

SEQ ID NO: 21850 - DNA, 22 bp, Homo sapiens
tggggctgcggtgggtcgggat

SEQ ID NO: 21851 - DNA, 21 bp, Homo sapiens
ctcggcctgtgggcactgagc

SEQ ID NO: 21852 - DNA, 22 bp, Homo sapiens
atctcccgcgccccgaggttgc

SEQ ID NO: 21853 - DNA, 20 bp, Homo sapiens
cagaaccaggaagggccagg

SEQ ID NO: 21854 - DNA, 20 bp, Homo sapiens
gccgcgcaggagcctcccgg

SEQ ID NO: 21855 - DNA, 23 bp, Homo sapiens
gtcccggacggcggtcccaagcg

SEQ ID NO: 21856 - DNA, 22 bp, Homo sapiens
tccccgcgtggaggtcccggga

SEQ ID NO: 21857 - DNA, 20 bp, Homo sapiens
gcgccgggtgctctcgcccc

SEQ ID NO: 21858 - DNA, 24 bp, Homo sapiens
gctgctgggtgtgggtggcgcgct

SEQ ID NO: 21859 - DNA, 20 bp, Homo sapiens
gccggcggggagggcgggga

SEQ ID NO: 21860 - DNA, 20 bp, Homo sapiens
ccccggggacccaggcgggc

SEQ ID NO: 21861 - DNA, 23 bp, Homo sapiens
tccgacctggggcggggggcggg

SEQ ID NO: 21862 - DNA, 20 bp, Homo sapiens
cccctccacgcgccccgcgc

SEQ ID NO: 21863 - DNA, 23 bp, Homo sapiens
aacatgatcctcccggacttcaa

SEQ ID NO: 21864 - DNA, 23 bp, Homo sapiens
aaagcccgtgggggacctgttca

SEQ ID NO: 21865 - DNA, 22 bp, Homo sapiens
cgcgcgcggctgcggggctcca

SEQ ID NO: 21866 - DNA, 23 bp, Homo sapiens
acccagggggcgcgggccgcacc

SEQ ID NO: 21867 - DNA, 23 bp, Homo sapiens
ccccaggccctgcagagctggca

SEQ ID NO: 21868 - DNA, 23 bp, Homo sapiens
ctccctgcagcggtcagaggatc

SEQ ID NO: 21869 - DNA, 23 bp, Homo sapiens
agaacggacttgggagccctcct

SEQ ID NO: 21870 - DNA, 21 bp, Homo sapiens
ccgcgcagcgctgggggcgcc

SEQ ID NO: 21871 - DNA, 21 bp, Homo sapiens
aggcagcatcaaggctgtggg

SEQ ID NO: 21872 - DNA, 21 bp, Homo sapiens
tgtgcaggtgctgtgtgggca

SEQ ID NO: 21873 - DNA, 23 bp, Homo sapiens
gctagtggcccggccggcctggg

SEQ ID NO: 21874 - DNA, 22 bp, Homo sapiens
actgcaacctctgcctccggta

SEQ ID NO: 21875 - DNA, 24 bp, Homo sapiens
agagtgatgcagctccctggggac

SEQ ID NO: 21876 - DNA, 21 bp, Homo sapiens
cgtgaagctgggggagctcgt

SEQ ID NO: 21877 - DNA, 21 bp, Homo sapiens
tgtcctccctctgctcgcagc

SEQ ID NO: 21878 - DNA, 20 bp, Homo sapiens
agcctgggcaggggggctga

SEQ ID NO: 21879 - DNA, 21 bp, Homo sapiens
taggtgtgtttctgtagtggt

SEQ ID NO: 21880 - DNA, 21 bp, Homo sapiens
gggaggagctcgaggcccaac

SEQ ID NO: 21881 - DNA, 22 bp, Homo sapiens
gctctgacgaggttgcactact

SEQ ID NO: 21882 - DNA, 22 bp, Homo sapiens
tccggcctcctccccccgcagg

SEQ ID NO: 21883 - DNA, 23 bp, Homo sapiens
gcggcggcggcggcggttactcc

SEQ ID NO: 21884 - DNA, 21 bp, Homo sapiens
gggcggccgaggccgccgtcg

SEQ ID NO: 21885 - DNA, 23 bp, Homo sapiens
ggtgcagccgcctgccgccgccg

SEQ ID NO: 21886 - DNA, 21 bp, Homo sapiens
ctgcagcacctgcagccgtcg

SEQ ID NO: 21887 - DNA, 20 bp, Homo sapiens
cctgcccggagggggcgggc

SEQ ID NO: 21888 - DNA, 22 bp, Homo sapiens
cctccgcaggccctgccggtgc

SEQ ID NO: 21889 - DNA, 23 bp, Homo sapiens
acatcgcgcacgtgcgccagcgc

SEQ ID NO: 21890 - DNA, 23 bp, Homo sapiens
cctttgcctctggctcaccctct

SEQ ID NO: 21891 - DNA, 20 bp, Homo sapiens
cggccgggcagacccaagtg

SEQ ID NO: 21892 - DNA, 23 bp, Homo sapiens
gatgcagtgcagtggtgcctcaa

SEQ ID NO: 21893 - DNA, 21 bp, Homo sapiens
agctctgtctgtgtctctagg

SEQ ID NO: 21894 - DNA, 23 bp, Homo sapiens
agggactcgctatgttgcccaga

SEQ ID NO: 21895 - DNA, 22 bp, Homo sapiens
cccgcccctcctccgcctcagc

SEQ ID NO: 21896 - DNA, 21 bp, Homo sapiens
gccactgacgtagcaccaggg

SEQ ID NO: 21897 - DNA, 21 bp, Homo sapiens
tagcagggtgggggggcagga

SEQ ID NO: 21898 - DNA, 24 bp, Homo sapiens
caggcagggctgagagggagcaca

SEQ ID NO: 21899 - DNA, 22 bp, Homo sapiens
ccccggcctctgtcggctccgt

SEQ ID NO: 21900 - DNA, 22 bp, Homo sapiens
tggcagtcaggattgttatgtt

SEQ ID NO: 21901 - DNA, 21 bp, Homo sapiens
gagcaggctccgggggacagg

SEQ ID NO: 21902 - DNA, 22 bp, Homo sapiens
gaagcgatcggggaagctcggg

SEQ ID NO: 21903 - DNA, 22 bp, Homo sapiens
ggggcagatccaggttcaggtg

SEQ ID NO: 21904 - DNA, 23 bp, Homo sapiens
tagcttgctgctgtgatgagtga

SEQ ID NO: 21905 - DNA, 21 bp, Homo sapiens
gtccctggaaggcagcttgga

SEQ ID NO: 21906 - DNA, 22 bp, Homo sapiens
tcctgacccagacccgtgccca

SEQ ID NO: 21907 - DNA, 24 bp, Homo sapiens
ctctcccgggctgccagccgggac

SEQ ID NO: 21908 - DNA, 23 bp, Homo sapiens
gaggctccccaaacttccggcct

SEQ ID NO: 21909 - DNA, 23 bp, Homo sapiens
ccgtctttcctcgtcttgcccgc

SEQ ID NO: 21910 - DNA, 23 bp, Homo sapiens
ccggcggagacttgggagtccgg

SEQ ID NO: 21911 - DNA, 22 bp, Homo sapiens
ccacggctgggaggagtgagga

SEQ ID NO: 21912 - DNA, 24 bp, Homo sapiens
caggcctcgatggggctgtgcttc

SEQ ID NO: 21913 - DNA, 24 bp, Homo sapiens
accctccctggctgggcccacacc

SEQ ID NO: 21914 - DNA, 23 bp, Homo sapiens
gagaggctgcggcggacgccagc

SEQ ID NO: 21915 - DNA, 22 bp, Homo sapiens
cggcctggcggacgcggtcggg

SEQ ID NO: 21916 - DNA, 22 bp, Homo sapiens
ttgcagatgcttttccctccaa

SEQ ID NO: 21917 - DNA, 22 bp, Homo sapiens
aggcgggaattccatctcattg

SEQ ID NO: 21918 - DNA, 22 bp, Homo sapiens
gctgctaacccgacccggattg

SEQ ID NO: 21919 - DNA, 23 bp, Homo sapiens
ttaccaccccttcctcacctcta

SEQ ID NO: 21920 - DNA, 22 bp, Homo sapiens
agtcacctccctcctggccagg

SEQ ID NO: 21921 - DNA, 24 bp, Homo sapiens
ctacctcctgcccttcccaccgca

SEQ ID NO: 21922 - DNA, 21 bp, Homo sapiens
gggccggtgcggcggcggcgg

SEQ ID NO: 21923 - DNA, 23 bp, Homo sapiens
ctgcacccagagtccctgacttt

SEQ ID NO: 21924 - DNA, 20 bp, Homo sapiens
acacgcaggcgcgagggcaa

SEQ ID NO: 21925 - DNA, 22 bp, Homo sapiens
cagctctcccagcccaacttcc

SEQ ID NO: 21926 - DNA, 21 bp, Homo sapiens
ggggcccggcgcggcaggggg

SEQ ID NO: 21927 - DNA, 21 bp, Homo sapiens
ggtgcccgggtgaggggcgga

SEQ ID NO: 21928 - DNA, 22 bp, Homo sapiens
cgcccaccccccgccccccgcc

SEQ ID NO: 21929 - DNA, 23 bp, Homo sapiens
gatgcctgggagttgcgatctgc

SEQ ID NO: 21930 - DNA, 22 bp, Homo sapiens
gacgaatttttgagcgggtaaa

SEQ ID NO: 21931 - DNA, 21 bp, Homo sapiens
cctggccctgtcccctgcaga

SEQ ID NO: 21932 - DNA, 23 bp, Homo sapiens
tccaggggcagtctgccacccat

SEQ ID NO: 21933 - DNA, 23 bp, Homo sapiens
gtccaggcgccctctggatccgg

SEQ ID NO: 21934 - DNA, 20 bp, Homo sapiens
cacctctcccgcgggacgcg

SEQ ID NO: 21935 - DNA, 20 bp, Homo sapiens
cgggcggcggcgggcggggg

SEQ ID NO: 21936 - DNA, 23 bp, Homo sapiens
gatcggcccgtgacgccctcacc

SEQ ID NO: 21937 - DNA, 24 bp, Homo sapiens
aggagggaggagatgggccaagtt

SEQ ID NO: 21938 - DNA, 21 bp, Homo sapiens
gctacatagtgagactcctgt

SEQ ID NO: 21939 - DNA, 20 bp, Homo sapiens
acccaggcctcccgactccc

SEQ ID NO: 21940 - DNA, 21 bp, Homo sapiens
cccatctcactcttgcccatc

SEQ ID NO: 21941 - DNA, 21 bp, Homo sapiens
cctagcgccccgcggccgctg

SEQ ID NO: 21942 - DNA, 20 bp, Homo sapiens
gacatggggaggagacccag

SEQ ID NO: 21943 - DNA, 23 bp, Homo sapiens
tttcttgtggtcagacgtttgga

SEQ ID NO: 21944 - DNA, 24 bp, Homo sapiens
gcgcgccgcagggcgcacagcaga

SEQ ID NO: 21945 - DNA, 22 bp, Homo sapiens
ccggctccccggcgccgctggg

SEQ ID NO: 21946 - DNA, 21 bp, Homo sapiens
tatactgaacagtgcacccga

SEQ ID NO: 21947 - DNA, 21 bp, Homo sapiens
cgccgccgctcctgggcgcgg

SEQ ID NO: 21948 - DNA, 21 bp, Homo sapiens
ggttcgtgcggaccgtggggt

SEQ ID NO: 21949 - DNA, 22 bp, Homo sapiens
cggcggcgtcgcgggcggcggg

SEQ ID NO: 21950 - DNA, 22 bp, Homo sapiens
cggccgcaggacctggagctcc

SEQ ID NO: 21951 - DNA, 23 bp, Homo sapiens
cccagcctgctgtcccaggtgaa

SEQ ID NO: 21952 - DNA, 23 bp, Homo sapiens
tctgcgtccccggctgtctgcgc

SEQ ID NO: 21953 - DNA, 22 bp, Homo sapiens
cgggccggggcggcggcggggg

SEQ ID NO: 21954 - DNA, 23 bp, Homo sapiens
ggccatggcctgcagggccccca

SEQ ID NO: 21955 - DNA, 23 bp, Homo sapiens
ggaggagctctgggcccacccag

SEQ ID NO: 21956 - DNA, 21 bp, Homo sapiens
cgggagggcagtggaggcgtg

SEQ ID NO: 21957 - DNA, 22 bp, Homo sapiens
ctcacccctgtggcactctggg

SEQ ID NO: 21958 - DNA, 22 bp, Homo sapiens
tctgggtgcctccacggagtgg

SEQ ID NO: 21959 - DNA, 23 bp, Homo sapiens
caggtggaggtgtgaggtcctgg

SEQ ID NO: 21960 - DNA, 20 bp, Homo sapiens
ctgcttctgctactggagcc

SEQ ID NO: 21961 - DNA, 24 bp, Homo sapiens
ggacccaggtgcggggctggctac

SEQ ID NO: 21962 - DNA, 23 bp, Homo sapiens
gacgctaactcggatgctcccag

SEQ ID NO: 21963 - DNA, 23 bp, Homo sapiens
cccggggccagcgccgtggtcgt

SEQ ID NO: 21964 - DNA, 24 bp, Homo sapiens
tcacgccccccaccatcctcaagt

SEQ ID NO: 21965 - DNA, 20 bp, Homo sapiens
gggggccctgaggaaaccgg

SEQ ID NO: 21966 - DNA, 21 bp, Homo sapiens
gaggcccgtgcgcccgcggct

SEQ ID NO: 21967 - DNA, 22 bp, Homo sapiens
tatcttatggataggaagcagg

SEQ ID NO: 21968 - DNA, 21 bp, Homo sapiens
agactggcggatcagagctgg

SEQ ID NO: 21969 - DNA, 20 bp, Homo sapiens
cccgccggtgtccgcccgtg

SEQ ID NO: 21970 - DNA, 22 bp, Homo sapiens
aaaagtgagccagacgtggtag

SEQ ID NO: 21971 - DNA, 21 bp, Homo sapiens
cacgcctggctcaaattttgt

SEQ ID NO: 21972 - DNA, 21 bp, Homo sapiens
ttagcaatcattagacatatt

SEQ ID NO: 21973 - DNA, 21 bp, Homo sapiens
atgtgcctaatgactgctagt

SEQ ID NO: 21974 - DNA, 20 bp, Homo sapiens
cagcgggctgagtgagctgc

SEQ ID NO: 21975 - DNA, 22 bp, Homo sapiens
accacgtcctcttccctccaca

SEQ ID NO: 21976 - DNA, 20 bp, Homo sapiens
gcgctgcgtgggggcggtgg

SEQ ID NO: 21977 - DNA, 23 bp, Homo sapiens
gcggccacagctcggcgccaacc

SEQ ID NO: 21978 - DNA, 22 bp, Homo sapiens
cccgcgatggtgagagagccgg

SEQ ID NO: 21979 - DNA, 23 bp, Homo sapiens
ctctgccaataccttctcccgcc

SEQ ID NO: 21980 - DNA, 22 bp, Homo sapiens
actgaggggatgaaggatcagg

SEQ ID NO: 21981 - DNA, 23 bp, Homo sapiens
gctccgcccccggggccgcggtt

SEQ ID NO: 21982 - DNA, 23 bp, Homo sapiens
agctccgcgccctgccgccccgg

SEQ ID NO: 21983 - DNA, 23 bp, Homo sapiens
tggtgccccggaggttctggaga

SEQ ID NO: 21984 - DNA, 24 bp, Homo sapiens
tttagcattttacagcatcacagt

SEQ ID NO: 21985 - DNA, 22 bp, Homo sapiens
tactgtaaaatgctaaacatga

SEQ ID NO: 21986 - DNA, 21 bp, Homo sapiens
tttagcattttacagtatcca

SEQ ID NO: 21987 - DNA, 22 bp, Homo sapiens
atgctgtaaaatgctaaacatg

SEQ ID NO: 21988 - DNA, 23 bp, Homo sapiens
ctcaccagtgccagcaaggagtc

SEQ ID NO: 21989 - DNA, 21 bp, Homo sapiens
gtcattgctgcctgttggtgt

SEQ ID NO: 21990 - DNA, 23 bp, Homo sapiens
tgcgtctgtccctcgccggagcc

SEQ ID NO: 21991 - DNA, 22 bp, Homo sapiens
tgcctgctttccctgccccagg

SEQ ID NO: 21992 - DNA, 24 bp, Homo sapiens
cggcggcagcggcagcggagccgc

SEQ ID NO: 21993 - DNA, 23 bp, Homo sapiens
agcgtcggcgactgtctctccgc

SEQ ID NO: 21994 - DNA, 20 bp, Homo sapiens
ttggcggcgaggtctcggcg

SEQ ID NO: 21995 - DNA, 20 bp, Homo sapiens
gcggcggcggcggggtgtgc

SEQ ID NO: 21996 - DNA, 20 bp, Homo sapiens
cggctggacgtccgctccgg

SEQ ID NO: 21997 - DNA, 23 bp, Homo sapiens
tgtttcgttgtcaaataccctgt

SEQ ID NO: 21998 - DNA, 21 bp, Homo sapiens
tgtgttgcatgtgtgtatatg

SEQ ID NO: 21999 - DNA, 24 bp, Homo sapiens
cccggtagccgggaggcggccgtc

SEQ ID NO: 22000 - DNA, 22 bp, Homo sapiens
gctagcgctgctgtgcgtggcc

SEQ ID NO: 22001 - DNA, 24 bp, Homo sapiens
aaaaactgtgattacttttgcatc

SEQ ID NO: 22002 - DNA, 23 bp, Homo sapiens
ctgcatctcaggtctgcacctct

SEQ ID NO: 22003 - DNA, 21 bp, Homo sapiens
attcccagggaagtgctctga

SEQ ID NO: 22004 - DNA, 23 bp, Homo sapiens
cacactggccttacttcctgacc

SEQ ID NO: 22005 - DNA, 22 bp, Homo sapiens
ctttgtctctctgatggagttt

SEQ ID NO: 22006 - DNA, 21 bp, Homo sapiens
tttttaattggtatgttgata

SEQ ID NO: 22007 - DNA, 23 bp, Homo sapiens
tcccctgtcccaagcccgacgcc

SEQ ID NO: 22008 - DNA, 23 bp, Homo sapiens
gcgctgcctctctggggccctgg

SEQ ID NO: 22009 - DNA, 21 bp, Homo sapiens
cgcggccctgcgcctccgcct

SEQ ID NO: 22010 - DNA, 22 bp, Homo sapiens
ccccccagctgtccgcagcaga

SEQ ID NO: 22011 - DNA, 20 bp, Homo sapiens
cagcaggccctgaatcagga

SEQ ID NO: 22012 - DNA, 22 bp, Homo sapiens
accggtgctcctgtctaacgga

SEQ ID NO: 22013 - DNA, 22 bp, Homo sapiens
ccttgagcccccagggcagcag

SEQ ID NO: 22014 - DNA, 23 bp, Homo sapiens
ggtgggcagtagatagtcagtct

SEQ ID NO: 22015 - DNA, 22 bp, Homo sapiens
acagtacctgggttcttctcct

SEQ ID NO: 22016 - DNA, 21 bp, Homo sapiens
gctggggccgcccgcggggct

SEQ ID NO: 22017 - DNA, 23 bp, Homo sapiens
ctctgcctcctcaccttgcaccc

SEQ ID NO: 22018 - DNA, 22 bp, Homo sapiens
ccaagtgattccaatgagcagc

SEQ ID NO: 22019 - DNA, 22 bp, Homo sapiens
ctcctctgcccaatcctccagg

SEQ ID NO: 22020 - DNA, 24 bp, Homo sapiens
gcctcgtgtgatgctgggcccatg

SEQ ID NO: 22021 - DNA, 20 bp, Homo sapiens
cctgaggatgaaggtcagaa

SEQ ID NO: 22022 - DNA, 22 bp, Homo sapiens
caggagcagcccgcaccggaca

SEQ ID NO: 22023 - DNA, 22 bp, Homo sapiens
tgccttgccctctccctctagg

SEQ ID NO: 22024 - DNA, 24 bp, Homo sapiens
gctgcttttgggattccgttgccc

SEQ ID NO: 22025 - DNA, 23 bp, Homo sapiens
ggacgaaatccaagcgcagctgg

SEQ ID NO: 22026 - DNA, 20 bp, Homo sapiens
ccgctctcgcgccacctagc

SEQ ID NO: 22027 - DNA, 21 bp, Homo sapiens
cccagtgggcagcgccgggag

SEQ ID NO: 22028 - DNA, 23 bp, Homo sapiens
ctgggatgggggttggggggagg

SEQ ID NO: 22029 - DNA, 22 bp, Homo sapiens
cccccaacccccatcccagtta

SEQ ID NO: 22030 - DNA, 20 bp, Homo sapiens
tgtgcccttgcccaccaacc

SEQ ID NO: 22031 - DNA, 22 bp, Homo sapiens
cggatcctggggcttcctccct

SEQ ID NO: 22032 - DNA, 23 bp, Homo sapiens
ccaggtgcgcgtcagtgtgatgc

SEQ ID NO: 22033 - DNA, 22 bp, Homo sapiens
tcggcctttccctgcgcccggc

SEQ ID NO: 22034 - DNA, 22 bp, Homo sapiens
cgccgtgggtcccggccctacc

SEQ ID NO: 22035 - DNA, 23 bp, Homo sapiens
tcgccttccccaacctcaggtct

SEQ ID NO: 22036 - DNA, 21 bp, Homo sapiens
tagagtaaacagacaacctct

SEQ ID NO: 22037 - DNA, 21 bp, Homo sapiens
caggcggggcagcggaggtga

SEQ ID NO: 22038 - DNA, 22 bp, Homo sapiens
ccttctcgagccttgagtgtgc

SEQ ID NO: 22039 - DNA, 20 bp, Homo sapiens
ggctcaaggttcaagaaggc

SEQ ID NO: 22040 - DNA, 23 bp, Homo sapiens
gcggtgccctcagttccccagca

SEQ ID NO: 22041 - DNA, 22 bp, Homo sapiens
cctgaccagccccttctcgtgc

SEQ ID NO: 22042 - DNA, 23 bp, Homo sapiens
gacatgcggagactggtgcacgg

SEQ ID NO: 22043 - DNA, 22 bp, Homo sapiens
ttcctcataattgtaaggcaca

SEQ ID NO: 22044 - DNA, 24 bp, Homo sapiens
ctcggggccacagcgccgtcgggg

SEQ ID NO: 22045 - DNA, 22 bp, Homo sapiens
ttacctgtcccctgtccttagg

SEQ ID NO: 22046 - DNA, 21 bp, Homo sapiens
aacacaaatattttgcaccaa

SEQ ID NO: 22047 - DNA, 23 bp, Homo sapiens
cctgcccatcacccatgtgctgt

SEQ ID NO: 22048 - DNA, 22 bp, Homo sapiens
agctcatggtatgtggtcagtg

SEQ ID NO: 22049 - DNA, 21 bp, Homo sapiens
cgcggtgagttttccagcctg

SEQ ID NO: 22050 - DNA, 21 bp, Homo sapiens
cgcgccgcagagcgcgcttgc

SEQ ID NO: 22051 - DNA, 21 bp, Homo sapiens
acacctatatatatctaagct

SEQ ID NO: 22052 - DNA, 24 bp, Homo sapiens
aggctgggggaagcgggaaggtga

SEQ ID NO: 22053 - DNA, 21 bp, Homo sapiens
tagcaccatttctggcttcaa

SEQ ID NO: 22054 - DNA, 21 bp, Homo sapiens
aaagcccatgtttgtattgga

SEQ ID NO: 22055 - DNA, 22 bp, Homo sapiens
cctagcacaagtcagtccgcac

SEQ ID NO: 22056 - DNA, 22 bp, Homo sapiens
cccggatgccttgtccttagct

SEQ ID NO: 22057 - DNA, 21 bp, Homo sapiens
ccggagtggcggaggcacggg

SEQ ID NO: 22058 - DNA, 22 bp, Homo sapiens
gagcctgtgcgcctcggtctga

SEQ ID NO: 22059 - DNA, 20 bp, Homo sapiens
cctatagcataataatgtta

SEQ ID NO: 22060 - DNA, 22 bp, Homo sapiens
tgtgtgtgcatggatatatata

SEQ ID NO: 22061 - DNA, 23 bp, Homo sapiens
aaggagatctgagagctggaagt

SEQ ID NO: 22062 - DNA, 21 bp, Homo sapiens
ccgcgggctggggcacggctc

SEQ ID NO: 22063 - DNA, 20 bp, Homo sapiens
ctgccagctgggtgccccct

SEQ ID NO: 22064 - DNA, 24 bp, Homo sapiens
gccgacagctccctgagccagccc

SEQ ID NO: 22065 - DNA, 23 bp, Homo sapiens
cccaggcagcccgcgacggaccg

SEQ ID NO: 22066 - DNA, 23 bp, Homo sapiens
ggtctcggccgcggtggcggcgg

SEQ ID NO: 22067 - DNA, 23 bp, Homo sapiens
tggctcagttcaagtccaacagc

SEQ ID NO: 22068 - DNA, 23 bp, Homo sapiens
agctcagggcccgctggctcgcc

SEQ ID NO: 22069 - DNA, 21 bp, Homo sapiens
cttggatcctcaacacaccca

SEQ ID NO: 22070 - DNA, 22 bp, Homo sapiens
tcggggtctggccggagtcccg

SEQ ID NO: 22071 - DNA, 20 bp, Homo sapiens
cttatcctgcaaggtgctgc

SEQ ID NO: 22072 - DNA, 21 bp, Homo sapiens
cgtatatgtctatatacgtat

SEQ ID NO: 22073 - DNA, 24 bp, Homo sapiens
cggagctgaggatggctgtgcccg

SEQ ID NO: 22074 - DNA, 21 bp, Homo sapiens
tgccctccttgggaatctaca

SEQ ID NO: 22075 - DNA, 23 bp, Homo sapiens
gcagattcccagagtgggacagg

SEQ ID NO: 22076 - DNA, 21 bp, Homo sapiens
gtccgtaatggggcagtgagg

SEQ ID NO: 22077 - DNA, 24 bp, Homo sapiens
tccctctccctccttgctcctacc

SEQ ID NO: 22078 - DNA, 21 bp, Homo sapiens
aaaatgcagaatccatttctg

SEQ ID NO: 22079 - DNA, 24 bp, Homo sapiens
ctgccttggggcccgggctctccg

SEQ ID NO: 22080 - DNA, 24 bp, Homo sapiens
ctgcgagcgcgctccccgcctcaa

SEQ ID NO: 22081 - DNA, 21 bp, Homo sapiens
accgatgttcagctcagtagg

SEQ ID NO: 22082 - DNA, 22 bp, Homo sapiens
tgccaaagccagtggggactgg

SEQ ID NO: 22083 - DNA, 20 bp, Homo sapiens
ggcaccgcgtgcaggcacag

SEQ ID NO: 22084 - DNA, 22 bp, Homo sapiens
tgcgcacatccccagggccgaa

SEQ ID NO: 22085 - DNA, 20 bp, Homo sapiens
caggcagtgccccgtagaga

SEQ ID NO: 22086 - DNA, 21 bp, Homo sapiens
gcgggcgcgggggggaggtgc

SEQ ID NO: 22087 - DNA, 22 bp, Homo sapiens
gacgctgccttgccctcccagt

SEQ ID NO: 22088 - DNA, 23 bp, Homo sapiens
tcactcccccttcctcgcgcagg

SEQ ID NO: 22089 - DNA, 22 bp, Homo sapiens
ttcttgccatcctcagcgctgg

SEQ ID NO: 22090 - DNA, 21 bp, Homo sapiens
aggtcctgaagctgatgcctg

SEQ ID NO: 22091 - DNA, 22 bp, Homo sapiens
cccatgagctccacctgcctgc

SEQ ID NO: 22092 - DNA, 22 bp, Homo sapiens
cccgtgagctccacctgcctgc

SEQ ID NO: 22093 - DNA, 22 bp, Homo sapiens
aggcaggtggagctcatgggca

SEQ ID NO: 22094 - DNA, 22 bp, Homo sapiens
agaagccggagcagcgctcgca

SEQ ID NO: 22095 - DNA, 21 bp, Homo sapiens
gccgtggggcaggcagatgcg

SEQ ID NO: 22096 - DNA, 23 bp, Homo sapiens
accggttacggcagctccttctt

SEQ ID NO: 22097 - DNA, 22 bp, Homo sapiens
gaggcgggagcagaccagcacg

SEQ ID NO: 22098 - DNA, 24 bp, Homo sapiens
tggcccgcggtgtctggcgctcgg

SEQ ID NO: 22099 - DNA, 22 bp, Homo sapiens
taacaggatgatggcctaaaca

SEQ ID NO: 22100 - DNA, 23 bp, Homo sapiens
tgtaagtcaagtctgaaggtgcc

SEQ ID NO: 22101 - DNA, 23 bp, Homo sapiens
tctaccgttgccagcccggctgc

SEQ ID NO: 22102 - DNA, 24 bp, Homo sapiens
aacaccatttcctctctgctcctc

SEQ ID NO: 22103 - DNA, 21 bp, Homo sapiens
gtgccttagttattagaggga

SEQ ID NO: 22104 - DNA, 23 bp, Homo sapiens
tcgccagccatgctcagcctcca

SEQ ID NO: 22105 - DNA, 22 bp, Homo sapiens
caatgtctgtgctaaagaagcc

SEQ ID NO: 22106 - DNA, 21 bp, Homo sapiens
catgtccgtgctaaagaagcc

SEQ ID NO: 22107 - DNA, 23 bp, Homo sapiens
tgagtgataatctgggcatctgg

SEQ ID NO: 22108 - DNA, 22 bp, Homo sapiens
tgcccggattatcacttactag

SEQ ID NO: 22109 - DNA, 22 bp, Homo sapiens
aggttgtaggatgctaaacaga

SEQ ID NO: 22110 - DNA, 22 bp, Homo sapiens
tgtttagcatcctgtagcctgc

SEQ ID NO: 22111 - DNA, 20 bp, Homo sapiens
gccggcgggagttccgggtg

SEQ ID NO: 22112 - DNA, 23 bp, Homo sapiens
ctcagcttcgctgcccgcccagg

SEQ ID NO: 22113 - DNA, 22 bp, Homo sapiens
atgtctactgtgatacagtcaa

SEQ ID NO: 22114 - DNA, 20 bp, Homo sapiens
cggcttgtgctcagacctcg

SEQ ID NO: 22115 - DNA, 23 bp, Homo sapiens
agaagctcaaatcaagcccttgc

SEQ ID NO: 22116 - DNA, 21 bp, Homo sapiens
gttccggctgcgttgggcttg

SEQ ID NO: 22117 - DNA, 22 bp, Homo sapiens
tactgagtcctttgttctctac

SEQ ID NO: 22118 - DNA, 22 bp, Homo sapiens
tagcatataattacaactctga

SEQ ID NO: 22119 - DNA, 21 bp, Homo sapiens
gagttgtaattatatgctatt

SEQ ID NO: 22120 - DNA, 22 bp, Homo sapiens
tggcatataattacaactttgt

SEQ ID NO: 22121 - DNA, 21 bp, Homo sapiens
tcagccccggggaggtcgtgc

SEQ ID NO: 22122 - DNA, 21 bp, Homo sapiens
ccagagcagtatatcgcccct

SEQ ID NO: 22123 - DNA, 21 bp, Homo sapiens
tgtatatacttgtgcatatat

SEQ ID NO: 22124 - DNA, 22 bp, Homo sapiens
tttcagtaactcaaataaaaaa

SEQ ID NO: 22125 - DNA, 22 bp, Homo sapiens
tcagtatgccatgttgccatat

SEQ ID NO: 22126 - DNA, 22 bp, Homo sapiens
tcctcttctcttcccccccacc

SEQ ID NO: 22127 - DNA, 23 bp, Homo sapiens
cccggcagcggtggcagcggtag

SEQ ID NO: 22128 - DNA, 23 bp, Homo sapiens
cgcccgctctcctctccctcggc

SEQ ID NO: 22129 - DNA, 20 bp, Homo sapiens
gacgaggcgccgcccgccgc

SEQ ID NO: 22130 - DNA, 23 bp, Homo sapiens
caggcccagctagctggacactt

SEQ ID NO: 22131 - DNA, 23 bp, Homo sapiens
gccgaggtggtgtccggcttcga

SEQ ID NO: 22132 - DNA, 21 bp, Homo sapiens
cccagcagtctccagcggcgg

SEQ ID NO: 22133 - DNA, 24 bp, Homo sapiens
cggcggagatggaggagggaggcc

SEQ ID NO: 22134 - DNA, 20 bp, Homo sapiens
cgcgcgggcgcggactgagg

SEQ ID NO: 22135 - DNA, 22 bp, Homo sapiens
ccgccagcgccggctgcccagc

SEQ ID NO: 22136 - DNA, 22 bp, Homo sapiens
tgactcacctctgctcccctct

SEQ ID NO: 22137 - DNA, 22 bp, Homo sapiens
catctgatatacaatattttct

SEQ ID NO: 22138 - DNA, 22 bp, Homo sapiens
catccgatgtacaataatttct

SEQ ID NO: 22139 - DNA, 22 bp, Homo sapiens
gaattataactcggtgctctgt

SEQ ID NO: 22140 - DNA, 24 bp, Homo sapiens
gctggccgaggcgccgccgcggca

SEQ ID NO: 22141 - DNA, 23 bp, Homo sapiens
taataccatccattattttgtgg

SEQ ID NO: 22142 - DNA, 22 bp, Homo sapiens
tggcgagctcatgggccagatg

SEQ ID NO: 22143 - DNA, 20 bp, Homo sapiens
ccgtcgaaggcccccgttgg

SEQ ID NO: 22144 - DNA, 23 bp, Homo sapiens
cccagacagctgcagcaatgtgt

SEQ ID NO: 22145 - DNA, 24 bp, Homo sapiens
gcggctcgggacggaggacgcgct

SEQ ID NO: 22146 - DNA, 22 bp, Homo sapiens
cggggcctgaggctcctggact

SEQ ID NO: 22147 - DNA, 20 bp, Homo sapiens
gccgcggcgaacaggccgga

SEQ ID NO: 22148 - DNA, 21 bp, Homo sapiens
tcctcctccctcccggcccgc

SEQ ID NO: 22149 - DNA, 22 bp, Homo sapiens
cgcgagtgggaggtggcaggcc

SEQ ID NO: 22150 - DNA, 20 bp, Homo sapiens
gttgtcggctgggaaatggc

SEQ ID NO: 22151 - DNA, 22 bp, Homo sapiens
caaaaccacaattactcttcca

SEQ ID NO: 22152 - DNA, 23 bp, Homo sapiens
cagaagtaattgcggttttcgca

SEQ ID NO: 22153 - DNA, 24 bp, Homo sapiens
agcctcctgggaggggccccgcgg

SEQ ID NO: 22154 - DNA, 23 bp, Homo sapiens
gccgcgggcccggccctgacccc

SEQ ID NO: 22155 - DNA, 22 bp, Homo sapiens
tcgggcggcggcggccggcggg

SEQ ID NO: 22156 - DNA, 21 bp, Homo sapiens
cagaccgggcccaaagcgcag

SEQ ID NO: 22157 - DNA, 21 bp, Homo sapiens
ccccctgccctgcctcctgat

SEQ ID NO: 22158 - DNA, 22 bp, Homo sapiens
ggacctgggtctgggcggggtc

SEQ ID NO: 22159 - DNA, 23 bp, Homo sapiens
aggcctgatgggtggatgccccg

SEQ ID NO: 22160 - DNA, 23 bp, Homo sapiens
tgaggagcctctgtgacctgagc

SEQ ID NO: 22161 - DNA, 21 bp, Homo sapiens
cgaccgcgtccctccccgcag

SEQ ID NO: 22162 - DNA, 23 bp, Homo sapiens
gagggccgggcagtcgggcttcg

SEQ ID NO: 22163 - DNA, 22 bp, Homo sapiens
agcccaggatgaaactctgaca

SEQ ID NO: 22164 - DNA, 20 bp, Homo sapiens
cctccccagtagctgcccag

SEQ ID NO: 22165 - DNA, 21 bp, Homo sapiens
cgtaccgtggacgccggggct

SEQ ID NO: 22166 - DNA, 22 bp, Homo sapiens
cccgcttgccggtcagggcctg

SEQ ID NO: 22167 - DNA, 22 bp, Homo sapiens
ctgctgcgctcggccgccctct

SEQ ID NO: 22168 - DNA, 20 bp, Homo sapiens
gtagggctaggccggcagga

SEQ ID NO: 22169 - DNA, 20 bp, Homo sapiens
gcctcccgggcgggcctaca

SEQ ID NO: 22170 - DNA, 24 bp, Homo sapiens
gagtggccagtgttgggcagcccc

SEQ ID NO: 22171 - DNA, 23 bp, Homo sapiens
tcccgcgcggagtacaccccggc

SEQ ID NO: 22172 - DNA, 21 bp, Homo sapiens
catggggaaaagcagtgctac

SEQ ID NO: 22173 - DNA, 22 bp, Homo sapiens
actcacaccgcctctcaggtac

SEQ ID NO: 22174 - DNA, 23 bp, Homo sapiens
cccctccctcgcgccgcccgctc

SEQ ID NO: 22175 - DNA, 22 bp, Homo sapiens
ccgctcctgttgctgcgaccgc

SEQ ID NO: 22176 - DNA, 22 bp, Homo sapiens
tgggtctttgcgggctctcgcc

SEQ ID NO: 22177 - DNA, 20 bp, Homo sapiens
agtcgggtggtcgcgggcca

SEQ ID NO: 22178 - DNA, 21 bp, Homo sapiens
aggcccacagtcatccgtgcg

SEQ ID NO: 22179 - DNA, 22 bp, Homo sapiens
tccctgactggctagtccacaa

SEQ ID NO: 22180 - DNA, 21 bp, Homo sapiens
ccgggtaggggccgcggcgag

SEQ ID NO: 22181 - DNA, 21 bp, Homo sapiens
gtcttgctgctgggtgacctt

SEQ ID NO: 22182 - DNA, 22 bp, Homo sapiens
cggcggcacttgcccgacacgg

SEQ ID NO: 22183 - DNA, 22 bp, Homo sapiens
tgaggtgggccaacatggctgt

SEQ ID NO: 22184 - DNA, 20 bp, Homo sapiens
gtcagggcggcaggggcatc

SEQ ID NO: 22185 - DNA, 21 bp, Homo sapiens
cgtgcatgtctgcatacgtgt

SEQ ID NO: 22186 - DNA, 23 bp, Homo sapiens
acttcccccacctcactgcccgg

SEQ ID NO: 22187 - DNA, 22 bp, Homo sapiens
attaaatgagttaatacttgca

SEQ ID NO: 22188 - DNA, 22 bp, Homo sapiens
catgtattgattcacttaatct

SEQ ID NO: 22189 - DNA, 21 bp, Homo sapiens
accaccccggcggcggcacga

SEQ ID NO: 22190 - DNA, 20 bp, Homo sapiens
gccgtggcgggcgacggttt

SEQ ID NO: 22191 - DNA, 22 bp, Homo sapiens
gaagatggcggctaccgtggcg

SEQ ID NO: 22192 - DNA, 20 bp, Homo sapiens
ggcatgatgtgggatgcccg

SEQ ID NO: 22193 - DNA, 22 bp, Homo sapiens
gcctactttctgcaccattcct

SEQ ID NO: 22194 - DNA, 21 bp, Homo sapiens
gggtcgtggcggcggcggcgg

SEQ ID NO: 22195 - DNA, 22 bp, Homo sapiens
cgcggccggcagagggagggga

SEQ ID NO: 22196 - DNA, 20 bp, Homo sapiens
gcagcgagcaggatccccta

SEQ ID NO: 22197 - DNA, 22 bp, Homo sapiens
ccggtctcgccgcagcagcagc

SEQ ID NO: 22198 - DNA, 21 bp, Homo sapiens
caggcggcagggaccgtgcga

SEQ ID NO: 22199 - DNA, 21 bp, Homo sapiens
accagcaggcggggagcgcct

SEQ ID NO: 22200 - DNA, 24 bp, Homo sapiens
ggcgtcgcggccgccccctcccgc

SEQ ID NO: 22201 - DNA, 21 bp, Homo sapiens
acctgggccagtagctgtgga

SEQ ID NO: 22202 - DNA, 24 bp, Homo sapiens
aaccctctaatctcccaggccaca

SEQ ID NO: 22203 - DNA, 21 bp, Homo sapiens
tcggagccccacggggagaca

SEQ ID NO: 22204 - DNA, 22 bp, Homo sapiens
gccgcaacatggcgaaacccca

SEQ ID NO: 22205 - DNA, 22 bp, Homo sapiens
gggttttgccatgttgcggata

SEQ ID NO: 22206 - DNA, 22 bp, Homo sapiens
tccgcaacatggcaaaacccca

SEQ ID NO: 22207 - DNA, 24 bp, Homo sapiens
gcttgggtgcatctgggccccgcc

SEQ ID NO: 22208 - DNA, 22 bp, Homo sapiens
aaacacacacacacatgccatt

SEQ ID NO: 22209 - DNA, 22 bp, Homo sapiens
ggattgagttctccccatctcc

SEQ ID NO: 22210 - DNA, 21 bp, Homo sapiens
cccaatcccggagccggcgca

SEQ ID NO: 22211 - DNA, 21 bp, Homo sapiens
tcagcttgaccagtggagagt

SEQ ID NO: 22212 - DNA, 22 bp, Homo sapiens
cggcggagcgcgccagcccagc

SEQ ID NO: 22213 - DNA, 22 bp, Homo sapiens
tggttcagttcagtgaaggtga

SEQ ID NO: 22214 - DNA, 24 bp, Homo sapiens
ttcgagacctcagaagcctggact

SEQ ID NO: 22215 - DNA, 21 bp, Homo sapiens
gcgaccggctggccctgctgg

SEQ ID NO: 22216 - DNA, 23 bp, Homo sapiens
cgagcggcggcagcgggggggtg

SEQ ID NO: 22217 - DNA, 24 bp, Homo sapiens
ttcccggtcagcgtcctacgcgtg

SEQ ID NO: 22218 - DNA, 22 bp, Homo sapiens
atagaacaaaaacagaagaaaa

SEQ ID NO: 22219 - DNA, 23 bp, Homo sapiens
agttggcatggctcagtccaagt

SEQ ID NO: 22220 - DNA, 21 bp, Homo sapiens
tgttatgcaggggttgcagat

SEQ ID NO: 22221 - DNA, 23 bp, Homo sapiens
agtacagatcaaataatctggta

SEQ ID NO: 22222 - DNA, 23 bp, Homo sapiens
tgtgatgaagacagtgctacaga

SEQ ID NO: 22223 - DNA, 23 bp, Homo sapiens
agatagttactgctacccagagc

SEQ ID NO: 22224 - DNA, 20 bp, Homo sapiens
actccggtggtaggggagcg

SEQ ID NO: 22225 - DNA, 20 bp, Homo sapiens
cagctgccttcaggccctgc

SEQ ID NO: 22226 - DNA, 23 bp, Homo sapiens
cagagttcctgacccagccgaga

SEQ ID NO: 22227 - DNA, 22 bp, Homo sapiens
tagacaccaccagaaaaggagc

SEQ ID NO: 22228 - DNA, 21 bp, Homo sapiens
gcgcggagcaccggagggcac

SEQ ID NO: 22229 - DNA, 22 bp, Homo sapiens
acccgggctccgacagcggctg

SEQ ID NO: 22230 - DNA, 20 bp, Homo sapiens
gcgggggctcgacgcgtctc

SEQ ID NO: 22231 - DNA, 22 bp, Homo sapiens
tcggagggcggcagcggcggcg

SEQ ID NO: 22232 - DNA, 23 bp, Homo sapiens
gagccgggccctgggcagcagcg

SEQ ID NO: 22233 - DNA, 23 bp, Homo sapiens
ctgccaagccatagtgctccctc

SEQ ID NO: 22234 - DNA, 22 bp, Homo sapiens
cggcggccgcggggcccttgca

SEQ ID NO: 22235 - DNA, 24 bp, Homo sapiens
accctcggctccgccgccggctcc

SEQ ID NO: 22236 - DNA, 24 bp, Homo sapiens
ctctgcgaaggctgtcgtgccccg

SEQ ID NO: 22237 - DNA, 22 bp, Homo sapiens
cagcgccatgctgggctcgcga

SEQ ID NO: 22238 - DNA, 22 bp, Homo sapiens
gtggggagatctaagcattgag

SEQ ID NO: 22239 - DNA, 23 bp, Homo sapiens
atgcttagatccccccactggtg

SEQ ID NO: 22240 - DNA, 23 bp, Homo sapiens
atgcttagatctccccactggta

SEQ ID NO: 22241 - DNA, 21 bp, Homo sapiens
cggcaggcagggtcgggtagg

SEQ ID NO: 22242 - DNA, 20 bp, Homo sapiens
cgactctatatacatagctg

SEQ ID NO: 22243 - DNA, 21 bp, Homo sapiens
cgctactgtttcatttgctaa

SEQ ID NO: 22244 - DNA, 22 bp, Homo sapiens
tgagagtggtgatttatggggt

SEQ ID NO: 22245 - DNA, 22 bp, Homo sapiens
ctatcttctttgctcatccttg

SEQ ID NO: 22246 - DNA, 21 bp, Homo sapiens
ccgtcggtcgggccgccagcc

SEQ ID NO: 22247 - DNA, 23 bp, Homo sapiens
ccccggcccctctgtacgcgtgg

SEQ ID NO: 22248 - DNA, 22 bp, Homo sapiens
ctgcctggggaacgcctgtgag

SEQ ID NO: 22249 - DNA, 23 bp, Homo sapiens
tgggctgttactgctgggacagg

SEQ ID NO: 22250 - DNA, 23 bp, Homo sapiens
tggggctcagtggtaccaggact

SEQ ID NO: 22251 - DNA, 23 bp, Homo sapiens
cccacgcgccccacgccccggga

SEQ ID NO: 22252 - DNA, 22 bp, Homo sapiens
cctataagaatctaatgcccca

SEQ ID NO: 22253 - DNA, 21 bp, Homo sapiens
ggtttcaatactttatctgct

SEQ ID NO: 22254 - DNA, 21 bp, Homo sapiens
tgagacagagtttggagtctc

SEQ ID NO: 22255 - DNA, 22 bp, Homo sapiens
cgagtcgttgcccccaccctcc

SEQ ID NO: 22256 - DNA, 22 bp, Homo sapiens
cgcccccgcaaccccccacccc

SEQ ID NO: 22257 - DNA, 22 bp, Homo sapiens
tctcctgggctcaggcaaccca

SEQ ID NO: 22258 - DNA, 20 bp, Homo sapiens
cccgcgcgcgccgctcggga

SEQ ID NO: 22259 - DNA, 22 bp, Homo sapiens
cccgccccgccgcgccccccat

SEQ ID NO: 22260 - DNA, 22 bp, Homo sapiens
tgtcactgcttcccggcctgtt

SEQ ID NO: 22261 - DNA, 22 bp, Homo sapiens
cggcctcagtcacccgccgcga

SEQ ID NO: 22262 - DNA, 21 bp, Homo sapiens
gcgtccaggagtcgggactgg

SEQ ID NO: 22263 - DNA, 22 bp, Homo sapiens
tcaaggccaacaactgactact

SEQ ID NO: 22264 - DNA, 20 bp, Homo sapiens
cggcggcggccgggcctctg

SEQ ID NO: 22265 - DNA, 21 bp, Homo sapiens
cctattccaatatcccaaagg

SEQ ID NO: 22266 - DNA, 23 bp, Homo sapiens
ggattctaagtcaatggcactgc

SEQ ID NO: 22267 - DNA, 23 bp, Homo sapiens
ttcccacgctcaggccgggtcgg

SEQ ID NO: 22268 - DNA, 23 bp, Homo sapiens
ccgcaattacttttgcaccgact

SEQ ID NO: 22269 - DNA, 24 bp, Homo sapiens
tgtcctcatgattcaaccaccttt

SEQ ID NO: 22270 - DNA, 21 bp, Homo sapiens
tggttgaatcacaaggacaga

SEQ ID NO: 22271 - DNA, 24 bp, Homo sapiens
tgtccttgtgattcaaccaccttt

SEQ ID NO: 22272 - DNA, 22 bp, Homo sapiens
cctcctccccgctgggacagcc

SEQ ID NO: 22273 - DNA, 22 bp, Homo sapiens
aggcattaggttaaaacccaga

SEQ ID NO: 22274 - DNA, 21 bp, Homo sapiens
ctcggggagactgtcacggga

SEQ ID NO: 22275 - DNA, 22 bp, Homo sapiens
tcccgtgacagtctccccgagc

SEQ ID NO: 22276 - DNA, 24 bp, Homo sapiens
ctcctcccgcgtctccgcccccgc

SEQ ID NO: 22277 - DNA, 21 bp, Homo sapiens
cgcgcgtggctggcgggtggc

SEQ ID NO: 22278 - DNA, 22 bp, Homo sapiens
tacagcctcttatgctttccaa

SEQ ID NO: 22279 - DNA, 20 bp, Homo sapiens
cccacacctgccgggatgtc

SEQ ID NO: 22280 - DNA, 21 bp, Homo sapiens
gtcctcggggaggagagggag

SEQ ID NO: 22281 - DNA, 22 bp, Homo sapiens
aggcgtttgatgtggttgtaga

SEQ ID NO: 22282 - DNA, 21 bp, Homo sapiens
cgctgtggaaccgcctcctgc

SEQ ID NO: 22283 - DNA, 23 bp, Homo sapiens
gcgggggcggagggggaggagga

SEQ ID NO: 22284 - DNA, 23 bp, Homo sapiens
gcctgagaggtctctcgtcgctg

SEQ ID NO: 22285 - DNA, 22 bp, Homo sapiens
ctcgcgccctttcccaccgctg

SEQ ID NO: 22286 - DNA, 20 bp, Homo sapiens
cggcggcggcgcgccgcgtg

SEQ ID NO: 22287 - DNA, 21 bp, Homo sapiens
ccccgtgccccagccgggtgc

SEQ ID NO: 22288 - DNA, 24 bp, Homo sapiens
gcgggctggccctcggctggtgct

SEQ ID NO: 22289 - DNA, 22 bp, Homo sapiens
ccccggggaggccccttccgca

SEQ ID NO: 22290 - DNA, 20 bp, Homo sapiens
cagccctgttccctccatcc

SEQ ID NO: 22291 - DNA, 23 bp, Homo sapiens
gcgggccgggccgggacggggac

SEQ ID NO: 22292 - DNA, 21 bp, Homo sapiens
ccaccccccgtccccgcccca

SEQ ID NO: 22293 - DNA, 22 bp, Homo sapiens
ggagacatctaggctttccaca

SEQ ID NO: 22294 - DNA, 23 bp, Homo sapiens
gggcgcgcgcgtcggggcggcgg

SEQ ID NO: 22295 - DNA, 22 bp, Homo sapiens
cagtagttctaaagtgtggtcc

SEQ ID NO: 22296 - DNA, 23 bp, Homo sapiens
agagaccacactttgagccactg

SEQ ID NO: 22297 - DNA, 22 bp, Homo sapiens
aaaggcttcaagcacgagttct

SEQ ID NO: 22298 - DNA, 22 bp, Homo sapiens
ttccttgacctgatgctgtagg

SEQ ID NO: 22299 - DNA, 22 bp, Homo sapiens
ctcccactctcctgtccccacc

SEQ ID NO: 22300 - DNA, 22 bp, Homo sapiens
gggacgcagaagcgagaagcgg

SEQ ID NO: 22301 - DNA, 21 bp, Homo sapiens
tgtagacatctgacaggacac

SEQ ID NO: 22302 - DNA, 21 bp, Homo sapiens
accccagcggcggcgcctcct

SEQ ID NO: 22303 - DNA, 22 bp, Homo sapiens
gggggccccgccgccgccgctg

SEQ ID NO: 22304 - DNA, 22 bp, Homo sapiens
atatgtacatacggctatgcgt

SEQ ID NO: 22305 - DNA, 21 bp, Homo sapiens
caattttagcataagtgtgag

SEQ ID NO: 22306 - DNA, 22 bp, Homo sapiens
tcttgggccccacccctggaga

SEQ ID NO: 22307 - DNA, 23 bp, Homo sapiens
gcaacacctcctggatctatgga

SEQ ID NO: 22308 - DNA, 20 bp, Homo sapiens
agcagctgcggctactgtgg

SEQ ID NO: 22309 - DNA, 22 bp, Homo sapiens
ctgtaccccgtggcttctcaca

SEQ ID NO: 22310 - DNA, 22 bp, Homo sapiens
agatccacagatgcgcaagtcc

SEQ ID NO: 22311 - DNA, 23 bp, Homo sapiens
gggagagcggggccaccggcgcg

SEQ ID NO: 22312 - DNA, 21 bp, Homo sapiens
ggtgccctcgccgcccccgcc

SEQ ID NO: 22313 - DNA, 22 bp, Homo sapiens
ttgggctcgcgtcctcggccgc

SEQ ID NO: 22314 - DNA, 21 bp, Homo sapiens
cccgagctaccgggggggcat

SEQ ID NO: 22315 - DNA, 22 bp, Homo sapiens
atgcaatgtgagccgcgtggca

SEQ ID NO: 22316 - DNA, 21 bp, Homo sapiens
caggtgagcgcgacggcactg

SEQ ID NO: 22317 - DNA, 21 bp, Homo sapiens
aggtcacggcgcctgccagcc

SEQ ID NO: 22318 - DNA, 21 bp, Homo sapiens
gtggcagtagccgtgacacca

SEQ ID NO: 22319 - DNA, 23 bp, Homo sapiens
ctgctgcagcgccgcccgcccgc

SEQ ID NO: 22320 - DNA, 22 bp, Homo sapiens
cgagccgtgaggggtgtgcgcg

SEQ ID NO: 22321 - DNA, 21 bp, Homo sapiens
gagccagcgggagaggattag

SEQ ID NO: 22322 - DNA, 22 bp, Homo sapiens
cggctaacatgcaactgctgtc

SEQ ID NO: 22323 - DNA, 22 bp, Homo sapiens
gagccttggcggcagcgctgcg

SEQ ID NO: 22324 - DNA, 20 bp, Homo sapiens
gccacaggccccgcagcaga

SEQ ID NO: 22325 - DNA, 22 bp, Homo sapiens
cgtcttccccagctctaagctc

SEQ ID NO: 22326 - DNA, 23 bp, Homo sapiens
aaggctgctctgtgcccacagtc

SEQ ID NO: 22327 - DNA, 23 bp, Homo sapiens
gcgcacagagcagccttctgagt

SEQ ID NO: 22328 - DNA, 23 bp, Homo sapiens
ctcccagcgccagctttgtctcc

SEQ ID NO: 22329 - DNA, 23 bp, Homo sapiens
ctgtggtttcctgcgacctgacc

SEQ ID NO: 22330 - DNA, 21 bp, Homo sapiens
tcattcagactgacagatgtt

SEQ ID NO: 22331 - DNA, 21 bp, Homo sapiens
acatctgtcagtctgagtgac

SEQ ID NO: 22332 - DNA, 23 bp, Homo sapiens
caggcctgagctcgctcccccac

SEQ ID NO: 22333 - DNA, 22 bp, Homo sapiens
tccctggtcgcctccgctcttc

SEQ ID NO: 22334 - DNA, 23 bp, Homo sapiens
atgtgctaccctgcttggcttgt

SEQ ID NO: 22335 - DNA, 20 bp, Homo sapiens
cggccgggctgccaggagca

SEQ ID NO: 22336 - DNA, 23 bp, Homo sapiens
gcgtcctcctgccgcgtcccgcc

SEQ ID NO: 22337 - DNA, 21 bp, Homo sapiens
gggagggcgaggcccggctgc

SEQ ID NO: 22338 - DNA, 24 bp, Homo sapiens
tcccggagcagcgccgcgcagagc

SEQ ID NO: 22339 - DNA, 22 bp, Homo sapiens
gctaatttatctccaccagttg

SEQ ID NO: 22340 - DNA, 23 bp, Homo sapiens
agcagcaccctcttctctgccag

SEQ ID NO: 22341 - DNA, 22 bp, Homo sapiens
gcggcggcagctggggcgggaa

SEQ ID NO: 22342 - DNA, 23 bp, Homo sapiens
atcctctttgcccaccgccctgc

SEQ ID NO: 22343 - DNA, 22 bp, Homo sapiens
tccccgccgcccgcgaccaccc

SEQ ID NO: 22344 - DNA, 22 bp, Homo sapiens
aggcgtgagttagccaggtgtc

SEQ ID NO: 22345 - DNA, 22 bp, Homo sapiens
tgctgccaccagataaatacat

SEQ ID NO: 22346 - DNA, 22 bp, Homo sapiens
aatagtgaaagggcaggatacc

SEQ ID NO: 22347 - DNA, 22 bp, Homo sapiens
tgtcccgcccgcaggcgcgcgt

SEQ ID NO: 22348 - DNA, 23 bp, Homo sapiens
tgtcaggggtgtgggcacggggg

SEQ ID NO: 22349 - DNA, 23 bp, Homo sapiens
ggtgcccacgacgcacggtccag

SEQ ID NO: 22350 - DNA, 20 bp, Homo sapiens
aggactggcaggcatccagg

SEQ ID NO: 22351 - DNA, 22 bp, Homo sapiens
tcgggcgctccggctgtaagga

SEQ ID NO: 22352 - DNA, 21 bp, Homo sapiens
atgagaagatgttttccaggt

SEQ ID NO: 22353 - DNA, 22 bp, Homo sapiens
taaaattaattgcagtttttgt

SEQ ID NO: 22354 - DNA, 24 bp, Homo sapiens
ggctgcgggcaggtgggcgggagg

SEQ ID NO: 22355 - DNA, 20 bp, Homo sapiens
cccaatggcaacttacaact

SEQ ID NO: 22356 - DNA, 22 bp, Homo sapiens
cgccgctttctgggctcgctca

SEQ ID NO: 22357 - DNA, 20 bp, Homo sapiens
gccctgggagtggagacgcg

SEQ ID NO: 22358 - DNA, 22 bp, Homo sapiens
tgctaagtttagttttctattg

SEQ ID NO: 22359 - DNA, 23 bp, Homo sapiens
cggcggccactgggcatgctccg

SEQ ID NO: 22360 - DNA, 23 bp, Homo sapiens
aacaggcaaatctggagtcagcc

SEQ ID NO: 22361 - DNA, 22 bp, Homo sapiens
tttccccagccttgtctagaca

SEQ ID NO: 22362 - DNA, 23 bp, Homo sapiens
gtgacgggtccgcgaggcccagc

SEQ ID NO: 22363 - DNA, 24 bp, Homo sapiens
ccgcggccgtgagcctgcccccaa

SEQ ID NO: 22364 - DNA, 20 bp, Homo sapiens
cggcccggcctggatgcgct

SEQ ID NO: 22365 - DNA, 21 bp, Homo sapiens
gaggcctgcctgcgggagacc

SEQ ID NO: 22366 - DNA, 20 bp, Homo sapiens
gaggccgggccggagccgca

SEQ ID NO: 22367 - DNA, 24 bp, Homo sapiens
cgcaggagccgcggagggccggat

SEQ ID NO: 22368 - DNA, 21 bp, Homo sapiens
tggctggccgcgctcttcgca

SEQ ID NO: 22369 - DNA, 20 bp, Homo sapiens
aggactggaaggtggctagg

SEQ ID NO: 22370 - DNA, 24 bp, Homo sapiens
tccggctgcggctccagcccgcga

SEQ ID NO: 22371 - DNA, 20 bp, Homo sapiens
cggcggcgggagaagccgcg

SEQ ID NO: 22372 - DNA, 23 bp, Homo sapiens
tccacagctcagcccaggctcca

SEQ ID NO: 22373 - DNA, 23 bp, Homo sapiens
cagactgggctgggctgtgggaa

SEQ ID NO: 22374 - DNA, 23 bp, Homo sapiens
gggactgtcactgggcgtgccat

SEQ ID NO: 22375 - DNA, 21 bp, Homo sapiens
cggctgccgcagtggaggagc

SEQ ID NO: 22376 - DNA, 24 bp, Homo sapiens
cagccagcaggagagagagggagc

SEQ ID NO: 22377 - DNA, 24 bp, Homo sapiens
tcccccccctctccgcgctggctt

SEQ ID NO: 22378 - DNA, 24 bp, Homo sapiens
acgtgcagccggtccggtcccaga

SEQ ID NO: 22379 - DNA, 23 bp, Homo sapiens
cgcctgcctcgccgccgccctcg

SEQ ID NO: 22380 - DNA, 23 bp, Homo sapiens
gcgcggcggccgcggcgggtgct

SEQ ID NO: 22381 - DNA, 21 bp, Homo sapiens
cgctcgctccctccccagccc

SEQ ID NO: 22382 - DNA, 21 bp, Homo sapiens
ctgaacacacaagactctgtg

SEQ ID NO: 22383 - DNA, 24 bp, Homo sapiens
gccgcagtgtccgcgaacagcagc

SEQ ID NO: 22384 - DNA, 21 bp, Homo sapiens
gagccttcgacgcagtgagca

SEQ ID NO: 22385 - DNA, 23 bp, Homo sapiens
ccctctccactcccagccccgga

SEQ ID NO: 22386 - DNA, 20 bp, Homo sapiens
cggtcctctcttcgcgccca

SEQ ID NO: 22387 - DNA, 20 bp, Homo sapiens
gtctacttcaaattcctccc

SEQ ID NO: 22388 - DNA, 21 bp, Homo sapiens
ccccaggatgccagcatagtt

SEQ ID NO: 22389 - DNA, 22 bp, Homo sapiens
agctggttggcattctggccct

SEQ ID NO: 22390 - DNA, 24 bp, Homo sapiens
tcgtccagggaaccggtgcgcagg

SEQ ID NO: 22391 - DNA, 23 bp, Homo sapiens
acagcaattacttttgcaccact

SEQ ID NO: 22392 - DNA, 24 bp, Homo sapiens
aggatcgcccagcggggccgcgtt

SEQ ID NO: 22393 - DNA, 23 bp, Homo sapiens
tgtctgggttgttcgagacccgc

SEQ ID NO: 22394 - DNA, 23 bp, Homo sapiens
cgggctggctttagctcagcggt

SEQ ID NO: 22395 - DNA, 23 bp, Homo sapiens
tcctgctgttcccaacatgatga

SEQ ID NO: 22396 - DNA, 23 bp, Homo sapiens
tatccagttccgcaattcacact

SEQ ID NO: 22397 - DNA, 22 bp, Homo sapiens
tggctgggtgctgctcccgata

SEQ ID NO: 22398 - DNA, 23 bp, Homo sapiens
actgcctggtgctgtccctgagc

SEQ ID NO: 22399 - DNA, 22 bp, Homo sapiens
tagcacagaatagttcagttgc

SEQ ID NO: 22400 - DNA, 22 bp, Homo sapiens
cgagctgcactctagcacctcc

SEQ ID NO: 22401 - DNA, 24 bp, Homo sapiens
ctccgggcctctgcggagccctgg

SEQ ID NO: 22402 - DNA, 24 bp, Homo sapiens
ggagtgcagcacaccaagggggaa

SEQ ID NO: 22403 - DNA, 23 bp, Homo sapiens
tccccagtggtctagcccttgag

SEQ ID NO: 22404 - DNA, 22 bp, Homo sapiens
ctccctgtcaattcgctttcca

SEQ ID NO: 22405 - DNA, 22 bp, Homo sapiens
gaaagcaaattcacagggagca

SEQ ID NO: 22406 - DNA, 23 bp, Homo sapiens
gactcccagactagcttctttgg

SEQ ID NO: 22407 - DNA, 21 bp, Homo sapiens
cgcccagggcgcaccaccggc

SEQ ID NO: 22408 - DNA, 23 bp, Homo sapiens
agccagggcaggccgggcctccg

SEQ ID NO: 22409 - DNA, 24 bp, Homo sapiens
acctctgagctcactcgctggttg

SEQ ID NO: 22410 - DNA, 22 bp, Homo sapiens
cctggacggagagaggaggtga

SEQ ID NO: 22411 - DNA, 22 bp, Homo sapiens
acaacagtgccaacctcacagg

SEQ ID NO: 22412 - DNA, 22 bp, Homo sapiens
caacaatgccaacctcacagga

SEQ ID NO: 22413 - DNA, 23 bp, Homo sapiens
agcgagacctcaactctacaatt

SEQ ID NO: 22414 - DNA, 22 bp, Homo sapiens
gcgcaggagcagaagtaacagg

SEQ ID NO: 22415 - DNA, 20 bp, Homo sapiens
ccgggctgggaagggcggga

SEQ ID NO: 22416 - DNA, 21 bp, Homo sapiens
tggacccgccgcagagccagg

SEQ ID NO: 22417 - DNA, 22 bp, Homo sapiens
tcctctcattccttggctcagc

SEQ ID NO: 22418 - DNA, 21 bp, Homo sapiens
gagggctgggagccgggtggg

SEQ ID NO: 22419 - DNA, 24 bp, Homo sapiens
gcagacagctccaggtcctccggc

SEQ ID NO: 22420 - DNA, 21 bp, Homo sapiens
ccggtaggtgtaggcgcagcc

SEQ ID NO: 22421 - DNA, 22 bp, Homo sapiens
tcacacatattttccatgcagt

SEQ ID NO: 22422 - DNA, 21 bp, Homo sapiens
gtcaccaacataatgagagca

SEQ ID NO: 22423 - DNA, 23 bp, Homo sapiens
cgcgcgcgcgcgtgtgttgtgcg

SEQ ID NO: 22424 - DNA, 21 bp, Homo sapiens
aaattattgttattactgagt

SEQ ID NO: 22425 - DNA, 21 bp, Homo sapiens
tcacctggcataagcaattca

SEQ ID NO: 22426 - DNA, 21 bp, Homo sapiens
atccaccgctatcactcgccc

SEQ ID NO: 22427 - DNA, 23 bp, Homo sapiens
ggcttctttacagtgctgccttg

SEQ ID NO: 22428 - DNA, 22 bp, Homo sapiens
tctctaagtgccaaagacctgt

SEQ ID NO: 22429 - DNA, 22 bp, Homo sapiens
agtcccttctggaacattgcct

SEQ ID NO: 22430 - DNA, 23 bp, Homo sapiens
cagacacaggtatggctggctcc

SEQ ID NO: 22431 - DNA, 20 bp, Homo sapiens
tggaagcgcggcgcctcgcc

SEQ ID NO: 22432 - DNA, 21 bp, Homo sapiens
accgccattacttttgcaccg

SEQ ID NO: 22433 - DNA, 20 bp, Homo sapiens
gccccgggccggtcgcgccg

SEQ ID NO: 22434 - DNA, 22 bp, Homo sapiens
tataggtatgagccactgagtt

SEQ ID NO: 22435 - DNA, 23 bp, Homo sapiens
cctgctaggtgcatggccacaga

SEQ ID NO: 22436 - DNA, 22 bp, Homo sapiens
cggctcgggtgacagcgtcgcg

SEQ ID NO: 22437 - DNA, 21 bp, Homo sapiens
cccggtggcggagaggaagtg

SEQ ID NO: 22438 - DNA, 23 bp, Homo sapiens
tgacggcccccctcccctccaca

SEQ ID NO: 22439 - DNA, 22 bp, Homo sapiens
cgccggggcggcccttcctgat

SEQ ID NO: 22440 - DNA, 20 bp, Homo sapiens
tcgcgctcgctgccttctcc

SEQ ID NO: 22441 - DNA, 23 bp, Homo sapiens
ccgctctctccccaccgctccgc

SEQ ID NO: 22442 - DNA, 23 bp, Homo sapiens
ctcgcgtgcctcccaggctccgc

SEQ ID NO: 22443 - DNA, 21 bp, Homo sapiens
aagaggtcggggaacggctgc

SEQ ID NO: 22444 - DNA, 23 bp, Homo sapiens
tgcaggcgccccacttccaccca

SEQ ID NO: 22445 - DNA, 24 bp, Homo sapiens
tttgacttgaactcattccccagg

SEQ ID NO: 22446 - DNA, 23 bp, Homo sapiens
ctgccatctggtgccagcctttg

SEQ ID NO: 22447 - DNA, 21 bp, Homo sapiens
cgcttcgctgcccttcccaga

SEQ ID NO: 22448 - DNA, 21 bp, Homo sapiens
ctggggaggacagccatgaca

SEQ ID NO: 22449 - DNA, 21 bp, Homo sapiens
tcaccatgggcttgaccttca

SEQ ID NO: 22450 - DNA, 24 bp, Homo sapiens
cttggcgcggccgccgccgccgcc

SEQ ID NO: 22451 - DNA, 20 bp, Homo sapiens
cctcggggggctgggagcgc

SEQ ID NO: 22452 - DNA, 20 bp, Homo sapiens
gccgggccgcggaggaggca

SEQ ID NO: 22453 - DNA, 22 bp, Homo sapiens
ctggcccccgccctccgcgtgc

SEQ ID NO: 22454 - DNA, 22 bp, Homo sapiens
acccgaggagatgaggctccgc

SEQ ID NO: 22455 - DNA, 22 bp, Homo sapiens
ccgccccgccctgcgccgtcga

SEQ ID NO: 22456 - DNA, 21 bp, Homo sapiens
ctctgctaattcctcccccag

SEQ ID NO: 22457 - DNA, 23 bp, Homo sapiens
tccgcaatgttggtttcactgag

SEQ ID NO: 22458 - DNA, 22 bp, Homo sapiens
ggcggcgggcggcgggcgggtc

SEQ ID NO: 22459 - DNA, 20 bp, Homo sapiens
gggcggtcgggcggcggcgg

SEQ ID NO: 22460 - DNA, 22 bp, Homo sapiens
cgcctgccttgccagccggtgc

SEQ ID NO: 22461 - DNA, 21 bp, Homo sapiens
gctcgatcttgggacccaccg

SEQ ID NO: 22462 - DNA, 20 bp, Homo sapiens
gggcccggttcgggggggcg

SEQ ID NO: 22463 - DNA, 20 bp, Homo sapiens
cgcacccagctcggagcccg

SEQ ID NO: 22464 - DNA, 21 bp, Homo sapiens
accaggcaagaactactgtct

SEQ ID NO: 22465 - DNA, 22 bp, Homo sapiens
tggctgccctgtcgccctttgt

SEQ ID NO: 22466 - DNA, 24 bp, Homo sapiens
agagaccaggcttaatgaggtgga

SEQ ID NO: 22467 - DNA, 23 bp, Homo sapiens
accgccccgacgagggcccaggc

SEQ ID NO: 22468 - DNA, 21 bp, Homo sapiens
tgcctccgctctgcccgcagc

SEQ ID NO: 22469 - DNA, 20 bp, Homo sapiens
ccccgcggcggggcgcgatg

SEQ ID NO: 22470 - DNA, 20 bp, Homo sapiens
gggccgggcgggctggggcg

SEQ ID NO: 22471 - DNA, 20 bp, Homo sapiens
ttcttgcctaccacctctct

SEQ ID NO: 22472 - DNA, 23 bp, Homo sapiens
gatccatgcaaggccttttgggg

SEQ ID NO: 22473 - DNA, 22 bp, Homo sapiens
gcgctgagttttgtctcccggg

SEQ ID NO: 22474 - DNA, 21 bp, Homo sapiens
caccgcccagggcctgccgcg

SEQ ID NO: 22475 - DNA, 20 bp, Homo sapiens
gccgcgagcccaggccccgg

SEQ ID NO: 22476 - DNA, 24 bp, Homo sapiens
cggtgactgggaccagaccgtcgc

SEQ ID NO: 22477 - DNA, 22 bp, Homo sapiens
cgcggcttcgggcgcctcgcag

SEQ ID NO: 22478 - DNA, 22 bp, Homo sapiens
tcagctctacaactcagtgtct

SEQ ID NO: 22479 - DNA, 23 bp, Homo sapiens
cactcacttcctgttctgtggcc

SEQ ID NO: 22480 - DNA, 20 bp, Homo sapiens
taacagattaggagaactca

SEQ ID NO: 22481 - DNA, 24 bp, Homo sapiens
attaacgctacgatgcctgaacct

SEQ ID NO: 22482 - DNA, 22 bp, Homo sapiens
tgcacactcgcacatgcacata

SEQ ID NO: 22483 - DNA, 21 bp, Homo sapiens
gagttctccgggccgcaccct

SEQ ID NO: 22484 - DNA, 22 bp, Homo sapiens
cgctgcgggctggagagctgct

SEQ ID NO: 22485 - DNA, 21 bp, Homo sapiens
gcaactctttacaatgtttct

SEQ ID NO: 22486 - DNA, 24 bp, Homo sapiens
cccagcagtgctagcccaccggtg

SEQ ID NO: 22487 - DNA, 24 bp, Homo sapiens
aacctagcagaggaatgccaagct

SEQ ID NO: 22488 - DNA, 23 bp, Homo sapiens
aggccatgaccatcgagggccgc

SEQ ID NO: 22489 - DNA, 22 bp, Homo sapiens
cgagcggcccctgcccggctcc

SEQ ID NO: 22490 - DNA, 20 bp, Homo sapiens
gtcccggcggagtcgcagcg

SEQ ID NO: 22491 - DNA, 20 bp, Homo sapiens
tcctgccgtagaggtggtgg

SEQ ID NO: 22492 - DNA, 21 bp, Homo sapiens
accgcgcctggccgggaaata

SEQ ID NO: 22493 - DNA, 24 bp, Homo sapiens
tgctctcgggaggcctggccctga

SEQ ID NO: 22494 - DNA, 22 bp, Homo sapiens
gcggagtgagcgagggagacgg

SEQ ID NO: 22495 - DNA, 23 bp, Homo sapiens
tgcgtcctaggcccccggctcta

SEQ ID NO: 22496 - DNA, 22 bp, Homo sapiens
ccgcctctgtaccccacctcct

SEQ ID NO: 22497 - DNA, 23 bp, Homo sapiens
cccgccttccccggtcccagccc

SEQ ID NO: 22498 - DNA, 22 bp, Homo sapiens
ccctgggtctaggggagagagt

SEQ ID NO: 22499 - DNA, 20 bp, Homo sapiens
cggcgttccgaaggactgag

SEQ ID NO: 22500 - DNA, 23 bp, Homo sapiens
cggggactcgttggcggcgtgga

SEQ ID NO: 22501 - DNA, 22 bp, Homo sapiens
gatgccgagtactggaacagcc

SEQ ID NO: 22502 - DNA, 20 bp, Homo sapiens
atgcctgagggggtcctccg

SEQ ID NO: 22503 - DNA, 20 bp, Homo sapiens
ccgccgcctcctccgctcgc

SEQ ID NO: 22504 - DNA, 23 bp, Homo sapiens
tagaacgagctggaggattctgc

SEQ ID NO: 22505 - DNA, 21 bp, Homo sapiens
accctgccccacctgcccctt

SEQ ID NO: 22506 - DNA, 23 bp, Homo sapiens
tacttgaccttgactctccctca

SEQ ID NO: 22507 - DNA, 22 bp, Homo sapiens
tcgagaattgcgtttggacaat

SEQ ID NO: 22508 - DNA, 21 bp, Homo sapiens
gacgtccagactcaactctcg

SEQ ID NO: 22509 - DNA, 23 bp, Homo sapiens
gccgcagtcggccagccatggag

SEQ ID NO: 22510 - DNA, 20 bp, Homo sapiens
ggtccggggccggagaccga

SEQ ID NO: 22511 - DNA, 23 bp, Homo sapiens
tgacacacccccacctcccctag

SEQ ID NO: 22512 - DNA, 23 bp, Homo sapiens
ccacagaatgccatgtgaaggat

SEQ ID NO: 22513 - DNA, 22 bp, Homo sapiens
cttcgcatggtattctgtgact

SEQ ID NO: 22514 - DNA, 23 bp, Homo sapiens
ggacggggtagggcggggcgcgc

SEQ ID NO: 22515 - DNA, 22 bp, Homo sapiens
tccaggtcccgccgcggtcgca

SEQ ID NO: 22516 - DNA, 23 bp, Homo sapiens
accatgaaccttttattgctcca

SEQ ID NO: 22517 - DNA, 24 bp, Homo sapiens
cggcaaataggatgtgtctggact

SEQ ID NO: 22518 - DNA, 20 bp, Homo sapiens
cgcaggatggatggcgggtc

SEQ ID NO: 22519 - DNA, 21 bp, Homo sapiens
acatcttttgggatgaaccgg

SEQ ID NO: 22520 - DNA, 23 bp, Homo sapiens
tctcccttcttcagtacacctac

SEQ ID NO: 22521 - DNA, 22 bp, Homo sapiens
ttggtcttctctgccctccagc

SEQ ID NO: 22522 - DNA, 22 bp, Homo sapiens
tcagagggcagagggcccacgt

SEQ ID NO: 22523 - DNA, 20 bp, Homo sapiens
ccgctggtggtggctctcga

SEQ ID NO: 22524 - DNA, 22 bp, Homo sapiens
aggacgcgcggcccggccctgg

SEQ ID NO: 22525 - DNA, 20 bp, Homo sapiens
ctccctgggcctctctggcc

SEQ ID NO: 22526 - DNA, 20 bp, Homo sapiens
cgcgaacctgctcgcgcagc

SEQ ID NO: 22527 - DNA, 21 bp, Homo sapiens
gcgcctgaagggaggggccga

SEQ ID NO: 22528 - DNA, 22 bp, Homo sapiens
ccacctgacctgattcaatgct

SEQ ID NO: 22529 - DNA, 23 bp, Homo sapiens
gccttgttttaaggaaccaccca

SEQ ID NO: 22530 - DNA, 21 bp, Homo sapiens
gagcccggagtcgctccctcg

SEQ ID NO: 22531 - DNA, 20 bp, Homo sapiens
gagagcaggtccggggtgcg

SEQ ID NO: 22532 - DNA, 20 bp, Homo sapiens
cccggcgcccaccgcggggg

SEQ ID NO: 22533 - DNA, 22 bp, Homo sapiens
aggctctctctgccagccgtgc

SEQ ID NO: 22534 - DNA, 20 bp, Homo sapiens
ggctagcaccagcgctctgt

SEQ ID NO: 22535 - DNA, 23 bp, Homo sapiens
tgcagccatgtcttggcctcaag

SEQ ID NO: 22536 - DNA, 23 bp, Homo sapiens
tccttcctccgcccttcctcgag

SEQ ID NO: 22537 - DNA, 21 bp, Homo sapiens
accacgaagacccaggcagcc

SEQ ID NO: 22538 - DNA, 22 bp, Homo sapiens
agggctgtgatgtagagtctgc

SEQ ID NO: 22539 - DNA, 21 bp, Homo sapiens
cacagccctgcagttatcacg

SEQ ID NO: 22540 - DNA, 23 bp, Homo sapiens
tccctccgccgactgcggcccga

SEQ ID NO: 22541 - DNA, 24 bp, Homo sapiens
agaataagaaggatattttacttc

SEQ ID NO: 22542 - DNA, 23 bp, Homo sapiens
ttcgagaccctgctggtccatgg

SEQ ID NO: 22543 - DNA, 22 bp, Homo sapiens
ccgacgtgtcccgcctccttga

SEQ ID NO: 22544 - DNA, 21 bp, Homo sapiens
gaacacaatatgcagtggaca

SEQ ID NO: 22545 - DNA, 22 bp, Homo sapiens
tgtttaaccttttgcctattgg

SEQ ID NO: 22546 - DNA, 22 bp, Homo sapiens
ttgctcagacaccatccccaga

SEQ ID NO: 22547 - DNA, 23 bp, Homo sapiens
acttcgcgggggtcagggcgcgt

SEQ ID NO: 22548 - DNA, 20 bp, Homo sapiens
ctctatgatatatatatgac

SEQ ID NO: 22549 - DNA, 24 bp, Homo sapiens
cactcttcctgcagggagctggtg

SEQ ID NO: 22550 - DNA, 21 bp, Homo sapiens
ctggaggcctctgggcgcgtg

SEQ ID NO: 22551 - DNA, 21 bp, Homo sapiens
tctcgtcccggccctgcccgc

SEQ ID NO: 22552 - DNA, 20 bp, Homo sapiens
ttgggtattatcctatttga

SEQ ID NO: 22553 - DNA, 20 bp, Homo sapiens
attgcatgtatccaaacctt

SEQ ID NO: 22554 - DNA, 20 bp, Homo sapiens
tagcttatcagtgactgact

SEQ ID NO: 22555 - DNA, 23 bp, Homo sapiens
tagcttgtcagactgatcaaaac

SEQ ID NO: 22556 - DNA, 23 bp, Homo sapiens
ctgggctgtagtgtgctatgatc

SEQ ID NO: 22557 - DNA, 24 bp, Homo sapiens
ggcgcgccagccgcgccaagcatc

SEQ ID NO: 22558 - DNA, 23 bp, Homo sapiens
cgcacacacacacacagacacct

SEQ ID NO: 22559 - DNA, 22 bp, Homo sapiens
cacctctgccgggagcgggacg

SEQ ID NO: 22560 - DNA, 21 bp, Homo sapiens
cccctcctccccgcgccccgc

SEQ ID NO: 22561 - DNA, 23 bp, Homo sapiens
tctgcagcctacctcatcagacc

SEQ ID NO: 22562 - DNA, 23 bp, Homo sapiens
ggctgaacgcggagggggcggag

SEQ ID NO: 22563 - DNA, 21 bp, Homo sapiens
tgaccttgaccctccctgtgc

SEQ ID NO: 22564 - DNA, 20 bp, Homo sapiens
cccccgcgggagcgcgcagg

SEQ ID NO: 22565 - DNA, 20 bp, Homo sapiens
ccgtgccctgcgcccgcact

SEQ ID NO: 22566 - DNA, 22 bp, Homo sapiens
taggcacaaaacatgcgtgtgt

SEQ ID NO: 22567 - DNA, 22 bp, Homo sapiens
acacacgcatgccttgtgccta

SEQ ID NO: 22568 - DNA, 22 bp, Homo sapiens
tcgagttaacatccaggcccag

SEQ ID NO: 22569 - DNA, 22 bp, Homo sapiens
tggacaggcacagtggcttaca

SEQ ID NO: 22570 - DNA, 22 bp, Homo sapiens
tccgccgcgcacacacacagca

SEQ ID NO: 22571 - DNA, 21 bp, Homo sapiens
accgcgcacacgcacactcac

SEQ ID NO: 22572 - DNA, 22 bp, Homo sapiens
cagctgagcagcggccgcccgc

SEQ ID NO: 22573 - DNA, 20 bp, Homo sapiens
gcatgggtggtatgcaccat

SEQ ID NO: 22574 - DNA, 21 bp, Homo sapiens
aggacgcactcgggccccagg

SEQ ID NO: 22575 - DNA, 21 bp, Homo sapiens
tagctgtgagactgtagccaa

SEQ ID NO: 22576 - DNA, 23 bp, Homo sapiens
gaggtctgggctgtagtgcgcta

SEQ ID NO: 22577 - DNA, 23 bp, Homo sapiens
ggccagcgcgccctgcatctccc

SEQ ID NO: 22578 - DNA, 24 bp, Homo sapiens
gccggcgggagccaagccgaggaa

SEQ ID NO: 22579 - DNA, 23 bp, Homo sapiens
gcagctctgttggcgggggcagc

SEQ ID NO: 22580 - DNA, 22 bp, Homo sapiens
acctcctcgagcagtgccaccc

SEQ ID NO: 22581 - DNA, 23 bp, Homo sapiens
gggggggaagggtcgggcgccgt

SEQ ID NO: 22582 - DNA, 23 bp, Homo sapiens
aacacgcaattaactgttgcacc

SEQ ID NO: 22583 - DNA, 22 bp, Homo sapiens
tgactactttgtttgattttgt

SEQ ID NO: 22584 - DNA, 21 bp, Homo sapiens
tatatacaagcacacacacaa

SEQ ID NO: 22585 - DNA, 24 bp, Homo sapiens
ctctcccgctggcgctcccggcgc

SEQ ID NO: 22586 - DNA, 20 bp, Homo sapiens
cgcgtccagctgggaggagc

SEQ ID NO: 22587 - DNA, 22 bp, Homo sapiens
cggagctcgggcggccgtggag

SEQ ID NO: 22588 - DNA, 24 bp, Homo sapiens
gtcgcccgccgcggtgccggccgg

SEQ ID NO: 22589 - DNA, 22 bp, Homo sapiens
tcctcctagctctgtctttcca

SEQ ID NO: 22590 - DNA, 22 bp, Homo sapiens
tcccctcagtgtgccactaaat

SEQ ID NO: 22591 - DNA, 22 bp, Homo sapiens
ccggcggggcgacccagcccga

SEQ ID NO: 22592 - DNA, 24 bp, Homo sapiens
gcaactggcggtggccgacgagct

SEQ ID NO: 22593 - DNA, 22 bp, Homo sapiens
ttcacatccagaggcttttcct

SEQ ID NO: 22594 - DNA, 22 bp, Homo sapiens
tgtttatttggagaggtgtact

SEQ ID NO: 22595 - DNA, 22 bp, Homo sapiens
tcggcctctgtggcgccgccct

SEQ ID NO: 22596 - DNA, 22 bp, Homo sapiens
ccccggcgccaggcgcagccgc

SEQ ID NO: 22597 - DNA, 23 bp, Homo sapiens
ctcctccagatcacatgtgtgca

SEQ ID NO: 22598 - DNA, 22 bp, Homo sapiens
ccgctcccgctcagggcgccgc

SEQ ID NO: 22599 - DNA, 22 bp, Homo sapiens
cggcggcgggcgggggaggggc

SEQ ID NO: 22600 - DNA, 22 bp, Homo sapiens
ctcaaggagggtggaagcgccg

SEQ ID NO: 22601 - DNA, 21 bp, Homo sapiens
cgggtgctcgtagcggccgcc

SEQ ID NO: 22602 - DNA, 23 bp, Homo sapiens
ctgctgtgtgactcggtcccctc

SEQ ID NO: 22603 - DNA, 22 bp, Homo sapiens
atagacatttatctccatgtgg

SEQ ID NO: 22604 - DNA, 24 bp, Homo sapiens
gaagccagaagcatgccagtcaga

SEQ ID NO: 22605 - DNA, 21 bp, Homo sapiens
ccagcggctgggcctgagcgt

SEQ ID NO: 22606 - DNA, 20 bp, Homo sapiens
acaacatagccaggcctcgt

SEQ ID NO: 22607 - DNA, 24 bp, Homo sapiens
agatgctgttggaacctggctgac

SEQ ID NO: 22608 - DNA, 24 bp, Homo sapiens
tcccttgagataccggcatccctg

SEQ ID NO: 22609 - DNA, 22 bp, Homo sapiens
cgccagcatctaatgggactgc

SEQ ID NO: 22610 - DNA, 23 bp, Homo sapiens
tgctgcacccccaaatccctcag

SEQ ID NO: 22611 - DNA, 20 bp, Homo sapiens
aggtcagggaacgcgggagc

SEQ ID NO: 22612 - DNA, 20 bp, Homo sapiens
cgctcgggtacgctccacgc

SEQ ID NO: 22613 - DNA, 24 bp, Homo sapiens
gtgcgatgaggggagtcctgagca

SEQ ID NO: 22614 - DNA, 21 bp, Homo sapiens
ttcctgtatgtgggcgtgcac

SEQ ID NO: 22615 - DNA, 22 bp, Homo sapiens
cgatgggatgcggccgtgggcg

SEQ ID NO: 22616 - DNA, 24 bp, Homo sapiens
aggctgggctcctctccccaccct

SEQ ID NO: 22617 - DNA, 21 bp, Homo sapiens
agggacgccccgacccaagcc

SEQ ID NO: 22618 - DNA, 24 bp, Homo sapiens
ccgtcgccagcgcgccgcccgcgc

SEQ ID NO: 22619 - DNA, 21 bp, Homo sapiens
gagcgcaggggaacccgggca

SEQ ID NO: 22620 - DNA, 23 bp, Homo sapiens
agatcctctgcgcgcacccgcgg

SEQ ID NO: 22621 - DNA, 20 bp, Homo sapiens
gggagggcgcgctcggttct

SEQ ID NO: 22622 - DNA, 22 bp, Homo sapiens
agctatgccacctgcacccagg

SEQ ID NO: 22623 - DNA, 22 bp, Homo sapiens
ccggccacgcgcctctgtcttg

SEQ ID NO: 22624 - DNA, 24 bp, Homo sapiens
cggcggagcccagagggcggcggg

SEQ ID NO: 22625 - DNA, 20 bp, Homo sapiens
gccgtccgtgcccgcgggac

SEQ ID NO: 22626 - DNA, 20 bp, Homo sapiens
gtcccagcgtctgtcccgcc

SEQ ID NO: 22627 - DNA, 24 bp, Homo sapiens
aggttaagctaagcagaggcatcc

SEQ ID NO: 22628 - DNA, 22 bp, Homo sapiens
tagctccaaaggacagggcgtt

SEQ ID NO: 22629 - DNA, 22 bp, Homo sapiens
agccactgatgagcctctgagg

SEQ ID NO: 22630 - DNA, 20 bp, Homo sapiens
ccggcccctcgggccgcttc

SEQ ID NO: 22631 - DNA, 21 bp, Homo sapiens
ggagagggcctggggcccggc

SEQ ID NO: 22632 - DNA, 21 bp, Homo sapiens
atcaggcccaccgggtcgcct

SEQ ID NO: 22633 - DNA, 23 bp, Homo sapiens
catccagggtcctcactgcctgt

SEQ ID NO: 22634 - DNA, 21 bp, Homo sapiens
tcggctgtggggtcctgtggt

SEQ ID NO: 22635 - DNA, 23 bp, Homo sapiens
gccccccgggccgtcttcccctc

SEQ ID NO: 22636 - DNA, 23 bp, Homo sapiens
ctcgtcctgcgcttgaccccaga

SEQ ID NO: 22637 - DNA, 20 bp, Homo sapiens
cggatgtgagtggagcggcc

SEQ ID NO: 22638 - DNA, 22 bp, Homo sapiens
atgctacgaacaatatcacaga

SEQ ID NO: 22639 - DNA, 23 bp, Homo sapiens
ggtggcggcggcggctccgggct

SEQ ID NO: 22640 - DNA, 23 bp, Homo sapiens
ccacagcgatacccccgcccctc

SEQ ID NO: 22641 - DNA, 22 bp, Homo sapiens
tgagtatttaatgagataatgt

SEQ ID NO: 22642 - DNA, 21 bp, Homo sapiens
gctggcgcgctctggggtgca

SEQ ID NO: 22643 - DNA, 22 bp, Homo sapiens
caaaaccgcaattactttagca

SEQ ID NO: 22644 - DNA, 20 bp, Homo sapiens
cgtcctcgtggcgcttgggc

SEQ ID NO: 22645 - DNA, 24 bp, Homo sapiens
gagcgtttctaagggggccgcccg

SEQ ID NO: 22646 - DNA, 22 bp, Homo sapiens
gctatggggccgggcggccgtg

SEQ ID NO: 22647 - DNA, 20 bp, Homo sapiens
accggcaatggagcggttga

SEQ ID NO: 22648 - DNA, 22 bp, Homo sapiens
ggcactccaagtacctcactcc

SEQ ID NO: 22649 - DNA, 20 bp, Homo sapiens
actgtgccattgaagaagaa

SEQ ID NO: 22650 - DNA, 20 bp, Homo sapiens
cccgcggagaacccaggggc

SEQ ID NO: 22651 - DNA, 21 bp, Homo sapiens
catacatgtaggcacgcatac

SEQ ID NO: 22652 - DNA, 22 bp, Homo sapiens
cccggccccggaggagcccgcg

SEQ ID NO: 22653 - DNA, 23 bp, Homo sapiens
tacccagcagtcattttggatct

SEQ ID NO: 22654 - DNA, 22 bp, Homo sapiens
caaatataaaagacaacatatt

SEQ ID NO: 22655 - DNA, 24 bp, Homo sapiens
atcatgccactgaggatttggtga

SEQ ID NO: 22656 - DNA, 23 bp, Homo sapiens
gatgtggttttgaaatcagtgct

SEQ ID NO: 22657 - DNA, 21 bp, Homo sapiens
gtcaccgcgtcgcctccccgc

SEQ ID NO: 22658 - DNA, 22 bp, Homo sapiens
caacagaacccagagagtcagc

SEQ ID NO: 22659 - DNA, 20 bp, Homo sapiens
tgaggcaggatgtcactgtc

SEQ ID NO: 22660 - DNA, 21 bp, Homo sapiens
ggcggcggcgggggtgtgtcc

SEQ ID NO: 22661 - DNA, 22 bp, Homo sapiens
actcccggcctagggcctcgcg

SEQ ID NO: 22662 - DNA, 22 bp, Homo sapiens
tcagccgtgtctgttctctggc

SEQ ID NO: 22663 - DNA, 21 bp, Homo sapiens
gtctagcatgcaggtcccgcg

SEQ ID NO: 22664 - DNA, 22 bp, Homo sapiens
tggtcagcgggggacggattgc

SEQ ID NO: 22665 - DNA, 20 bp, Homo sapiens
ggctcgcgggtcggggccgc

SEQ ID NO: 22666 - DNA, 22 bp, Homo sapiens
taagattttgaccagtggggag

SEQ ID NO: 22667 - DNA, 22 bp, Homo sapiens
gacctgcgcccccagccccctc

SEQ ID NO: 22668 - DNA, 22 bp, Homo sapiens
agggggctgggggcgcaggtcg

SEQ ID NO: 22669 - DNA, 24 bp, Homo sapiens
attccccacctgtccctgcccagc

SEQ ID NO: 22670 - DNA, 23 bp, Homo sapiens
acgccctccgcagtgcctggcga

SEQ ID NO: 22671 - DNA, 21 bp, Homo sapiens
agcagcgcctgcagcggtcgc

SEQ ID NO: 22672 - DNA, 21 bp, Homo sapiens
ggtgagccgctgccctgcaga

SEQ ID NO: 22673 - DNA, 22 bp, Homo sapiens
cggccgccagcgcgggaggagc

SEQ ID NO: 22674 - DNA, 20 bp, Homo sapiens
gatcccggggccgagggggc

SEQ ID NO: 22675 - DNA, 20 bp, Homo sapiens
cgcagcgcggccgcagcagc

SEQ ID NO: 22676 - DNA, 22 bp, Homo sapiens
ttagctcgtgtggtgattgctg

SEQ ID NO: 22677 - DNA, 20 bp, Homo sapiens
gagcggggcgtctgagcgtg

SEQ ID NO: 22678 - DNA, 23 bp, Homo sapiens
cagtgccctctgagctcactgag

SEQ ID NO: 22679 - DNA, 20 bp, Homo sapiens
cgcctcggaactgcgcgccc

SEQ ID NO: 22680 - DNA, 21 bp, Homo sapiens
atatatatgagcgtatatata

SEQ ID NO: 22681 - DNA, 24 bp, Homo sapiens
gcggcggcgggcggcgggcggcgg

SEQ ID NO: 22682 - DNA, 22 bp, Homo sapiens
aattaggcccaacagttcccgt

SEQ ID NO: 22683 - DNA, 24 bp, Homo sapiens
ctttgtctcgctgcagcgggtgct

SEQ ID NO: 22684 - DNA, 21 bp, Homo sapiens
atatatagtggattctgggat

SEQ ID NO: 22685 - DNA, 21 bp, Homo sapiens
gaagcatggcccgggggtcgg

SEQ ID NO: 22686 - DNA, 21 bp, Homo sapiens
ccgccctcccgcctgcgcact

SEQ ID NO: 22687 - DNA, 24 bp, Homo sapiens
aggctccgtgtccagacgccagct

SEQ ID NO: 22688 - DNA, 21 bp, Homo sapiens
acgcgcaacagctggagggcg

SEQ ID NO: 22689 - DNA, 24 bp, Homo sapiens
cctgcccaggatgagcggcgccgg

SEQ ID NO: 22690 - DNA, 22 bp, Homo sapiens
tagctttagtcactgccagcag

SEQ ID NO: 22691 - DNA, 23 bp, Homo sapiens
caggtctccaaggtggagtcaga

SEQ ID NO: 22692 - DNA, 21 bp, Homo sapiens
gcaaacaccaattactctcgt

SEQ ID NO: 22693 - DNA, 23 bp, Homo sapiens
caatcacctctcaaaggccctat

SEQ ID NO: 22694 - DNA, 24 bp, Homo sapiens
atgtgagcccctgtgcccagccca

SEQ ID NO: 22695 - DNA, 21 bp, Homo sapiens
cccggactggagctgcctggc

SEQ ID NO: 22696 - DNA, 24 bp, Homo sapiens
cgcgggacagctggcccgtatcct

SEQ ID NO: 22697 - DNA, 23 bp, Homo sapiens
cagcttgggtctctcctgcttcc

SEQ ID NO: 22698 - DNA, 22 bp, Homo sapiens
gcaagaaagtgagactctgcct

SEQ ID NO: 22699 - DNA, 20 bp, Homo sapiens
cagctgctccccgcgccggg

SEQ ID NO: 22700 - DNA, 23 bp, Homo sapiens
tggcctgcagtggacgagcatcg

SEQ ID NO: 22701 - DNA, 22 bp, Homo sapiens
gcggcttctacagctcggaccc

SEQ ID NO: 22702 - DNA, 20 bp, Homo sapiens
gggttgctgcgccgtcctcc

SEQ ID NO: 22703 - DNA, 23 bp, Homo sapiens
tggcccgggctctgcccccagac

SEQ ID NO: 22704 - DNA, 23 bp, Homo sapiens
ccctggcctgagaagctccggca

SEQ ID NO: 22705 - DNA, 22 bp, Homo sapiens
caaaaaccgtaattacttgtgt

SEQ ID NO: 22706 - DNA, 22 bp, Homo sapiens
cctgctgccgacagctgctgct

SEQ ID NO: 22707 - DNA, 23 bp, Homo sapiens
gccctcttcggcagtctctccgg

SEQ ID NO: 22708 - DNA, 22 bp, Homo sapiens
actccattttccataggactta

SEQ ID NO: 22709 - DNA, 22 bp, Homo sapiens
tcagctgcggcgcattccctcc

SEQ ID NO: 22710 - DNA, 22 bp, Homo sapiens
caggcatgagccacggcaatca

SEQ ID NO: 22711 - DNA, 20 bp, Homo sapiens
gtcagctcccctttctcgcc

SEQ ID NO: 22712 - DNA, 22 bp, Homo sapiens
gctgtcctgtgagggagaccag

SEQ ID NO: 22713 - DNA, 24 bp, Homo sapiens
gcgccgggtgagcagcgtctcggc

SEQ ID NO: 22714 - DNA, 23 bp, Homo sapiens
cccctgctcctcctcgaccccgc

SEQ ID NO: 22715 - DNA, 21 bp, Homo sapiens
acaccggggacagcaccacca

SEQ ID NO: 22716 - DNA, 24 bp, Homo sapiens
cctcgcgcccacctggtcactgcc

SEQ ID NO: 22717 - DNA, 23 bp, Homo sapiens
ccctcggtctagtctggccacct

SEQ ID NO: 22718 - DNA, 24 bp, Homo sapiens
ccttcccagtctggagccacccat

SEQ ID NO: 22719 - DNA, 22 bp, Homo sapiens
tctaaccgccgcgcgccccgca

SEQ ID NO: 22720 - DNA, 22 bp, Homo sapiens
cttcccggggctacgctcattc

SEQ ID NO: 22721 - DNA, 22 bp, Homo sapiens
gacacctctgcactcaaggcgg

SEQ ID NO: 22722 - DNA, 23 bp, Homo sapiens
cccctaagccttctgcccccaac

SEQ ID NO: 22723 - DNA, 22 bp, Homo sapiens
cagcccctgggccgccgcctcc

SEQ ID NO: 22724 - DNA, 23 bp, Homo sapiens
ccgccggggcccagtgcgccgcg

SEQ ID NO: 22725 - DNA, 22 bp, Homo sapiens
tgagtcaggcctggtcttgggt

SEQ ID NO: 22726 - DNA, 22 bp, Homo sapiens
caaagacttccttctctcgcct

SEQ ID NO: 22727 - DNA, 20 bp, Homo sapiens
cggcaatgtagtaatagaat

SEQ ID NO: 22728 - DNA, 23 bp, Homo sapiens
tttttttcgggctccactccctg

SEQ ID NO: 22729 - DNA, 20 bp, Homo sapiens
ggactcattttcaggaaggt

SEQ ID NO: 22730 - DNA, 23 bp, Homo sapiens
cggctctggcctcctgacccaga

SEQ ID NO: 22731 - DNA, 24 bp, Homo sapiens
ctgctgctcccagtcctgcccctg

SEQ ID NO: 22732 - DNA, 24 bp, Homo sapiens
cgccccctccccgccccgcgccct

SEQ ID NO: 22733 - DNA, 24 bp, Homo sapiens
ttgggtaaggttgagattctgcat

SEQ ID NO: 22734 - DNA, 20 bp, Homo sapiens
gggcgcgcgcagcggctgga

SEQ ID NO: 22735 - DNA, 22 bp, Homo sapiens
tcatcacgtggtgacgcaacat

SEQ ID NO: 22736 - DNA, 20 bp, Homo sapiens
cggcggcccgcggcggggct

SEQ ID NO: 22737 - DNA, 20 bp, Homo sapiens
ggcgtcctgcgactgcccga

SEQ ID NO: 22738 - DNA, 22 bp, Homo sapiens
gccgggctggggcgcgggagcc

SEQ ID NO: 22739 - DNA, 22 bp, Homo sapiens
tcctccctctccctgcctggtc

SEQ ID NO: 22740 - DNA, 23 bp, Homo sapiens
cacctcctctgcggcagctgcgc

SEQ ID NO: 22741 - DNA, 23 bp, Homo sapiens
ccacgccccctcccctcctcccg

SEQ ID NO: 22742 - DNA, 21 bp, Homo sapiens
tagtgttgctcagaatcaacg

SEQ ID NO: 22743 - DNA, 24 bp, Homo sapiens
accaggagattcccctctgcccga

SEQ ID NO: 22744 - DNA, 23 bp, Homo sapiens
tcggaggtccgcgggcgccccat

SEQ ID NO: 22745 - DNA, 23 bp, Homo sapiens
ccgcaggcaggcaggcaggcagg

SEQ ID NO: 22746 - DNA, 22 bp, Homo sapiens
tactctctcggacaagctgtag

SEQ ID NO: 22747 - DNA, 21 bp, Homo sapiens
aattacagattgtctcagaga

SEQ ID NO: 22748 - DNA, 22 bp, Homo sapiens
ccggctccccgcgctggagcct

SEQ ID NO: 22749 - DNA, 22 bp, Homo sapiens
agccctgagagtgaggacctcc

SEQ ID NO: 22750 - DNA, 22 bp, Homo sapiens
actctcagggttgtacaagagc

SEQ ID NO: 22751 - DNA, 24 bp, Homo sapiens
ggggcggggcggcggcggcccggg

SEQ ID NO: 22752 - DNA, 21 bp, Homo sapiens
cggctggcggagggggaggag

SEQ ID NO: 22753 - DNA, 22 bp, Homo sapiens
ccacagtgtggcacagtcgtgt

SEQ ID NO: 22754 - DNA, 21 bp, Homo sapiens
tcggctgtgtatctctgtgcc

SEQ ID NO: 22755 - DNA, 21 bp, Homo sapiens
aggctgctccggaccgggacg

SEQ ID NO: 22756 - DNA, 23 bp, Homo sapiens
ccccacccttccttgcccacagg

SEQ ID NO: 22757 - DNA, 24 bp, Homo sapiens
cccaggatgcagtgtggaccggcc

SEQ ID NO: 22758 - DNA, 22 bp, Homo sapiens
gccagcggcgcagtgggcggtg

SEQ ID NO: 22759 - DNA, 22 bp, Homo sapiens
tggccgttctctttcccacagt

SEQ ID NO: 22760 - DNA, 20 bp, Homo sapiens
tcgacggcatctccaccggg

SEQ ID NO: 22761 - DNA, 23 bp, Homo sapiens
tcgggccccagatggccggcggc

SEQ ID NO: 22762 - DNA, 22 bp, Homo sapiens
agctcagggtgggccccatggt

SEQ ID NO: 22763 - DNA, 22 bp, Homo sapiens
acacagagaaccgggccttgcg

SEQ ID NO: 22764 - DNA, 20 bp, Homo sapiens
cgggcccgcggaggagcggc

SEQ ID NO: 22765 - DNA, 23 bp, Homo sapiens
cctggcctagccgcaggcccctc

SEQ ID NO: 22766 - DNA, 23 bp, Homo sapiens
caagtccccctcctccctgcaga

SEQ ID NO: 22767 - DNA, 24 bp, Homo sapiens
agcccgcgttccaccctctgtgcc

SEQ ID NO: 22768 - DNA, 20 bp, Homo sapiens
gcgagttggagaggtctgtg

SEQ ID NO: 22769 - DNA, 22 bp, Homo sapiens
gcctggtctagcatgctataat

SEQ ID NO: 22770 - DNA, 20 bp, Homo sapiens
cccgctggggccggggatgc

SEQ ID NO: 22771 - DNA, 23 bp, Homo sapiens
cccacccctgctccccgcgcccc

SEQ ID NO: 22772 - DNA, 23 bp, Homo sapiens
tggcttgtagatagcaggctggc

SEQ ID NO: 22773 - DNA, 22 bp, Homo sapiens
gtgtccccggcggcgggggcgc

SEQ ID NO: 22774 - DNA, 23 bp, Homo sapiens
tgtgcaaatctatatggaactga

SEQ ID NO: 22775 - DNA, 21 bp, Homo sapiens
tctcacctgattccctctcta

SEQ ID NO: 22776 - DNA, 20 bp, Homo sapiens
gatgccccgggccgccgcct

SEQ ID NO: 22777 - DNA, 24 bp, Homo sapiens
cgcgcgggtcggcgcggtgccgga

SEQ ID NO: 22778 - DNA, 20 bp, Homo sapiens
ctggaccccccagtgtggcc

SEQ ID NO: 22779 - DNA, 22 bp, Homo sapiens
tgcccctccgtccgcgcgcgtc

SEQ ID NO: 22780 - DNA, 24 bp, Homo sapiens
tccggcggccgggagggacgcgga

SEQ ID NO: 22781 - DNA, 22 bp, Homo sapiens
actgaggtccacagagccagct

SEQ ID NO: 22782 - DNA, 21 bp, Homo sapiens
aggctctggtgctttctgtct

SEQ ID NO: 22783 - DNA, 21 bp, Homo sapiens
gccagcagcctggctcccagg

SEQ ID NO: 22784 - DNA, 23 bp, Homo sapiens
cctgaggagcgcgcgtgcccgga

SEQ ID NO: 22785 - DNA, 21 bp, Homo sapiens
gcccggggagcccgcgcccgt

SEQ ID NO: 22786 - DNA, 22 bp, Homo sapiens
cacggatatggaacccacgata

SEQ ID NO: 22787 - DNA, 22 bp, Homo sapiens
agccctggaggtagagactgca

SEQ ID NO: 22788 - DNA, 21 bp, Homo sapiens
gccttccgtgtggccagtgct

SEQ ID NO: 22789 - DNA, 21 bp, Homo sapiens
tggccagaaagcagctaaaca

SEQ ID NO: 22790 - DNA, 20 bp, Homo sapiens
cccatacagcagaaagcact

SEQ ID NO: 22791 - DNA, 21 bp, Homo sapiens
ttcccgtccccctttcctcga

SEQ ID NO: 22792 - DNA, 22 bp, Homo sapiens
tcccaggccccctgcatctatc

SEQ ID NO: 22793 - DNA, 24 bp, Homo sapiens
tgcctgctttttggccagctccat

SEQ ID NO: 22794 - DNA, 20 bp, Homo sapiens
gccccgccctcggggcttcc

SEQ ID NO: 22795 - DNA, 21 bp, Homo sapiens
gggccgtgaaggtgggacctc

SEQ ID NO: 22796 - DNA, 22 bp, Homo sapiens
tgagcaaaagtaattgcggttt

SEQ ID NO: 22797 - DNA, 21 bp, Homo sapiens
ttgtacttcagaatctccagg

SEQ ID NO: 22798 - DNA, 22 bp, Homo sapiens
accgccctggtgctggctcaga

SEQ ID NO: 22799 - DNA, 21 bp, Homo sapiens
ctccagcgcgggaccagcagc

SEQ ID NO: 22800 - DNA, 22 bp, Homo sapiens
gccttctcttcccggttcttcc

SEQ ID NO: 22801 - DNA, 21 bp, Homo sapiens
gcactcaataaacgttcatgt

SEQ ID NO: 22802 - DNA, 20 bp, Homo sapiens
gacgcagtgaggggggtcgg

SEQ ID NO: 22803 - DNA, 21 bp, Homo sapiens
ggaagtggggcagccggcaga

SEQ ID NO: 22804 - DNA, 24 bp, Homo sapiens
ccgcccctctgccccttcgcccct

SEQ ID NO: 22805 - DNA, 21 bp, Homo sapiens
agcgcgggcggtgggcgggag

SEQ ID NO: 22806 - DNA, 23 bp, Homo sapiens
tgggtcctcaaacatggttggaa

SEQ ID NO: 22807 - DNA, 21 bp, Homo sapiens
aatggcaatccacatgatctg

SEQ ID NO: 22808 - DNA, 22 bp, Homo sapiens
tgggcgccgcgccttccgccga

SEQ ID NO: 22809 - DNA, 22 bp, Homo sapiens
gaggtcgccgccatggcccgct

SEQ ID NO: 22810 - DNA, 22 bp, Homo sapiens
tgggaatgaggctttgggcgac

SEQ ID NO: 22811 - DNA, 22 bp, Homo sapiens
cccccaaagcccaggaggtcct

SEQ ID NO: 22812 - DNA, 20 bp, Homo sapiens
gccgccgcgagtctggtatc

SEQ ID NO: 22813 - DNA, 22 bp, Homo sapiens
tggcatggttgggagcaattgt

SEQ ID NO: 22814 - DNA, 20 bp, Homo sapiens
gcggccggagcggagccggg

SEQ ID NO: 22815 - DNA, 24 bp, Homo sapiens
gccgaggacgagccacgcgcccaa

SEQ ID NO: 22816 - DNA, 21 bp, Homo sapiens
ccttatatatcctttcttatg

SEQ ID NO: 22817 - DNA, 23 bp, Homo sapiens
aacagcttctctatgtgtggatt

SEQ ID NO: 22818 - DNA, 20 bp, Homo sapiens
atatagtgtggtctatagca

SEQ ID NO: 22819 - DNA, 21 bp, Homo sapiens
ccgtggggagcggggcgggaa

SEQ ID NO: 22820 - DNA, 23 bp, Homo sapiens
acctggtagcatttattttccct

SEQ ID NO: 22821 - DNA, 22 bp, Homo sapiens
gagcagcagaggtctagcagcc

SEQ ID NO: 22822 - DNA, 20 bp, Homo sapiens
gcgggggcggggcgcccgga

SEQ ID NO: 22823 - DNA, 23 bp, Homo sapiens
cggggcagctcagtacaggatgc

SEQ ID NO: 22824 - DNA, 24 bp, Homo sapiens
tcctgtactgagctgccccgagct

SEQ ID NO: 22825 - DNA, 22 bp, Homo sapiens
ccagccgcacctgtgcaactgt

SEQ ID NO: 22826 - DNA, 21 bp, Homo sapiens
gcgcccgggcgcgcgccggcc

SEQ ID NO: 22827 - DNA, 24 bp, Homo sapiens
gagacgggagaggaggaacccccg

SEQ ID NO: 22828 - DNA, 21 bp, Homo sapiens
agctcctcctctcccgggtcg

SEQ ID NO: 22829 - DNA, 20 bp, Homo sapiens
aggcagaccaggtccggatg

SEQ ID NO: 22830 - DNA, 24 bp, Homo sapiens
gcccacgtggacctggccgtcgct

SEQ ID NO: 22831 - DNA, 23 bp, Homo sapiens
agtgccccgcggagagtcgagct

SEQ ID NO: 22832 - DNA, 21 bp, Homo sapiens
cgagcgtcgtcggcaagcggc

SEQ ID NO: 22833 - DNA, 20 bp, Homo sapiens
gccccggcggccgtcgggtt

SEQ ID NO: 22834 - DNA, 21 bp, Homo sapiens
ctctgcgcatgcccggacccc

SEQ ID NO: 22835 - DNA, 22 bp, Homo sapiens
gccgccagtagtgggagacgtg

SEQ ID NO: 22836 - DNA, 22 bp, Homo sapiens
acctgagccactgcacccggct

SEQ ID NO: 22837 - DNA, 22 bp, Homo sapiens
ttccgggccgcggcctccgagc

SEQ ID NO: 22838 - DNA, 20 bp, Homo sapiens
cggcggcggcggcgggggta

SEQ ID NO: 22839 - DNA, 22 bp, Homo sapiens
gaccccggccccctcccccagc

SEQ ID NO: 22840 - DNA, 24 bp, Homo sapiens
tggtgccgcggccgcctccgcgag

SEQ ID NO: 22841 - DNA, 23 bp, Homo sapiens
aaacctcagtaacttttgcacca

SEQ ID NO: 22842 - DNA, 24 bp, Homo sapiens
ccgccccgacgccgtggccagccc

SEQ ID NO: 22843 - DNA, 22 bp, Homo sapiens
agccggcccggagcgctctgac

SEQ ID NO: 22844 - DNA, 22 bp, Homo sapiens
tacactgttgtggctggaacac

SEQ ID NO: 22845 - DNA, 22 bp, Homo sapiens
tcctcctggctgccacccctgt

SEQ ID NO: 22846 - DNA, 22 bp, Homo sapiens
cttgggcattgtttctggctga

SEQ ID NO: 22847 - DNA, 24 bp, Homo sapiens
tcggcctcgctcccgcccctcccc

SEQ ID NO: 22848 - DNA, 21 bp, Homo sapiens
ctcataggctcctctgcttct

SEQ ID NO: 22849 - DNA, 23 bp, Homo sapiens
ccacggtccgcccgaggcttcgg

SEQ ID NO: 22850 - DNA, 23 bp, Homo sapiens
cccgcggcggcggcggcgtccta

SEQ ID NO: 22851 - DNA, 20 bp, Homo sapiens
cctcggggagcccggcggtc

SEQ ID NO: 22852 - DNA, 22 bp, Homo sapiens
gcttcagatgggatcaggtgga

SEQ ID NO: 22853 - DNA, 20 bp, Homo sapiens
agggccgtccccgggcagga

SEQ ID NO: 22854 - DNA, 21 bp, Homo sapiens
ccaggacaccgcggccccggc

SEQ ID NO: 22855 - DNA, 21 bp, Homo sapiens
gcgcaggctgtggctccccga

SEQ ID NO: 22856 - DNA, 20 bp, Homo sapiens
tcccccacgggccgtgccgg

SEQ ID NO: 22857 - DNA, 22 bp, Homo sapiens
tccttcagtcgcccgccgtcag

SEQ ID NO: 22858 - DNA, 21 bp, Homo sapiens
tccgcagcagggagagcccgg

SEQ ID NO: 22859 - DNA, 20 bp, Homo sapiens
ccagccgttgcagcccacag

SEQ ID NO: 22860 - DNA, 23 bp, Homo sapiens
ggtcccggaggtggggttgcgct

SEQ ID NO: 22861 - DNA, 22 bp, Homo sapiens
gggctgggcggcgcggcgccgg

SEQ ID NO: 22862 - DNA, 20 bp, Homo sapiens
tgggctgcgtcaggctgagc

SEQ ID NO: 22863 - DNA, 22 bp, Homo sapiens
tacacaccatatatatactctc

SEQ ID NO: 22864 - DNA, 22 bp, Homo sapiens
caagaaccgtaattacttttgt

SEQ ID NO: 22865 - DNA, 24 bp, Homo sapiens
ttagagcttcaacctccagtgtga

SEQ ID NO: 22866 - DNA, 24 bp, Homo sapiens
ctagcgcccaggcgcctctcgcct

SEQ ID NO: 22867 - DNA, 22 bp, Homo sapiens
ttaccttctcttacagatcact

SEQ ID NO: 22868 - DNA, 22 bp, Homo sapiens
ctccggacccggggctccccct

SEQ ID NO: 22869 - DNA, 21 bp, Homo sapiens
cccgtgactgcagcgcgagcg

SEQ ID NO: 22870 - DNA, 21 bp, Homo sapiens
tctctatttcttgtgttccct

SEQ ID NO: 22871 - DNA, 23 bp, Homo sapiens
aggaacacaggaaataaagtgct

SEQ ID NO: 22872 - DNA, 22 bp, Homo sapiens
gctggctggctcacagaacagt

SEQ ID NO: 22873 - DNA, 21 bp, Homo sapiens
gcccagagcctgggaagtggc

SEQ ID NO: 22874 - DNA, 21 bp, Homo sapiens
gcgcgcgggcggggtccgcgg

SEQ ID NO: 22875 - DNA, 20 bp, Homo sapiens
gtgcgcggcgtcggagcaag

SEQ ID NO: 22876 - DNA, 23 bp, Homo sapiens
gacccgcgctttctctcccccag

SEQ ID NO: 22877 - DNA, 20 bp, Homo sapiens
tcggctgtcctgtgcccctt

SEQ ID NO: 22878 - DNA, 22 bp, Homo sapiens
gcgggcggcgcgctgagcgcca

SEQ ID NO: 22879 - DNA, 24 bp, Homo sapiens
tcccagagctcccaagggccccca

SEQ ID NO: 22880 - DNA, 22 bp, Homo sapiens
cctgctgcccttgccctaggcc

SEQ ID NO: 22881 - DNA, 21 bp, Homo sapiens
cgatcgataaccttcaccaga

SEQ ID NO: 22882 - DNA, 21 bp, Homo sapiens
ctgctctggacgctgaggccc

SEQ ID NO: 22883 - DNA, 22 bp, Homo sapiens
ctggcggagcttccgaatatcc

SEQ ID NO: 22884 - DNA, 23 bp, Homo sapiens
tccctgccggcccttcctcatac

SEQ ID NO: 22885 - DNA, 23 bp, Homo sapiens
cccacgtttgttgggctgggtgg

SEQ ID NO: 22886 - DNA, 23 bp, Homo sapiens
ctccctcgccttccccggagtga

SEQ ID NO: 22887 - DNA, 23 bp, Homo sapiens
ccgttcggcggcgccttcgcctt

SEQ ID NO: 22888 - DNA, 20 bp, Homo sapiens
cggcggcggcgctcggcggg

SEQ ID NO: 22889 - DNA, 21 bp, Homo sapiens
ttcccctcggccctgccccac

SEQ ID NO: 22890 - DNA, 24 bp, Homo sapiens
gggccagccgggggaggtgggtag

SEQ ID NO: 22891 - DNA, 22 bp, Homo sapiens
ccgcggggacagagtggccgcc

SEQ ID NO: 22892 - DNA, 24 bp, Homo sapiens
ggagggagcagctgggccctgggc

SEQ ID NO: 22893 - DNA, 22 bp, Homo sapiens
gcgaccaggtgccctcaccagg

SEQ ID NO: 22894 - DNA, 20 bp, Homo sapiens
gagcagcctgtgggcaccgc

SEQ ID NO: 22895 - DNA, 23 bp, Homo sapiens
ccacggcagctagcccgtcccgc

SEQ ID NO: 22896 - DNA, 22 bp, Homo sapiens
cagtcctgagctccaccccctc

SEQ ID NO: 22897 - DNA, 20 bp, Homo sapiens
tcagagaggtctggacctgg

SEQ ID NO: 22898 - DNA, 22 bp, Homo sapiens
cgcgggtgcctctgtccccaat

SEQ ID NO: 22899 - DNA, 20 bp, Homo sapiens
tgcgggtggaactcagggct

SEQ ID NO: 22900 - DNA, 21 bp, Homo sapiens
taagcggcgccgggcgggaga

SEQ ID NO: 22901 - DNA, 22 bp, Homo sapiens
gtaggcctcagtgctgggctac

SEQ ID NO: 22902 - DNA, 22 bp, Homo sapiens
ctggcctgccgcagagctgtcc

SEQ ID NO: 22903 - DNA, 20 bp, Homo sapiens
cggcggcggcggctctgggc

SEQ ID NO: 22904 - DNA, 21 bp, Homo sapiens
ggcggcgggggcgagaagaca

SEQ ID NO: 22905 - DNA, 23 bp, Homo sapiens
ggcctcaagacaagtttcctgca

SEQ ID NO: 22906 - DNA, 23 bp, Homo sapiens
cccgcctgggcaacaagagcgag

SEQ ID NO: 22907 - DNA, 23 bp, Homo sapiens
gctcctgccttgccggagtctgt

SEQ ID NO: 22908 - DNA, 20 bp, Homo sapiens
ccgcggcggggcgcgcctga

SEQ ID NO: 22909 - DNA, 23 bp, Homo sapiens
tctccttactgtagtttcaggaa

SEQ ID NO: 22910 - DNA, 23 bp, Homo sapiens
tgctattacaaagttgcatatat

SEQ ID NO: 22911 - DNA, 22 bp, Homo sapiens
cggcggcggcggcggcaccatc

SEQ ID NO: 22912 - DNA, 22 bp, Homo sapiens
gtggctgtgctggggtctcact

SEQ ID NO: 22913 - DNA, 24 bp, Homo sapiens
ctgcggcaggagctggggcggcct

SEQ ID NO: 22914 - DNA, 20 bp, Homo sapiens
cccgcagccagggacccgcg

SEQ ID NO: 22915 - DNA, 24 bp, Homo sapiens
tccaacgccccgatgcccctggcc

SEQ ID NO: 22916 - DNA, 23 bp, Homo sapiens
tcggttatcatggtaccgatgct

SEQ ID NO: 22917 - DNA, 21 bp, Homo sapiens
ggcgaaaggagcccgggcctg

SEQ ID NO: 22918 - DNA, 21 bp, Homo sapiens
agcacatttaggaatagggga

SEQ ID NO: 22919 - DNA, 22 bp, Homo sapiens
tcccctattcttatatgtgctc

SEQ ID NO: 22920 - DNA, 22 bp, Homo sapiens
agcacatataagaataggggaa

SEQ ID NO: 22921 - DNA, 23 bp, Homo sapiens
tcctcttctctcccccctcctcg

SEQ ID NO: 22922 - DNA, 22 bp, Homo sapiens
acgcaggagtcttgtatctttt

SEQ ID NO: 22923 - DNA, 22 bp, Homo sapiens
cccaatgacttttgcaccaacc

SEQ ID NO: 22924 - DNA, 21 bp, Homo sapiens
ctgcgcggcgcagacatggcc

SEQ ID NO: 22925 - DNA, 20 bp, Homo sapiens
tcgccgctgcctcccaccca

SEQ ID NO: 22926 - DNA, 23 bp, Homo sapiens
tggttaggaatgtgggatctgga

SEQ ID NO: 22927 - DNA, 22 bp, Homo sapiens
tggttaggaatgtgggctctgg

SEQ ID NO: 22928 - DNA, 21 bp, Homo sapiens
atcccacattcctaaccacct

SEQ ID NO: 22929 - DNA, 24 bp, Homo sapiens
ccccacgatatagggagtgatggc

SEQ ID NO: 22930 - DNA, 23 bp, Homo sapiens
actgcagcttccctccctccttg

SEQ ID NO: 22931 - DNA, 21 bp, Homo sapiens
cccccactctcagtgcctcga

SEQ ID NO: 22932 - DNA, 20 bp, Homo sapiens
tccccgcccccggagccggc

SEQ ID NO: 22933 - DNA, 22 bp, Homo sapiens
tcctggtttggacaatacatta

SEQ ID NO: 22934 - DNA, 23 bp, Homo sapiens
cttgtaatggagaacactaagct

SEQ ID NO: 22935 - DNA, 24 bp, Homo sapiens
cccaggaaggatcccagccagttt

SEQ ID NO: 22936 - DNA, 22 bp, Homo sapiens
ctagggatttggatgtgaacag

SEQ ID NO: 22937 - DNA, 20 bp, Homo sapiens
aggagtactgatgagatctc

SEQ ID NO: 22938 - DNA, 21 bp, Homo sapiens
aaaagctgtccactgtagagt

SEQ ID NO: 22939 - DNA, 21 bp, Homo sapiens
caggccccggctccctcctga

SEQ ID NO: 22940 - DNA, 24 bp, Homo sapiens
caatgtgtgaatgacactccctaa

SEQ ID NO: 22941 - DNA, 22 bp, Homo sapiens
agtatcctgtggagcacccaga

SEQ ID NO: 22942 - DNA, 20 bp, Homo sapiens
ccggatgctagcttccgggt

SEQ ID NO: 22943 - DNA, 20 bp, Homo sapiens
gccagcccgtgggaaggtga

SEQ ID NO: 22944 - DNA, 20 bp, Homo sapiens
ccccgcgcgcgccgctcgtc

SEQ ID NO: 22945 - DNA, 22 bp, Homo sapiens
aagcctgtccctaaatccttcc

SEQ ID NO: 22946 - DNA, 22 bp, Homo sapiens
acaccaaaacaatgaaaacaga

SEQ ID NO: 22947 - DNA, 23 bp, Homo sapiens
gttatcattgttttagtgtttgt

SEQ ID NO: 22948 - DNA, 21 bp, Homo sapiens
ctggctggaggagctagggga

SEQ ID NO: 22949 - DNA, 23 bp, Homo sapiens
tagcagtgcccaggtagagtgta

SEQ ID NO: 22950 - DNA, 22 bp, Homo sapiens
tctttaggaactctggctaact

SEQ ID NO: 22951 - DNA, 22 bp, Homo sapiens
tcttcaggaactctggctaact

SEQ ID NO: 22952 - DNA, 21 bp, Homo sapiens
ttctggtactctgcatgaggg

SEQ ID NO: 22953 - DNA, 21 bp, Homo sapiens
aggcaggactgggtggagacg

SEQ ID NO: 22954 - DNA, 22 bp, Homo sapiens
cggccgggacgcggagctgtgt

SEQ ID NO: 22955 - DNA, 22 bp, Homo sapiens
ctgcgtccgctcttcccgcagc

SEQ ID NO: 22956 - DNA, 22 bp, Homo sapiens
ctagccttagggtttagtaatc

SEQ ID NO: 22957 - DNA, 21 bp, Homo sapiens
cgcgcagacttgcgcacgcgt

SEQ ID NO: 22958 - DNA, 24 bp, Homo sapiens
cggcccccgcgggctctgcggacg

SEQ ID NO: 22959 - DNA, 20 bp, Homo sapiens
gcagacaggcacagcccggg

SEQ ID NO: 22960 - DNA, 22 bp, Homo sapiens
ccaggaacgccagccgttcacg

SEQ ID NO: 22961 - DNA, 21 bp, Homo sapiens
ggacccgctcctcagggctga

SEQ ID NO: 22962 - DNA, 24 bp, Homo sapiens
tgcgctctgaaaggccgggtcccg

SEQ ID NO: 22963 - DNA, 22 bp, Homo sapiens
cagccccggccaccgcccctcc

SEQ ID NO: 22964 - DNA, 24 bp, Homo sapiens
ccttctcccaacgtccctgccaga

SEQ ID NO: 22965 - DNA, 22 bp, Homo sapiens
gctccaggtgtcgggcgccggg

SEQ ID NO: 22966 - DNA, 21 bp, Homo sapiens
tctgagaaagcaggggtgagc

SEQ ID NO: 22967 - DNA, 20 bp, Homo sapiens
tgcccttccacgacccctac

SEQ ID NO: 22968 - DNA, 23 bp, Homo sapiens
gagcctgcggagccacgcgtaga

SEQ ID NO: 22969 - DNA, 23 bp, Homo sapiens
tgtccctgtccccttccccccaa

SEQ ID NO: 22970 - DNA, 20 bp, Homo sapiens
ctcggcagcctcagtccgtc

SEQ ID NO: 22971 - DNA, 22 bp, Homo sapiens
gcctctctcctcccgccggaca

SEQ ID NO: 22972 - DNA, 23 bp, Homo sapiens
gctcctctacacctgccgccgcc

SEQ ID NO: 22973 - DNA, 23 bp, Homo sapiens
ggcggagcggccgtcgcaggtcc

SEQ ID NO: 22974 - DNA, 21 bp, Homo sapiens
tttggcagcacaggcagctcc

SEQ ID NO: 22975 - DNA, 24 bp, Homo sapiens
tcctcccccgaccgcagcggctgg

SEQ ID NO: 22976 - DNA, 22 bp, Homo sapiens
tacaggtttgtccggagactga

SEQ ID NO: 22977 - DNA, 23 bp, Homo sapiens
ctcagtctcctgtgcagacctgt

SEQ ID NO: 22978 - DNA, 21 bp, Homo sapiens
taaacactggccaccagcagt

SEQ ID NO: 22979 - DNA, 23 bp, Homo sapiens
ccgcgcctgaggtgatgcggacc

SEQ ID NO: 22980 - DNA, 23 bp, Homo sapiens
cgatgacctctctaacaaggtgc

SEQ ID NO: 22981 - DNA, 21 bp, Homo sapiens
gtcgattggacccgccctccg

SEQ ID NO: 22982 - DNA, 22 bp, Homo sapiens
acctagttctctcgggctccgc

SEQ ID NO: 22983 - DNA, 22 bp, Homo sapiens
cctgcccgccggtgccgtctgc

SEQ ID NO: 22984 - DNA, 22 bp, Homo sapiens
tattgcagtcgctgtgccagga

SEQ ID NO: 22985 - DNA, 22 bp, Homo sapiens
tccgcggccctctcctgtgcga

SEQ ID NO: 22986 - DNA, 20 bp, Homo sapiens
ggaggcggcggcggctctgg

SEQ ID NO: 22987 - DNA, 21 bp, Homo sapiens
agggcgcgcggggcggggcgg

SEQ ID NO: 22988 - DNA, 22 bp, Homo sapiens
tccactattaggtcagcaggct

SEQ ID NO: 22989 - DNA, 21 bp, Homo sapiens
agccgggcgggggcgggggtg

SEQ ID NO: 22990 - DNA, 22 bp, Homo sapiens
cgcgcccagacctggggccccg

SEQ ID NO: 22991 - DNA, 21 bp, Homo sapiens
cgctgctcctgctgctactga

SEQ ID NO: 22992 - DNA, 20 bp, Homo sapiens
ccccggggtgcccggggggc

SEQ ID NO: 22993 - DNA, 22 bp, Homo sapiens
aaccgcaaattactgttgcacc

SEQ ID NO: 22994 - DNA, 24 bp, Homo sapiens
cttagactaccagactccctgaaa

SEQ ID NO: 22995 - DNA, 20 bp, Homo sapiens
gccagacgggactagccggg

SEQ ID NO: 22996 - DNA, 22 bp, Homo sapiens
atgccagcccctacctccatca

SEQ ID NO: 22997 - DNA, 24 bp, Homo sapiens
tcactcttcttctcttgttccccc

SEQ ID NO: 22998 - DNA, 21 bp, Homo sapiens
cgctccagccgatgtcgctct

SEQ ID NO: 22999 - DNA, 20 bp, Homo sapiens
cgcggagcagacaaaggatg

SEQ ID NO: 23000 - DNA, 22 bp, Homo sapiens
tctccagtgccgcagcagcagg

SEQ ID NO: 23001 - DNA, 21 bp, Homo sapiens
tccccgccccgcgccctccct

SEQ ID NO: 23002 - DNA, 23 bp, Homo sapiens
cccgctggccgaggcactgccga

SEQ ID NO: 23003 - DNA, 20 bp, Homo sapiens
cccagtgcggctgaggaggg

SEQ ID NO: 23004 - DNA, 22 bp, Homo sapiens
ccctcctcctcctcccaccctc

SEQ ID NO: 23005 - DNA, 22 bp, Homo sapiens
cataggaaggctcttgtctgtc

SEQ ID NO: 23006 - DNA, 22 bp, Homo sapiens
ttcaaagcttggctctgccacc

SEQ ID NO: 23007 - DNA, 21 bp, Homo sapiens
ctcactgatcaatgaatgcaa

SEQ ID NO: 23008 - DNA, 24 bp, Homo sapiens
cccaggaggtggagtgcagtgaac

SEQ ID NO: 23009 - DNA, 21 bp, Homo sapiens
agccgcttcccgcccccgagc

SEQ ID NO: 23010 - DNA, 22 bp, Homo sapiens
ccgagctcccgccatggcccgg

SEQ ID NO: 23011 - DNA, 23 bp, Homo sapiens
ccgccggcaccgcccccggggcc

SEQ ID NO: 23012 - DNA, 24 bp, Homo sapiens
ggcgccgccgcctccgcctccgcc

SEQ ID NO: 23013 - DNA, 20 bp, Homo sapiens
cctcctgtaacgggctctgg

SEQ ID NO: 23014 - DNA, 21 bp, Homo sapiens
gccaggcaggccagccaggtc

SEQ ID NO: 23015 - DNA, 21 bp, Homo sapiens
ccgaggcccgagcccacccga

SEQ ID NO: 23016 - DNA, 22 bp, Homo sapiens
tcagcagccgcccgcctccagg

SEQ ID NO: 23017 - DNA, 21 bp, Homo sapiens
caggtcagtgcgtgcccgcgc

SEQ ID NO: 23018 - DNA, 24 bp, Homo sapiens
tcccaggcctgggccgggccgtga

SEQ ID NO: 23019 - DNA, 21 bp, Homo sapiens
caagcggcgcctcgcagcatc

SEQ ID NO: 23020 - DNA, 23 bp, Homo sapiens
gtcatgggtctgggctttgtggc

SEQ ID NO: 23021 - DNA, 23 bp, Homo sapiens
cccccatcctgctctctcccaga

SEQ ID NO: 23022 - DNA, 22 bp, Homo sapiens
gctccttttcaccctgccccct

SEQ ID NO: 23023 - DNA, 22 bp, Homo sapiens
ccgccgggcgtcgcggggccta

SEQ ID NO: 23024 - DNA, 24 bp, Homo sapiens
ctcctcgccccttcccccgccacc

SEQ ID NO: 23025 - DNA, 23 bp, Homo sapiens
ccgctgggcgccgtccgagttcc

SEQ ID NO: 23026 - DNA, 20 bp, Homo sapiens
gaagcgggtgctctcggcta

SEQ ID NO: 23027 - DNA, 21 bp, Homo sapiens
tcctgaggtctgaagcacgcc

SEQ ID NO: 23028 - DNA, 20 bp, Homo sapiens
gcggggacccgatgcgcggg

SEQ ID NO: 23029 - DNA, 20 bp, Homo sapiens
taagcgtgcgccactgtgcc

SEQ ID NO: 23030 - DNA, 23 bp, Homo sapiens
ccgcgatgacttttgcatcaacc

SEQ ID NO: 23031 - DNA, 21 bp, Homo sapiens
aaccccagactgggaggacct

SEQ ID NO: 23032 - DNA, 22 bp, Homo sapiens
gccggccccgcgcccgcgctgc

SEQ ID NO: 23033 - DNA, 21 bp, Homo sapiens
caggcggcaggggttggtatc

SEQ ID NO: 23034 - DNA, 22 bp, Homo sapiens
cctgcctgtgtccccagtgtct

SEQ ID NO: 23035 - DNA, 22 bp, Homo sapiens
gtcctgctgcttggtgagctgg

SEQ ID NO: 23036 - DNA, 21 bp, Homo sapiens
tcggcgttcgtttggccgcgc

SEQ ID NO: 23037 - DNA, 22 bp, Homo sapiens
gcccgcggggccgggtgcgatg

SEQ ID NO: 23038 - DNA, 22 bp, Homo sapiens
ctgtcctgccggcggccgtggc

SEQ ID NO: 23039 - DNA, 23 bp, Homo sapiens
cctccgagacgcgacctcaggag

SEQ ID NO: 23040 - DNA, 22 bp, Homo sapiens
cgccgcggctcctgccccgccc

SEQ ID NO: 23041 - DNA, 24 bp, Homo sapiens
ctcccagggacgtgcaggcagttg

SEQ ID NO: 23042 - DNA, 22 bp, Homo sapiens
aatcggcctgtggcatgcagtc

SEQ ID NO: 23043 - DNA, 21 bp, Homo sapiens
tgagggctgctgggtgcctgg

SEQ ID NO: 23044 - DNA, 23 bp, Homo sapiens
tcgcgggccccccgccacccccc

SEQ ID NO: 23045 - DNA, 20 bp, Homo sapiens
cggtggcggcggcggcgcgc

SEQ ID NO: 23046 - DNA, 23 bp, Homo sapiens
cccccatgtccaacccacgctgc

SEQ ID NO: 23047 - DNA, 20 bp, Homo sapiens
aaggatagcccgggtttggg

SEQ ID NO: 23048 - DNA, 20 bp, Homo sapiens
gcacgaggtcggcggcgccg

SEQ ID NO: 23049 - DNA, 23 bp, Homo sapiens
cgctgcccgccgatggccagagc

SEQ ID NO: 23050 - DNA, 21 bp, Homo sapiens
acagtggcatgggctttggct

SEQ ID NO: 23051 - DNA, 22 bp, Homo sapiens
tggacaggtggagtgtggcctg

SEQ ID NO: 23052 - DNA, 21 bp, Homo sapiens
cccccaagtctgggcctgact

SEQ ID NO: 23053 - DNA, 22 bp, Homo sapiens
tggccgggggctgggggtcctg

SEQ ID NO: 23054 - DNA, 23 bp, Homo sapiens
ttcggagtctgcgagcccagcca

SEQ ID NO: 23055 - DNA, 24 bp, Homo sapiens
tctcactgccctgctcttacccct

SEQ ID NO: 23056 - DNA, 22 bp, Homo sapiens
cccaggggccgtgcccactgac

SEQ ID NO: 23057 - DNA, 22 bp, Homo sapiens
cgcgtaccaaaagtaataatgt

SEQ ID NO: 23058 - DNA, 20 bp, Homo sapiens
tggacactgaccaggacccc

SEQ ID NO: 23059 - DNA, 22 bp, Homo sapiens
gccctggcctggatccatgctg

SEQ ID NO: 23060 - DNA, 24 bp, Homo sapiens
ggagcccagcctgcccctctagtg

SEQ ID NO: 23061 - DNA, 23 bp, Homo sapiens
acacacctgaccacccactctcc

SEQ ID NO: 23062 - DNA, 23 bp, Homo sapiens
tcacccaggcgctgttctgcagc

SEQ ID NO: 23063 - DNA, 23 bp, Homo sapiens
cggttggggctggaggaacagga

SEQ ID NO: 23064 - DNA, 23 bp, Homo sapiens
gcccggtgtctgcgtggcccatc

SEQ ID NO: 23065 - DNA, 24 bp, Homo sapiens
ctccccctccaccgcccctgcagc

SEQ ID NO: 23066 - DNA, 21 bp, Homo sapiens
atggcttcggagcaggacgtg

SEQ ID NO: 23067 - DNA, 20 bp, Homo sapiens
cgcagcgcgcacccgcagcc

SEQ ID NO: 23068 - DNA, 24 bp, Homo sapiens
tgcgcgccctccgcgccgacagcg

SEQ ID NO: 23069 - DNA, 21 bp, Homo sapiens
gccgcgttcgcagcatggccg

SEQ ID NO: 23070 - DNA, 21 bp, Homo sapiens
cacgagggagctcctggccag

SEQ ID NO: 23071 - DNA, 22 bp, Homo sapiens
ccctgcctcacggtgaccagca

SEQ ID NO: 23072 - DNA, 21 bp, Homo sapiens
gccccggcccgcccgggcccg

SEQ ID NO: 23073 - DNA, 22 bp, Homo sapiens
ccgcctcggagaccccgcagcc

SEQ ID NO: 23074 - DNA, 24 bp, Homo sapiens
tacgtctgcgcctgcgcctgcgcc

SEQ ID NO: 23075 - DNA, 21 bp, Homo sapiens
cggcggggggcggcgcggggg

SEQ ID NO: 23076 - DNA, 20 bp, Homo sapiens
ccgcgcgcgccgctcgccct

SEQ ID NO: 23077 - DNA, 21 bp, Homo sapiens
tacggtcaatgctctgaaatc

SEQ ID NO: 23078 - DNA, 20 bp, Homo sapiens
aggattaggattgttgtgaa

SEQ ID NO: 23079 - DNA, 22 bp, Homo sapiens
ggtgctgaggtcgcctcggtgc

SEQ ID NO: 23080 - DNA, 23 bp, Homo sapiens
cgccgcgctctcggggcagggcc

SEQ ID NO: 23081 - DNA, 22 bp, Homo sapiens
ccgctgggggttccgcggcagc

SEQ ID NO: 23082 - DNA, 21 bp, Homo sapiens
gctcagaagtgcggacgcccg

SEQ ID NO: 23083 - DNA, 22 bp, Homo sapiens
tctcaaccacctgggctcaaac

SEQ ID NO: 23084 - DNA, 22 bp, Homo sapiens
gccactgcacttcccaggctca

SEQ ID NO: 23085 - DNA, 21 bp, Homo sapiens
cgcccgccgctcctggcgcat

SEQ ID NO: 23086 - DNA, 20 bp, Homo sapiens
ccccgcgcgcgccgcctcct

SEQ ID NO: 23087 - DNA, 24 bp, Homo sapiens
gaggcagctgaatgaggagctctg

SEQ ID NO: 23088 - DNA, 22 bp, Homo sapiens
cgcccacgacaggtgtcaggct

SEQ ID NO: 23089 - DNA, 22 bp, Homo sapiens
ggtccacctaagtctccgggag

SEQ ID NO: 23090 - DNA, 22 bp, Homo sapiens
aagggaaaatagttgatgacca

SEQ ID NO: 23091 - DNA, 22 bp, Homo sapiens
ccgctctcagcctctcatctgt

SEQ ID NO: 23092 - DNA, 20 bp, Homo sapiens
ccccgccccccgcgcggccg

SEQ ID NO: 23093 - DNA, 22 bp, Homo sapiens
taggttgggagtgagaggtggt

SEQ ID NO: 23094 - DNA, 23 bp, Homo sapiens
cggcggcggcgaggctgggcgcg

SEQ ID NO: 23095 - DNA, 21 bp, Homo sapiens
cgccgcgtgagaaccggtgcg

SEQ ID NO: 23096 - DNA, 24 bp, Homo sapiens
gagcccaacagatctgggggcgtc

SEQ ID NO: 23097 - DNA, 21 bp, Homo sapiens
ctacgagcagccgctcccggc

SEQ ID NO: 23098 - DNA, 22 bp, Homo sapiens
gctacggtaatctttatactta

SEQ ID NO: 23099 - DNA, 22 bp, Homo sapiens
taagaccatcctttcctcaata

SEQ ID NO: 23100 - DNA, 22 bp, Homo sapiens
aggtccggggtggaatcgacgt

SEQ ID NO: 23101 - DNA, 22 bp, Homo sapiens
agggatgaatgtaaagaactgg

SEQ ID NO: 23102 - DNA, 22 bp, Homo sapiens
ggccgccttagcgcccggtgct

SEQ ID NO: 23103 - DNA, 21 bp, Homo sapiens
catgccttggctcccactcaa

SEQ ID NO: 23104 - DNA, 21 bp, Homo sapiens
aggcctggacagccagtggcg

SEQ ID NO: 23105 - DNA, 24 bp, Homo sapiens
gaagacagagcggctgagcccaga

SEQ ID NO: 23106 - DNA, 23 bp, Homo sapiens
ctgaccctccatgtccccccagg

SEQ ID NO: 23107 - DNA, 20 bp, Homo sapiens
ggccggacccacccgcgggg

SEQ ID NO: 23108 - DNA, 21 bp, Homo sapiens
cggcgggggcggcgcgcgctc

SEQ ID NO: 23109 - DNA, 21 bp, Homo sapiens
catcggggttcgccgcaggct

SEQ ID NO: 23110 - DNA, 22 bp, Homo sapiens
caagagagggaatgactgggct

SEQ ID NO: 23111 - DNA, 22 bp, Homo sapiens
ggctaattatttgtatttttgt

SEQ ID NO: 23112 - DNA, 23 bp, Homo sapiens
ctacttcctggtaaacccattgt

SEQ ID NO: 23113 - DNA, 20 bp, Homo sapiens
cccgggggagccggcgctct

SEQ ID NO: 23114 - DNA, 20 bp, Homo sapiens
atcacattattgaaacagaa

SEQ ID NO: 23115 - DNA, 22 bp, Homo sapiens
gattagttttaatgaattattt

SEQ ID NO: 23116 - DNA, 23 bp, Homo sapiens
cctaccttttctcctaactacat

SEQ ID NO: 23117 - DNA, 22 bp, Homo sapiens
agagttgggagagaagagaaga

SEQ ID NO: 23118 - DNA, 23 bp, Homo sapiens
tcctccgccacctccgcccctgc

SEQ ID NO: 23119 - DNA, 21 bp, Homo sapiens
gctactccgggtcccgattcc

SEQ ID NO: 23120 - DNA, 22 bp, Homo sapiens
tgaagctgatttggggaacctt

SEQ ID NO: 23121 - DNA, 22 bp, Homo sapiens
agggccggcgggggcccctcgg

SEQ ID NO: 23122 - DNA, 23 bp, Homo sapiens
aacattcatggctgggcccagtg

SEQ ID NO: 23123 - DNA, 22 bp, Homo sapiens
cagcccagtggtgtgtgatcga

SEQ ID NO: 23124 - DNA, 23 bp, Homo sapiens
tgtcacaggactgggatggttgg

SEQ ID NO: 23125 - DNA, 21 bp, Homo sapiens
gagcctgggaaggtggccgag

SEQ ID NO: 23126 - DNA, 22 bp, Homo sapiens
ctcggcccacccacgcgcccgc

SEQ ID NO: 23127 - DNA, 23 bp, Homo sapiens
gaggaggccatagtggcaactgt

SEQ ID NO: 23128 - DNA, 22 bp, Homo sapiens
aggtcctcaataagtatttgtt

SEQ ID NO: 23129 - DNA, 22 bp, Homo sapiens
gaacatcctgcatagtgctgcc

SEQ ID NO: 23130 - DNA, 24 bp, Homo sapiens
tccgcctttggaacatacctgaca

SEQ ID NO: 23131 - DNA, 21 bp, Homo sapiens
ggcggcggagccgggaagtgg

SEQ ID NO: 23132 - DNA, 22 bp, Homo sapiens
cccgggtcggggctcgatggct

SEQ ID NO: 23133 - DNA, 22 bp, Homo sapiens
ccggagagccccaggcccgagc

SEQ ID NO: 23134 - DNA, 20 bp, Homo sapiens
acgctccccggaccccgtcc

SEQ ID NO: 23135 - DNA, 22 bp, Homo sapiens
tctactgtggctgtggttgcac

SEQ ID NO: 23136 - DNA, 22 bp, Homo sapiens
cggcgggtgcgggggtcggcgg

SEQ ID NO: 23137 - DNA, 22 bp, Homo sapiens
actcctcatttgtaaactcagg

SEQ ID NO: 23138 - DNA, 23 bp, Homo sapiens
ccgatggcctgcctctgcctaca

SEQ ID NO: 23139 - DNA, 22 bp, Homo sapiens
gccgcccccgccacccttctct

SEQ ID NO: 23140 - DNA, 22 bp, Homo sapiens
attgggaacattttgcatgtat

SEQ ID NO: 23141 - DNA, 20 bp, Homo sapiens
atgcacagatctcagacatc

SEQ ID NO: 23142 - DNA, 21 bp, Homo sapiens
tctcatggactccgcccacaa

SEQ ID NO: 23143 - DNA, 23 bp, Homo sapiens
tcagaacagtggctggcatgcac

SEQ ID NO: 23144 - DNA, 23 bp, Homo sapiens
ctgaggcggtgagtccccgagcg

SEQ ID NO: 23145 - DNA, 21 bp, Homo sapiens
cgtcggagcgcgcgccgccgc

SEQ ID NO: 23146 - DNA, 22 bp, Homo sapiens
gagtctccagtaatggacggga

SEQ ID NO: 23147 - DNA, 21 bp, Homo sapiens
taggcattcagaaggaggcac

SEQ ID NO: 23148 - DNA, 22 bp, Homo sapiens
tccgcgcctccaaacaaagggc

SEQ ID NO: 23149 - DNA, 22 bp, Homo sapiens
cgcgcgggggtcggggggcggg

SEQ ID NO: 23150 - DNA, 20 bp, Homo sapiens
gggcggctccgtggcgcttc

SEQ ID NO: 23151 - DNA, 21 bp, Homo sapiens
cgggcctgggtgagtgtgcgg

SEQ ID NO: 23152 - DNA, 22 bp, Homo sapiens
ggatgtactgaactgggtcaga

SEQ ID NO: 23153 - DNA, 23 bp, Homo sapiens
tcctccgcccaccctgcttcagg

SEQ ID NO: 23154 - DNA, 21 bp, Homo sapiens
agcatggagcaggcccggaga

SEQ ID NO: 23155 - DNA, 22 bp, Homo sapiens
ctctgtgccttccccatggtgg

SEQ ID NO: 23156 - DNA, 23 bp, Homo sapiens
ctcaggaaccctgcccgcccccc

SEQ ID NO: 23157 - DNA, 22 bp, Homo sapiens
cctgaccctgccgtgcctcagg

SEQ ID NO: 23158 - DNA, 21 bp, Homo sapiens
accagcccctccaccgagtcc

SEQ ID NO: 23159 - DNA, 23 bp, Homo sapiens
ttcacgatccgctgggacccgcg

SEQ ID NO: 23160 - DNA, 22 bp, Homo sapiens
ctgacgccccccgccccgcagc

SEQ ID NO: 23161 - DNA, 22 bp, Homo sapiens
gggaagtgagtcagtgtccgcg

SEQ ID NO: 23162 - DNA, 23 bp, Homo sapiens
tcagcctccgctcctctccccgc

SEQ ID NO: 23163 - DNA, 24 bp, Homo sapiens
tcagctggcccctctgcctgcagc

SEQ ID NO: 23164 - DNA, 24 bp, Homo sapiens
aagggaggggtcgcccagccgagc

SEQ ID NO: 23165 - DNA, 20 bp, Homo sapiens
cgcgcgcggctcccgcgcac

SEQ ID NO: 23166 - DNA, 24 bp, Homo sapiens
ccccgcggccccgccaggcctcgc

SEQ ID NO: 23167 - DNA, 20 bp, Homo sapiens
accgcggccgtcggggctcg

SEQ ID NO: 23168 - DNA, 20 bp, Homo sapiens
acctacagtggactacccga

SEQ ID NO: 23169 - DNA, 24 bp, Homo sapiens
tagcttatctctgcagccttgaca

SEQ ID NO: 23170 - DNA, 21 bp, Homo sapiens
ccctcccgcctgcgcccctcg

SEQ ID NO: 23171 - DNA, 21 bp, Homo sapiens
gggacgcagcacggagggcgc

SEQ ID NO: 23172 - DNA, 23 bp, Homo sapiens
cattgatcagaagtccagcctaa

SEQ ID NO: 23173 - DNA, 22 bp, Homo sapiens
tccctccctcactcactcaaca

SEQ ID NO: 23174 - DNA, 22 bp, Homo sapiens
ctcaggactgggtcattctgtt

SEQ ID NO: 23175 - DNA, 22 bp, Homo sapiens
tcttatactttggactggtctc

SEQ ID NO: 23176 - DNA, 21 bp, Homo sapiens
cccatactttcacccctctct

SEQ ID NO: 23177 - DNA, 22 bp, Homo sapiens
cactaaagagacactggagaat

SEQ ID NO: 23178 - DNA, 23 bp, Homo sapiens
tccagtgtttctttagtgcctgg

SEQ ID NO: 23179 - DNA, 22 bp, Homo sapiens
tctccagtgtctctttagtgcc

SEQ ID NO: 23180 - DNA, 21 bp, Homo sapiens
tgacaacaccccaagaatatt

SEQ ID NO: 23181 - DNA, 23 bp, Homo sapiens
cggtcagctgcgcccggcctgaa

SEQ ID NO: 23182 - DNA, 23 bp, Homo sapiens
tgcccccagactgggctcagtgt

SEQ ID NO: 23183 - DNA, 22 bp, Homo sapiens
tggatgggatcggagctctaga

SEQ ID NO: 23184 - DNA, 23 bp, Homo sapiens
tgaggccgagaaggcaaccgcga

SEQ ID NO: 23185 - DNA, 23 bp, Homo sapiens
ggcgccctgcgtccctccccacg

SEQ ID NO: 23186 - DNA, 24 bp, Homo sapiens
tggtaggagctatcagaacttagt

SEQ ID NO: 23187 - DNA, 23 bp, Homo sapiens
cctgttcgtaaatgttagtggat

SEQ ID NO: 23188 - DNA, 22 bp, Homo sapiens
agcccagccctcttctgtctcc

SEQ ID NO: 23189 - DNA, 21 bp, Homo sapiens
ttagctccctcttcccatgtt

SEQ ID NO: 23190 - DNA, 22 bp, Homo sapiens
tctgggcgtggtgagaagttca

SEQ ID NO: 23191 - DNA, 24 bp, Homo sapiens
tgtgcagtactcaccccctccgtc

SEQ ID NO: 23192 - DNA, 22 bp, Homo sapiens
tctgagactagagcaaagccct

SEQ ID NO: 23193 - DNA, 22 bp, Homo sapiens
tcagacgtctcgaggctcgcgt

SEQ ID NO: 23194 - DNA, 23 bp, Homo sapiens
gctggtgttcccaccctttgagc

SEQ ID NO: 23195 - DNA, 23 bp, Homo sapiens
aaagggtgagaataccagccatt

SEQ ID NO: 23196 - DNA, 21 bp, Homo sapiens
ttaatatgtactgacaaagcg

SEQ ID NO: 23197 - DNA, 23 bp, Homo sapiens
tggtaatgaaataaaaaccctgc

SEQ ID NO: 23198 - DNA, 23 bp, Homo sapiens
aaccctttcctatagttgttgct

SEQ ID NO: 23199 - DNA, 23 bp, Homo sapiens
cgtgtccagaatggccagccaga

SEQ ID NO: 23200 - DNA, 21 bp, Homo sapiens
tggctggctgctccgggcact

SEQ ID NO: 23201 - DNA, 23 bp, Homo sapiens
tctctctctctccgtgtcagtgt

SEQ ID NO: 23202 - DNA, 22 bp, Homo sapiens
tgacacagagagagagacagga

SEQ ID NO: 23203 - DNA, 23 bp, Homo sapiens
aggccattccccatcagatgagt

SEQ ID NO: 23204 - DNA, 22 bp, Homo sapiens
gcagagcaaaacggaccatgca

SEQ ID NO: 23205 - DNA, 21 bp, Homo sapiens
catggtccattttgctctgct

SEQ ID NO: 23206 - DNA, 24 bp, Homo sapiens
ccccctggtttgcaggccttttga

SEQ ID NO: 23207 - DNA, 21 bp, Homo sapiens
tctggctgctatggccccctc

SEQ ID NO: 23208 - DNA, 22 bp, Homo sapiens
cccgcctcccgctcatccccgc

SEQ ID NO: 23209 - DNA, 23 bp, Homo sapiens
aaatgaatcatgttgggcctgta

SEQ ID NO: 23210 - DNA, 23 bp, Homo sapiens
ctgcccatcccaccccagcatcc

SEQ ID NO: 23211 - DNA, 23 bp, Homo sapiens
gcaggaagagacgcagcagcttg

SEQ ID NO: 23212 - DNA, 22 bp, Homo sapiens
tgctgcgtttcatggagcccct

SEQ ID NO: 23213 - DNA, 23 bp, Homo sapiens
atggggcattggaagtggtggtc

SEQ ID NO: 23214 - DNA, 21 bp, Homo sapiens
atttgctgttaagatatggga

SEQ ID NO: 23215 - DNA, 22 bp, Homo sapiens
agggatgctctgaggtcctgct

SEQ ID NO: 23216 - DNA, 23 bp, Homo sapiens
acaggacctctgtgctttcacct

SEQ ID NO: 23217 - DNA, 22 bp, Homo sapiens
caaaaataggaagtccaaggac

SEQ ID NO: 23218 - DNA, 21 bp, Homo sapiens
cctggacttcttattttggct

SEQ ID NO: 23219 - DNA, 23 bp, Homo sapiens
tgctgatcctctcccaccccaga

SEQ ID NO: 23220 - DNA, 22 bp, Homo sapiens
tggcccaagaccccagaccaca

SEQ ID NO: 23221 - DNA, 22 bp, Homo sapiens
tatccgctggcttactctctct

SEQ ID NO: 23222 - DNA, 22 bp, Homo sapiens
tgtattctacttcatttatcca

SEQ ID NO: 23223 - DNA, 22 bp, Homo sapiens
attcgctgggaattcagcctct

SEQ ID NO: 23224 - DNA, 24 bp, Homo sapiens
agcagtctcagcccagcttccttc

SEQ ID NO: 23225 - DNA, 22 bp, Homo sapiens
tcagcgttggttcccgtcttgg

SEQ ID NO: 23226 - DNA, 22 bp, Homo sapiens
ccagagaaggctgctcctcacc

SEQ ID NO: 23227 - DNA, 22 bp, Homo sapiens
ccaggaatcctgctgtggtgga

SEQ ID NO: 23228 - DNA, 23 bp, Homo sapiens
agccttttcctgcagcaccccac

SEQ ID NO: 23229 - DNA, 23 bp, Homo sapiens
gaggaccctgcaggaatggacgt

SEQ ID NO: 23230 - DNA, 22 bp, Homo sapiens
cattccagggctctcctctacc

SEQ ID NO: 23231 - DNA, 22 bp, Homo sapiens
tctgggaggaaggcagacagag

SEQ ID NO: 23232 - DNA, 22 bp, Homo sapiens
tcaggatttaaaggggcactca

SEQ ID NO: 23233 - DNA, 22 bp, Homo sapiens
gaatagttttagtaactcttga

SEQ ID NO: 23234 - DNA, 21 bp, Homo sapiens
tcccttttctggtagttctca

SEQ ID NO: 23235 - DNA, 23 bp, Homo sapiens
aggaattacctgggaatgggaag

SEQ ID NO: 23236 - DNA, 23 bp, Homo sapiens
attcttgtttccaggtctggtga

SEQ ID NO: 23237 - DNA, 21 bp, Homo sapiens
acagacctggattcaaaaact

SEQ ID NO: 23238 - DNA, 22 bp, Homo sapiens
tcccagctggtcattaatcctc

SEQ ID NO: 23239 - DNA, 21 bp, Homo sapiens
gaattaatggctggctgggag

SEQ ID NO: 23240 - DNA, 23 bp, Homo sapiens
tgcacaccttttctcccatacct

SEQ ID NO: 23241 - DNA, 21 bp, Homo sapiens
tctggctcctttctaatcact

SEQ ID NO: 23242 - DNA, 22 bp, Homo sapiens
cctctagggaagagaaggttgg

SEQ ID NO: 23243 - DNA, 24 bp, Homo sapiens
tttcctctctgccccatagggtgt

SEQ ID NO: 23244 - DNA, 22 bp, Homo sapiens
agtgcaaaagtaatcgcagttt

SEQ ID NO: 23245 - DNA, 22 bp, Homo sapiens
taggtcactggggtcagagcca

SEQ ID NO: 23246 - DNA, 22 bp, Homo sapiens
ttgcgtgaacctgagaatgagc

SEQ ID NO: 23247 - DNA, 21 bp, Homo sapiens
atgccatattggaagcaaggc

SEQ ID NO: 23248 - DNA, 22 bp, Homo sapiens
ctctgcttccagtgtgacatcg

SEQ ID NO: 23249 - DNA, 22 bp, Homo sapiens
ccccctttccctgagcctgcat

SEQ ID NO: 23250 - DNA, 23 bp, Homo sapiens
ccaggctcagggaaactgagaca

SEQ ID NO: 23251 - DNA, 23 bp, Homo sapiens
tacacacacacacactttccaat

SEQ ID NO: 23252 - DNA, 23 bp, Homo sapiens
aaccactaaactgcttcctgtct

SEQ ID NO: 23253 - DNA, 22 bp, Homo sapiens
gagtagccactagccacatgtc

SEQ ID NO: 23254 - DNA, 22 bp, Homo sapiens
tccccccaaaattcataatgtt

SEQ ID NO: 23255 - DNA, 22 bp, Homo sapiens
tcgttgtaagttgaaaatatag

SEQ ID NO: 23256 - DNA, 22 bp, Homo sapiens
tcccctactctttccacagtga

SEQ ID NO: 23257 - DNA, 22 bp, Homo sapiens
gcttgttagacatgcagcatct

SEQ ID NO: 23258 - DNA, 22 bp, Homo sapiens
ctggggtggagccctggagtct

SEQ ID NO: 23259 - DNA, 24 bp, Homo sapiens
tgtccagggccttacctcttcaga

SEQ ID NO: 23260 - DNA, 22 bp, Homo sapiens
ttttgtgtgtcagggtgcaggt

SEQ ID NO: 23261 - DNA, 23 bp, Homo sapiens
tcactctgtctttcctgcctcat

SEQ ID NO: 23262 - DNA, 22 bp, Homo sapiens
tccgtcccttcgccagcgcaga

SEQ ID NO: 23263 - DNA, 22 bp, Homo sapiens
agctcagtgttcctttttcagt

SEQ ID NO: 23264 - DNA, 22 bp, Homo sapiens
gaacactgagctgagtgcatgc

SEQ ID NO: 23265 - DNA, 22 bp, Homo sapiens
cgctgccatggctgggggccgt

SEQ ID NO: 23266 - DNA, 22 bp, Homo sapiens
caagcccaggggagggaccagc

SEQ ID NO: 23267 - DNA, 21 bp, Homo sapiens
tcagccaagtggtccccacca

SEQ ID NO: 23268 - DNA, 20 bp, Homo sapiens
gtgtggggagcacgtgaggc

SEQ ID NO: 23269 - DNA, 22 bp, Homo sapiens
taacatattttgaaaggcctga

SEQ ID NO: 23270 - DNA, 23 bp, Homo sapiens
aaagtgaccttggggcccccaga

SEQ ID NO: 23271 - DNA, 23 bp, Homo sapiens
aacctagaactccaagcctgttt

SEQ ID NO: 23272 - DNA, 22 bp, Homo sapiens
aagcccagatttgtgactatgc

SEQ ID NO: 23273 - DNA, 24 bp, Homo sapiens
ccagcctgctggagcttacagtgg

SEQ ID NO: 23274 - DNA, 21 bp, Homo sapiens
ctctttaaggatagggctgaa

SEQ ID NO: 23275 - DNA, 22 bp, Homo sapiens
cagccgtatcagtgaagagtga

SEQ ID NO: 23276 - DNA, 23 bp, Homo sapiens
cttccatctccatcaccttgagc

SEQ ID NO: 23277 - DNA, 22 bp, Homo sapiens
tgtgcactgtacacatacatgt

SEQ ID NO: 23278 - DNA, 23 bp, Homo sapiens
gagctggtccaatgcctgggaga

SEQ ID NO: 23279 - DNA, 24 bp, Homo sapiens
tcccaggcactagcatgaccagct

SEQ ID NO: 23280 - DNA, 23 bp, Homo sapiens
tcaggcagctgttccctccttgt

SEQ ID NO: 23281 - DNA, 23 bp, Homo sapiens
gaggccattcggctctgaggtcc

SEQ ID NO: 23282 - DNA, 23 bp, Homo sapiens
accctcagtccgtattggtctct

SEQ ID NO: 23283 - DNA, 20 bp, Homo sapiens
tctgagccataccccctcct

SEQ ID NO: 23284 - DNA, 22 bp, Homo sapiens
tagtccaggcagactctcctga

SEQ ID NO: 23285 - DNA, 22 bp, Homo sapiens
aaacaggctctcgctctgtagc

SEQ ID NO: 23286 - DNA, 22 bp, Homo sapiens
cagggttttgcagaccgggtct

SEQ ID NO: 23287 - DNA, 23 bp, Homo sapiens
gggatgggaagagacccgggaca

SEQ ID NO: 23288 - DNA, 21 bp, Homo sapiens
cagcagctaccccggcgtcgg

SEQ ID NO: 23289 - DNA, 21 bp, Homo sapiens
tttggggattctaagaggaag

SEQ ID NO: 23290 - DNA, 21 bp, Homo sapiens
actcttagaatccccaaagca

SEQ ID NO: 23291 - DNA, 22 bp, Homo sapiens
agcctctgtgttttgccctagt

SEQ ID NO: 23292 - DNA, 20 bp, Homo sapiens
cccctgggctgttactgttc

SEQ ID NO: 23293 - DNA, 21 bp, Homo sapiens
agacagtaacagcccgggaca

SEQ ID NO: 23294 - DNA, 23 bp, Homo sapiens
ctccaggctcatggtccctcact

SEQ ID NO: 23295 - DNA, 23 bp, Homo sapiens
tgcagcatggtcggggcacttct

SEQ ID NO: 23296 - DNA, 20 bp, Homo sapiens
ggggggccggcggcggcggc

SEQ ID NO: 23297 - DNA, 22 bp, Homo sapiens
aactgcaatgactttcgcacca

SEQ ID NO: 23298 - DNA, 22 bp, Homo sapiens
atctggagtggagctcaggaac

SEQ ID NO: 23299 - DNA, 22 bp, Homo sapiens
tcagtgcacgttagctgtcatt

SEQ ID NO: 23300 - DNA, 21 bp, Homo sapiens
agcacctgccgagcactgaga

SEQ ID NO: 23301 - DNA, 21 bp, Homo sapiens
ctgggcacctacttcctgcct

SEQ ID NO: 23302 - DNA, 22 bp, Homo sapiens
gcggcctgagccctgaagcgcg

SEQ ID NO: 23303 - DNA, 23 bp, Homo sapiens
cagggaggtgaatggttctgtct

SEQ ID NO: 23304 - DNA, 22 bp, Homo sapiens
cgcggtcgcgctgagtcacagc

SEQ ID NO: 23305 - DNA, 22 bp, Homo sapiens
tctgacctctctgacctgcagc

SEQ ID NO: 23306 - DNA, 20 bp, Homo sapiens
ggaccccatgggaactctac

SEQ ID NO: 23307 - DNA, 24 bp, Homo sapiens
acacagctctgatgatctctatgt

SEQ ID NO: 23308 - DNA, 22 bp, Homo sapiens
aaaagccgcaattactttagca

SEQ ID NO: 23309 - DNA, 24 bp, Homo sapiens
cagaacgggttcttcccaggccga

SEQ ID NO: 23310 - DNA, 23 bp, Homo sapiens
tcagaaccgaccgcctcccagct

SEQ ID NO: 23311 - DNA, 21 bp, Homo sapiens
cagccacactacatccaaact

SEQ ID NO: 23312 - DNA, 22 bp, Homo sapiens
catctcccgcctccttttcccg

SEQ ID NO: 23313 - DNA, 23 bp, Homo sapiens
gccctgcacctgacacagcctcc

SEQ ID NO: 23314 - DNA, 22 bp, Homo sapiens
tggctgtgccatcccagggacc

SEQ ID NO: 23315 - DNA, 21 bp, Homo sapiens
cttccccaccctctcctgcag

SEQ ID NO: 23316 - DNA, 22 bp, Homo sapiens
gacagacgcaggtacacacaga

SEQ ID NO: 23317 - DNA, 24 bp, Homo sapiens
gtgtgtgcacctgtgtctgtctgt

SEQ ID NO: 23318 - DNA, 22 bp, Homo sapiens
tctcattggtcaggcctgagtc

SEQ ID NO: 23319 - DNA, 22 bp, Homo sapiens
tcatgtctgaaccaatgagagc

SEQ ID NO: 23320 - DNA, 23 bp, Homo sapiens
gcacacatacaaacaaacacaca

SEQ ID NO: 23321 - DNA, 23 bp, Homo sapiens
gcaggcctcacttggcaccagtg

SEQ ID NO: 23322 - DNA, 22 bp, Homo sapiens
aaacctccacttcctcctcatc

SEQ ID NO: 23323 - DNA, 22 bp, Homo sapiens
tgaggaggatctgaaggattgg

SEQ ID NO: 23324 - DNA, 22 bp, Homo sapiens
ttagtggctccctctgcctgca

SEQ ID NO: 23325 - DNA, 20 bp, Homo sapiens
tcccgggcggggactcgcgg

SEQ ID NO: 23326 - DNA, 23 bp, Homo sapiens
gtccccagactctcccgggctgt

SEQ ID NO: 23327 - DNA, 23 bp, Homo sapiens
cctctccggcccccaccgcggat

SEQ ID NO: 23328 - DNA, 21 bp, Homo sapiens
tttctctggccttggaatcct

SEQ ID NO: 23329 - DNA, 22 bp, Homo sapiens
acaacttacaacatggcctttt

SEQ ID NO: 23330 - DNA, 22 bp, Homo sapiens
taggccattttggaagctgttt

SEQ ID NO: 23331 - DNA, 22 bp, Homo sapiens
ggaggtcggctgcggctccgct

SEQ ID NO: 23332 - DNA, 21 bp, Homo sapiens
acagagacctctaaacccaaa

SEQ ID NO: 23333 - DNA, 22 bp, Homo sapiens
ttcgggtttagaggtttctgtt

SEQ ID NO: 23334 - DNA, 22 bp, Homo sapiens
ctggaattctgtatctgagcag

SEQ ID NO: 23335 - DNA, 22 bp, Homo sapiens
taaggctgatttacaggagaga

SEQ ID NO: 23336 - DNA, 20 bp, Homo sapiens
aggtgacaatgtcaggtgct

SEQ ID NO: 23337 - DNA, 23 bp, Homo sapiens
caactcaggggccaggcaccatt

SEQ ID NO: 23338 - DNA, 21 bp, Homo sapiens
ttgtgtccagttgttggggga

SEQ ID NO: 23339 - DNA, 22 bp, Homo sapiens
attcagctacgatcaccagggc

SEQ ID NO: 23340 - DNA, 22 bp, Homo sapiens
acgaactcataagataatacct

SEQ ID NO: 23341 - DNA, 22 bp, Homo sapiens
ctagagaaccatctgaaagact

SEQ ID NO: 23342 - DNA, 22 bp, Homo sapiens
tcctttcagatggttctctaga

SEQ ID NO: 23343 - DNA, 23 bp, Homo sapiens
tacaacagatgagacatacctaa

SEQ ID NO: 23344 - DNA, 22 bp, Homo sapiens
atacccccccaatgcagagaca

SEQ ID NO: 23345 - DNA, 21 bp, Homo sapiens
agaagtaattgcggtctttgc

SEQ ID NO: 23346 - DNA, 23 bp, Homo sapiens
tggcccaagaatagctggccagt

SEQ ID NO: 23347 - DNA, 22 bp, Homo sapiens
tttgattggccagtggacagcg

SEQ ID NO: 23348 - DNA, 23 bp, Homo sapiens
ttgggcatatgtgtatatatgtg

SEQ ID NO: 23349 - DNA, 20 bp, Homo sapiens
atggacacataagaggtact

SEQ ID NO: 23350 - DNA, 22 bp, Homo sapiens
tcaggatcaggatctgcagagt

SEQ ID NO: 23351 - DNA, 22 bp, Homo sapiens
gcctcagaaatataaaactagc

SEQ ID NO: 23352 - DNA, 23 bp, Homo sapiens
ccctcctctcctgtggccacaga

SEQ ID NO: 23353 - DNA, 21 bp, Homo sapiens
tggtccaacgacaggagtagg

SEQ ID NO: 23354 - DNA, 22 bp, Homo sapiens
atctccccagttatgacaacca

SEQ ID NO: 23355 - DNA, 22 bp, Homo sapiens
tgtgggcgacaaggtttgctgc

SEQ ID NO: 23356 - DNA, 23 bp, Homo sapiens
cagctttgcaggtggtgactaga

SEQ ID NO: 23357 - DNA, 22 bp, Homo sapiens
ggctccaccttcctaggttggc

SEQ ID NO: 23358 - DNA, 21 bp, Homo sapiens
gctgtgttaattctcttctgt

SEQ ID NO: 23359 - DNA, 22 bp, Homo sapiens
tccccacctggaatttctatga

SEQ ID NO: 23360 - DNA, 22 bp, Homo sapiens
caatgcccaggtctgccctaga

SEQ ID NO: 23361 - DNA, 22 bp, Homo sapiens
cagactgtctgtgctgtggact

SEQ ID NO: 23362 - DNA, 24 bp, Homo sapiens
ccgcgtgttcctggggagccgaag

SEQ ID NO: 23363 - DNA, 22 bp, Homo sapiens
cctctccccgcttttaacccta

SEQ ID NO: 23364 - DNA, 24 bp, Homo sapiens
tagggttaaaagcggggagagggt

SEQ ID NO: 23365 - DNA, 23 bp, Homo sapiens
caacaggccttgctctgctcaca

SEQ ID NO: 23366 - DNA, 22 bp, Homo sapiens
cacaggcaggagaccccacagc

SEQ ID NO: 23367 - DNA, 22 bp, Homo sapiens
caaattgacatttgggaactga

SEQ ID NO: 23368 - DNA, 21 bp, Homo sapiens
tcagggatgctacttaacttc

SEQ ID NO: 23369 - DNA, 22 bp, Homo sapiens
caaaaatcacaattattttcgc

SEQ ID NO: 23370 - DNA, 23 bp, Homo sapiens
tgaaagtaattgcggttttgcca

SEQ ID NO: 23371 - DNA, 24 bp, Homo sapiens
aaacaaatgtatctatgtgtatgt

SEQ ID NO: 23372 - DNA, 22 bp, Homo sapiens
agatcaaaagcctcagggcaga

SEQ ID NO: 23373 - DNA, 23 bp, Homo sapiens
tgcatcaggccactccttcctcc

SEQ ID NO: 23374 - DNA, 21 bp, Homo sapiens
ctgacacttctcagaattctt

SEQ ID NO: 23375 - DNA, 20 bp, Homo sapiens
aaccgccattacttttgcaa

SEQ ID NO: 23376 - DNA, 21 bp, Homo sapiens
cgagttataattccaaagtca

SEQ ID NO: 23377 - DNA, 24 bp, Homo sapiens
gaagagtaattgtggttttgccgt

SEQ ID NO: 23378 - DNA, 22 bp, Homo sapiens
agcactgcttttccccatgtgg

SEQ ID NO: 23379 - DNA, 23 bp, Homo sapiens
gatgcccctgccgccctgacgcc

SEQ ID NO: 23380 - DNA, 21 bp, Homo sapiens
gctggagggagctggtccctg

SEQ ID NO: 23381 - DNA, 22 bp, Homo sapiens
aaaggggacagctcacaggatt

SEQ ID NO: 23382 - DNA, 22 bp, Homo sapiens
aacaacagtatacaccaaatag

SEQ ID NO: 23383 - DNA, 22 bp, Homo sapiens
gagctagggatatctcctgaga

SEQ ID NO: 23384 - DNA, 22 bp, Homo sapiens
agattgagttctccccatctcc

SEQ ID NO: 23385 - DNA, 21 bp, Homo sapiens
agatggggagaactcaatcct

SEQ ID NO: 23386 - DNA, 23 bp, Homo sapiens
tgtgcaggcatgcagtttatgtt

SEQ ID NO: 23387 - DNA, 22 bp, Homo sapiens
ccctggtgacctgtgacaaagg

SEQ ID NO: 23388 - DNA, 22 bp, Homo sapiens
aagtgactgtggtttttgccat

SEQ ID NO: 23389 - DNA, 22 bp, Homo sapiens
attcctgtaactgggccagttt

SEQ ID NO: 23390 - DNA, 21 bp, Homo sapiens
ctacgtgaccagaagtttcag

SEQ ID NO: 23391 - DNA, 22 bp, Homo sapiens
cctagcagtctcaggacacaca

SEQ ID NO: 23392 - DNA, 21 bp, Homo sapiens
tgtgccctgagactgctaagt

SEQ ID NO: 23393 - DNA, 21 bp, Homo sapiens
ttccccgcttcccccctaggg

SEQ ID NO: 23394 - DNA, 21 bp, Homo sapiens
tgaatgatgtaaatgaggcag

SEQ ID NO: 23395 - DNA, 21 bp, Homo sapiens
ctggcacaaaagtagttgcgg

SEQ ID NO: 23396 - DNA, 22 bp, Homo sapiens
tctgccattgacccattattga

SEQ ID NO: 23397 - DNA, 22 bp, Homo sapiens
gttgtcagtcaggggtccctgg

SEQ ID NO: 23398 - DNA, 23 bp, Homo sapiens
tctaaatgggagttgagcaatga

SEQ ID NO: 23399 - DNA, 23 bp, Homo sapiens
caaaggtacttgcagtttttgct

SEQ ID NO: 23400 - DNA, 21 bp, Homo sapiens
gggagcgggcgggcgggagcg

SEQ ID NO: 23401 - DNA, 22 bp, Homo sapiens
ccccctggccccgtcgccccgc

SEQ ID NO: 23402 - DNA, 21 bp, Homo sapiens
tgaacttgacttacagggtga

SEQ ID NO: 23403 - DNA, 22 bp, Homo sapiens
tagcaagggctccggaaggtca

SEQ ID NO: 23404 - DNA, 23 bp, Homo sapiens
cagaacgacgggcagaggcgcga

SEQ ID NO: 23405 - DNA, 24 bp, Homo sapiens
ttccccaaaccttgtctggacatg

SEQ ID NO: 23406 - DNA, 21 bp, Homo sapiens
caaaagggctcagagcacagc

SEQ ID NO: 23407 - DNA, 22 bp, Homo sapiens
gagggtctgactgtcacttgga

SEQ ID NO: 23408 - DNA, 22 bp, Homo sapiens
gctggggaggtgaactggtgaa

SEQ ID NO: 23409 - DNA, 21 bp, Homo sapiens
accagctctcatccccagcgc

SEQ ID NO: 23410 - DNA, 22 bp, Homo sapiens
tccacctgtttctccacccaca

SEQ ID NO: 23411 - DNA, 21 bp, Homo sapiens
tgagggaacagaggactgaag

SEQ ID NO: 23412 - DNA, 22 bp, Homo sapiens
gcaaaaaccttaattacctttg

SEQ ID NO: 23413 - DNA, 22 bp, Homo sapiens
ttttttgctggaacatttctgg

SEQ ID NO: 23414 - DNA, 22 bp, Homo sapiens
gcccggagagctgggagccaga

SEQ ID NO: 23415 - DNA, 22 bp, Homo sapiens
tggctcccttctctccgtctgc

SEQ ID NO: 23416 - DNA, 21 bp, Homo sapiens
taaaaaccgtgactacttctg

SEQ ID NO: 23417 - DNA, 22 bp, Homo sapiens
ccacatacttcacttgctcagt

SEQ ID NO: 23418 - DNA, 22 bp, Homo sapiens
attgagcaagtgaagtatgtgg

SEQ ID NO: 23419 - DNA, 23 bp, Homo sapiens
ctataggattataatgaagctga

SEQ ID NO: 23420 - DNA, 21 bp, Homo sapiens
ctgagcgggctcgggcgccgc

SEQ ID NO: 23421 - DNA, 22 bp, Homo sapiens
gctggaggaggtttgtcccaca

SEQ ID NO: 23422 - DNA, 23 bp, Homo sapiens
tgggacaaacctcccccagcatg

SEQ ID NO: 23423 - DNA, 22 bp, Homo sapiens
gcaggttccacaacccagccgt

SEQ ID NO: 23424 - DNA, 22 bp, Homo sapiens
tgagccaccactcccagtccta

SEQ ID NO: 23425 - DNA, 22 bp, Homo sapiens
atcgcctcgtttcggccactgc

SEQ ID NO: 23426 - DNA, 22 bp, Homo sapiens
gaccgtaaggatacaatgattg

SEQ ID NO: 23427 - DNA, 23 bp, Homo sapiens
gacagacagatcttttcccaacc

SEQ ID NO: 23428 - DNA, 22 bp, Homo sapiens
tgcgtgactgaccacaatccga

SEQ ID NO: 23429 - DNA, 23 bp, Homo sapiens
tggattgtgggttggccacatgg

SEQ ID NO: 23430 - DNA, 22 bp, Homo sapiens
ttgctgggaaagggagaagttc

SEQ ID NO: 23431 - DNA, 22 bp, Homo sapiens
accaacttctccctttcccaga

SEQ ID NO: 23432 - DNA, 21 bp, Homo sapiens
atccacccacattaccaagga

SEQ ID NO: 23433 - DNA, 21 bp, Homo sapiens
aaagagaagcgaagatggagc

SEQ ID NO: 23434 - DNA, 21 bp, Homo sapiens
gccatctcctctgttctttgc

SEQ ID NO: 23435 - DNA, 22 bp, Homo sapiens
tggctaacccaaaacagagact

SEQ ID NO: 23436 - DNA, 21 bp, Homo sapiens
atatctgctgaattctgctga

SEQ ID NO: 23437 - DNA, 20 bp, Homo sapiens
tgctgaattctgttgatatt

SEQ ID NO: 23438 - DNA, 21 bp, Homo sapiens
cgtaacattccacaggctgct

SEQ ID NO: 23439 - DNA, 23 bp, Homo sapiens
gaggaggccgcgccgcagccact

SEQ ID NO: 23440 - DNA, 22 bp, Homo sapiens
ttatcctccagtagactaggga

SEQ ID NO: 23441 - DNA, 21 bp, Homo sapiens
ccagcctactggaggataaga

SEQ ID NO: 23442 - DNA, 22 bp, Homo sapiens
ttccgtgtgggccggcagtggc

SEQ ID NO: 23443 - DNA, 22 bp, Homo sapiens
tggagcacaccagtgaaaggtt

SEQ ID NO: 23444 - DNA, 22 bp, Homo sapiens
cataaaccacaattacttttgc

SEQ ID NO: 23445 - DNA, 21 bp, Homo sapiens
gatgctctctacataaaccta

SEQ ID NO: 23446 - DNA, 20 bp, Homo sapiens
atggaggtggaagtcagaga

SEQ ID NO: 23447 - DNA, 22 bp, Homo sapiens
tggccaaaacagcagttacttt

SEQ ID NO: 23448 - DNA, 23 bp, Homo sapiens
caagaaccacagagcaacacaga

SEQ ID NO: 23449 - DNA, 20 bp, Homo sapiens
tgcccccacccacactggag

SEQ ID NO: 23450 - DNA, 22 bp, Homo sapiens
ccaggtgtcttccattctgtcc

SEQ ID NO: 23451 - DNA, 23 bp, Homo sapiens
acaggatgccagcacccaagggc

SEQ ID NO: 23452 - DNA, 22 bp, Homo sapiens
tggagaaaggacttcagggagt

SEQ ID NO: 23453 - DNA, 22 bp, Homo sapiens
catcttcccaagcctcctccat

SEQ ID NO: 23454 - DNA, 21 bp, Homo sapiens
cagcagggtggtgctgtctgt

SEQ ID NO: 23455 - DNA, 21 bp, Homo sapiens
tctgtcagcctcattggtagc

SEQ ID NO: 23456 - DNA, 20 bp, Homo sapiens
acagtaggcacagaatccca

SEQ ID NO: 23457 - DNA, 22 bp, Homo sapiens
agattgctctttgactaattag

SEQ ID NO: 23458 - DNA, 23 bp, Homo sapiens
tagctgtgcaccctctggcaagt

SEQ ID NO: 23459 - DNA, 22 bp, Homo sapiens
tgaggctcgccaggggagttga

SEQ ID NO: 23460 - DNA, 24 bp, Homo sapiens
cgggcggcggctgtgttgcgcagt

SEQ ID NO: 23461 - DNA, 22 bp, Homo sapiens
ctcaattacttttgtgcctatc

SEQ ID NO: 23462 - DNA, 54 bp, Homo sapiens
gcgaacaaagccccgggacgcagcgcccggcgcggccgtggggcgggaaagggg

SEQ ID NO: 23463 - DNA, 66 bp, Homo sapiens
ccgtcgggcctgggggaggtggggggcaggccgagcatctgccaccgctgacctgaggctccccct

SEQ ID NO: 23464 - DNA, 81 bp, Homo sapiens
gggccagactgccgagggtcccgcctgcgccgggggctaccttccccctgggacggtgctgggaagaaggggagggcccag

SEQ ID NO: 23465 - DNA, 61 bp, Homo sapiens
catcgttaccagacagtgttagagtcaagctgggaaatccagcactgtccggtaagatgct

SEQ ID NO: 23466 - DNA, 61 bp, Homo sapiens; identical to SEQ ID NO: 23465

SEQ ID NO: 23467 - DNA, 83 bp, Homo sapiens
cgccggccgatgggcgtcttaccagacatggttagacctggccctctgtctaatactgtctggtaaaaccgtccatccgctgc

SEQ ID NO: 23468 - DNA, 57 bp, Homo sapiens
tggggaggagggggcctcagcccagctgctggggggctggcctgtctcctgcccagg

SEQ ID NO: 23469 - DNA, 71 bp, Homo sapiens
cgggggtgggggttgggccggagctgggggccttgcctcccccagactcatccctacctctgctctccagg

SEQ ID NO: 23470 - DNA, 65 bp, Homo sapiens
cagggcgggggggaggggaacgccggaggcccctccgcggccctcacctaccctcccccgccaga

SEQ ID NO: 23471 - DNA, 62 bp, Homo sapiens
agtcgggacgcgcgcgggagccgggggcggcggccggggcctgggcggtcgggcgggggcgc

SEQ ID NO: 23472 - DNA, 51 bp, Homo sapiens
ggcgcaggcgggagggcggcggggctgagcgcgccctccgtgctgcgtccc

SEQ ID NO: 23473 - DNA, 73 bp, Homo sapiens
cgcgcgcgggcccgcgctccattatgatccggcgcatgcgacgcgcgccgctggctgtgggcccgtgggcgcc

SEQ ID NO: 23474 - DNA, 77 bp, Homo sapiens
agcgggggccgtggcccgggtcggggcgcaggtcttgctggtacctgacgccgccccgaccccgcgttccccgcaga

SEQ ID NO: 23475 - DNA, 69 bp, Homo sapiens
cacccccggggccgcgcaggtcccagtggagcacgcgctggcggtcgtgcagccggtcctgggtccaca

SEQ ID NO: 23476 - DNA, 76 bp, Homo sapiens
aggctgctacccgccaggtgtctacccgccaccccagctgctgctggcacgggggactgaggggggtcagctctgg

SEQ ID NO: 23477 - DNA, 56 bp, Homo sapiens
cggccgccagaccccgggcgcacgcaattacgggcccggcgctggcggctcctgcg

SEQ ID NO: 23478 - DNA, 77 bp, Homo sapiens
ggggcagcggcgctagcggcgggggtggcagggggactcacaggggccatgtcgtccgtccactcgccatgcccagc

SEQ ID NO: 23479 - DNA, 82 bp, Homo sapiens
gctggacctggccgccgagggtcgcgtgctcaaggcccttcagggctgcgcccagcgcttccggtgagtccgtggacggcgg

SEQ ID NO: 23480 - DNA, 84 bp, Homo sapiens
gggtcgggggcggtggggggcccgcgtcggcccgagatagcggctgggagagcggccggcgcgagccccgggccccggacccca

SEQ ID NO: 23481 - DNA, 51 bp, Homo sapiens
cggcggcggcgcgccgcgcgaggacggcccggcgggccccgcgcccgcgcc

SEQ ID NO: 23482 - DNA, 77 bp, Homo sapiens
gagctcagcgagcgcagcgtccgcgtgtaccacgagtgcttcggcaagtgtaaggggctgctggtgcccgagctcta

SEQ ID NO: 23483 - DNA, 54 bp, Homo sapiens
gagggcagaggtggggggagagagatggccctccccaccctacctctgcatcct

SEQ ID NO: 23484 - DNA, 57 bp, Homo sapiens
gggccccggggtgggtggtggcccaatgccctctccctgccatcttctggggccagg

SEQ ID NO: 23485 - DNA, 56 bp, Homo sapiens
gtggccaggtaggctgtggctgccgctccgacagccccgcctgcctgaggccatga

SEQ ID NO: 23486 - DNA, 88 bp, Homo sapiens
gcggccgggaggcggcggcggcgcaggtggtggaggcgtctttatgggcgccaggcagtggtgcacgctttcccacgcccggcagcca

SEQ ID NO: 23487 - DNA, 62 bp, Homo sapiens
ctggcttccctgctgtgagcctgtctctcctccgtgggacaggccagcctgggcagccatcc

SEQ ID NO: 23488 - DNA, 61 bp, Homo sapiens
cccgcctctccgttgggccgccgacttggaccccgtcggccattggcgcagcaggcggagc

SEQ ID NO: 23489 - DNA, 65 bp, Homo sapiens
cgcgggagcgccgcgtggggccctcaaaagagaggctttctcgccccctgccggcgcgtggtggg

SEQ ID NO: 23490 - DNA, 74 bp, Homo sapiens
ggggccggcgccaccccagaggaaaagcccagcggagccgggttgggcaggagctggcggcggcggtgcgctgg

SEQ ID NO: 23491 - DNA, 82 bp, Homo sapiens
gtgggaaccagtgcagggcactcaggaagtccgaccgcccagcgggccgggccctgcctcacctgtgcatggtttccttcct

SEQ ID NO: 23492 - DNA, 54 bp, Homo sapiens
tccctgtcactgccgcagcagcttggggtgcaaggcggcctggggcggcggaag

SEQ ID NO: 23493 - DNA, 64 bp, Homo sapiens
tccaatcacacttcgttgcctgattctctatgcttacagtgcaagcaaggaagaggattggaag

SEQ ID NO: 23494 - DNA, 56 bp, Homo sapiens
ggcgccgccgcccgctagtccgccgcccggcgccatggcgggctgcgcggcgcggg

SEQ ID NO: 23495 - DNA, 70 bp, Homo sapiens
cccggcccgcgggccgctccgccgccagccacccccgcggccctcggcggcctgcgctcggcccgggggc

SEQ ID NO: 23496 - DNA, 70 bp, Homo sapiens
ccagaatcgtacgcccgcgcgagctctctgcagccttggcggcctgggaggcggggctcggggtggggcc

SEQ ID NO: 23497 - DNA, 69 bp, Homo sapiens
tggggaggagggcgggaatgagggcggtgaggagaagctcacagcccccacccccaccatcctcccagg

SEQ ID NO: 23498 - DNA, 64 bp, Homo sapiens
agctcgttgtggggcagggatgcctgggggatccctggtttcccatctgcttttctggggctgg

SEQ ID NO: 23499 - DNA, 51 bp, Homo sapiens
ggcgggcgcgacttcccggcgcaccgtgcggtgctggccgccgccagcccc

SEQ ID NO: 23500 - DNA, 61 bp, Homo sapiens
cagggtcgcgggaggacgctggagactttggagtctgctccagcactcgcccggcccggcc

SEQ ID NO: 23501 - DNA, 63 bp, Homo sapiens
atgacagcagataagtgccagtgaacagctaaagttcagtggcacttacctgctgtcatcaga

SEQ ID NO: 23502 - DNA, 63 bp, Homo sapiens; identical to SEQ ID NO: 23501

SEQ ID NO: 23503 - DNA, 59 bp, Homo sapiens
gaggagcagggtgaggtcggtaaggggtccctccttgccagggcctggtccctcctccc

SEQ ID NO: 23504 - DNA, 75 bp, Homo sapiens
cgccgtccagcgcggctcgggcgcagttccggcgcagtccccgcgccgagcggctccgcgccccgcaccagcctc

SEQ ID NO: 23505 - DNA, 77 bp, Homo sapiens
aacagtcgcaatttgtaaacacagaaaagaggaatgaaatgaaaggccgtgtctgtgctacaaatcgcgtctgtgat

SEQ ID NO: 23506 - DNA, 79 bp, Homo sapiens
tctgtgttttggacatctccacttgttaagtggagttaagattataacttgttaagtggagatgtccaaagcacagatt

SEQ ID NO: 23507 - DNA, 64 bp, Homo sapiens
tcgccctgtgtttccaggcctgcacgtctggtccttcagctgcacatggaactgcagggcaggc

SEQ ID NO: 23508 - DNA, 64 bp, Homo sapiens; identical to SEQ ID NO: 23507

SEQ ID NO: 23509 - DNA, 72 bp, Homo sapiens
ggggtgggggtgtggggtggggggcatggagccggcgtggaaccagagccctcactcctgcccacacccctc

SEQ ID NO: 23510 - DNA, 59 bp, Homo sapiens
ggagtttcgcgagggccgaagcggggcagtgtgacggcagcggtcctgggaggcgcccg

SEQ ID NO: 23511 - DNA, 87 bp, Homo sapiens
gggagcgggcgggcgggcgcggccgggggcgctgccaggcgccgcggtgattggcagggcggccgcggcgccgcctcctcggcccgg

SEQ ID NO: 23512 - DNA, 63 bp, Homo sapiens
cgcgcgggtcgtggggcaggcgcgcgcggcggccgtcggtcgcgctcgcggggcccgagcggc

SEQ ID NO: 23513 - DNA, 66 bp, Homo sapiens
cctgcggctgctgcgtcccagcttccttcccagcttgggaatgggttgggagaagcagtccggggc

SEQ ID NO: 23514 - DNA, 70 bp, Homo sapiens
gggggaggaggcggccctagcgccattttgtgggagcgaagcggtggctgggctgcgcttgggtccgtcg

SEQ ID NO: 23515 - DNA, 76 bp, Homo sapiens
accgcccgggaaggaggaaggacggggcggggcagcagggcccgaccttccttcggttccgccccaggacagggct

SEQ ID NO: 23516 - DNA, 55 bp, Homo sapiens
ctccctccggagggcgcccggggatgcccgcgagtgtccaggaggctggtgacct

SEQ ID NO: 23517 - DNA, 74 bp, Homo sapiens
tcaggctccgtcccctccctcctcggcatagttcaccctgtcccagtcctcggagttggggacagagccctggg

SEQ ID NO: 23518 - DNA, 81 bp, Homo sapiens
gtggggtgggtacttgcgactttgaatttccagctcccccaactggaagggaaattcaaagcagcaagtacccacccacct

SEQ ID NO: 23519 - DNA, 52 bp, Homo sapiens
aggaagggctcccggccccgtgcgggccgcgccggcgcccggaaccctctgc

SEQ ID NO: 23520 - DNA, 55 bp, Homo sapiens
accccatgctgacttggagaaccccagatctctggggcccagccaggcagggtgt

SEQ ID NO: 23521 - DNA, 51 bp, Homo sapiens
tccccgccggccgcgctccggagcctccgggccgcggtggagcgagggccc

SEQ ID NO: 23522 - DNA, 56 bp, Homo sapiens
gcggcggcccccggcccccggcgcgggaagcggcggcggggcggcggcggcggtgg

SEQ ID NO: 23523 - DNA, 80 bp, Homo sapiens
aggccctctgcacccacgcaccgaggccgaggccagggcccgccccgccggcctgagtggaggactgtggcgggcactag

SEQ ID NO: 23524 - DNA, 72 bp, Homo sapiens
gactacaggcggggaaggaacgctcgcgcgctcggccccggtgcgcaggcgcgcagctgctagtggagtccc

SEQ ID NO: 23525 - DNA, 79 bp, Homo sapiens
gggggctcgggcgccctcagctcggcctcagctccagcctgggtcgtccctgctgccgccgcgcccggctcgcctcgcg

SEQ ID NO: 23526 - DNA, 63 bp, Homo sapiens
gtcttctcccggcctgagcagcagcagctgcggcggcggcggcgtttgagtggaggaagatgg

SEQ ID NO: 23527 - DNA, 62 bp, Homo sapiens
aggggtggggcgtcgggttgggagaggtcttgccgacctccacctcctggcatcactccagc

SEQ ID NO: 23528 - DNA, 67 bp, Homo sapiens
tgttgggtgcagggcagaggggtgggctccccagccagcacctcagctgcctctccaaccctgcagg

SEQ ID NO: 23529 - DNA, 57 bp, Homo sapiens
acttcctcctctgccctccccaaagtggcggccgcagggtgggcggagagggggcga

SEQ ID NO: 23530 - DNA, 85 bp, Homo sapiens
agcctttgcacatgccattccttctgggtggagaaaacacacattaactcccctgggtagaaggagcagcatgtgcaaaggttca

SEQ ID NO: 23531 - DNA, 65 bp, Homo sapiens
caggagctgcttgcaccctaggacctgggtccaaggctggtctaggggggctctcagctcctgag

SEQ ID NO: 23532 - DNA, 77 bp, Homo sapiens
cgcattttccactgtcaggcggcctcgggccatggatcaaaggcgcggcggcgacggcggcggcggcggagcgcggg

SEQ ID NO: 23533 - DNA, 78 bp, Homo sapiens
cactgacgccgggaccgggaccgccgccgccgccgccaccatggtaaaggccgcacggccccctccccggcccggggg

SEQ ID NO: 23534 - DNA, 50 bp, Homo sapiens
ccgggccgggccggggcggggaaggaaggtggcggcggcccggcgcgggg

SEQ ID NO: 23535 - DNA, 74 bp, Homo sapiens
gcaggtggatcgctggagtccatccccatccaaatctcatgttggtctcctggactccaacaatccacctgcct

SEQ ID NO: 23536 - DNA, 78 bp, Homo sapiens
aggcaggtggattgttggagtccaggagaccaacatgagatttggatggggatggactccagcgatccacctgcctcg

SEQ ID NO: 23537 - DNA, 59 bp, Homo sapiens
gaggaaggaagggaagccccacgggaggtcaggcctctcggccttttccggcccctccg

SEQ ID NO: 23538 - DNA, 90 bp, Homo sapiens
gggacgggtgaggcgggccgggagcgagggaggcggcgccgggggacgcgccgggctcggcctggcgaccgttgcccgctcgcgtccatc

SEQ ID NO: 23539 - DNA, 89 bp, Homo sapiens
tttagtggcaacagctttgaactagagaggtagatgtattaaagcagcatagaaccataacttctagataatgtagttgccactaggag

SEQ ID NO: 23540 - DNA, 119 bp, Homo sapiens
agtcagcctgttgaagctttgaagctttgatgccaggcattgacttctcactagctgtgaaagtcctagctaaagagaagtcaatgcatgacatcttgtttcaatagatggctgtttca

SEQ ID NO: 23541 - DNA, 81 bp, Homo sapiens
taggtgcaggaggtggtcagagtgggagggcagggggcttggccctggccctcactcaccgcagccctttctgtgcccacc

SEQ ID NO: 23542 - DNA, 62 bp, Homo sapiens
gcctgaggccctgcggaccccggcggttccgccaggcccccggggggcgaggcccgcggagg

SEQ ID NO: 23543 - DNA, 77 bp, Homo sapiens
ctgtacgcaatacaactcccgagaggccccgcgccgccccgcgccggggcgactcgggagtgcggtcggcagtagag

SEQ ID NO: 23544 - DNA, 58 bp, Homo sapiens
ggtggccagggtagggaggccttaggcttcctggggacccctaccctgaagccaccca

SEQ ID NO: 23545 - DNA, 84 bp, Homo sapiens
gccggtgccccgggtccccgcgctagctcgtcccaacccctggaagagggctgcgcttccgagggggcagggggcagagggtag

SEQ ID NO: 23546 - DNA, 56 bp, Homo sapiens
gaggttcgggatcgcttgagcccgggaagtctgggctgcagtgaaccgaaccgtga

SEQ ID NO: 23547 - DNA, 62 bp, Homo sapiens
ctgcagtcgctgccgactccattttgtcggtagaggcagaaggagaaggtcgggttgtagaa

SEQ ID NO: 23548 - DNA, 81 bp, Homo sapiens
tgagccagccgcagcccgagccgcttcaaacggctgggaggggcgccgggggcggggcctcgggctgtaggcagggccaag

SEQ ID NO: 23549 - DNA, 84 bp, Homo sapiens
gtgctttacatgaatggtcccattgaatcccaacagctttgcgaagtgttgttgggattcagcaggaccattcgtgtaaagtaa

SEQ ID NO: 23550 - DNA, 68 bp, Homo sapiens
gcctctgccccgcccccggacgcgcggccctcagccggctgcggcgcggcggcggcgggagggggcgc

SEQ ID NO: 23551 - DNA, 68 bp, Homo sapiens
cggccggcgctccgctcgcctcctccctctctcgaggatttgcagagccgggagtcgtcggaggtgtg

SEQ ID NO: 23552 - DNA, 52 bp, Homo sapiens
gcagcaaggaaggcaggggtcctaaggtgtgtcctcctgccctccttgctgt

SEQ ID NO: 23553 - DNA, 63 bp, Homo sapiens
cttcagtctgctgccgccggggccggggctagggttagttctggagctggaccaggaggagct

SEQ ID NO: 23554 - DNA, 64 bp, Homo sapiens
cgcggtgtcgcctagctccagcgtcccgaagggcaggctgcgcagctgcgggggcggccgcggc

SEQ ID NO: 23555 - DNA, 75 bp, Homo sapiens
ctgcagccgccgccgggttgtgcctcagactgtcagataaatcggcgggccgggccggcgggtcggtgagcgcgg

SEQ ID NO: 23556 - DNA, 65 bp, Homo sapiens
ccggctctagcctcccgctgttcgactgcccaacctggtgagtggcggggcggccagggctagag

SEQ ID NO: 23557 - DNA, 76 bp, Homo sapiens
taagcatgagctatcacacacaacctatgttctattaaacaaaaaacagggcctggtgtggtggctcatgcctgta

SEQ ID NO: 23558 - DNA, 54 bp, Homo sapiens
tttgtagctgtacactaagggaatcccaactcccttagtgtacagctacaaaat

SEQ ID NO: 23559 - DNA, 60 bp, Homo sapiens
ccgcaccgcggcgcccgcgcaggcgggagattcaaactgcgcgagcgcggcgggccgggt

SEQ ID NO: 23560 - DNA, 52 bp, Homo sapiens
gggcattgagctcttgggctagagcgtcgccgagtcggagccggagcctgag

SEQ ID NO: 23561 - DNA, 56 bp, Homo sapiens
acctccacccagtttcaggcctggaggatggtcttggcaggaggctgggtggggaa

SEQ ID NO: 23562 - DNA, 58 bp, Homo sapiens
tgagggtggggagggaggctgctgggtgtctgacacccttcttctcccccaccccagc

SEQ ID NO: 23563 - DNA, 63 bp, Homo sapiens
cgctgcccgcagcgcgcgccgggccgagtgacggccgaggcgggacgcggcgcctgcgcgggc

SEQ ID NO: 23564 - DNA, 77 bp, Homo sapiens
gcgcgatcggccgggctgtaaccgtcgtctgtccgggagcggctggagcggcagcggcggccgggcacggcgcgagg

SEQ ID NO: 23565 - DNA, 91 bp, Homo sapiens
ggtgcgcaggcgccgtggccggactggggactttgttctccgcggagaaacccaagggcggtgccggtggctggctgcgcacgcgcgccgc

SEQ ID NO: 23566 - DNA, 68 bp, Homo sapiens
tgtcactagaatctggaatagattccatgtaagccatgtgggaatctattccagattccagtgacact

SEQ ID NO: 23567 - DNA, 70 bp, Homo sapiens
cgtacatgcatgtgtgtgtgcatgtgtgtgcatttgtgcatgcatgtgtgtgtgtgcatgtgtgtgtgtg

SEQ ID NO: 23568 - DNA, 67 bp, Homo sapiens
tggcgaccccctgcggcagggctggggcttgagcctgccagtgcgctgggatggggcgcgaagcggg

SEQ ID NO: 23569 - DNA, 65 bp, Homo sapiens
gctggcgggcctggcccctccctgcctggagcaccgctgggcaagctcggggctggcctccgcca

SEQ ID NO: 23570 - DNA, 62 bp, Homo sapiens
gcagtccgggactggggctgggcgcgctgcccgggagccccgcacccacgcctggaccgcgg

SEQ ID NO: 23571 - DNA, 66 bp, Homo sapiens
cggagtcgcagcgcggtcacactgccccgcaacggccgggaccagggtaggggctgcgaccctggg

SEQ ID NO: 23572 - DNA, 65 bp, Homo sapiens
ctgcagacccatgcctggctcccaggggctcgccatctggccgggcggggcaggtgctgtgagca

SEQ ID NO: 23573 - DNA, 53 bp, Homo sapiens
cgagcccggccaaaaatgttttaagaaattagctgggtgtggccgggcgcggt

SEQ ID NO: 23574 - DNA, 74 bp, Homo sapiens
gcgcccatgtaacccggtccgtgccgcaaagcgaacggcggccgcggcgcgggccccgcgggggttagaggtca

SEQ ID NO: 23575 - DNA, 56 bp, Homo sapiens
atcccagtccagctctctgctaacagagagtgagcagtgcagcctggatgggaaga

SEQ ID NO: 23576 - DNA, 78 bp, Homo sapiens
gagtcgtcggacacttctgaaatagacaggaaagatgacgaggatgaggaggaggaggaagaagtgtctgacagctag

SEQ ID NO: 23577 - DNA, 66 bp, Homo sapiens
agaaggcccactgaagggaagcctgagaaggaaaaattcaagtcatctctccaggggcctatcacc

SEQ ID NO: 23578 - DNA, 73 bp, Homo sapiens
ccggccgcaggggtcatgcgcttctccttctgccgccggttgcagaaccagacgcgcaccacctccttctcca

SEQ ID NO: 23579 - DNA, 99 bp, Homo sapiens
tctacaagcagatacaaggatgcccttgtacacaacacacgtgctgcttgtatagacatgagtgttgtctacgagggcatccttgtgtctgtgtgtgtg

SEQ ID NO: 23580 - DNA, 57 bp, Homo sapiens
atcgcgccgcccgggtcgctgccggagctcgccggtcgcccctgcgctgcgcggacc

SEQ ID NO: 23581 - DNA, 60 bp, Homo sapiens
gagatgggggcggggtgggcggggctgtcgctgcgccccaacccaccgcacccccctcag

SEQ ID NO: 23582 - DNA, 79 bp, Homo sapiens
cgggcggcgggcggcggggcggggcgggacgggcggcgaccgcggcctcagcgcggtccctggagcgcccgccgcgcga

SEQ ID NO: 23583 - DNA, 62 bp, Homo sapiens
ctgtgacctgggccccagttctggagactgaggaccagaactcaggcccctggtcccacagg

SEQ ID NO: 23584 - DNA, 62 bp, Homo sapiens; identical to SEQ ID NO: 23583

SEQ ID NO: 23585 - DNA, 62 bp, Homo sapiens
ttggaggctctctcagctgacaggcagacctagattgtgaagctgggattttcctcccaagg

SEQ ID NO: 23586 - DNA, 57 bp, Homo sapiens
tcatgagagttgtgtgagaaccgtgaggaagaatctgttccatgcctctctcctggc

SEQ ID NO: 23587 - DNA, 52 bp, Homo sapiens
tgggggtgtgcagtgggatctgtctgacatccgccctctgtacctccccaga

SEQ ID NO: 23588 - DNA, 60 bp, Homo sapiens
gcgggcggacagactgcgggacggacggtggacgctgggacgcgtttgtagctccggccc

SEQ ID NO: 23589 - DNA, 77 bp, Homo sapiens
ggagggggggtgcagactgggtggggttctttgcccttcctggagcctgttccagtctgtccgtccccatcctcagg

SEQ ID NO: 23590 - DNA, 62 bp, Homo sapiens
cccgcggtacctcccgcactctgacctgcggcccgtaggtccgagccggggacggcggcgtc

SEQ ID NO: 23591 - DNA, 61 bp, Homo sapiens
caggctggagttacctttaggggagcctagagtcctctccttggggtaactccagcctggc

SEQ ID NO: 23592 - DNA, 59 bp, Homo sapiens
gggggcctcacgagccccggcctcagctacggtctgggctccagctttggctctggcat

SEQ ID NO: 23593 - DNA, 58 bp, Homo sapiens
tgagggtatagctgtcccagaggcccctccaaaactgggtccctgctgtaccctccca

SEQ ID NO: 23594 - DNA, 72 bp, Homo sapiens
gagcttgagggcagttggtgcggtcgggttggttcttacaccccggcgggagcgcccagacaagccgagctg

SEQ ID NO: 23595 - DNA, 52 bp, Homo sapiens
gctgtcccccctcccggcgcggttgggtggcgcctcagcgggtgggcagcat

SEQ ID NO: 23596 - DNA, 58 bp, Homo sapiens
cccacccctgggctgcttcttcttgagatcaggaggggcgttgcccagggctggtgtt

SEQ ID NO: 23597 - DNA, 75 bp, Homo sapiens
ccccgggaggcgcggcaggcggggcgggagcggggcgcgggcctgcgcggccgcccgtccatccgtccgtccgtg

SEQ ID NO: 23598 - DNA, 56 bp, Homo sapiens
aacctccctgcacagtccacctcgttctgctcagctggactctgaagtgaggtcga

SEQ ID NO: 23599 - DNA, 80 bp, Homo sapiens
gcccctgccgccgccgcacccacacccgcaccctcacccggagctgctgctgcgtggcggggccgcggcggcgggggatc

SEQ ID NO: 23600 - DNA, 65 bp, Homo sapiens
ttcacctggagatgcagttgaacttcgagccgcgctcgccggccccacagcgcgcccgggacctg

SEQ ID NO: 23601 - DNA, 65 bp, Homo sapiens
gtgcaaaagtaattgaggttttgcctttaaaagcaatggcaaaaacttcaattacttttgcatcg

SEQ ID NO: 23602 - DNA, 83 bp, Homo sapiens
agttcttctgcagacaaaagcatcaggaagtacccaccatgtaccagtgggcccttcttgatgctcttgattgcagaggagcc

SEQ ID NO: 23603 - DNA, 53 bp, Homo sapiens
tcaggccagactgggaggctgcatttacagcatcctcccagcctggcctgagt

SEQ ID NO: 23604 - DNA, 55 bp, Homo sapiens
actcaggccaggctgggaggatgctgtaaatgcagcctcccagtctggcctgagt

SEQ ID NO: 23605 - DNA, 55 bp, Homo sapiens; identical to SEQ ID NO: 23604

SEQ ID NO: 23606 - DNA, 51 bp, Homo sapiens
tgagagttgtgaaatatttgtggttttttccccattatggacacttgcact

SEQ ID NO: 23607 - DNA, 63 bp, Homo sapiens
tgcggcggagggggcagggagggggcagggaaaaggccttgcccccttctcccctcctccagt

SEQ ID NO: 23608 - DNA, 74 bp, Homo sapiens
ctttattgagtccctactatgttccaggcactgggtatcgtaggtgcctggaacatagtagggactcaataaag

SEQ ID NO: 23609 - DNA, 62 bp, Homo sapiens
cggccgccagccccagcctcccaggtccggagcccggactggcggaggccgcgagggaggga

SEQ ID NO: 23610 - DNA, 63 bp, Homo sapiens
gctggtggtgggcggggacggccggttctacatgaaggaggccatccagctcatcgctcgcat

SEQ ID NO: 23611 - DNA, 57 bp, Homo sapiens
caggcggcgccgggggccgagggcgcgccactgcccagcgcctagcgcctgccttca

SEQ ID NO: 23612 - DNA, 74 bp, Homo sapiens
tgtatgggctactatacacctaggctacaattgtatagtagactgtacacctaagctatagtaggctatacatc

SEQ ID NO: 23613 - DNA, 93 bp, Homo sapiens
atctacaatggtgatgggtgaatttgtagaaggatgaaagtcaaagaatccttctgggaactaatttttggccttcaacaagaattgtgatat

SEQ ID NO: 23614 - DNA, 72 bp, Homo sapiens
cccaggggcggcggcggcccagcccaggtgcccgcgcacaggggacctcggtgcggagccacccctcgagcg

SEQ ID NO: 23615 - DNA, 62 bp, Homo sapiens
gtagcacaagtgagtgtgaatcactggagtgagttagagtgagtcaggcaacctgtgtttga

SEQ ID NO: 23616 - DNA, 81 bp, Homo sapiens
ctagctgctgctgggcgtttaccgcgggagcccttagcggtctggaggtgagggcagtggtgggtcccggaagtaaaaggc

SEQ ID NO: 23617 - DNA, 62 bp, Homo sapiens
tcacaccaccgtgtccaccattaaaggggaaattctttaatggtggacacagtggtgtccct

SEQ ID NO: 23618 - DNA, 57 bp, Homo sapiens
gatgaggcagagtaactcacaatagaacaaacagttttgagttactttgccttatcc

SEQ ID NO: 23619 - DNA, 65 bp, Homo sapiens
tagtgtattagtccattttcacattgctataaagacatacctgagactgggtagtttataaaggt

SEQ ID NO: 23620 - DNA, 92 bp, Homo sapiens
tgagcccgcagcctccggcagccgggaaagtgcgggcgcggggccgcagcctgcccgcccggagcggcccaggagcacgccgcggggagcgc

SEQ ID NO: 23621 - DNA, 61 bp, Homo sapiens
gctacaactctgaaatcagaaagactcttgttgcatatgagtatggtttcatcttttgtga

SEQ ID NO: 23622 - DNA, 71 bp, Homo sapiens
tagcctgtgcggcaaaatgcgtccttttggatggctgggacccagcctagggcgtagctccccgggcccga

SEQ ID NO: 23623 - DNA, 80 bp, Homo sapiens
ggcgcgtcgcccccctcagtccaccagagcccggatacctcagaaattcggctctgggtctgtggggagcgaaatgcaac

SEQ ID NO: 23624 - DNA, 70 bp, Homo sapiens
ttcgctccccacagacccagagccgaatttctgaggtatccgggctctggtggactgaggggggcgacgc

SEQ ID NO: 23625 - DNA, 66 bp, Homo sapiens
ctttttaatggtgccaaacagcagttgatctataataactgctgcttggcaccattaaaaagtaca

SEQ ID NO: 23626 - DNA, 53 bp, Homo sapiens
gccgggtgcttcgcagcggagctcgaggctctgtagcacccagttggacccag

SEQ ID NO: 23627 - DNA, 52 bp, Homo sapiens
gcttggaggtgcagtcgcggaggctccagctaccgcggcggccgtcgcgccc

SEQ ID NO: 23628 - DNA, 72 bp, Homo sapiens
caagggccatgtttcagcactgtgttacagcttttttagctctgccatttggcgagtcctgcgtccttgtcc

SEQ ID NO: 23629 - DNA, 57 bp, Homo sapiens
ggggctgcgctctcggtcctgcggctcccgcgccaggcacggcagccgcagcccggc

SEQ ID NO: 23630 - DNA, 102 bp, Homo sapiens
ggtcctctgactctcttcggtgacgggtattcttgggtggataatacggattacgttgttattgcttaagaatacgcgtagtcgaggagagtaccagcggca

SEQ ID NO: 23631 - DNA, 84 bp, Homo sapiens
tgtctcaaaaccaaaacaaaactaaaaccaactcagtttaaattgtgttacctcgagttgtctttacagctgatgtggtgacag

SEQ ID NO: 23632 - DNA, 82 bp, Homo sapiens
taaatgcctttgactactacatacatatgcctactactactttcatatgtaggcatatgtatgtagtagtcaaaggcattta

SEQ ID NO: 23633 - DNA, 56 bp, Homo sapiens
tactacatacatatgcctacatatgaaagtagtagtaggcatatgtatgtagtagt

SEQ ID NO: 23634 - DNA, 64 bp, Homo sapiens
gggttcagtgcggactcctccctaggaagatgagaccatgctggaggggtcagcctggcccctt

SEQ ID NO: 23635 - DNA, 66 bp, Homo sapiens
aggggccaggctgacccctccagcatggtctcatcttcctagggaggagtccgcactgaaccctgg

SEQ ID NO: 23636 - DNA, 75 bp, Homo sapiens
ggctgtgccgggtagagagggcagtgggaggtaagagctcttcacccttcaccaccttctccacccagcatggcc

SEQ ID NO: 23637 - DNA, 75 bp, Homo sapiens
gcccccctatccttgacctccgcgggtccgacactttcactttcacgcggggggaggcctaggggacaggttcgg

SEQ ID NO: 23638 - DNA, 57 bp, Homo sapiens
tccgggtagaagacatgtcactcactctaaacagtgtctgtcttctttcctgggcct

SEQ ID NO: 23639 - DNA, 57 bp, Homo sapiens; identical to SEQ ID NO: 23638

SEQ ID NO: 23640 - DNA, 57 bp, Homo sapiens
cgggaactcggttcgcgggcgcggagcggtcccggaccctcgaagccagttccttgc

SEQ ID NO: 23641 - DNA, 83 bp, Homo sapiens
gccctcccgcccagcgcggcaacccctgggcgcccggcaccggcttggacccgccggggcggggatggaagcgctggcggcgg

SEQ ID NO: 23642 - DNA, 53 bp, Homo sapiens
cgtggtcttcggggagagagcgccggcggctctctggccccggggaccacctg

SEQ ID NO: 23643 - DNA, 77 bp, Homo sapiens
ccctggatcccttgtctgctcagccttcctggaaggagaatttccttgggggttattagtagcaacgctttagactg

SEQ ID NO: 23644 - DNA, 56 bp, Homo sapiens
gtagggtgcctgtgtttcagcaaagcctgggcaattggaatgcagagctcctaaga

SEQ ID NO: 23645 - DNA, 56 bp, Homo sapiens
cactgaattccatttgtggactgaaaagtattcaatccacttttggggttcagaga

SEQ ID NO: 23646 - DNA, 56 bp, Homo sapiens
ttggtaaagttggtttaaagtgatgacatgtatcttccttgaccatccttatcaga

SEQ ID NO: 23647 - DNA, 52 bp, Homo sapiens
tgtcagtcccagttgatgtttttggcttcacgtctggttaactttaggagag

SEQ ID NO: 23648 - DNA, 57 bp, Homo sapiens
cagatggggccagagtgttctagagatccagactctagagctccgatcccatccacc

SEQ ID NO: 23649 - DNA, 64 bp, Homo sapiens
ggaagatggcggccggcggcggcggaggcagcagtaaggcctcctcctcgtcggcctcttcggc

SEQ ID NO: 23650 - DNA, 73 bp, Homo sapiens
agagatagggggaggggaggccggcgcggtgattggcggaagcgccggcgcaagccccccgtccaccctcacg

SEQ ID NO: 23651 - DNA, 89 bp, Homo sapiens
aaccctatgatgaatggttcctgaaatttttttcttttttgagagaccaaaaaaaaaaagtgtttaggaaccattcatcacagggttgt

SEQ ID NO: 23652 - DNA, 52 bp, Homo sapiens
tgttcttcgttctggcccttccagggtaattaggaaggcagaacaagacaga

SEQ ID NO: 23653 - DNA, 71 bp, Homo sapiens
cagccggggcctggtgcagcctccgcggccgctgtcagggaagcgcaggcggccaatggaacccgggagcg

SEQ ID NO: 23654 - DNA, 86 bp, Homo sapiens
cccgcacacagcccgacgtccacacgcacgctcggcgcgaggcgtctcggaggagtgggcggcgcgggcgcgggcggtggcccgct

SEQ ID NO: 23655 - DNA, 78 bp, Homo sapiens
cacaggcctttccttgccttcctgggccttcctggggcttcaggagctgggccgtggagtgggggagaggctgtcagc

SEQ ID NO: 23656 - DNA, 64 bp, Homo sapiens
agctgcccgccgcggggccccaggcgcagcacgctctcgcgcgtgggccgcagctggcagcaca

SEQ ID NO: 23657 - DNA, 56 bp, Homo sapiens
tcggcaaggggagcaggaggaggactgcggcggtcacccctgcttcctctgccaga

SEQ ID NO: 23658 - DNA, 66 bp, Homo sapiens
tccccctgcccccagggcaaccagttctcctatgctctatgaggttgtctatgaggcaggggccct

SEQ ID NO: 23659 - DNA, 79 bp, Homo sapiens
tgcttctgtgtgatatgtttgatattgggttgtttaattaggaaccaactaaatgtcaaacatattcttacagcagcag

SEQ ID NO: 23660 - DNA, 66 bp, Homo sapiens
cggcggcggcggcggcggcggagcccggagcgcaggccggaggctcccggcccgccggccccggag

SEQ ID NO: 23661 - DNA, 65 bp, Homo sapiens
tgccccttccctctcggtgtggcctggagagatgtgcaggctccccgagggcaggggggggtagt

SEQ ID NO: 23662 - DNA, 52 bp, Homo sapiens
gcccttccctccccgcggggcaccgtcacgcgtggggagggacgcagggcgc

SEQ ID NO: 23663 - DNA, 65 bp, Homo sapiens
tgcccacagtgcccgcccatcccttgacctatgaggaggaggaggtggcgggcagagtgggcagc

SEQ ID NO: 23664 - DNA, 78 bp, Homo sapiens
tgcaggatggagagagggtgtggggcagggggcagggagaggcccccagccccaaccttccttgccaccctccccagc

SEQ ID NO: 23665 - DNA, 59 bp, Homo sapiens
gccgggacgagtgcaatattggcgggggaaaaaacaacactgcaccgcgtcccgtccct

SEQ ID NO: 23666 - DNA, 57 bp, Homo sapiens
tcccatcccccttctctagtccccgacctgcggcagccggagctcggggagcggagc

SEQ ID NO: 23667 - DNA, 51 bp, Homo sapiens
aaggcctcaaaggggaggaggcggttatctcctcctactttgttgccaaat

SEQ ID NO: 23668 - DNA, 58 bp, Homo sapiens
cctccttccgcgactcgggcgccggtggcgccatcttactcggttgcgggaggggtca

SEQ ID NO: 23669 - DNA, 64 bp, Homo sapiens
tcccggggagctgcctgggcaggggtggctggccggctcccagcctctgcagctccccggcccc

SEQ ID NO: 23670 - DNA, 90 bp, Homo sapiens
ccgccgccccttccccggagtggggagttggccagggccgatcgactcgctggccggccggcccgcctccgctcccggggggctctaatg

SEQ ID NO: 23671 - DNA, 90 bp, Homo sapiens; identical to SEQ ID NO: 23670

SEQ ID NO: 23672 - DNA, 62 bp, Homo sapiens
gcgtggagcacgaggtgggcgagcgcctcggaatccggcgtgcccgcgcgtccgccacgagg

SEQ ID NO: 23673 - DNA, 52 bp, Homo sapiens
gggccggagcggagcggcgccgccaccgccgcacgcgcaaacttgggctcgc

SEQ ID NO: 23674 - DNA, 64 bp, Homo sapiens
gcataaggagccgatcgccgagcacgccgagcaggctttgtgtgcccgcggtcggtgggtgccc

SEQ ID NO: 23675 - DNA, 63 bp, Homo sapiens
gcgtcctctctgtggaaaacaacaggcgggcgggtgagcgggctgctccgcagcggggcgtgg

SEQ ID NO: 23676 - DNA, 57 bp, Homo sapiens
cccgcggccaccaccggctttcccagcagcagggggcacccggtgggggcagcggcg

SEQ ID NO: 23677 - DNA, 61 bp, Homo sapiens
tgcccgttcccggcctctccctgtacatgtgcgggaggaaggtgagagggggctgggccct

SEQ ID NO: 23678 - DNA, 86 bp, Homo sapiens
tcagtagacactttgatttttaaatcttgagatacagtaagaaatctgagttggagatacagatttgagaattgagtttatggatg

SEQ ID NO: 23679 - DNA, 62 bp, Homo sapiens
gtagggagaagggagtaaacaggaatgaccacaaccctttcccgatctccttttttcctagt

SEQ ID NO: 23680 - DNA, 84 bp, Homo sapiens
gcgcaccgcgcggctgtacttgtaaaacgcgaactgcagcggcgtgtcgcgcttctgcgggtgcaggcgcgtgtcgcagcgcag

SEQ ID NO: 23681 - DNA, 51 bp, Homo sapiens
ctctgcttaattaaaaccaggcctgtgtacgtggttttaattaagcagagt

SEQ ID NO: 23682 - DNA, 53 bp, Homo sapiens
ctaggaggggccaggagccggccggcagagagcggctcgtgggtcccaggacc

SEQ ID NO: 23683 - DNA, 50 bp, Homo sapiens
taactatagtctgtgataacttattgttagctatagtctgtgttgtacag

SEQ ID NO: 23684 - DNA, 52 bp, Homo sapiens
ctggctctgctcctcggcgcgcccaggctgggccgggacgtggtcgcgagct

SEQ ID NO: 23685 - DNA, 58 bp, Homo sapiens
aggcgcggcttccggccggtccgggcagtccctggcgggcctgggtagccgtgccctc

SEQ ID NO: 23686 - DNA, 58 bp, Homo sapiens; identical to SEQ ID NO: 23685

SEQ ID NO: 23687 - DNA, 64 bp, Homo sapiens
tggaaagtaagtcagccctaagtttaaatagcccagaaaatttagagctgaattactttccaga

SEQ ID NO: 23688 - DNA, 84 bp, Homo sapiens
cgcgggtccgcgcgcgcactgctcgccgccctgctggcgtcgacgctgttggcgctgctcgtgtcgcccgcgcggggtcgcggc

SEQ ID NO: 23689 - DNA, 60 bp, Homo sapiens
tgggatcctttggtgacatgaattttgctctagtggtttatgacatcactggaaccccgt

SEQ ID NO: 23690 - DNA, 79 bp, Homo sapiens
aggacattttgcccagatccgtggcctattcagaaatgtggcctgtgattaggccgcagatctgggtgaaatgtcctcc

SEQ ID NO: 23691 - DNA, 66 bp, Homo sapiens
gtgcttacaggctccctgccgagtcgcaactgtttacagggctcagcagggagcctgtaaggggct

SEQ ID NO: 23692 - DNA, 68 bp, Homo sapiens
aatcccatcacttggaagaccaaggtgcagtcctcccaccttggtctcccaaggggtgagactacaga

SEQ ID NO: 23693 - DNA, 52 bp, Homo sapiens
tgggcgcaggctgcagcgccgcgactcgtgcgggtaggcgtctgcgctcggt

SEQ ID NO: 23694 - DNA, 67 bp, Homo sapiens
cggaacgggaagaaggagctgtctctctcttctgaggggtaggcaggtgcttccgaatcgcggaatg

SEQ ID NO: 23695 - DNA, 86 bp, Homo sapiens; identical to SEQ ID NO: 10497

SEQ ID NO: 23696 - DNA, 52 bp, Homo sapiens
ggagccgcgcgcgcgcgcgcaccaacggagcgcgctcgcgggggctctgaga

SEQ ID NO: 23697 - DNA, 55 bp, Homo sapiens
gtgtcagttgttgggctgtaatggcgactgggccgcccctgacgaagtgactccc

SEQ ID NO: 23698 - DNA, 59 bp, Homo sapiens
cccgactcatccggtgcttgcgtgtggtggtgagcgcagcgccgaggatgaggaggtgc

SEQ ID NO: 23699 - DNA, 56 bp, Homo sapiens
ccccgtggccagctgccggttgcagatgatgcaagcaaagcagtgcaggtggtaga

SEQ ID NO: 23700 - DNA, 56 bp, Homo sapiens
tgctgcctggtgagtagctgcattatcagatgtgtagctgcatgccaggggctaga

SEQ ID NO: 23701 - DNA, 77 bp, Homo sapiens
agagtcgagagtgggagaagagcggagcgtgtgagcagtactgcggcctcctctcctctcctaacctcgctctcgcg

SEQ ID NO: 23702 - DNA, 77 bp, Homo sapiens; identical to SEQ ID NO: 23701

SEQ ID NO: 23703 - DNA, 85 bp, Homo sapiens
agacccgctccccgcgcgggagtcgctggggtccttgggctccgcggcctgggagactccggattgcgggaggagtcgggggagg

SEQ ID NO: 23704 - DNA, 75 bp, Homo sapiens
ccagctccgtggagggtgtggttctggcccggcttgcctccggggctgccccttgcccggtgttggggtctggtc

SEQ ID NO: 23705 - DNA, 88 bp, Homo sapiens
ggtcgcgcgtggaggtcggtcgctcagagctgctgggcgcagtttctccgcctgctgcttcggcgcggctgtatcggcgagcgagcga

SEQ ID NO: 23706 - DNA, 80 bp, Homo sapiens
cggggcggcgcggcgggaggtggccgacaggctccgggcctcgcagcctcagcccccggcccagcgcgctttccgacggc

SEQ ID NO: 23707 - DNA, 64 bp, Homo sapiens
tcagccacactcagctctaacaaagtccttttgaagcagttggagctgaggctgtggccactga

SEQ ID NO: 23708 - DNA, 120 bp, Homo sapiens
agttggccaggaccccaagcccccagcacttcattcttgctgtcctctcctggtctgggaggatagaagagaggataggaagaatgaagtgctgggcgcttagggggatcctggccaact

SEQ ID NO: 23709 - DNA, 92 bp, Homo sapiens
gtcagtgtctgggcggacagctgcaggaaagggaagaccaaggcttgctgtctgtccagtctgccaccctaccctgtctgttcttgccacag

SEQ ID NO: 23710 - DNA, 80 bp, Homo sapiens
ggcggaagaggagcccgagcctggccgcgggctgggccccgccgcagctccagctggccggcttggtcctgcggtccctt

SEQ ID NO: 23711 - DNA, 58 bp, Homo sapiens
taggttatacaacataatgtgtgtgtatacataacatacattatgttgtataacctaa

SEQ ID NO: 23712 - DNA, 56 bp, Homo sapiens
agctacaggtgagatcaggttttgttttttttgagacggagtctcgccctgtcgcc

SEQ ID NO: 23713 - DNA, 67 bp, Homo sapiens
tctctcctccttcagctcattcccgtgttccatctgaggggcgggaggaaggcaggagggggagatg

SEQ ID NO: 23714 - DNA, 60 bp, Homo sapiens
gtggtgaccctgtggtacaggccccccgatgtgctgctgggatccacagagtactccacc

SEQ ID NO: 23715 - DNA, 88 bp, Homo sapiens
cccccacttcctgttgtgccgcgcgcccctcggcccccgcccccgctcccggccggtggggctgtggccgcgagatcccgagggggcg

SEQ ID NO: 23716 - DNA, 74 bp, Homo sapiens
gggcgaggagggggtgggtaatggggaggagggctggggaacccccagacctgagaggtccactccctgccccc

SEQ ID NO: 23717 - DNA, 68 bp, Homo sapiens
ccccttcccttggagggagaggtggcaggaatacttcacctttcctctccctcaggggcaggtggtgg

SEQ ID NO: 23718 - DNA, 58 bp, Homo sapiens
agacttcagcacctttatcttttctgatatcagaaaagataaaggtgctgaagtctct

SEQ ID NO: 23719 - DNA, 50 bp, Homo sapiens
ggaagcggccgccgcggagccggcgtccgcagcggctgcgcatctcgggc

SEQ ID NO: 23720 - DNA, 88 bp, Homo sapiens
ggctccgctgagacgcgctgcagggctgtccgggccctccctcggcgacgcggccagcagcccgcgccgcgtcctcagcggcggcaaa

SEQ ID NO: 23721 - DNA, 59 bp, Homo sapiens
acagagtggagccttcgagacagacacaaaagaactgtctcggaggctgactctgctca

SEQ ID NO: 23722 - DNA, 56 bp, Homo sapiens
gggaggggccccgagcgccgcgagtgcgggccgcggaagaaatggaaccttcccgg

SEQ ID NO: 23723 - DNA, 61 bp, Homo sapiens
acacctgatatgatttagatagtgagtgatttagatactatctaaatcatttcaggtgtag

SEQ ID NO: 23724 - DNA, 67 bp, Homo sapiens
gggaacataaaaggccaaatctttaatttaatctttaaatctttgatttggccttttatgttcttga

SEQ ID NO: 23725 - DNA, 85 bp, Homo sapiens
atggtgttatcaagtgtaacagcaactccatgtggactgtgtaccaatttccagtggagatgctgttacttttgatggttaccaa

SEQ ID NO: 23726 - DNA, 61 bp, Homo sapiens
cctgcggccccagcgcccctcgctctcatccagcccgcgaggagtgcgggcgccgcgccgc

SEQ ID NO: 23727 - DNA, 54 bp, Homo sapiens
ctgacatgagcacccacttcgtgcccccaactcccttctaatgctcttgttgag

SEQ ID NO: 23728 - DNA, 67 bp, Homo sapiens
ctgggtagacggggagcggcgggagccggccgccttttctttcttcgccccggactgaagtgcggtc

SEQ ID NO: 23729 - DNA, 65 bp, Homo sapiens
ggagccaggctgcggtggggcaggacaaaggcgcccacgaaccctccctgccgccgccgctccac

SEQ ID NO: 23730 - DNA, 54 bp, Homo sapiens
ccgcgcgtggctccggaagcaggtcggcttgcctctggggatccgcgcgcctct

SEQ ID NO: 23731 - DNA, 81 bp, Homo sapiens
gcgttgtgggagccgcggccacgccagcgccggggcccctcccgcccgagactggtgaggcggcgggaaaccgcgggacgg

SEQ ID NO: 23732 - DNA, 54 bp, Homo sapiens
acatgtttagtgatacaatcccacctgtgtctggattgtgtcactaaacatgca

SEQ ID NO: 23733 - DNA, 56 bp, Homo sapiens
gccacggcgcggcggtggcgcagttcccagcctgcgcccagtcccgccgcagctcc

SEQ ID NO: 23734 - DNA, 68 bp, Homo sapiens
tcagccaccactgggcgttcactgcagcctgctgcttttccacgtgagcctgcagggccaggctgggg

SEQ ID NO: 23735 - DNA, 52 bp, Homo sapiens
gggacctggggtggggctgcatgggctcactgtgccctgaccccaggcccca

SEQ ID NO: 23736 - DNA, 69 bp, Homo sapiens
ccccttacttgagccttggcatagatctacaacactaggatacctatgccaaggctcaagtgaggggaa

SEQ ID NO: 23737 - DNA, 84 bp, Homo sapiens
gcggggctccgggtttaaacgtcgcggcgggcagggccggcggaggggcggggcggcctctgtgtcgtgtaccgggtcccgtag

SEQ ID NO: 23738 - DNA, 65 bp, Homo sapiens
ccggttctgaggttgagttcgtcagggttccgacccaatgctgaccaactcaacctcaaaacggc

SEQ ID NO: 23739 - DNA, 65 bp, Homo sapiens; identical to SEQ ID NO: 23738

SEQ ID NO: 23740 - DNA, 58 bp, Homo sapiens
tccagagactggagctgacttgtgcaactggcctgataagccaactgcagtcattgga

SEQ ID NO: 23741 - DNA, 75 bp, Homo sapiens
tggccgctgacgctggcgctggagagcggcgacgccaggagctgtgagagagcggcggagcgacccggggcccgc

SEQ ID NO: 23742 - DNA, 55 bp, Homo sapiens
tgtgtggaaggcggaggagacactgtttgggatgtcgctctgccctccacccatc

SEQ ID NO: 23743 - DNA, 63 bp, Homo sapiens
agaccccagcaaggcaaacctgagccattcttgggacagggttggtcttgatggggccacatc

SEQ ID NO: 23744 - DNA, 63 bp, Homo sapiens; identical to SEQ ID NO: 23743

SEQ ID NO: 23745 - DNA, 76 bp, Homo sapiens
ctgagcgcgatgcgcggagacccccgcgggggcggcggcggccgtgagccccgatgaggcccgagcgtccccggcc

SEQ ID NO: 23746 - DNA, 53 bp, Homo sapiens
cgtgggcggagggtgctgggagaggggcagctcccgcaccgtcctgccccata

SEQ ID NO: 23747 - DNA, 75 bp, Homo sapiens
ccgctcgccggctccttgcggcacctactgggacccgggccggctcccggggcggcggcggcggcgggggtgggg

SEQ ID NO: 23748 - DNA, 59 bp, Homo sapiens
agtgggcgggagcagaccaggtgcgtttcctaacacctgggttctgccccgtccacgct

SEQ ID NO: 23749 - DNA, 58 bp, Homo sapiens
cggggcgcgcccggcgcggggaggggttctgcggcctcctcccgggctgcgcctcgct

SEQ ID NO: 23750 - DNA, 74 bp, Homo sapiens
aggctataaggtgtagtagcctgttgctcctagactaaaaatctgtgcagcttgttactacgctgaatagcgta

SEQ ID NO: 23751 - DNA, 75 bp, Homo sapiens
cgtgagaaagtgaaaggagcccgcaggcggcggcgacagctgcgctgggaggggcttgtttccaggctcagaggc

SEQ ID NO: 23752 - DNA, 74 bp, Homo sapiens
cagaagggcgcggcttccgggatctggcggggccttcgtctctcctgccagcctcagctgggtcgtcttctgtg

SEQ ID NO: 23753 - DNA, 52 bp, Homo sapiens
gggctttgtgggtcagccacgtcgccgcgcccgggcttccccgcgggcccgc

SEQ ID NO: 23754 - DNA, 62 bp, Homo sapiens
cgccccaaccggcagctggcgggcctggtggagagcgtgcggcggctggggttgggcgcggg

SEQ ID NO: 23755 - DNA, 65 bp, Homo sapiens
gcgagccctctggtgccggacgttgcgcggccgcgacgcccgacgccaacgcaggcgcagcgctc

SEQ ID NO: 23756 - DNA, 70 bp, Homo sapiens
gcccccgtcggaggcacctggggctgtggaacagaagcctgcacccccaccccgtgtgtgtcctctgccc

SEQ ID NO: 23757 - DNA, 71 bp, Homo sapiens
cgcgaggagccgccgagacctccgcctgcgaacaaagaggaggccgtgcggggcgcggcgcccgcggagca

SEQ ID NO: 23758 - DNA, 61 bp, Homo sapiens
cctcgcgccccgcgcgcgcgcgccctgcccccgcggccccgtgacgcgcgcgcgcagagac

SEQ ID NO: 23759 - DNA, 76 bp, Homo sapiens
cggccctgagcgcaggcggccccgggtctcaggcctcaggcggaccgcgccccgggctcgcagccctcccgccccg

SEQ ID NO: 23760 - DNA, 55 bp, Homo sapiens
ccccgcagccccgaggggtctgggcgcgctgaagaccccttcggctgctgggcca

SEQ ID NO: 23761 - DNA, 66 bp, Homo sapiens
tgtgcgtttgtgtgcgcccctggggtgtgtttgtgtgcgcccctggggtgtgtgtgtttgtgtgtg

SEQ ID NO: 23762 - DNA, 67 bp, Homo sapiens
aaggcgcgggcggccgcgcgccggaggagtccgcgctgtgaggtgcgcggccgagccctgcactgcg

SEQ ID NO: 23763 - DNA, 81 bp, Homo sapiens
ccggagctaagggagccggggctgggagagccggggcgggccgcgtcgcctgtccccagtcccggtctctcttccccgctg

SEQ ID NO: 23764 - DNA, 64 bp, Homo sapiens
tacagatctgggtctcttagagtttatactatttgcagttctttaagtggcctgaatttgtaga

SEQ ID NO: 23765 - DNA, 64 bp, Homo sapiens; identical to SEQ ID NO: 23764

SEQ ID NO: 23766 - DNA, 73 bp, Homo sapiens
ctggggtcggtgcttgctgcctgcggctctcagaagcctctgctccaccgcggcgagaggcatgggcacgtgg

SEQ ID NO: 23767 - DNA, 89 bp, Homo sapiens
ggcgcttcccggggctgcggcggggcggagctcgcggaggaagtcggcgggcgtctcgggctccaggtcccggccagaggaggagctcg

SEQ ID NO: 23768 - DNA, 83 bp, Homo sapiens
cagatttttgtggttgtttaatagtccctgggaacatttgtcctctcaccaccaaccagagtcagccaactaggatcgatgtc

SEQ ID NO: 23769 - DNA, 82 bp, Homo sapiens
tccgggcatcacctcccactgcagagcctggggagccggacagctcccttcccaggctctgcagtgggaactgatgcctgga

SEQ ID NO: 23770 - DNA, 54 bp, Homo sapiens
tgcactaagtatatgccaagcatggttgtcagcttggcatacacttagtgcgtg

SEQ ID NO: 23771 - DNA, 60 bp, Homo sapiens
cgcagaggcggcggggatgccgggcggctcgggctgcggcgcagcttcctcctctgcagt

SEQ ID NO: 23772 - DNA, 57 bp, Homo sapiens
atattacatattgaaattgcatattgatatgtaatatgcaattaatatgtaatatgc

SEQ ID NO: 23773 - DNA, 59 bp, Homo sapiens
cggcccacctagtgggtcctgacctggggaagccgagtccgcgcgcgggtcgggccgcg

SEQ ID NO: 23774 - DNA, 70 bp, Homo sapiens
cggcggcggccgccgcgggggccacttgcctggagaggtttcatctggtcaacggcttctgcccgcctcc

SEQ ID NO: 23775 - DNA, 136 bp, Homo sapiens
cgcccgccggggcgcgccggcctgcgcccaacggtcaccgccgcccccacctgggccgcaaccgccggcgcccccgccccgtgccgcggccgcgggagggacgcggagggtccgcggcggggcgcggggggtgtgg

SEQ ID NO: 23776 - DNA, 136 bp, Homo sapiens; identical to SEQ ID NO: 23775

SEQ ID NO: 23777 - DNA, 91 bp, Homo sapiens
gccaggccggggagggggccgcgcccgggcctgggccaagagcgcgcgtcccccgcccgggccctgcggccctccccaggtgtctgagcag

SEQ ID NO: 23778 - DNA, 61 bp, Homo sapiens
cagagcacgcctgcccgtgggaatcccaacacttgtgctccgcgaggccggcggggcgggg

SEQ ID NO: 23779 - DNA, 90 bp, Homo sapiens
tccgtccgtccgtccgtccgtcctcaggcgcgctctccggggactgggggctgggctctgccagggcagggcgatgcgggggtgtggggg

SEQ ID NO: 23780 - DNA, 75 bp, Homo sapiens
gcgggcagcgcgggatcgtccggctgcggggtccggctcacgccgggcgggcgggcggggcgcgctgtcccggag

SEQ ID NO: 23781 - DNA, 82 bp, Homo sapiens
cgcggcctagccaggggagggggcgcagcgccggggccatggatccgcgtcaggccgctgcttcccgccggcgggcccgggg

SEQ ID NO: 23782 - DNA, 52 bp, Homo sapiens
ggcggtgactgcctcgttgaacggttaggactgctggacgaggcgccggcgc

SEQ ID NO: 23783 - DNA, 53 bp, Homo sapiens
gggtggccgacgatccaggcgctcgtgcgctcactgaatcgatgacggctggc

SEQ ID NO: 23784 - DNA, 59 bp, Homo sapiens
atctcaacattttgtcttgtggatattgacaaattgaatccaaagtttatatggagatg

SEQ ID NO: 23785 - DNA, 71 bp, Homo sapiens
gggggccgggctcccactgggctcgtgcgttctgcgcccgccgcggcggtgccgagcccgctggctcccga

SEQ ID NO: 23786 - DNA, 63 bp, Homo sapiens
cctccgttgcttttttggatcattgtgtgacccagtgtgtgacccaatgaagcaatggagaca

SEQ ID NO: 23787 - DNA, 68 bp, Homo sapiens
ccggctcccggcgcggggcgctatttacggcgcggagccggagagacctgggctggcgcgggcgggag

SEQ ID NO: 23788 - DNA, 81 bp, Homo sapiens
gtgagtcaggggcagagcagggcggtctgagcgtgcgggcgacgcgggtctcactcgtccgctccgctctggactgcgcgc

SEQ ID NO: 23789 - DNA, 90 bp, Homo sapiens
cctgagcagtccggaggccgagcgcggggagttgggaaggggcgtggccctgcccgagctggcgccagggaggctcccacctgccagggg

SEQ ID NO: 23790 - DNA, 64 bp, Homo sapiens
gagcggcacagcctcccaccctcccggctggtgttagtgcccggacggcgggctctgcgctccg

SEQ ID NO: 23791 - DNA, 79 bp, Homo sapiens
ggcgggggctgcggcgagggcgggcgccgctggcgagggagggccgccagcatcctccctggccgcgccgcaccgcgcc

SEQ ID NO: 23792 - DNA, 74 bp, Homo sapiens
cccgcaccgcggcggcggcaggggcggtggcggcggggacgcggcggcgcccccagctcgcggcggcggcggtg

SEQ ID NO: 23793 - DNA, 63 bp, Homo sapiens
ggggtggggggaagcgcccgcggggcggggagggaccctgcaggcgcggactccacacccagc

SEQ ID NO: 23794 - DNA, 62 bp, Homo sapiens
ctgcggagcccaggacgctgggaggagcgttctgcgctcctccggtcgcggtctccgcacta

SEQ ID NO: 23795 - DNA, 95 bp, Homo sapiens
gggtgcagggggtcctggcgccgtccagcccggggcggagttctcagcaactccgcgcgccgggatcccggccgccctccccgcgcgcgtccccc

SEQ ID NO: 23796 - DNA, 55 bp, Homo sapiens
cgcgggaacgtcgccgtcaccttgtctcggggcctcggcgctgcttcccgccaaa

SEQ ID NO: 23797 - DNA, 81 bp, Homo sapiens
gggcgggtgccgggcgcgcctgctgcgcggggcgggacgcggactcccaggctctgcggagagcggctgccactcgcctct

SEQ ID NO: 23798 - DNA, 62 bp, Homo sapiens
cgcggcggcgccagagcgcggcgaggccctcacttccggcggcgcgggaggcgcccagcgag

SEQ ID NO: 23799 - DNA, 51 bp, Homo sapiens
tcgcccgggcccgcgccgccctcgttgcggccagcgcgctcccgagcggac

SEQ ID NO: 23800 - DNA, 72 bp, Homo sapiens
accagtggtgggaggaggctgcggcgctagatgcggacacctggaccgccgcgccgaggctcccggcgctcg

SEQ ID NO: 23801 - DNA, 65 bp, Homo sapiens
gtgtcacaaaggggcggggcgcggcggcagcggagcgttgtcggccagtgccttccgtgaagttg

SEQ ID NO: 23802 - DNA, 92 bp, Homo sapiens
agggagcctctgttggggctggaaccctgggaggggtagaattctcccctccactcagatttgttccctgttgctgcccacctggcccctgc

SEQ ID NO: 23803 - DNA, 79 bp, Homo sapiens
ggatgttctgggtcagctgtggggcaccaggttggcctgtggggtcatcgtgctccctctcctgggcctgagcatccac

SEQ ID NO: 23804 - DNA, 92 bp, Homo sapiens
ccagagacagggtgcagctacagtgtgcacagggacgacccctcctctgggcatctctcccctcatgtgtgtctgttccctgtctctctagc

SEQ ID NO: 23805 - DNA, 92 bp, Homo sapiens; identical to SEQ ID NO: 23804

SEQ ID NO: 23806 - DNA, 50 bp, Homo sapiens
cagctcgtgcaggtgcggtcctcaggtggggacagtacttcatgtaggga

SEQ ID NO: 23807 - DNA, 50 bp, Homo sapiens
ggcggctctgacgcagtcggagttttcacctcgcgcggttagagctcttg

SEQ ID NO: 23808 - DNA, 58 bp, Homo sapiens
aaaagtaattgtggtttctgccattaaaagtaattgcagaaaccagaattacttttgc

SEQ ID NO: 23809 - DNA, 72 bp, Homo sapiens
tgtcagtttgtcaaattctttcaccgaccagttttgttcccttgctggcgaggagttgtgatcctttggaga

SEQ ID NO: 23810 - DNA, 70 bp, Homo sapiens
cacctgtaagaaatgccagaggatcggttgtgggcccctcagaagaacttggctcagttcaccaggagaa

SEQ ID NO: 23811 - DNA, 51 bp, Homo sapiens
cgtccgtgtcgctctcgctggcgctgtccgccatggccgcggcgggctggg

SEQ ID NO: 23812 - DNA, 63 bp, Homo sapiens
agccttctttgctcatgctctagtctagatttgtgctttctgagcctgggcacaggggtcacc

SEQ ID NO: 23813 - DNA, 63 bp, Homo sapiens; identical to SEQ ID NO: 23812

SEQ ID NO: 23814 - DNA, 59 bp, Homo sapiens
aactgggtgtcatgacagaaaacagagcagatggttttgtggacatggcaccaagtgaa

SEQ ID NO: 23815 - DNA, 84 bp, Homo sapiens
cccctccaacctgggtgacagagcgagtttgagtctgtgtctcaaaagacacagtctcattctgttgcccaggctggggggcat

SEQ ID NO: 23816 - DNA, 61 bp, Homo sapiens
gcgcgcgccgcctgccctgagcgcctgcccacccagcgccgccggagcaggggcgccgcgc

SEQ ID NO: 23817 - DNA, 68 bp, Homo sapiens
ccgcgatcctcccgaggatgcgacggcagtgccgagcctttgtatcccgcggctgatgcgttgcggtg

SEQ ID NO: 23818 - DNA, 67 bp, Homo sapiens
tggctgttcccctggtggttgcatccaagtatctgtctttctttatggaccacgaagggaagcccac

SEQ ID NO: 23819 - DNA, 67 bp, Homo sapiens; identical to SEQ ID NO: 23818

SEQ ID NO: 23820 - DNA, 65 bp, Homo sapiens
tgccgctgctgttgctcctgaggctgctggctgaggccggaggatcgagcggcggcggcggcggc

SEQ ID NO: 23821 - DNA, 65 bp, Homo sapiens
ctaagaatgaccgctgaagaacgttgacccatttgagtacccggtctcagtcgtcatttttaagt

SEQ ID NO: 23822 - DNA, 65 bp, Homo sapiens
cgcccgggggctgcggctgggctgagtgtgtctttaaatctgagccccccgcccctcgcggtggg

SEQ ID NO: 23823 - DNA, 67 bp, Homo sapiens
tgggagccccggggtggcggtgggggcaggggagcctcctcccactgacctcacctctggcctcagc

SEQ ID NO: 23824 - DNA, 62 bp, Homo sapiens
ccatggtgagtccaggggtgcgcggccgcgatcggggcagcggggccggggcagccgcgggc

SEQ ID NO: 23825 - DNA, 54 bp, Homo sapiens
cggcgctcggcattgtggcaggcggctggggccggctagggcgccggagccgca

SEQ ID NO: 23826 - DNA, 73 bp, Homo sapiens
tgccaagcccagtggtcctggccgtgcgccggaggcagcggcggcgtggcgcagcggcgacagtaagtgcggg

SEQ ID NO: 23827 - DNA, 57 bp, Homo sapiens
gcctggacacctggagtcctggacacctggagtcctggacacctggagtcctggcct

SEQ ID NO: 23828 - DNA, 61 bp, Homo sapiens
taggagggcaggaaggtgggtcttcttgtgactgaaggtcccccggatctgcccctccaga

SEQ ID NO: 23829 - DNA, 73 bp, Homo sapiens
ggaggcgggaccaggggcggggcgaggccctcagccggctcccagggcactcaccctccctccccgccccgcg

SEQ ID NO: 23830 - DNA, 84 bp, Homo sapiens
ggggcggggctggagggcacccgggagcggtccggggtctgcggtgtccgcggcggcgcgtggggagcagcggccccgccagtt

SEQ ID NO: 23831 - DNA, 84 bp, Homo sapiens; identical to SEQ ID NO: 23830

SEQ ID NO: 23832 - DNA, 59 bp, Homo sapiens
ggtaggggcacgcggccgggatcccggagggccgaggtttccgggccgacccccactct

SEQ ID NO: 23833 - DNA, 53 bp, Homo sapiens
cccggctggacacgcagcggctcgcatcgcagagcgcagcgccggcgcggggc

SEQ ID NO: 23834 - DNA, 62 bp, Homo sapiens
ccaggacgcggggctggtcgcccagcagctctgagatgctcccagccctgctccctgtggca

SEQ ID NO: 23835 - DNA, 56 bp, Homo sapiens
ggcggcggcgcgggggcccgggcgggtccggcgcccgctcgctccgcgctgcccgc

SEQ ID NO: 23836 - DNA, 63 bp, Homo sapiens
cgctcggccaggccggcaccatgcggcccctgctctgcgcgctgaccggactggccctgctcc

SEQ ID NO: 23837 - DNA, 69 bp, Homo sapiens
ctggggcagccgcgcccgcggagttttccgcccggcgctgacggctgctgcgcccgcggctccccagtg

SEQ ID NO: 23838 - DNA, 55 bp, Homo sapiens
acctgaaagtgatctgtgatccaacctcttctggatcacagatcactttcagaaa

SEQ ID NO: 23839 - DNA, 58 bp, Homo sapiens
tttctgaaagtgatctgtgatccagaagaggttggatcacagatcactttcaggttgg

SEQ ID NO: 23840 - DNA, 67 bp, Homo sapiens
tgtgctaagtgaagtcagacaccaaaacattatgtggcttttggtgtctgactttgcttagcacaat

SEQ ID NO: 23841 - DNA, 67 bp, Homo sapiens; identical to SEQ ID NO: 23840

SEQ ID NO: 23842 - DNA, 60 bp, Homo sapiens
gagttcacaggagatctcgtcctttaaaagtgtatggacaagatcgtctgtgaactcagg

SEQ ID NO: 23843 - DNA, 67 bp, Homo sapiens
tgtaaatataccacaactgtttttattaaatcactatttttagttatcatgttgtctttatgagcat

SEQ ID NO: 23844 - DNA, 81 bp, Homo sapiens
cgcggccagcccgccctgcgtctccttcctcctccttcccgggctggggcccaggcgagcgagacgggccggagccgcggg

SEQ ID NO: 23845 - DNA, 74 bp, Homo sapiens
ggaaaaaacaaggtattgttcagacttatgatttttggggtcaaagattctgagcaataacctattaaaaaacc

SEQ ID NO: 23846 - DNA, 55 bp, Homo sapiens
agattgattgatggctctgtggcaaacactaccatagagccatcgatcaatatgt

SEQ ID NO: 23847 - DNA, 61 bp, Homo sapiens
tgttttctaatctgtgtactggaacacactttcataactggcacacagattaggaaacaga

SEQ ID NO: 23848 - DNA, 55 bp, Homo sapiens
agctctgggctgtcccgggctcagtctcgccggcggcccccgctcccggatcccc

SEQ ID NO: 23849 - DNA, 81 bp, Homo sapiens; identical to SEQ ID NO: 15377

SEQ ID NO: 23850 - DNA, 63 bp, Homo sapiens
ccgcctggcgccccggggtcacaagttgcctaacctgacctcggtgcgggccggtgggcggcg

SEQ ID NO: 23851 - DNA, 53 bp, Homo sapiens
ccacagagccggcgcgctcccgcctgcagggggagagcagacggggcgcgggg

SEQ ID NO: 23852 - DNA, 80 bp, Homo sapiens
cggagtggcggcggcagcggcggctagaagcggcagcccagagccctctcgcggccgcggcggcagcagcagcgccagcc

SEQ ID NO: 23853 - DNA, 52 bp, Homo sapiens
cgccgcggcgcgggccagcagctctgcgaggggccggagcgcggcggagcca

SEQ ID NO: 23854 - DNA, 52 bp, Homo sapiens
taacttgagacaactgagctgggatgtcccttctcagttgtctcaagttaga

SEQ ID NO: 23855 - DNA, 61 bp, Homo sapiens
caagctgttccgcgcgtcctgcccgtctgtccccgcgggtcgtcgcccgccacagccgcgc

SEQ ID NO: 23856 - DNA, 96 bp, Homo sapiens
ttgcctaaagtcacacaggttatagatctggattggaacccagggagccagactgcctgggttcaaatccagatctataacttgtgtgactttggg

SEQ ID NO: 23857 - DNA, 86 bp, Homo sapiens
gccccgtccgccccccgcctcccggaccttgggccgccctcgggtggctttttccctgcgggccggagggagcgcggacgggggcg

SEQ ID NO: 23858 - DNA, 69 bp, Homo sapiens
cggggctgggcgggcgccgcggcggagcagcgctaacgggctccctccccgggcgccctggggcctttt

SEQ ID NO: 23859 - DNA, 57 bp, Homo sapiens
ctggggacccggtttggggctggggcgcggagcctagcccaggaccggccctcgggc

SEQ ID NO: 23860 - DNA, 65 bp, Homo sapiens
tcagcaaggttgaagaatacaagataaatatgcaaaaacatcgattgtatttctacatactagca

SEQ ID NO: 23861 - DNA, 52 bp, Homo sapiens
ggcggggcttggggacgggggaggaagaaacctccccctcccaccccgtcac

SEQ ID NO: 23862 - DNA, 50 bp, Homo sapiens
cctgccacgcgggaggcctccgggagagggcagagggcgccgggcaggga

SEQ ID NO: 23863 - DNA, 53 bp, Homo sapiens
ccccgccctttcccgggacgcggggccggctcggggcggggagcgggcgggcg

SEQ ID NO: 23864 - DNA, 70 bp, Homo sapiens
gctgctcatctgctcctacctggacatgcgggccctcggccgcctggcccaggtgtgccgctggctgcgg

SEQ ID NO: 23865 - DNA, 56 bp, Homo sapiens
aaagagctgtggtagaaagtaaggttgcaaatcactttctaccacagctctttgtt

SEQ ID NO: 23866 - DNA, 60 bp, Homo sapiens
ggagcgcggcccggggtggagagagatacaccacactgcccaccccggctccgcctcccc

SEQ ID NO: 23867 - DNA, 57 bp, Homo sapiens
tggggagcatcaggatcaagatgcctgaaggatcctgaccctgctcttgctctcagg

SEQ ID NO: 23868 - DNA, 59 bp, Homo sapiens
ggccctgagccctgctggcaggcgaggtgtcgcgaccggtcccaggtgggtcgggcgcg

SEQ ID NO: 23869 - DNA, 56 bp, Homo sapiens
aggggttggaaggcaagtgggtctcgggcctggctcaccctgctttcatccccaga

SEQ ID NO: 23870 - DNA, 87 bp, Homo sapiens
tgcggcggcttcagctcaggcccttgctcttcctggggcggccgcgctccgcggcttcccgggctgggctgctgtcgccgctgtcgg

SEQ ID NO: 23871 - DNA, 87 bp, Homo sapiens
aggaggaggaggagggactcggcgggaggatggtgagtgtgggggcctgggcccccttggagccggccggttatccccctcccgtcc

SEQ ID NO: 23872 - DNA, 53 bp, Homo sapiens
ctcgtcgctcggcctcggcctggcctatcgccggccgccggcgtccgacgggc

SEQ ID NO: 23873 - DNA, 62 bp, Homo sapiens
cggcgcactaggatcgggccggcgcccggcagacgagggccagctacgtccctgacgccgct

SEQ ID NO: 23874 - DNA, 54 bp, Homo sapiens
acctcccaattctttgcatcgctagggcaagccatgcaaagaattgggaggtga

SEQ ID NO: 23875 - DNA, 56 bp, Homo sapiens
tcacctcccaattctttgcatggcttgccctagcgatgcaaagaattgggaggtga

SEQ ID NO: 23876 - DNA, 95 bp, Homo sapiens
tgctcggctgttcctagggtgtttctctcatctctggtctataatgggttaaatagtagagatgagggcaacaccctaggaacagcagaggaacc

SEQ ID NO: 23877 - DNA, 84 bp, Homo sapiens
agaagcactagtctatgaccatggttctctatgagtaaacatagttaaccacagagaaccatggtcatagactagtgcttccga

SEQ ID NO: 23878 - DNA, 73 bp, Homo sapiens
tagagtcaactctcattgtgaaatctgttttgttagaccatatttaggtttcacaatgaggattgactctaac

SEQ ID NO: 23879 - DNA, 77 bp, Homo sapiens
tctccgggcgctggaggcgccgccggcgacccccccctaggcctcgcaggcgctgcctccgcctatccccgctgacc

SEQ ID NO: 23880 - DNA, 70 bp, Homo sapiens
tgccggcgttagagcgagaggaagtggaaggcgcctcttcgttctctcttccgcgcttcgctgagggact

SEQ ID NO: 23881 - DNA, 51 bp, Homo sapiens
ccactccctgagggtcctaaggtgaatctcaaagaccctcagggagtaagc

SEQ ID NO: 23882 - DNA, 51 bp, Homo sapiens; identical to SEQ ID NO: 23881

SEQ ID NO: 23883 - DNA, 52 bp, Homo sapiens
gtgtgcgtatgtgtgtgtgtgtatatatatacacacatatatacgcacacac

SEQ ID NO: 23884 - DNA, 60 bp, Homo sapiens
tgtcccttctttaagagtgtctggttgctttgctgacaaacacctcagaaaagggacaga

SEQ ID NO: 23885 - DNA, 75 bp, Homo sapiens; identical to SEQ ID NO: 15471

SEQ ID NO: 23886 - DNA, 57 bp, Homo sapiens
agactggccagagatctttagactcttacttagtttgaacatctcttgctgctcaca

SEQ ID NO: 23887 - DNA, 84 bp, Homo sapiens
aatagtcgttgaggtctcagccccctaaggtctccaagctcatttgaccagcgcagctgcgacttcggctgtctgcctctggca

SEQ ID NO: 23888 - DNA, 63 bp, Homo sapiens
tcctccgtgacagactgcagaccatgttagaagagaaggaaggtttgtggatcaagagggttg

SEQ ID NO: 23889 - DNA, 62 bp, Homo sapiens
cgcccggcctgtgtggtgctcagatcagacttatccacccgagcaccacgcagaccagcgcc

SEQ ID NO: 23890 - DNA, 76 bp, Homo sapiens
gccgctcgccccgacccagccgcccgatgtcctcaaaatggaggcagcgggggcggcggcgtgaagaaagcggcgc

SEQ ID NO: 23891 - DNA, 58 bp, Homo sapiens
gggggagcacaggggccccagatgtgatgactgctctgagctctctgcactcccaggc

SEQ ID NO: 23892 - DNA, 61 bp, Homo sapiens
tcctcctcgggcgcccgcggcgatgttcaaccgcgccgtgagccggctgagcaggaagcgg

SEQ ID NO: 23893 - DNA, 103 bp, Homo sapiens
gagtcagaattctcatcaggctgtgatgctcagttgtgtgtagattgaaagccctaattttacacacaactgaggatcatagcctgatggttcctttttgttt

SEQ ID NO: 23894 - DNA, 70 bp, Homo sapiens
aggctatgatcctcagttgtgtgtaaaattagggctttcaatctacacacaactgagcatcacagcctga

SEQ ID NO: 23895 - DNA, 70 bp, Homo sapiens; identical to SEQ ID NO: 23894

SEQ ID NO: 23896 - DNA, 62 bp, Homo sapiens
gaaagtaatggtgggttttgcctttaaaactaatggcaaaacccacaattacttttgcacca

SEQ ID NO: 23897 - DNA, 65 bp, Homo sapiens
cacgctcactccgtgtccgcgaccgtcgtcgccggcggaaagcgagccacgggagggagtgtgtg

SEQ ID NO: 23898 - DNA, 90 bp, Homo sapiens
ggtacaagagtaggttacagcctgtttacacatctaggacagagcccaagctgtatcctacaaacaggctgtaacctactcttgtaccca

SEQ ID NO: 23899 - DNA, 62 bp, Homo sapiens
agtcccagcccagtgccctccagctcagccctaaggtgccagggcaacgtggctgggtctaa

SEQ ID NO: 23900 - DNA, 57 bp, Homo sapiens
gcacccgggcgctgctggcggccaagctggatgggtcgccagtgagtttcggtgcgg

SEQ ID NO: 23901 - DNA, 61 bp, Homo sapiens
tgctgggggagcagggggaggattgtttcacccactcttgtctccccgcgtcccccgcagc

SEQ ID NO: 23902 - DNA, 62 bp, Homo sapiens
agaggcccaggctctggaagacctgactggctttaaagagctcttccagacccctggtcata

SEQ ID NO: 23903 - DNA, 56 bp, Homo sapiens
ttgattctcatagattcataacagaaaggctgggagggactgtcagagcatcaggt

SEQ ID NO: 23904 - DNA, 55 bp, Homo sapiens
gcagcccggccgagcccggcaccatccagacccagggcggcggcggcggcggctc

SEQ ID NO: 23905 - DNA, 58 bp, Homo sapiens
gtcctcaattcccaggctgggaggagccctgcccggcggcgctgggtcgccaggacaa

SEQ ID NO: 23906 - DNA, 88 bp, Homo sapiens
gtgagcgcggcggggctcgggagagcagagccgggggcccgcgtcctgcgaacggccccagcgccagccccgggccccgcggccgcct

SEQ ID NO: 23907 - DNA, 64 bp, Homo sapiens
gcctggcaccacggggacgctcccagggggtgcccagagggaacgtgcgcatcgggcggggtac

SEQ ID NO: 23908 - DNA, 59 bp, Homo sapiens
ctggaggggcacgggggtcccagctctgacccaggctctcggccctgtctcctccagcc

SEQ ID NO: 23909 - DNA, 80 bp, Homo sapiens
ctgggagggagagactcagggtgtggtgctggggccccatggccggacactgaccatgcgccctgtgcttcctccccagg

SEQ ID NO: 23910 - DNA, 61 bp, Homo sapiens
cagaggaggtcagctgcgggagcgtttccggggacggtgccgccatgagattgaccccgcg

SEQ ID NO: 23911 - DNA, 60 bp, Homo sapiens
tggtcagtgcctcctgtgttggccgcaatgctgtgctcctcacagctggcgctgaccgct

SEQ ID NO: 23912 - DNA, 60 bp, Homo sapiens; identical to SEQ ID NO: 23911

SEQ ID NO: 23913 - DNA, 66 bp, Homo sapiens
ggggcggcggcgggaccgaacagcatccacggctgccaccgcggatcgggccccggccgcgcgcgc

SEQ ID NO: 23914 - DNA, 71 bp, Homo sapiens
gccccagcgtagcacccacccccctgacggtcccgccccgcagggagggcctgtgccggctgctggagctc

SEQ ID NO: 23915 - DNA, 63 bp, Homo sapiens
ctgaggggcaggaggtgggagtggggaattcaagcccatccctctctgacctgcctacctggc

SEQ ID NO: 23916 - DNA, 62 bp, Homo sapiens
ccgtgggcagggccgggtgtggccggcgtcccatactctggctgaccctggcgcccacagac

SEQ ID NO: 23917 - DNA, 73 bp, Homo sapiens
tgtacgtgtgtatgcgtgtgtgtacgcgtgtgtacgcgcgtgtgtacacatgcgtggccgcctgtggtgtgca

SEQ ID NO: 23918 - DNA, 73 bp, Homo sapiens
ggacgggcgcggggcggggcgtgcgcaggcccgcccgagtctccgccgcccgtgccctgcgcccgcaacccga

SEQ ID NO: 23919 - DNA, 64 bp, Homo sapiens
gtggctccttgcacctgtggctgcctgtggatggggaaggtgcccagaggatcacggagccact

SEQ ID NO: 23920 - DNA, 64 bp, Homo sapiens; identical to SEQ ID NO: 23919

SEQ ID NO: 23921 - DNA, 58 bp, Homo sapiens
tggcagctctgcagggaggcaaggctcgctgtgctccctccactgccgtgttgccagc

SEQ ID NO: 23922 - DNA, 64 bp, Homo sapiens
accggagctttgccacagcagcacttgagccgggggccatagtgcttgtggacaaggacggcga

SEQ ID NO: 23923 - DNA, 61 bp, Homo sapiens
gagggtggcaggccgcgcctcagcccacaggcaggtgctcagggggcctgtctgccccagg

SEQ ID NO: 23924 - DNA, 70 bp, Homo sapiens
gggggttcttcgcgtgcggccgggccgggccgggcagtctgggacgcgccgccgccatgatcatccctgt

SEQ ID NO: 23925 - DNA, 69 bp, Homo sapiens
tcccggggccgagcctcgctgcccggcgcgcccactttgcgggagggaaactgaggccgtgcaaggagg

SEQ ID NO: 23926 - DNA, 64 bp, Homo sapiens
tgtcgccgccgcccgggggtccccgtccctccctagcccgatcccccggagccgcggccccacc

SEQ ID NO: 23927 - DNA, 71 bp, Homo sapiens
gcccgcgggggcgccccggccgggtcggcgcggacggcactcggcggacgcgggcggacgctgggcggccc

SEQ ID NO: 23928 - DNA, 62 bp, Homo sapiens
ggcactgaccacgtcactggatctgattagccagattcagtgtctggtgagggtccctttcc

SEQ ID NO: 23929 - DNA, 62 bp, Homo sapiens; identical to SEQ ID NO: 23928

SEQ ID NO: 23930 - DNA, 60 bp, Homo sapiens
tgaggacccccagtgcccacaggttcagagagggaggtctggcgggcgctgcggggcagc

SEQ ID NO: 23931 - DNA, 50 bp, Homo sapiens
cactgactttctgggtgaaccaccagctgtggtcttgctctcagcagggc

SEQ ID NO: 23932 - DNA, 60 bp, Homo sapiens
tgggcagctgggtgggcctgagctagggcagcagggcctggctcacgccgctgcctcaga

SEQ ID NO: 23933 - DNA, 78 bp, Homo sapiens
cttccctccccaggcctcgcttccccagccttctgaaagaaggaggtttaggggatcgagggctggcggggagaagca

SEQ ID NO: 23934 - DNA, 69 bp, Homo sapiens
gccccgacggggagccaagaagcgggttctcaccagcaaccgcatctgctggccccttgatctgggccg

SEQ ID NO: 23935 - DNA, 61 bp, Homo sapiens
ttccagaaggcagccgggtgattcttgggaaagatctagaatccccaagctttctgggagc

SEQ ID NO: 23936 - DNA, 60 bp, Homo sapiens
ctggggaggggcgcccgcaccctggggcagtggggcagccgcgggtgtctccctcccagg

SEQ ID NO: 23937 - DNA, 84 bp, Homo sapiens
cgatggcacctgcccggatgcacctccgcatgggtggggtctggcctcggccatgggaggtgcttctcaggctcctccatcgcc

SEQ ID NO: 23938 - DNA, 61 bp, Homo sapiens
tctagcgctggacacatgaagacaccatctctgtctttatgtggcttacagtttatggggc

SEQ ID NO: 23939 - DNA, 61 bp, Homo sapiens
tgcgctcggagctttgacttgagaatccatatccttcgttcagcacaaagtttctgagcgc

SEQ ID NO: 23940 - DNA, 51 bp, Homo sapiens
cggcgccgcggccgcgcggggaaggattcccgggaggcactctgcgccgct

SEQ ID NO: 23941 - DNA, 63 bp, Homo sapiens
cgcgccgtcgggcccggctcgcagcagcggcggtggaatgcgcgggagggccctggccgtgcg

SEQ ID NO: 23942 - DNA, 79 bp, Homo sapiens
gcgggagcctcgcgagcagcagctgcccgggccgggccgcagccggagcctgagccgcgcgcgcgtccttcctccgcgc

SEQ ID NO: 23943 - DNA, 80 bp, Homo sapiens
cagctcgctggtggtgctgaggctgtcttcattgaggctggagggtgaggacggcagactcagctgagccagcagcagca

SEQ ID NO: 23944 - DNA, 62 bp, Homo sapiens
gcgaagggccgggaggctgggcagtcctggtgcccgccttggcctagccccggccccgggac

SEQ ID NO: 23945 - DNA, 86 bp, Homo sapiens
ccggccccgcccgccccccgagccccggcctcattttcacacggtccctcccgggccggggcgggaagcgcaggcgggagcagtgc

SEQ ID NO: 23946 - DNA, 71 bp, Homo sapiens
gcgctggggcgagagcatgcgcagtcgcggcactcgagtcacccggctgcgactcgctggccctggcgtct

SEQ ID NO: 23947 - DNA, 73 bp, Homo sapiens
cggcctggacgcacccccctcgctgctcctccggtgctgggggatctgaagaggggcaggcggccgggcagcg

SEQ ID NO: 23948 - DNA, 64 bp, Homo sapiens
ggttgaggcctggagcccccgggcgcagcgccgggacactacccggctccaggtcctcggcttc

SEQ ID NO: 23949 - DNA, 52 bp, Homo sapiens
ccgggccgcctcgctcgctcccagctctgtcagtggcccgcggggcccgatc

SEQ ID NO: 23950 - DNA, 63 bp, Homo sapiens
tgctgcaaaggtaattgcgatctttgccatcttaatggtaaaaaccacaattacctttgcacc

SEQ ID NO: 23951 - DNA, 89 bp, Homo sapiens
gacggaggtgcctgtttacccgcgccggactcaccgccgccgccgccgcgggatccgagtgcgggcgcgggcgcgggcgctcccggcga

SEQ ID NO: 23952 - DNA, 61 bp, Homo sapiens
aagctttcggcggcggctgagccagctgaggggaaaaatggctcggactgtggcggcttcg

SEQ ID NO: 23953 - DNA, 57 bp, Homo sapiens
accgtgcccagccatatttattaatcttaagaggtgttggtttgctgggcgcagtgg

SEQ ID NO: 23954 - DNA, 56 bp, Homo sapiens
gttatcctgtccatttgactctattttctgagagaggcaaatggataggataacac

SEQ ID NO: 23955 - DNA, 67 bp, Homo sapiens
tagcagcattatttataatggccaaagagtgggaacaacctagatagccatcgactgatgaatagat

SEQ ID NO: 23956 - DNA, 64 bp, Homo sapiens
gctaattggattacaaggtacacattaaagaattagactgtatatttgttgcccatttagccaa

SEQ ID NO: 23957 - DNA, 57 bp, Homo sapiens
agctaaatgtgtgctgggacatttggctcaaatgtgtcccagcacacatttagctca

SEQ ID NO: 23958 - DNA, 62 bp, Homo sapiens
gaggggcaaggatagtggggtggttttagttgggagaccaccacttccaatgccccatcccc

SEQ ID NO: 23959 - DNA, 56 bp, Homo sapiens
cggggcgggcactggcggagggactggccagtcccctcctccgcgccggccccaac

SEQ ID NO: 23960 - DNA, 50 bp, Homo sapiens
gcgtcaggaatgggccccaatcgccgtgggccccgcaccctgcgtcgccc

SEQ ID NO: 23961 - DNA, 62 bp, Homo sapiens
gccacccccgttcccggcagcctcgccccctagttctgcaggagccggcccgggggaggggg

SEQ ID NO: 23962 - DNA, 62 bp, Homo sapiens
ggcggcgggggcccggtccctgtcccaggcgctccccgccccggcgcccccgcccccgccac

SEQ ID NO: 23963 - DNA, 55 bp, Homo sapiens
agttggtgcaccttccagacactgcatccatgtgtcaaggtggcaaattaccaga

SEQ ID NO: 23964 - DNA, 63 bp, Homo sapiens
tggtgaggctggggcgtctgaggccgggacacccagcctccctctgactctccgcctctcccc

SEQ ID NO: 23965 - DNA, 51 bp, Homo sapiens
gcgtcccgacccggccccggagaaaactcccggggccccttaggcccgcgc

SEQ ID NO: 23966 - DNA, 61 bp, Homo sapiens
agtcatggcggcgactgtggcgacggcggcagctgtggccccggcgccagcgcccggcacg

SEQ ID NO: 23967 - DNA, 58 bp, Homo sapiens
cggcggcggcagcggcttcccgggcacctgggcgtggggagcgggggcgcgcggcgcg

SEQ ID NO: 23968 - DNA, 60 bp, Homo sapiens
gctcagggaaggaggggtggccccaggaggtccagccctgccatgcctcctgccctcagc

SEQ ID NO: 23969 - DNA, 72 bp, Homo sapiens
ccacagacagggatgctgcattcctgcctcctcacggtggggtctgtagtgtagcaccagggtcccgtggtg

SEQ ID NO: 23970 - DNA, 64 bp, Homo sapiens
gtgccccccagtgcagacgcggaactggcgcccgctcggagcggcgccgcgctggggagcgact

SEQ ID NO: 23971 - DNA, 69 bp, Homo sapiens
tactgagttgcagtagggtatcagcttctgatgctaatgtgtctgattcctgctgtctgcttctcaggg

SEQ ID NO: 23972 - DNA, 69 bp, Homo sapiens; identical to SEQ ID NO: 23971

SEQ ID NO: 23973 - DNA, 50 bp, Homo sapiens
cggcacgcggcgcctcgggttccggacaggccccttgtgacgtggccgcg

SEQ ID NO: 23974 - DNA, 62 bp, Homo sapiens
ggtggctccgtctgtctgtccgtccgcccgcgggtgccatcatggcggacgcggccagtcag

SEQ ID NO: 23975 - DNA, 60 bp, Homo sapiens
tcctccaccacctcctcctgcggaagatggtgagatccaggaggtagagatggaggatga

SEQ ID NO: 23976 - DNA, 60 bp, Homo sapiens; identical to SEQ ID NO: 23975

SEQ ID NO: 23977 - DNA, 77 bp, Homo sapiens
cctcgagagctgataagaacagaggcccagattgaagttgaatagtgctgggcctttgtttttaccaagttccctgg

SEQ ID NO: 23978 - DNA, 58 bp, Homo sapiens
tgatgatgaagatggtgaacatggtggttaccagatgtttaccatcttcattgtcatt

SEQ ID NO: 23979 - DNA, 54 bp, Homo sapiens
ccgaggccgggccgctgcggccgccgccgccgcagctgtgtcccgccggaggaa

SEQ ID NO: 23980 - DNA, 66 bp, Homo sapiens
agggagggagagcgcgaggcgccgccccggctccccggcgggtcgcacctccagttccgccccacc

SEQ ID NO: 23981 - DNA, 60 bp, Homo sapiens
gagggaaagatttgttgcaagtcaactgggaaggagacatgctcaaatctgtctccccaa

SEQ ID NO: 23982 - DNA, 78 bp, Homo sapiens
ctgcagggagggggcggctacttccctgctggggctggggtcctggctggagctgagccgccccccttccccgcagct

SEQ ID NO: 23983 - DNA, 73 bp, Homo sapiens
gagctcgggagcggggaccggtagccgactgcctctgggacagcggtggcgtctctgtgcccgtttagtggag

SEQ ID NO: 23984 - DNA, 82 bp, Homo sapiens
gtgaggccgcggggatcgccggggtgggaccggtgggcccgagggctcagccgccaccgcaactcttccctccggcccaggc

SEQ ID NO: 23985 - DNA, 82 bp, Homo sapiens; identical to SEQ ID NO: 23984

SEQ ID NO: 23986 - DNA, 60 bp, Homo sapiens
tgagagaacttcgcccttgttgcccaggctggagtgcaatggcgcgatctcctctcacct

SEQ ID NO: 23987 - DNA, 55 bp, Homo sapiens
gttgctggtcggcctgaaagtaactctaaagagtgcgtgggtcggaggacatcgg

SEQ ID NO: 23988 - DNA, 86 bp, Homo sapiens
agggccgggcaggagctggggcaggggcaggggctgaggagcatcaagcttggttagcactgtccccctcacccctctcgcccagg

SEQ ID NO: 23989 - DNA, 68 bp, Homo sapiens
ggggtggcatgggggccagggtgctgcggacccggtccagggccctgactcgtccatgcctgcccagc

SEQ ID NO: 23990 - DNA, 54 bp, Homo sapiens
cagagaggggcctgggccccagccccgcaggggacgggccctcaggctccggca

SEQ ID NO: 23991 - DNA, 56 bp, Homo sapiens
gccgccgagtgaggggacgcggcgcggtggggcggcgcggcccgaggaggcggcgg

SEQ ID NO: 23992 - DNA, 60 bp, Homo sapiens
tggaggagctggggagggtttcggggaggaagcctcagcacccctcttgctcctaccagc

SEQ ID NO: 23993 - DNA, 50 bp, Homo sapiens
cggcggcaagttctgcagcgaaggtgagccccggggagcggccgcccggt

SEQ ID NO: 23994 - DNA, 73 bp, Homo sapiens
tggagggtgaggagtggctatcagtgaggggagaggccagcaaggtgctgaggccactcctcatgcccccagt

SEQ ID NO: 23995 - DNA, 73 bp, Homo sapiens; identical to SEQ ID NO: 23994

SEQ ID NO: 23996 - DNA, 60 bp, Homo sapiens
gagttgtcccccgcggccactcccggggttaaacggtctggcccgggatggtgcaacccg

SEQ ID NO: 23997 - DNA, 50 bp, Homo sapiens
gtgaggtggccgggctgtgcggcgcaactgtatagactgggggcccacta

SEQ ID NO: 23998 - DNA, 76 bp, Homo sapiens
tgggcggggtggggcggggcctggtggggggcagcgcaggcccagcccggtgcccactgcctgctcccctgccagt

SEQ ID NO: 23999 - DNA, 58 bp, Homo sapiens
aggggtaggggccacagagcagggcacccggccatcccatctgtgaccccacctctag

SEQ ID NO: 24000 - DNA, 69 bp, Homo sapiens
tctgcgcggggcgcggtggggttctgcggggtcggaaagactccccagatccccgcgcggccccagacc

SEQ ID NO: 24001 - DNA, 68 bp, Homo sapiens
gggctgggctgtgcgcctgcgcagtgtgggtcgctcccgattccctgccccggccggccccgcctcgg

SEQ ID NO: 24002 - DNA, 75 bp, Homo sapiens
ggggagggaaggggctgacggcaggcagggtctgcagtcactggccaccaccatcagcacctttgtcctcccagg

SEQ ID NO: 24003 - DNA, 58 bp, Homo sapiens
cttgggcagcagcggcagccatcttggttttaggaaatggggccgcctggcccagcca

SEQ ID NO: 24004 - DNA, 58 bp, Homo sapiens; identical to SEQ ID NO: 24003

SEQ ID NO: 24005 - DNA, 67 bp, Homo sapiens
gcttcctcccgccgtggcttccgcgtcgcttcccggtcagctgcgtccttagcgggagcccgagtgc

SEQ ID NO: 24006 - DNA, 66 bp, Homo sapiens
gggggcggggcggcccagaaggccagcggggtgctgcgaggggacgtggaacgctccgcaccccaa

SEQ ID NO: 24007 - DNA, 63 bp, Homo sapiens
ggcacccgcgcaggggccgctgggagtcccgcgctgcctcccctgcccccgcgccggggccac

SEQ ID NO: 24008 - DNA, 70 bp, Homo sapiens
aggctcgggtcctggctgcactcatctatgtctgcggggcaagagtagcgcagctggaaacccagcccct

SEQ ID NO: 24009 - DNA, 70 bp, Homo sapiens
ggcggggctggctctgggcctcagacactctggaatcgccaaggtctgagctcagggcctggcccccttc

SEQ ID NO: 24010 - DNA, 83 bp, Homo sapiens
ctgggggaggaggaagaggagatggggaggcaggtgagcctgaccaagcagcctgctccctttctccctccccttccccctcc

SEQ ID NO: 24011 - DNA, 62 bp, Homo sapiens
gggggtggggctagtgatgcaggacgctggggactggagaagtcctgcctgaccctgtccca

SEQ ID NO: 24012 - DNA, 72 bp, Homo sapiens
actacggctcccggcagcccccgcgccggcctgcgcgcttctcatcgcctgggctcctggggatcgtggtcc

SEQ ID NO: 24013 - DNA, 63 bp, Homo sapiens
gccggccgttccgcgaggggcgccccagcgcgcgccccgaacccctccccccgcggccggtgt

SEQ ID NO: 24014 - DNA, 58 bp, Homo sapiens
atccgggccaagctgcggctgcaggctcagtccctgagcacagtggggccccggctgg

SEQ ID NO: 24015 - DNA, 53 bp, Homo sapiens
gggcacccctcggggctggcgggccctgggaactgcgccccgggcgggtcctc

SEQ ID NO: 24016 - DNA, 59 bp, Homo sapiens
ggggtctgggaggcaggggcccgggcagccctgagcccaacccctggctccctctccca

SEQ ID NO: 24017 - DNA, 88 bp, Homo sapiens
ctgttgctggcctgggcggccgcagggcccacactgggccaggacccctgggctgctgagccccgtgccgcctgcggccccagcagct

SEQ ID NO: 24018 - DNA, 67 bp, Homo sapiens
agggtattcctgcagcagccagtcttagtcattatggcaacctggtgctggagagcaggcccaggca

SEQ ID NO: 24019 - DNA, 65 bp, Homo sapiens
tggggctcagtcggctgctgcggccactggctcctatggtgccgcagcagcctacggggcccaac

SEQ ID NO: 24020 - DNA, 60 bp, Homo sapiens
taccctgactgtccctctgtagactgttgagactgagttcctgttgggacagtcagttgg

SEQ ID NO: 24021 - DNA, 60 bp, Homo sapiens; identical to SEQ ID NO: 24020

SEQ ID NO: 24022 - DNA, 76 bp, Homo sapiens
cgcgccgcccggaagccaccgcggcccccctcactcctagaggaagggagcaccgcgaggctcacggcagggccct

SEQ ID NO: 24023 - DNA, 57 bp, Homo sapiens
tataaaatgggggtagtaagacaaggaaggaaggtcttactgccctcattttataga

SEQ ID NO: 24024 - DNA, 58 bp, Homo sapiens
gggtggaggtgggcaggggcgatgcgagcattgtgaccccttaccagctcccacccct

SEQ ID NO: 24025 - DNA, 57 bp, Homo sapiens
ggtggggagcagggtccttggggccactgtgaccctgggttcctcatctccccccag

SEQ ID NO: 24026 - DNA, 56 bp, Homo sapiens
agcccaggctggggcggggcctcggaagcaactgccctcgccctagccagggctgc

SEQ ID NO: 24027 - DNA, 60 bp, Homo sapiens
ggcgacccgggtcctcgaggccgagatctggctgtggcccgcgaagccccgcttgcccgc

SEQ ID NO: 24028 - DNA, 63 bp, Homo sapiens
ctctggggctgcggctcctacggcccgcctcgctggggctccaggttgccgcctccccaggtc

SEQ ID NO: 24029 - DNA, 58 bp, Homo sapiens
gtgaccggggaggcccgcggcgcccgccagccagctgctcctggctcccccggcacgc

SEQ ID NO: 24030 - DNA, 53 bp, Homo sapiens
ggggtgtcgggggaggggtgctgaggtgcagccagcctcccccaccaccccag

SEQ ID NO: 24031 - DNA, 53 bp, Homo sapiens
gagcagtggtgagggcgggggctcccacccccagcccggctcacccaccacct

SEQ ID NO: 24032 - DNA, 52 bp, Homo sapiens
ccctccccaccccggcggggtccgggcagccccgcctgcagcggaggaggca

SEQ ID NO: 24033 - DNA, 59 bp, Homo sapiens
tggtgggggaggcagggcaggaggttggagcagccctgcccagccccgtggccgccagc

SEQ ID NO: 24034 - DNA, 83 bp, Homo sapiens
cttggaaactgtgactttaagggaaatggcgcacagcagaccctgcaatcatgccgttttgcttgaagtcgcagtttcccagg

SEQ ID NO: 24035 - DNA, 75 bp, Homo sapiens
ccggtggcaaggtggatgcaatgtgacctcaactcttggtcctctgaggtcacattgtatccaccttaccactgg

SEQ ID NO: 24036 - DNA, 78 bp, Homo sapiens
tgtaagccaaggagctggggcattggggcaggcagtgccgttggctgatgctgtctcccccggcgcctctctgccagg

SEQ ID NO: 24037 - DNA, 72 bp, Homo sapiens
actggacggcttgaacgcgcctgtgggtccgtggttgaactttgtctccacgggagcgtcggtctcggtgag

SEQ ID NO: 24038 - DNA, 65 bp, Homo sapiens
atgagggctgagtttgcacagtggtctggaatggactgggtgccacggtggacttagctctgagg

SEQ ID NO: 24039 - DNA, 65 bp, Homo sapiens; identical to SEQ ID NO: 24038

SEQ ID NO: 24040 - DNA, 71 bp, Homo sapiens
accaccaggcccaaaggagccagacagtggcaggaagcctggctcctgctcctcctctgagctggtggtct

SEQ ID NO: 24041 - DNA, 54 bp, Homo sapiens
ggaaaggggaagctgcctgtggcctgggctggtggcacagcttcctctttctct

SEQ ID NO: 24042 - DNA, 77 bp, Homo sapiens
cgggcccagcctgggccgcgggcgcggcagcgagggcaacccgggcccgccgcgtcggcggcgcgttgggcgcagcc

SEQ ID NO: 24043 - DNA, 64 bp, Homo sapiens
agctgagcctgcggggctggccctggcctggctgctgctgcctgcagcccccagctcaggctcc

SEQ ID NO: 24044 - DNA, 95 bp, Homo sapiens
ctcatctgtctgttgggctggaggcagggcctttgtgaaggcgggtggtgctcagatcgcctctgggcccttcctccagccccgaggcggattca

SEQ ID NO: 24045 - DNA, 63 bp, Homo sapiens
tgagggatggaatctcctagcctggagataattaaataaggcttagatctccctctctccctt

SEQ ID NO: 24046 - DNA, 55 bp, Homo sapiens
ctcctgtcctgagcttgaggactcccctcccagccctccagctcagcccaggaaa

SEQ ID NO: 24047 - DNA, 69 bp, Homo sapiens
ctgcgggaggcggggcgggcacggctccaccggagccgcagccgccgccgccgcgccggggagggggag

SEQ ID NO: 24048 - DNA, 54 bp, Homo sapiens
cggacttcggactcgggcctggagaccgcctcctacccagagccggagcccgca

SEQ ID NO: 24049 - DNA, 84 bp, Homo sapiens
ggcggggcgggcggcccggcggggactaggcggcgcggcgcggcgcgagcccggcagcctcgcgcgcgcccgctcccccgcccc

SEQ ID NO: 24050 - DNA, 54 bp, Homo sapiens
cggcgcgggggggcgccacgcaggtgatgggcgcctctccgggggccacgcgcg

SEQ ID NO: 24051 - DNA, 70 bp, Homo sapiens
cgcgggagggcgcgcgcgcgcgcccctttttcagcagtgtggcggggtcgcacgcacgcccgcctcggcg

SEQ ID NO: 24052 - DNA, 60 bp, Homo sapiens
attactatttaccccatacacatgggggtgttggtggtggtgtgaggtaagtagcagtga

SEQ ID NO: 24053 - DNA, 55 bp, Homo sapiens
cggggcaggcatgggagccgcgcgctctctcccggcgcccacacctgtctgagcg

SEQ ID NO: 24054 - DNA, 55 bp, Homo sapiens
tcgcccttttcgctcgcggtttgggaggaggagactgcgagagacaagcgcgagg

SEQ ID NO: 24055 - DNA, 53 bp, Homo sapiens
ttcgaggctacagtgagatgtggcaggatcacatctcactgtagcctcaaacc

SEQ ID NO: 24056 - DNA, 56 bp, Homo sapiens
cggctgcggggcaggtcccggcggccatagcgcgccacctgcacccgcagctcgcg

SEQ ID NO: 24057 - DNA, 58 bp, Homo sapiens
ggaagatgggggcgggtggaacaacgggccggtgaggagcagccgccgccgtctccgc

SEQ ID NO: 24058 - DNA, 53 bp, Homo sapiens
taaattagaggagagcagtttgggtctggacaaactgctcttctctaatttaa

SEQ ID NO: 24059 - DNA, 66 bp, Homo sapiens
tgggcgccggagacgcgcaagggcgccgatggaggcagactcgccagcgggccccggcgccccaga

SEQ ID NO: 24060 - DNA, 66 bp, Homo sapiens
cgcaggctccctttcccgcccgctgtcccgcctcgtctccctcgggcgggaacgcgagccagtgcc

SEQ ID NO: 24061 - DNA, 69 bp, Homo sapiens
agtggcggctgcagaaagcgtggagtgaatggaccagagaccgagccgcgctgctgccgccgccgccgc

SEQ ID NO: 24062 - DNA, 66 bp, Homo sapiens
tgcggagctgcagcaggacgacgcggccggcgcggcagacggccacggctcggtgggctccgcggc

SEQ ID NO: 24063 - DNA, 63 bp, Homo sapiens
agctggcggggctgccggggccgggactgggggagccgggcccgcgggccgcctgctgcctcc

SEQ ID NO: 24064 - DNA, 69 bp, Homo sapiens
cggtttctgaggtgggtggcggggagaataaagagccagtcaagtctccgccctcctcagtgagccaga

SEQ ID NO: 24065 - DNA, 58 bp, Homo sapiens
atccccgctgtttccctgaacctatttctgcagaggctcggggagacatcggggatga

SEQ ID NO: 24066 - DNA, 55 bp, Homo sapiens
tggcaggaagtaccatggagatacaggaggctctccatggtacttcctgcccctc

SEQ ID NO: 24067 - DNA, 55 bp, Homo sapiens; identical to SEQ ID NO: 24066

SEQ ID NO: 24068 - DNA, 60 bp, Homo sapiens
aggaagaaccaggctgttatgccatgtgggcatgtggcacaacagcctcgttcttcctgc

SEQ ID NO: 24069 - DNA, 56 bp, Homo sapiens
cagtcctctctctgccccagaccctacctggggagggtagagggagccaggctggc

SEQ ID NO: 24070 - DNA, 85 bp, Homo sapiens
tccggtagggttcgggccttccggatgcggcttgggcgctcttcggggacctccgtggcgcggaagacccgagcctgccgggggg

SEQ ID NO: 24071 - DNA, 57 bp, Homo sapiens
gatttccacaggtcggacgcctgtgaggttaagaaggaggtgacccctgtggaaatc

SEQ ID NO: 24072 - DNA, 81 bp, Homo sapiens
cccgcctgcgcggccctggcacctggcagcgggcgcgaaagaggacgagcccaggcactcgggcctgcggggtcctgggac

SEQ ID NO: 24073 - DNA, 54 bp, Homo sapiens
gaagccctggtccgggaggcggaggcggcggcgtctcccggcgcagggccggct

SEQ ID NO: 24074 - DNA, 56 bp, Homo sapiens
gccggccctgcgccgggagacgccgccgcctccgcctcccggaccagggcttccag

SEQ ID NO: 24075 - DNA, 78 bp, Homo sapiens
aagggatggggagcagtccgcggcgctgagagacccgggtccctgtcacctcgggccgcgggacctctccgccggcgc

SEQ ID NO: 24076 - DNA, 58 bp, Homo sapiens
gggcaccgtttgcctcagggggcctgcccatggcctccctggggcaaacgatgccagc

SEQ ID NO: 24077 - DNA, 71 bp, Homo sapiens
tgctggctgcccagctgctaggacagtttgcagagcagtggcgtgcggagcggcggcggaccacctccagg

SEQ ID NO: 24078 - DNA, 55 bp, Homo sapiens
ctgccgcccggagctctctgcgaagtctggacgcagaggctgcacggcggcagcg

SEQ ID NO: 24079 - DNA, 55 bp, Homo sapiens
aggagcagccttctctggggaattagaaactatctacagagaatgctgcccccac

SEQ ID NO: 24080 - DNA, 57 bp, Homo sapiens
tgaagtatcaaagcacagttgaggcaagagagcacatcaaactgtaggttgaagcca

SEQ ID NO: 24081 - DNA, 66 bp, Homo sapiens
tcagggagaaagaagggttattaacattaaaagaacttgcagtaattcctttttctcttcctcaga

SEQ ID NO: 24082 - DNA, 66 bp, Homo sapiens; identical to SEQ ID NO: 24081

SEQ ID NO: 24083 - DNA, 56 bp, Homo sapiens
cgcggggtccgccgcccgggggcgcccccagcgcgcggacggcgggaccctgcggc

SEQ ID NO: 24084 - DNA, 58 bp, Homo sapiens
cctctgcctgggagcccctccgcctggaacaaagcgaggggccccggcggtgggggca

SEQ ID NO: 24085 - DNA, 90 bp, Homo sapiens
ccctggtggcctctgctgaatgggttccttggtcaacagatagcagcccctctaggccagtggaggacccatggagaggccagcagggac

SEQ ID NO: 24086 - DNA, 59 bp, Homo sapiens
gcagaggagctggggccggcgccgggaattcaggccgcgttcgccgccgcttcctgctg

SEQ ID NO: 24087 - DNA, 65 bp, Homo sapiens
aagcctttgtgtccccttctccttcttgctgtgtgatctgcagaggaggggataaaaggctcatc

SEQ ID NO: 24088 - DNA, 61 bp, Homo sapiens
acacgttaagcagggagcaggtttacattagaactaaacctgctccctgcttaatgtgtgt

SEQ ID NO: 24089 - DNA, 77 bp, Homo sapiens
cgggagggggcgggctccggcgggaccccagcgctgcaggcggtgcggctgagccagggagccccccgcgccctgcg

SEQ ID NO: 24090 - DNA, 56 bp, Homo sapiens
tttgcactggactgggaatgagttttcacctgctcattcccagtccagtgcaagag

SEQ ID NO: 24091 - DNA, 56 bp, Homo sapiens; identical to SEQ ID NO: 24090

SEQ ID NO: 24092 - DNA, 56 bp, Homo sapiens
cttgcactggactgggaatgagcaggtgaaaactcattcccagtccagtgcaaaag

SEQ ID NO: 24093 - DNA, 66 bp, Homo sapiens
ccctgagccaagttctccactccacaaaatgaacttctccctcatgtgtagggcatggctcagact

SEQ ID NO: 24094 - DNA, 66 bp, Homo sapiens; identical to SEQ ID NO: 24093

SEQ ID NO: 24095 - DNA, 60 bp, Homo sapiens
aggcacttggagttctttgcccagactgtgttgtatgggcagagacctccaagtgccttc

SEQ ID NO: 24096 - DNA, 56 bp, Homo sapiens
gcacttggaggtctctgcccatacaacacagtctgggcaaagaactccaagtgcct

SEQ ID NO: 24097 - DNA, 60 bp, Homo sapiens
gagcctgcaggaggcagcccagccctgctagcattctgggagagctccgactgcagctgc

SEQ ID NO: 24098 - DNA, 57 bp, Homo sapiens
acgggctccattctcccatgtgccaaactcgtgctctcggggaatgcagagcccact

SEQ ID NO: 24099 - DNA, 67 bp, Homo sapiens
tctgagatctctatgaggaggcttcccccttcccctctaggaagactcctcatagagatctcagagt

SEQ ID NO: 24100 - DNA, 67 bp, Homo sapiens
tctgagatctctatgaggagtcttcctagaggggaagggggaagcctcctcatagagatctcagagt

SEQ ID NO: 24101 - DNA, 67 bp, Homo sapiens; identical to SEQ ID NO: 24100

SEQ ID NO: 24102 - DNA, 53 bp, Homo sapiens
cgggccccgagcgcgccgcagaccggatgcgggaagtgggctcggggccccgc

SEQ ID NO: 24103 - DNA, 65 bp, Homo sapiens
aagggcccactcgcccagagacgccgtggggtcacggctgcggcctcggcggggtgggctcgaca

SEQ ID NO: 24104 - DNA, 61 bp, Homo sapiens
gaggaccccccctgcctggccttcgagtctggagggaggccaggaggaggaggtcctgtga

SEQ ID NO: 24105 - DNA, 73 bp, Homo sapiens
tgaaaggttccctctgcagggacctggcctccagcctgctggggagggaccgggaccctgactggaggtcaga

SEQ ID NO: 24106 - DNA, 75 bp, Homo sapiens
gagcccggggacggggcacggggcccgcgaggcacgggtgctctctcggggttccggaagcctccctccccgccc

SEQ ID NO: 24107 - DNA, 65 bp, Homo sapiens
ggcgcgggatgcggggcggggcctggggttgccgcccgaggctcaccggcccgcgtccccgcagc

SEQ ID NO: 24108 - DNA, 71 bp, Homo sapiens
gtgaccctgagtagctgggattacaggtgccagcatatgcacctgtaatccctcctccctggggaaaatct

SEQ ID NO: 24109 - DNA, 65 bp, Homo sapiens
tggggcaggggaatgggtgaggctgaagctgagagtcagcggcctgccttctcccatgcctcagc

SEQ ID NO: 24110 - DNA, 78 bp, Homo sapiens
gctggtcggcggcagctctgctggtgcgggggcggcgagcccgggatcgagctaccgcggccgagcgcgccggccacc

SEQ ID NO: 24111 - DNA, 62 bp, Homo sapiens
ctgtccccgccctgccggctgccccaggccagtggagtggcagccccagaactgggaccacc

SEQ ID NO: 24112 - DNA, 64 bp, Homo sapiens
tggggggtgagcagcccctcggtgtccgcctatgcctggacctgaggtttgactgccccccacc

SEQ ID NO: 24113 - DNA, 64 bp, Homo sapiens
tcacaaccctgctgttcctgtcgcctggagagaagatgacaggaacagcaaggttgtgaggaca

SEQ ID NO: 24114 - DNA, 51 bp, Homo sapiens
acgcaggtgtcagatccgctcggcagtgctcggcgcgctggcccggccccc

SEQ ID NO: 24115 - DNA, 55 bp, Homo sapiens
actcagcaacccacacacggtctcagcagctgagaccgtgtgtgggttgcggtgc

SEQ ID NO: 24116 - DNA, 55 bp, Homo sapiens; identical to SEQ ID NO: 24115

SEQ ID NO: 24117 - DNA, 57 bp, Homo sapiens
gttacaagcccagtatgcattaggtatttgtcctaatgcatgctgggcttgtaacct

SEQ ID NO: 24118 - DNA, 60 bp, Homo sapiens
ccggcctggggggctgcgccgctcgccccgctcgcagccgcggccccacgcggccccgct

SEQ ID NO: 24119 - DNA, 59 bp, Homo sapiens
cccgggtccccgcgccgcgccgcgacctgcagaccccgccgccgcgctcgggcccgtct

SEQ ID NO: 24120 - DNA, 58 bp, Homo sapiens
ctaactgcccctgtgctgcacggactggggaggaacatgcagcatagggcagttagga

SEQ ID NO: 24121 - DNA, 57 bp, Homo sapiens
atctgtaaaaggagggggttgctcaggacccttgcacctccttccttttacagatga

SEQ ID NO: 24122 - DNA, 59 bp, Homo sapiens
aggttcggggcccggcgctgcgttggcgggttcgccgcggcgcctaagccccgacctcc

SEQ ID NO: 24123 - DNA, 54 bp, Homo sapiens
agccccgccggagcgcccgagagcccgcgcgtcccgggcgtccgtcggggtccg

SEQ ID NO: 24124 - DNA, 55 bp, Homo sapiens
tctcccacaaagttgcagtcaagtatccactagggctgaagttgtctgaaggctt

SEQ ID NO: 24125 - DNA, 72 bp, Homo sapiens
cgcggcggggcggccggccggcggccgccgggatgcggaggggcggcgacgggggccggaccctgccggggc

SEQ ID NO: 24126 - DNA, 78 bp, Homo sapiens
ttgtgggccagctggagttccgggtgggagtgggcttggcaggccccacattcggagcgaccggctggccctgccagc

SEQ ID NO: 24127 - DNA, 55 bp, Homo sapiens
gggcgcccggccggctgcggtccgtgcggaggctgagccggccgcgggcgcgacc

SEQ ID NO: 24128 - DNA, 59 bp, Homo sapiens
gggggctggggggctcgggagagttttctgctccctctcctgaacccacgcagccctgt

SEQ ID NO: 24129 - DNA, 86 bp, Homo sapiens
gcgcggtgggcgggagttggcggacggtccctggctgggttctggaggccctgggaccgcggaagaggcttcagacgctgcagcga

SEQ ID NO: 24130 - DNA, 59 bp, Homo sapiens
gagtgtctcggaagcctgtgaggggcggagacccggcccggggaggtggagaagctcgc

SEQ ID NO: 24131 - DNA, 65 bp, Homo sapiens
gcgcccccggcagcagcaccatgttgaatcgcgtccccgggctgagctgcctcagccggcggcgc

SEQ ID NO: 24132 - DNA, 89 bp, Homo sapiens
ccagccgccccagtcgtgtcccatggctgtccactttcctccccgtgtcacaggtgggctggccaggtgagagctgctggcaggtgggc

SEQ ID NO: 24133 - DNA, 75 bp, Homo sapiens
catgtcacttcctctctgatggcctcagtctcttctcagtctcctctgaggtaatcagagaggaagtgacatatc

SEQ ID NO: 24134 - DNA, 60 bp, Homo sapiens
ccatgcacctctaggccgcctgcgatcacagtcagccgggggtcgagggggtgccaccga

SEQ ID NO: 24135 - DNA, 65 bp, Homo sapiens
acgcgagggaccgggccccgagaagagcggtaacccgactggtcggagcccgcctctcgccgccc

SEQ ID NO: 24136 - DNA, 67 bp, Homo sapiens
aggcctctcctcggcctgctcctctgacctcccggtctccctctgcaggctgggggcagaggcctga

SEQ ID NO: 24137 - DNA, 54 bp, Homo sapiens
tgtgcgcgcggggccccggatccgggagcgggacccagggctccccgcgccgcc

SEQ ID NO: 24138 - DNA, 65 bp, Homo sapiens
tggcaacagagtgagaccctgtcttttttttctttttttgagacagtcttcctctgttacctagg

SEQ ID NO: 24139 - DNA, 71 bp, Homo sapiens
aggttgttctgggtggtctggagatttgtgcagcttgtacctgcacaaatctccggaccacttagtcttta

SEQ ID NO: 24140 - DNA, 79 bp, Homo sapiens
ccccgccccgcccgccgggggaggcgcgccggggctgggacagcgcgcgggcggccgcgggcgcgggggcggggggcgc

SEQ ID NO: 24141 - DNA, 53 bp, Homo sapiens
cctgatggcacaggcggtgtacaccatgtgtgtacaccgcctgtgtcattatt

SEQ ID NO: 24142 - DNA, 64 bp, Homo sapiens
ttgttgaactagggcaggatcctttctgtccagaagaaaagggacctgccctagttcagtagga

SEQ ID NO: 24143 - DNA, 60 bp, Homo sapiens
gtggggtgggagcagccacaatgggggctctgctgaccatctgcccttccaccctacagc

SEQ ID NO: 24144 - DNA, 61 bp, Homo sapiens
gagggcggaccaggcaggcggttggcccgggcggggccttcgctgctcgggccgcccccgc

SEQ ID NO: 24145 - DNA, 82 bp, Homo sapiens
ccggcgcggggtgggccgagccccccgcccggccagggccacgtggcccctacccggaagaaggcgcccacccccgcaaagg

SEQ ID NO: 24146 - DNA, 76 bp, Homo sapiens
gggcagtgtctacacctaggtcggggaggctgggtgcgcccttcttcggatccctgggtcggctggcgaaacccgc

SEQ ID NO: 24147 - DNA, 66 bp, Homo sapiens
cagctgctctctgtgctccagacgcatcatgggctttgtgagtcggagccaggagcgccggctgct

SEQ ID NO: 24148 - DNA, 61 bp, Homo sapiens
ttcctgtcctttttccagagggtttaatcttctgaccctggggcagggatgggcttgtctt

SEQ ID NO: 24149 - DNA, 59 bp, Homo sapiens
tgtggggagggcaccagcagggacctagcccccaactccccttgtgtcctcctcactcc

SEQ ID NO: 24150 - DNA, 64 bp, Homo sapiens
atggggtgtggggctgggaagaagaggaccctgacctttccctcttggcaccctccccccagga

SEQ ID NO: 24151 - DNA, 60 bp, Homo sapiens
ccgccggccgtcggggccgagccgcagccgagcggccgtgggcccgggcggcgggcggag

SEQ ID NO: 24152 - DNA, 61 bp, Homo sapiens
tgctgcaggctcataccatcctaactctgtaagcgacttttggtgataggagtctgtgatt

SEQ ID NO: 24153 - DNA, 64 bp, Homo sapiens
aaagcaaatgttgggtgaacggctgtttcctcttattcaagccatgcaccttactcttgctggt

SEQ ID NO: 24154 - DNA, 53 bp, Homo sapiens
ggagctgcagaggccatctggcgcggaaggcagaagccggccctcagcctccc

SEQ ID NO: 24155 - DNA, 58 bp, Homo sapiens
caaaagtagttgtggtttttgccattgaaagaatggcaaaaacgcaattactttagca

SEQ ID NO: 24156 - DNA, 79 bp, Homo sapiens
tgagtgcgcgggggcgcgcgcgcgcgggcccgggagaggctcccgagccaggcggtcttcggtcctcgcagcgcttcca

SEQ ID NO: 24157 - DNA, 59 bp, Homo sapiens
tctgctctggttatgtagaggcaggcatgccagtgcctttatgttgactggggcagtgg

SEQ ID NO: 24158 - DNA, 61 bp, Homo sapiens
agcgcccagtgccctggcccggagagtggaatgatccccgaggcccagggcgtcgtgcttc

SEQ ID NO: 24159 - DNA, 60 bp, Homo sapiens
tgccacacctcttctccctacctatacatagggcaaggtatgggagaaaaggtgtgcaga

SEQ ID NO: 24160 - DNA, 83 bp, Homo sapiens
agcggcggcggcggctctgggtcccggcagagggacagccgcgtcctgatgcgccacaaggtcccggagctccgagctgccgg

SEQ ID NO: 24161 - DNA, 60 bp, Homo sapiens
cctggacttaccatttgaaggtggtaggaaatggccaccttcaaatgggaagtctaggct

SEQ ID NO: 24162 - DNA, 98 bp, Homo sapiens
ctcttgttcacagccaaactctacttgtccttctgagtgtaattacgtacatgcagtagctcaggagacaagcaggtttaccctgtggatgagtctga

SEQ ID NO: 24163 - DNA, 59 bp, Homo sapiens
agtggccgcccgcgtccccgcaggacccgcctcctcggctccgcagagcggcacacagg

SEQ ID NO: 24164 - DNA, 59 bp, Homo sapiens
catgactctagtaggttgagaaataagttaatgcttgttaacctactagagtcactgtg

SEQ ID NO: 24165 - DNA, 88 bp, Homo sapiens
ccgcccggtgaggaagcccggggtggctgctccgccgtcggggccgcgccgccgagccccagccgccccgggccgcccccgcacgccg

SEQ ID NO: 24166 - DNA, 70 bp, Homo sapiens
cgcgcactcccgggctggagttcggcgaggccttgggactggcgctggagcccagcgtgggatgaccgtg

SEQ ID NO: 24167 - DNA, 63 bp, Homo sapiens
cggccgccccctcgcggtagggcagcagcagcttgctgaagctgctcccgggccggggccgcg

SEQ ID NO: 24168 - DNA, 56 bp, Homo sapiens
cgcagcccccgagggcgccccaggccaggagctgcgcgccgtcggcgggccgtgcc

SEQ ID NO: 24169 - DNA, 66 bp, Homo sapiens
ctgccccgggtgatgcagccgtcagtcgggggcccctgtgtgaagcggccgtcatccggggacccc

SEQ ID NO: 24170 - DNA, 94 bp, Homo sapiens
gagtttggttttgtttgggtttgttctaggtatggtcccagggatcccagatcaaaccaggcccctgggcctatcctagaaccaacctaagctc

SEQ ID NO: 24171 - DNA, 51 bp, Homo sapiens
atttcagttgaagcatggagaaactcttaagcagtgtttcctactctatgg

SEQ ID NO: 24172 - DNA, 86 bp, Homo sapiens
gtccagtttcttccttggcttcttaaaaagtctacttgtgcttgagtttagtaactttatcaaagagtcagggaatgggataggga

SEQ ID NO: 24173 - DNA, 100 bp, Homo sapiens; identical to SEQ ID NO: 16290

SEQ ID NO: 24174 - DNA, 59 bp, Homo sapiens
accgaggggtcttccaggaactccggcatctcggggatctgcgaagccccctccccaca

SEQ ID NO: 24175 - DNA, 61 bp, Homo sapiens
gcggggagagcccggcgctcggcgcagcgcggcgcggccaagctccgcgcctctcccgccc

SEQ ID NO: 24176 - DNA, 67 bp, Homo sapiens
gtgctggggtcacgtggccgcgggcgccggcggccaggctggaggcccgcgggcagtggagagacgc

SEQ ID NO: 24177 - DNA, 64 bp, Homo sapiens
gggaggggaggcgaggcggcggccgcggccctgacagctgtcaccgcccggtcactgcttcctt

SEQ ID NO: 24178 - DNA, 58 bp, Homo sapiens
aaggccagaagtcccacaggtgtgctttccagccctgctgtgggacctctggccttga

SEQ ID NO: 24179 - DNA, 59 bp, Homo sapiens
ccacccatactgcagcaaaagtcttgagggtctgaacttttgctgcagtgtggatggta

SEQ ID NO: 24180 - DNA, 75 bp, Homo sapiens
gggcgagcgtcccggctgtcaccctgtcctggtttccagactccggggcgggagggccggggcggtggggctggg

SEQ ID NO: 24181 - DNA, 64 bp, Homo sapiens
atggtctggcaaacaaaaatcaatcaatataatgtatttattgattttgtatgccagaccatcc

SEQ ID NO: 24182 - DNA, 52 bp, Homo sapiens
accgtgcccgtatatatatgtcattaaactaatgacactcagggcacagtgg

SEQ ID NO: 24183 - DNA, 83 bp, Homo sapiens
gtttgcagccgccacggccgctgctgcgctccggtgcagggcaggctggcgccgagcgaaccagggccgggaactgggagccg

SEQ ID NO: 24184 - DNA, 68 bp, Homo sapiens
aatgcaaaggtgtgtaggtcaacacacccaagggtgacaaactgctgacttacacacatttgcattgc

SEQ ID NO: 24185 - DNA, 61 bp, Homo sapiens
acacttgcctcctttaacggagttaaagctcctttagccccattaaaggagccaagtgtgg

SEQ ID NO: 24186 - DNA, 53 bp, Homo sapiens
tcggtgtgggggcggggcctgggtggggcctaggcgggcgcgatggcccggga

SEQ ID NO: 24187 - DNA, 85 bp, Homo sapiens
cggtgagcacagggggtgctgggggctgagacagctggcccacagctgggtccctctctgaggcatcctctgccccctccccagg

SEQ ID NO: 24188 - DNA, 67 bp, Homo sapiens
aatgtaagggtgttcggttgcgtgcatgtgcgtttttagcaacacatctaccaaccctgtgcatgac

SEQ ID NO: 24189 - DNA, 55 bp, Homo sapiens
cccgctctcccgaagctgttcgggcagtgtccgaacggcttcggaggggcgagaa

SEQ ID NO: 24190 - DNA, 55 bp, Homo sapiens; identical to SEQ ID NO: 24189

SEQ ID NO: 24191 - DNA, 75 bp, Homo sapiens
tggcccgcgccgtgctcggcggcctctcgcagaccgaccccagggccggcggcggcggcggcggcgactacggac

SEQ ID NO: 24192 - DNA, 64 bp, Homo sapiens
gctggccaggaacttttgggatggggacaccacctctcagccctccctctcttcctggccccag

SEQ ID NO: 24193 - DNA, 64 bp, Homo sapiens; identical to SEQ ID NO: 24192

SEQ ID NO: 24194 - DNA, 117 bp, Homo sapiens
tgtgtcccataattaaataatgaaatctgaaatcaccaataatgggacactaatgtgattaatgttgttgtgtcccattattggtgatttcagatttcatatatgattaaggacata

SEQ ID NO: 24195 - DNA, 50 bp, Homo sapiens
tgccagctgcagtgaccctgccacagaggcagggtcagtgcagaggtcgc

SEQ ID NO: 24196 - DNA, 55 bp, Homo sapiens
tggattggggcaggccaggacccctgctcagctgcggctctgccctgtccccagg

SEQ ID NO: 24197 - DNA, 62 bp, Homo sapiens
gcgggggaggaggagggcagtggccgccgggcaaggccgctgccccctgggcctatccgcct

SEQ ID NO: 24198 - DNA, 62 bp, Homo sapiens
acaattcaggactcttccttgaagatgagttggatatttttgggaagaattctgatattggt

SEQ ID NO: 24199 - DNA, 63 bp, Homo sapiens
tgtggaaggagcagttccgggtgaggtgagccagcggccccgcgccccggctgcgcgcccacc

SEQ ID NO: 24200 - DNA, 63 bp, Homo sapiens
ttgccggcgcctgacgcgcgcgggcacctgttcgccccgcccgcgcgggattcgccggctcgc

SEQ ID NO: 24201 - DNA, 73 bp, Homo sapiens
tctctcgccaggcgtcctcgtggaaggttcgtgtgctagttagatgggcgccaggggtcgccggcgggaagca

SEQ ID NO: 24202 - DNA, 59 bp, Homo sapiens
cccgcggcgtcgggcggtgcggatgtcgggctgggcggacgagcgcggcggcgagggcg

SEQ ID NO: 24203 - DNA, 58 bp, Homo sapiens
cggggtgggggcagttagtgcctggggggcgcggcccaactcaaccccttaccccagg

SEQ ID NO: 24204 - DNA, 53 bp, Homo sapiens
ggagctattgcggccgtgggtggtcgcgggcgatgcggggctgccagctcctc

SEQ ID NO: 24205 - DNA, 68 bp, Homo sapiens
tgggcttggggagggtgggctcgcccccggcagctgcccatggcgtgccgtccttccctgtgcccagg

(The sequence listing continues in the following parts.)

What is claimed is:

1. A method of treating colon cancer in a subject in need thereof, the method comprising:
   a) measuring in a biological sample obtained from a tissue of interest the expression profile of two or more isoforms of one or more miRNAs, wherein the miRNAs are selected from the group consisting of: SEQ ID NOs: 35717, 35716, 42515, 31086, 31085, 40501, 40502, 40500, 29783, 45821, 39673, 39671, 27278, 34326, 46315, 34324, 46025 and 32857 by deep sequencing, and;
   b) computing a difference in the expression profile of the two or more isoforms of one or more miRNAs as compared to the expression profile of the same isoforms in a reference sample by determining differential expression based on a log 2-change in expression of $\geq 0.58$ and $\leq -0.58$,
   c) administering to the subject an anticancer treatment selected from the group consisting of chemotherapy, radiation therapy, surgery, immunotherapy, RNA therapeutics or any combinations thereof.

2. The method of claim 1, wherein the reference sample represents a normal condition of the tissue.

3. The method of claim 1, wherein the tissue of interest is selected from the group consisting of blood and colon.

* * * * *